United States Patent 9,487,797 (GENOMIC PLANT SEQUENCES AND USES THEREOF) - sequence listing, part 105

SEQ ID NO: 96188 - DNA, 506 bp, Oryza sativa
tttgggaagccatatgccgcaatttatcctcctggtggagctttttcacatccgttcatgcccctagtaagcatttcattttgttcacctatctatttttcagaacattgcatttaactaaacatggaaggcaccatggatttgagtcaactatcacgctttggaattaaagcgatatccaatttgttaaaatgcttgcataaagccatgttaacatggaaacttctctatgagcagaactaacacgaatgatttctgccgttcgaagtattcatgatatgtagttggaacttggaaaacctatccttgcagacgaattatctctacatgaaaataaattcattcatatattgccattttttctgtagaaggaagctggattttttatttttttttcttctgtggaagtatatatgtatttttaaatcatttgttcaattgttcttttctttaatgtctttcttgcttcacttgtgtgaacgttctgtgctgaattgctaatcgtt

SEQ ID NO: 96189 - DNA, 649 bp, Oryza sativa
gttggtttatttgtggagctaagtttccaatttaaaagactgtatatatccggttgggtctctaggtcgggtaaaaaatacatttttctaaaataaaagaaagatagtatagatagaatggctggattgatgagaaaatgatctcaacagaacctagtagaaagatagtatggataaaatggctggattgatgagaaaatgatctcagcagaacctagtagagaagaaaaaggaagaaagaaagatggtgcctctggtaaccaataggcgaggatgatgacattgattagtgacatctgtgctgaagaaataagagcagtaatttttttttgagaccaaaataagagcagtaattgacaagctagtgtgagaagtggatggcagccatgtgtcttgcagttgcaggttggatttgatcaaatggaagtcaaacatatggcgatgcttacacacgacttttcaggcgatctgttgcatgcactcacactgccgaggagtaaatcaaacatcggactagttgcatttgttctataaacaaaatagtatagtagcaggggcgtatatatcgttggggcttgtcagggctcaagccccagctctgccgccaaatctatcatcccttgcaacatagtacagtactgatagccaa

SEQ ID NO: 96190 - DNA, 1172 bp, Oryza sativa
catggtgcgtcatttcaaagttgttttaataatataatagatagatagatagatagatattgcttgacagatgtgtcctatcttacaggtttggaatcctttttgttggttaagaaagcagtaatcgcctgttgcttgctgctcttatcagctgtcacagacaaaccctttggcttctcaccctcttaaccttgttcacttttatccagaccagataatatatgaggtgagtgtttttagatgaacacaatgggaaacactgcgtatgcagtcatggaattatttttatctcttagattgttaatggcatggtgtttccttttctggatgcttacacagaaacgaaatacaaatagggaagaaaaaaagaagaagaaagggatgaagtacccgatttcattgtgtttgaatcttctctgcactttccagtttcatcgtaccatttggccatttgagccctttaggctcgtgcttcgtgtccaactttgtagccaccgaattactgcaacttcgtggggattaatcgagattttgatgtgcactctagtctatcttggctggccatccaacttgcccttgtcctctacgggttgcaagtggccacgcacagttgcgttggtctacgcaccgtagatcacgccgctggtgtcgacgaatttaacttggttcaagatgtgccatgtgtgccgtgtgttgccttgtccgggaaagatggaaattctgaatgtgtggtttactagtacaaggattatttcatccaaagagggaaaaaaaatctgcgagttcccttcagtagaaaatgggtagcagaacattattgttttaagctgagttctagatgtgtggacagttttccatattcagatgaaattcagtccttaatttttcttctaagaaatggtttggttgagagggttagaaacagctgcaactgtgttttttctcctttctcaacgaaaggcaggattgctaccgtcggattgagaaggcaaataggtatttataatacagaaacgagtttacaggaggctataagtactaaaactcaggcctgtcgaaaaacacaggctgatgaatgatgattgaatgaacagagacaactgggccttaacccagtgcactcactactctgaataatgatcaaagcacttatttgcatgcatatctaccat

SEQ ID NO: 96191 - DNA, 1009 bp, Oryza sativa
  unsure (1)..(1009): unsure at all n locations
tagctcgctgctcttctttctttctttatctttttaaaatatatttatagctggcttatagcctgctagtgtacctgctctcacgtacactacagtatatactactctcacgtactgtactcctactagaagtactccactccgtactctgcacacgctcttcgtcatcatgcacatctaatcatcatcgtctcttcaattacacaatatacagcctctcgtttttctttcaaaaggatataggagtagcaaagtactataactcgtacgaataacatgaatcgcggtatttctttgtctaaccagaaaacataaataaacttttaagggcgcgcacatatatattaatattgacaaccagtagtagtagtttgaatcgcgacgagtttgcttagaatgatgtgcttttgttggaacttgctaaagaatctaggattggaaacgagctaccaaccaggaagatatgcatgtccctacgctgatcaaagatcacctatgcctaattctcacaggggctctaaaaggattaaatacactaacttttgggggttacaagtaaaactaattacgtgttgtcgaaaaaatcgtacctactcccttctccacaaaatgaatcatntctgatttacccccagaagctgattcacttgaggatagagggtgtgtatatatagtagacaatatttactatgggacataaaaaaacgtgtaattagctaagagacacagtaaaaacatgaatttgttgaaggacaccacagaaaatcggtaattagctgctggacacttgtcagattattttattatatccgaataaattggagagataaacacatgtataactatagttttaccttcaattttttttctttattcttccttatcttctctctcattctttctctctttctccctgctctttcttcaaccgaggacggctgcacagcgaggcgtgggccagtgtggcgcctcggacggggaggcgctgcgcggtcatgcgcaggggttg

SEQ ID NO: 96192 - DNA, 756 bp, Oryza sativa
accaactgccgccggccaattgccgccaccatcgtcgccacaccgctgccgccgtcgccaactgccgccaccctccagatccggtcgagaggcgcggatctggggggcaccgccgccgccgccaggcactggccgtccagccacgggaccaccgtgccgcctccgcgccctcggccagctccgtccccgccgccttcagccaccgccgccccagcgccgcgcgcccccgccgcctcgctgctggggtcagagctcggcctcccacgccggatccggacaggagggggccgaatccggccaccccgccgcctccacgcgcatcaccgccgccggcggcctatccccccgcaccagatccgcgcaggagagcgtgggagccagcaccgccgcctcgtcatcgtcgtcggcccggttgcccacctcttcaaccgtcgtcggcgccgccacctcgccgacaccatgcgccaccgttgatctcgacatcgcagccgccgaagtcgccgccccggagctaggtcggagtcgtgggctccaaacgccgcgaccttggggggggagaaggccacgccgccgccgtccttgcggccgcgcggtttccggcggcccgctcgggcggcggcgaggtggaaggagggcagtgggggtggtgtggcggcggcggctgggtcgcctcccgtgtcgcccctgccctaggagcgacgcgggggcaatggtgttacagcatcgacgcactaaatccagaatgaatcggtgtga

SEQ ID NO: 96193 - DNA, 660 bp, Oryza sativa
aaccccccccccccccaaaaaaaaaataaataaatctaggggttatggtccaccaaacacgcttgttgcacgagtattgctggtatgcttagaatttatcacataagtcatgttctataatctattctgacttgcatcctatttcgtcattgtatctttttgatgcgtgaatactctcacgtttcagcatcatagcttgttttgctgctacagctcatgcaatgattttaatgagttcagaatcggtacatgaattcacatgttttttttatgttttacccaaacgaaacgacatttatcagggggaagtactagcactaaaaaaacaattttgcccagacctacgttttatttttatcaggtgggcttaaaatattaatgcttgttaatacttgtataaataacgggaagcccgtagatttagccctgcctataaaaatcggcaccgtcgatcacaccaacttggtgggccttaggaggcaaagggacatcaattgggcctgcgacgatgaacgtggccaccaccaccacgacactagtgatgacgacaatgaccacgatcgtgaagacagcgatgtgacctccatagcttgaatccgccgtcaccggcctcaggagcatcaggtctgcaaccacagggtcttgggagtctagatccac

SEQ ID NO: 96194 - DNA, 874 bp, Oryza sativa
attgaaatgctagtatattcgcacgaccgtgaattgttagctgtaaatttcttttagtaatataagataacttctcacatagaactgcgattgagcactacttgtcatttttgtttcttgtaatgtagcgtacatcttagtgtaaaatcctacattagtatatctatatactagttctacaacctacgtcccaaataacttaatattttacccatctcacacataccaataatgatctctactattataaaaattgaagatgtttttaccgatattttggtacgtcatccgtgtattagtcggtttttaggttcgtttgcttttggaaatacatatccgtatttgagtcggtttttaacatcgttcacttttggtaatacaggtggaatcatataagaaatttgtttaaaaaaactcgcatgctaacttgagacgatcgaactcctaactgcagctcatgattatctaaaaatatatatatccaagcgaactccccgcagtgaatttcatcctaactaaaccatataacaataataagattaaaatagacttcacccgttgtaacacactagcattttttttctagtaataataataaaagaaatactcctaatctatcaaatcccaatgcaactattcctctttttatctactcctaatacaattattttttacttttataaactctgatataatgattcctccaaaaataaacttatttagggacaaaatggactgagctaaaaataaacttaatatgagacggaggaagtagttaacacttactaataatcatttaattgagaagaatataattaggctaatcttgtgataatgaccatataaacatacacatacacactcctattactat

SEQ ID NO: 96195 - DNA, 833 bp, Oryza sativa
caagtttagagaccggccatgtatttcactctttaatttatcctgagcagtaatcaaagacacacacaaaaaaaaaagcttaagagcggttagaaatccgacctcaagtggatatttatacaaccataagttacattcttaatctcataactgaaatatataacaaacaataaagaaaaactaaaacactagcttcaagcttttcctccttgcttcaaacttcaagacaaagcagggctacgtctttccgccaccctgcctcctctctgttcttgttgccatcacataagctcctatgtttagttaagagcaaagaaaagggacggaactagtccgactagacaccttgtcgttgctaagcaccccacctcaatgcgaatgagcacggcggtacccatgttatcgtcaccgcagagcaccacacccgtcgagctgccgtagcttaattatctcaccaaaaggattgcgcgcgccgttgagccgccatagcttatctcatcgaagaaccgccacaaccacgccatcgtcactacaaaccgcgacctctgtcaagccgccgtagcttatctcgccggagagccacccctgacctgcaccacctctgccactctccctactgccactactgcattcgacgtcgctcctaacgcacttctccttcctgacggcggcccaacgtggagcagaagggggaagaggggtggcgccgatcaaatggaggggaaaggaaggaagataagttatataagggtcactaacgggtgggccttacaggataactcagcaggttggaccaagtcaaaggccacgtcaaagaaattgtccttcaaaat

SEQ ID NO: 96196 - DNA, 570 bp, Oryza sativa
ttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatg

SEQ ID NO: 96197 - DNA, 624 bp, Oryza sativa
gacctctccaccgacgccggcctgcaccaccgccgccgcactcactctctcgaccgccgccatccatctccaccgccatctccaccgtcgccgtctcgacctctccgccgccatctccgccgccatccagaccctcctcgccgccgccctctatgccgccatctccgccctctccgccgccctcgccgcctccttctccaccgccgcctcctcactcactctatcgaccgccgccgtcctctccaccgacatctccaccgtcgccgcctcaacctctcctctgccctctccgccgccatctccgctgccctctctgccgccatctctgccgtcctctccaccgccctctccgccgccgcctccaccgccgccctcgccgccggtcgtcctctccgccgtccgtccatcgacttccccgacctccccgaccctgatctccccgacgccgggatccccgaccaccgccgaccgcctcgacctcttcgccactgcctctcgccgccgccaccaggatccaggacgactacggcctgcgccgccgtctccaagtacgccgcttctccaagtatgccgccaccctcccccattcctccttttttccgatggatgaattgcattgtttag

SEQ ID NO: 96198 - DNA, 536 bp, Oryza sativa
cgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaattaggccccgggaaggcccccccccccctttccgggggaaattattgggggggccccccaaaaaaaaagggggcccccccccccgggggaaaggcccccccctgtaccaagtagtgttttaattcttaaaatttgctcaacaactaaaatatggaatgg

SEQ ID NO: 96199 - DNA, 2361 bp, Oryza sativa
tgaatcgtgctaatggaaaacaagtgagtagaagataggaagagggagtatcgaacatatacctaaagtgtgtatttggtattgagggttagaaaccctttttcgtcgacatgcaaaacggagcacgcgattagcgcatggttacctgagtattagataacaaatatttattcatatggtctctaaggcaactcttgtatagaaaattttcatagatgatgcatcgtttcacaattcagaaagcatgttcgtggaaaactagagtgtgctctaaacctccgcttcccaacctttactcccccattttctatgcccgcgcttcccgactgtataacggtgtgtttcttttaaaatttttatactaataatatgaatatattttcaactattttcagctaatacttagtggcagacacacccactgggcagggtgggtcggtcgtcccaactacgatccatattgccccacacccccaaacctcatttataatcttgtttctagcacatcagttatccttatcagtccactattgaataatcctataaattaagtattttaagtaggacaaaaatatttatgaaaattggtgactgaatgattattatctctgtataagtagtaccattttcaatagtttggtaggattgatagaaataagcagtaccattttcaatagtattatttctacatataagtcatacttgcacattactttggtaggattgatagatccattataacctacctcttaacattttgttataatttttatccatatttacatatgttttgaaggactttgaaagtattttgatactttgataattgtatcatttatggcttagaaaatttcagcttaaaatacgacttatataaagagaaacaaagaagagatgctattaagcagcaatgcaaaccattttcaatattttagggttaaaatgaccaaaatatattttaaccccaatgatcaaataaaattgtccgggggggtgaaatggatttttttaaatatgaatattcccaaatgcctataaatttgtttttaataaataattttatgttcaatcattttcatccctaattcctagcatgagacatccagcgtctctcatcttcgtgactaacctactacctcttctatctaactctgacatttgttcgactattaattttcgtgtgtgttgttgtgcctgtgccatgaaccggcgattatggtttatgtgcgttgtgccattatctaattaggactagctagctctttactagataccggtccatctatattttaaagctatgtgaccagcgtccgtcactaggaacagagtttgccctggttatccatagggcaaggaacgtttacccacccttaaattttaacatggctaagacagttttaagattttcacatgtaaatatgtaattgtaaatttatactattatatttatgcactgttggagcctctcctactgtatttttcctaaaaaaaaggttttttttgggggggacggcaggacaacagacttttggagggccaaatggactgcaggggggcaacgttcctaactcagtgccaacgttttatgaggacagaagtgcatgaacagctttatgagggcattcattatcatttaacgtggtttagctacatctcataactctgtcagtttaaacatcgtttgctgctccctataagtgtgctacagccgcttcatgctctgatgacaatgctgccatctcaacttgttctactccatgattcgagcaaaaaaaaaaaaacttgctaggcatctctaggacttcctagtgcaaactcttgtttcctagaacacagaaacaaattgcagcaaaaaacattgcacacaactattgaagcaactagtaaatctatggtgttgacataccacatatatctaacaatgctctctctcagttagaaatcatagcatgagaacagcaacttcccaacatcatctactagcctacattgtcacgataattcaaatacattctagcttcaatatccggcagttccactttgtaagttgaatcgatatgaacatgtaaattagaactttccatcatctcctgtaaccctatgttcatatcgattcatcatacacttacctagctaggcttctctcttaatttcagacaagcaggcaaatatgtatgttaggactgggatgcattatgaaagattaggtataggaagtacggacacctcgcaccaaataagttgttcaagcaagttctgatgccacgccacgcaacattattatacctccaagtagtgataggataatttcattctttgtcctaacatattctcaaagtacagctagtgtttcatttacca

SEQ ID NO: 96200 - DNA, 525 bp, Oryza sativa
gtgggaggattcatactatggttattaatattttattggctttgcttgtgggtttgtaatatgcaagcaagtcataatcatgcaaccaataagtaatactacctccgtccaaaaataagtttagttttgcacggttcatatttaacgtttgaccgtttgtcttatttgaaaaaaaaattatgattagtatttttattgttattagatgatagaacctgaatagtactttacgtgtgactttttttaataaaaaattcataaatttttcaaataagacggacggtcaaacgttggatacggatacctatggctgcacttactttgggatggaggtagtaagtaataacgaagtcctgcaatggatattgatggctatgcatcgctctagtaggtctaatttgaaacaggtataggatgtttcctgttcatttgatggcacatatccccaatagaagctaaaattatttttggaacaaaacctgatcactgattgtaatagcaaaggaaataaaccctatgctgctg

SEQ ID NO: 96201 - DNA, 847 bp, Oryza sativa
attcctgcagccttaaatatactattagttattcctcgtaaacaagcgatttattaatatttacatttctcgatgcccatgtagccaatcttgtgtggaagaatggagagtcacgcattaaatccgagaaagtcattaagaagataggttgttggattgaaatatgcctatcaaaaataaatttttcagatttggaaatatgactatcaaaattagatgcagggattataagttaataattactccctccgtcccaaaatataaaaatctagtactggataggatatttcctagtacaacgaatctggtattaggaaatgtcccatcatattataggttcttatattttgggatggagggagtagataatttggttgtgttctagtatcaagttttcaacctctgtttttttttcacgtgtatgcttcccgaactgctaaatggtgtgtatatttttaaaaatccataagaaagttgctgtaaaaaaatcatattaatctattttttaaaaataacatacttatttaatcatatgttaataatcgatcccgttttccatacgcaggttctcaaactcttctaccgaaaaagccttagtacatattgtacacttcgataattcttgctcaccactatatgtatatatatgtgactgttagaaacttagaataattagtgacgccacacaggtagttgccgtagtggagcggatgtgaattgtattatccgtgcggatgaaaaagtaagcattgaagcaagatgatggccagcagaaccggttggtttatttgccacgtaggacgatctgtctgacaccacttgcaagtgtgtgtgacgtgcagccttc

SEQ ID NO: 96202 - DNA, 816 bp, Oryza sativa
cgtgcgtcgccgccgcctctactccccgtcccatccagatttgagccgccgccgccgtcttctccatgttgccgacctccccaaaaccgtcgacgccgacctccgggccaagtcgccgacgccgccgacctcctccccaagttgccgacgccgccgccctcgtccccaagccgccgacaccgacctcctacccaagtcaccgacgccgtcgacctcctccccatgttgccgactccaccgccctcatccccaagccgcctcctcgccgacctccgccgccggcctccccgaccacctccccaagccgccggccgaccatctcctccggtaagccattttttacttttttatattttgcatgttgtgatatatgcatgttgtgatgatttttgatgtggattagtatatgatgtggtgatttgtgagatgagatgagataagatgttgatatatgcagggatgatgatttgtgatgaggattagtatatgatgtggtgatttgtgagatgagatgagatgatatgttgatatatgcacgtagggatgatgatttgtgatgtggatttgtatatgatgtggtgatgtgcatatagatgagatgaatgcatagatgagatgatatgttgatttgtgatgttgatttctggttatgtgcatatagtgagtttcgcattttagggtatttgtgatgttaattagatggactttgtgaattaaatggaatttatgatgttaatgctgcttttagtatatgatgtggtaatttgatttaatttgatgtttcgcctaattttccatctaatgtcccgtgagggg

SEQ ID NO: 96203 - DNA, 631 bp, Oryza sativa
tgataggacctacactagagtaaagcaaacctcttagacctttgtgtgacgatgaatttcatgtaaacaagtggtaacattttacaagacttctaaaagttataaatacggaattcgattagacaataaactccaaaaattacatgtttgatttttagaggtcccaaagaatatgaaaagaagtcataacaggaaaaaagaacagaaataggggacgacaagtaaagggtgatggttggcgtaacctttaaaaactataaaattgaatcctgctaatggtaatgtttgattttttaaaattctaaaataataggatgactatataaaaaagcttaaataaaaccatacgtaaaaaataaataattttgtatgtgctagctgcacaattacaccgcgccacctgctagttactttgaaaatttcgttttcaccaggggtagtagcatgaagcatacgatatttggggcaagtgtgttcttacccctgttttgttttacaattgtgattttaccttttttttagggtttgtgattttgaaataaagcaccagtttacccttcctttggatgactgtttggtgaggtttggttgagtgaactaaaaacaatgatcaatataataagaaaacatg

SEQ ID NO: 96204 - DNA, 635 bp, Oryza sativa
atataaaaaaaaagaatagaaatgttggagctgtgctgaactagtcgtcgtcttcgtcgggctagctagcgtatataagagtcgacgagggcgagcgaattcattccatcatccgcaccaacaccattagttatattacccatgaacacactcaaattctctccttatcaacttcggttcatcatcatgattgtctccattttcagatactttacatttcttcgatgctttttttcccctgatgatgcctggctgtttctagatgatgcaattcttgttccaaatcctagcttataagcataagcgttgtaaacatttcttgcctcttccactatatcgaactccattccaatgtatggaacaattggtggggaacaaacaacatccttttctttttcatcattttcagatgcatcttcatccaattgttcatcaatttcaacagtcacagcagccacatctgtgttgtcaacactttccacatccacaacctagtacacaaaaaagtttcactaagttacatactgtgttttcaaagcaaaatatcccccctacatttgtgatatttcaaatccaaggacaactcaccaagtcagtttcatgcccagaggatttggataatagcacatcaagga

SEQ ID NO: 96205 - DNA, 1710 bp, Oryza sativa
atctctcatgttgacccaaaaatactatcatctcacttttatatacttgtcaagctgcttggtgatgagaatctctgaaagattaccccgattgatcaagtttttatcatctgttcatcttctgcacatggtaaaccattccttccttgtttgtacatgtattctgaatacttcattgagttcattctggtgtagtaggaccgaacatttaactttggcagagccagcagcaggctttggtcactgaagtctgaaggtggctcacatgcaagaccgttggtgagcaatgggaatctgggtctgacgaatactcgttcatattaaacgacaagtcttgacgaaatgaagccagtctgcctgccagtgagctcaacatgtctgattttagcttcccttttcttttttttcccttaaaaatggcagatttagagtaacccttttcatcatcctttcttatcagcatcctatttttggggaggcgcatagttcatggaggtactcccaacaaggctcgctgtgctcaggcttatccgaatgatgcatttggctacgcccgccttcatggtgagaaaaaaatgttttcctttcctcttgcctttcacgtgctttgtttcgtccccccaaagaaatctctctatcggcagacaaacaactgaagcctgcattaaaaagagcaaaaatcattagccaaaactattcttcctaggtgcctttttccaaaatgaatttagtctagatcccatgcaagtactgatctgtaggtcctgggcagtttaatgaaggcgttctggctctttttttttctttttacctgccctctattgggcttagatgtttgatgtttcgttacataagatatagtgggtaagaaatggaatccgctcttcatgaaacacaaactgcaatagcaaataggagacggatttttttgtcttgcactcttacctgattcttgattcttccatgtagaatgcgcggcataatctgattagggataattactactcccattgcttgctttcctcgacacactcttcaaagagaacaaagcatttttaccgtaaagctgcacttttgcatcattttgcctgcattcttatgtccgtcccatgttatgtaatcaccaatcagacccacaaaagattctcctttctactagttgtccagaaatgacgcagtcctcaactagttcttgctcttttctcgacgtcatccgatggccatggaggtggcggagctgctgaatgcctgaaccggatcaggccatgtccggatttagtaaaaccgaacagtgagcctaccattttcatacagaagcgagtaaaacgacccaactaacacgcctacctgtcagtgggccccaccccgcactggacccacctatcattaccaaaccttttcgcccaaaaaaaaagaaagaaaaacctgcgtcgaggctggctggcgctcgtcgctgctactacaggccaagccacccacccacgccccgacgccattaatttccccaaagcacaaatcacaacacgcggcacgaaaactttgcactgaaatcgattcgagaaaacaataaatctaaacagaaaaaacctattgattttttttcttcgtgaaaaaatatagagccaaaaaaaaaaaaaaactcatttccgctcggctcgggtcacctccccacatcacccaacacgagctcaccaccaccaccacctcact

SEQ ID NO: 96206 - DNA, 692 bp, Oryza sativa
atggtggttgatgagatggattggtgaggcagagcttcggggttgtggggttatggttgttgatgatcgatgatggacaaggaagggattggggtcctatttatagggctagaaggagtggatgagttcggacccgtcattgccatggatgagctccatctttggatagggttggggcggcaaaggctgtgagagggcggccaagatcaatttgagtggcgggaggccacgtttgaatacttaccggcgaaggattggcttgactgcatgcgaattcggctggcgatgtgttggcgccaatccgggcacgacgcgcggcggcggcgagggtgaaaatggctgactcgggggtgaatggtttgaattgtgagaggggataccaccgtctatcttcaatccaaccgcgcggcaagaattggcgcaattcacctcgggtagaagcaaaatcgcattcggcggcggctttggacgagcgcgcacggcgtcgagcggcgatttcttgcggcggtcgtcgtcccggctttgtcgttgtcaagattggtgcggcgatgatggtctgagggcgtcgaacggctagcggcgcgccaaggcgatcgagcacgcgcgatcgatcccgagaccgacgcgcggcggctcggcgtgcggcgaagtcggacgccagagagcgcgcacaaaggggaggaaggagcaaa

SEQ ID NO: 96207 - DNA, 898 bp, Oryza sativa
acgtgaactttcgatgctatataaccaattttgcgtaattttaaatggcaaataaagaattctctctctctcaaaaaaggaaaattgtcggtggcattgccgggacgcatacaccaatctacttactttaccacgtatgtttatcttctattcatatttggaatattttcagtggcgttacctttacgcatagtgtaacaacaactttatacaaggggactttatatatgagtattattcataaactactttttttgtgaaacataaattgatcgatataaatgtgtcttttgtgtgaagaaagtaacatcatatcatttctaacaaaaccattcgtatgacgtgataaaaatagataaacaaatcgcattatttgagataaaaatagttaatacaaatcgcattatttgagagacgcattgtaagttggcaacaccatggttacctcacggttactgcaataatctcgtacagtaaccatctctattttttaaaacctcacggcttttctcgataaccatataggttttgttaagtaaccacgataccatcatgtcagtaactcctaccaaggctacctcacaattaccgcaatgatctcgtacagcaaacatctcagtttttttaaacctcacggctaaccaccctaccaaaatggtgaggaaaccctatctaccgctgcatggttttgagtctgtaacccctaccaaaatggtggcctggtgggggaaacctttgctacagctgcatgatttgaactttgaagtggcgcgtctttacgtatagccgcagccagatttcagatgggattttcttggatgccttctgtggtcaaggttctgactataggcagtatatatggccaatttgggggatccacactagttatagagcggcc

SEQ ID NO: 96208 - DNA, 741 bp, Oryza sativa
tggaaaggaggaactaacagtcaagctgtcaagagctaagggctcaaggcaagtgactatgaggtaaatagcgattgatcgcacttttttaggactatagcacagcaactatgccacatatgccccctccacataagaacccaaacggccaaactatcccctcaaatgtagatagcatggcccactgcacagtgaccaaagatcatctctcatgaaatcgcgtggtggcccatctgaccaaaatctagccaacccgcgttctgtccgaaattaagcacgcgggcccaaaggcgtatcaggcccacgcaagtcacgcgacgagtatacaacgtaaaccgttgatcgagcgatcagccgatcacgaccgttgaatcgaaggaggcagcaataacgtacaacaacgtaccggaccaggaagcagactgcagtttttgtaagctcgtcccaaaatatcatcatttttagggttttacaggtgattaggaaaattgattgagtaaattaaagcctctcatcgttccctttacaactgataagccatataaaaatacacgaaatatcaaaaaatagtttacaagtaaaatttttatacctaggatcttaattatttaaaaggtaatactgaaaaataaactataattaaaaaaaatcttaaattaactttaaagtttaaattttggttgtgactcataatgtaacgagcaattaatgatgaagcaataaaatggttgtgattatagg

SEQ ID NO: 96209 - DNA, 545 bp, Oryza sativa
atgaagaagaatacaaccataatcttcatgtaagacctcacattgaccttgacgatgatccccaagagcctgtggcatatgctcgttcagatcatacggaaggcataaccttgtaaccgatgcatttgtacttatctattgtaatgaatgaagtattttgttttattgttttattgcaaagacttgatatgtgtagtcattaatatggctaattttgttttattacaaatgaccaaaagaaaagttgtagatcttgatgagaggatcaactttgttgttgaccatatttccatttgaaatcatttagtatccaaaaatgtattatagctaataaaatgaattattacacatcagctatatattttgcactcacagatacaaaaacttcaaatgaaagatggaaaatgagtcatcggtgacgggccttagtttatgtccgatagagaataatctatctcaatcgggctttgccgtagggcctgtcacagatgactcatctgtgacgggctccatactaatgcccgattgaaatgacatttatgccc

SEQ ID NO: 96210 - DNA, 663 bp, Oryza sativa
cacttcctaattcttgctctccatgcttcacccaacatgtatagccctccatgaatcctcgttgtatcatatgaccatgtacgtcctctccgctatcaaacatattctcattcttgcaatctgcacatggacaacacatgtaatcactgtttcttcttttccgatcctcctccgcggcgttcataaaatttattatgccctttctgtactccgtagaatgacgtttcaaatttttcgcatacatccaacttcgatcaattgctacaaaataaaaaaaacaaattacatgcacatcttataagatcagtattgcaaaagtaagacgtgatgaatttgctcaattaatgattaatattactcacttgattgatccattttgatcacttttgggaattttctgttttccttggaaaaaagacaaaaaatcgccccatacagcctcccaccaaaatagtaaacagtgggatacagctacactaggtggtggggggtatttatactgtgcaacaaatatctgtaacggccctaaaacaatcaaccgtgatgggcatacaagtaatctctatcgggccttaagaaaagcccgtcaaaaaagagtgtcatctgtgacgggcattaaacttatctcaatcgggcctctagttggagcccgtcacggatgac

SEQ ID NO: 96211 - DNA, 631 bp, Oryza sativa
ctcaatcgggcacagcgtccgtcacaggctagaagtcaccgatgtgaagagttatctcaatcgggcaaacggccgtcacggatgaatctatgtcaatcgggccctaagtaaagcccgtcaccgatagctttgacccagacgaccagtcaaactatagcccgccacagatgacctatctcaatcgggccacaattagagcctgtcacagatgatactcatctcaatcgggcctaaactagagtccgtcacagataactgctgacctcaatcgggcctaaactagagcccgtcacagatgactataatccacaaaaaaaataaattttgttttttggctagcctcaggcctttgctagccatgcccgctgcataaataacagaaacaaacacagatatccaatatccccagctccccagcatcacccattcatatacatatgcattcacatacacagacatcaatatatttcacacaagttgtaccatgttaatccgattaaacgatcttgtaaccgagttaatccgattgttattaccagattgagttgggcgacaatacttacaaggagtagcacttaaggaggcttgtgtccactgctcggagcctgtagaggtcgaatagatccttgaa

SEQ ID NO: 96212 - DNA, 691 bp, Oryza sativa
tgattatttgtattattgtttttagtcaattctataatttatggactttaaatttattttttcgatagaccatattttctttcttacaacgaatttacttctaatgttgtaacaatttacttgcattttatgctaagttacttttatgatttatgtaaattattatttctactacagagagttagaagtacttctattacataactaagttacttctgttacatataattacttctactacataaacttatttctattgcatagctaagttacttctattgtatagctaagttacttctgcaatttaaatacattacttttaaattaataaaatatttgaatatatatcaaatatggatcttgcattgtcacatattttatgtagagtataatgatgcaaatagatcttaaaaataatacaaatatataagttattaaagagcttaaatctaaaagtaatttatgaatatgacaaaagtaacttacatatatattaaaagtaacttacatatataataaaagtaatttatatatatatatatatatatatatatatatatatatatatatatataagaatataattatgtaagatcttgttgtaaagatttaattgcaacgaacacaacggtataatcggattataaatcggataagtattttaagagatacttctctaaaaagaaaaaaa

SEQ ID NO: 96213 - DNA, 638 bp, Oryza sativa
cctgcagccagggttgtgtttcacgccaaaattaaaagtttggttgaaattaaaaagatgtgacggaaaagttgaaagtttatatgtgtagtaaagttttgatgggtttgtgtgtaggaaagttttgatgggacttcttacacacaaacttccaactttttcatcatatcgtttcattttcaaccaaactttcaatttcggcattaactaaacacactctcaactccacattttctttagaattagactgacctccacattttcttttcacggaaaatatacacgatgctaaaattatttgatttatagaagtatatcttttattttgttttttattagacttaatagtaaatgaaaaaggaaatatgtgtgcccaattgtcatacttataaaacccaataaactcaagaaaatgttgaccattcagtttttaacaattttgttaataaaaatttgaattttcatctattgtttctaccaaaattgtatttttaaaatatttgaattatgttacatctgtcaccaaatgtcttgttttagtttttttctcaaattcaagcctaacattttttttaaaaaaaaaaatctagcaccaagttttgaaagtaaaagaaaccatgttcaaatcgaacaaagct

SEQ ID NO: 96214 - DNA, 835 bp, Oryza sativa
atataaaacggcacttgcacggcacatttgacgtgtaacgataccgatttgtactgcttggacagttggaacaatcacccaaccattcgttcatgtgcgaaccaaccgtttgcttgcttcaactccacaatgccctttgtgtgcctacacggcttccgtgctacaaaactctccactcggcagctgctttttttcatgcagttacagcacgcaaagagttgctttcagtccaggggattggcaacaaggaacaccaattgcatgtggtgcttgctgctgccacaggcatgctttgccttagagcaagtttaatagtataggccattactagctccaaataatctatagccgatgtaatagccaattcatacaatagttgcttactatactattaatatctgatcccacctgtcatacacacattacgtcttggagtccgtgctgcagctggctatagatctgtagcccgctgctcttctctctcttcctttatttctttaaaatatgtttatagctggtttatagcctgctattgtacctgctcttaaggcaatgttcagaaatcgatattagtgtatgatcgccgttaacttgatcattatgtggtgaggtgatcaattgggttccagtttagttgatgttgagaagtggcaattcggatttcaatggaaaatcaagaagagcagatctatcgtcggtgcccagaaatggacaaattgaggccacgttcatcctccctagtgcatagtaggacacaagatccaaaatattttctccaaagcatgttcttcattaatccgtataactagaatattaagtgtgtactaatatatat

SEQ ID NO: 96215 - DNA, 568 bp, Oryza sativa
tgaccattgctacagttaatttgaaataggaaaggaaaacatctgcaaatacatgaaaaagaatgttcttgtacaccactctaactaacatgctttactgaagatcctttgcataagtattgcatcatataagatgggtacagaatacacacccgcttagttctaatttgattcatcactcagtcatttcatgacagctgatgaagagcaatctacccaccgagcaatttagaacaactggaagggtagcagaaattaaacaattcttagtcaggcaatcaatggccttgcagttgcaagggctgagaattttgttagtgcaagcttaagtcgcccattttcagatttgatataaaattagctgtccctgtcacctcgcaacaacataaatttgcgaaagagcaaacaaaatctcagttaactgaaacactctctacaccaaaccaatacgaacattacaggagcagacacagctaatcatcataatggtcagacatttgtgccacattgcaactgaaatacacacacacagcagtaaacctgcaaaggaggagccactgaccgcgtc

SEQ ID NO: 96216 - DNA, 597 bp, Oryza sativa
ttagaagagaaagcaacggtgtagctcacgctttagctaatttggccttacgaaccaaacattgttctgttttagcgtatgggatgcccctgcttgtattatgaggagctattgaaccgtgaatctcaacaagttgttgagtaatcaataaagctttctcttcctcacaaaaaataaaaaggagtatgaaagaacttccaaactgccgctaagtagtagtactactaaagagcctaacgtattattgtcaagtcaaaatgcaaacgaatatacctgcctgacttcaagtgttgcaactgagaaaaatattttctacatctataggtgccataccacctagttcatgtgatttaaatggttatataaaagatttgtccttgcaactgcccttgctgcatgaacgcgagcccgggcttgatgccagcgatggcagttcacaggccgagagagagagaaaaagaaaaactgaaacggatacgaagaattgcgccgggcggccggggggcgaaacaatcccgcgatcgaggacaggagcacagcgcgcggccatgcatccactgatccacatgccccaaaccataggatcgcgccggcttt

SEQ ID NO: 96217 - DNA, 698 bp, Oryza sativa
tttgtgtcggccactgaaacccaatgtctccttaaaacaagatacagtggcctttgtactgtgattgtatacatgttagcgtgtgattactaaaatataagattgtagcttgtggttggttaactatgatactgaactgtcagaaaaaaaacaggttttatgcataagtttgagactttgggtctggtgaatcagtccagtggtgtgtacggatctattgtaatctacaagttttatggccttaattgtaagattattatatcttgctgttgtcactcaatgactttatgatcatcatattattctgcaaaaaagtactatctttgcttcagttatgtgtcttcgtttcttgatgctatgttaagttgcttcgaagtagtgttgtagaaatttttgctctgaaaaaattgatacaacacaaagcatataagaggccatttgcttcataatttgcttcatacatctaattgttctcctgacaaacgggtttatatatgtttcttctctttactttatgctgtcgcacatgcatcctataatacagataagagataattaaatcttactactacaatataatttgagagctaatttgctctgaactgtactccaaatctatgcaaaattctggaatttccccacatatctgacctgcttattaccacctgataaaaatggctagctgccacatgttcaga

SEQ ID NO: 96218 - DNA, 559 bp, Oryza sativa
  unsure (1)..(559): unsure at all n locations
tggcttaggacgagctgggacccagggtcgggttgccagttcggtctgaatcatcataggccttgggttaaggcaggttcgtgtgggttcacggccttgattaataacattgtttagttctaggatcgtgtttacaactagctttggagncaactaaattcctttaaatgctgtttactgcaactctaaccccttatgttataattcccttgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaattgtatcaacttttggtgtaccttgcctcctgggacaaggaataatacacgcacgtcaggaacgcctgttgggtgatttccggtcgtgaca

SEQ ID NO: 96219 - DNA, 550 bp, Oryza sativa
aattaatcgtcaacgccagaaacagaaaggcgcagccgcaaacaagtccgaggagaaaaaaaggaggaagttatcgtacgcatgcaggcaaacgcggcaaatttctcatgtgatctcacgtacttgatcatgttgcatataatcacatcatatttgtcgctaatttgatctggttatataatgcgagtacacgtacacacggcgtactacgtgttaccagaaatgctcctgcatgcccaaaccaaaaactcacgtatatacaaatacaccctgtatggacaaacaggtcaaggcttccgttgacctggttaattacgcttaagaatccacttaattagctaataatgacatgcacccgcaggtactctccatatcgtgtgttcagctcagcgtttacgattccgacattaccttccgtttcggtcaggcggaatttggaatttcgtgaaatccgtagaaaaccgtaaattccgacaaattttataaatcaaattactgagtttgccgacaagttctcgaaactggtcgattttggcgaaatcttgatcga

SEQ ID NO: 96220 - DNA, 571 bp, Oryza sativa
acccatcggtcggacgaaattacaagtttaatacactgtcgaacaaccgtggtttgacagggaacctgtccaacttacctcattaactgttgcagtttgacgggttagtggtcaaaaaaaaaaagtacgtgctacagtactcggtagggacctatcgaacaagggaacaggtagtgttcgataggtgtgatgctacagtgtttttcctttcataaaaattattttatcacctgtcgaactgtggttattcgataggtgccatgtcgaaccacggttgttcgataggatgctaaacttgcgattttgtctgactgatatatatttgtgcgattttccattaaaatcgtattattttcaaaaaaattccccccaaccccacccccataaaaaatgatattattttaaccgatttttttaatttggcggtatttgttcacatttcaccaaattttgttaaaaaaataattttggaatattgtcaccttcgatacaaatggagaaaaaaacgaaatattaaaccctagttctaggtccggcctatttggggatcctctagagtcgacctgcaggc

SEQ ID NO: 96221 - DNA, 829 bp, Oryza sativa
cggatccctgcacttaatctaattcacggaagtcatccctctgctctagacatagcagagctagccatggctgagctcgatctggagctcgccggcggcaaacggtggctcgcttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgcgcatggaagtcgattacaacgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagattggcgccggtgaagaaaaggatgtgttctccgtgttcttgatgtttccggctggggttcttgaggcgttttgaagaggaggttgaggcaatgacaatggcgcagcagctttctctgaggtgaatgagaatggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacg

SEQ ID NO: 96222 - DNA, 718 bp, Oryza sativa
  unsure (1)..(718): unsure at all n locations
gatgcgccnaatgaagaacttcgcngcaggccgcgcggncgactctagaggatcccccgatcgatcgtcttgtatgtttttttacatacttatatcatcattaccaattttttttaatatagtatctatttaattgttatggaaacagcgggctgctatgattacacgtacgctagcagggtgtatagaacaatagtcagacatcacatcccctaacacatcgccactagaaatttttgttgcggagcagagaaagaagtagcagactgcgactgatgccgtggtatatgtcactcggtgcgtaagctaactagctttttcccgatggaaaaatggaagctgctactagtatactccctccgtcctaaaatataataatttttagccttcagaatttatcataaaatatagcaacttcttcaccaacattctcttcctaaccaatcataaccctccaccattcactttttccacctacctcccatactcatccaatcgcaaccctcaaccactcacttctatctactttcttagtaaccgttttcaactctaaaacttattatattttgggacggatggagtactctttatgtcccataaaaaccaactaatactgatgtgacacatcataatactattaatatttattatatctaaattcgtaatattaggatatatcacattcggtattagattggtttttatgggatggaacgag

SEQ ID NO: 96223 - DNA, 503 bp, Oryza sativa
cggcccttagatgctatccatctgccgccggcactctagaggatcccccggggcggtgtcgagggtgatctcgtcgtgcctcctcgacgccgtcatccgctcgctgcgacgccgcttcttctaccagcgctccctgttgctgccggcgccgaggcctctcccctcctccctcgcactcctcgccaaggtctccgtcgccctcgcgatccaccagtgccatcgtccttgcatgctgctcccgccacctccttgccggtgagtgcaggtgggtcctcctccaccaccgcagaagaagaagaagccggcggtctcagtgcctctgtcaccgcaacaccggcgacaacctgctctagaacctctacctcctctctttcgccatcaacttcaagatgaagttgctgaagcgcagttcctggagatggtcaccgccgacttccggccggacctcaccatcttctgcgtccgtgccacggccttccaatagagtttctaaataaatggca

SEQ ID NO: 96224 - DNA, 724 bp, Oryza sativa
tggctttagaggtttaggtccagaacttgcctcatctagctagtgatgtataaaatgagtattttagttaactaatctaatcttagttcataattttagagtttatattattttactacacattttataattagggatgttctatgttagttacttaacacaccaacctagaaatgtatatgagttaagtttgataagttttggtggaaggggatggactatgcattcactggtctaacaagttttatttgggtttcattatagctagagtgtatttctatatacatttatatatatacatattgctcaatcaatactatgtgattagtacctatcctataaatttaaagtttagagctataacctgtacagaaggttccatattttattttaatatgttgaagcccactgtttgctggttctatagatatttggttcacttcatttagactaaagatgaattttctacaaattttacaatttaaggttgctctatgttggttattacttacataagtatttagaggcttttatcatacagtaagtatataattttattttataatttggaagtatatgttttggtgattctacagaacttgggtttactcaaaaaggatctaagatgaattttatatgaacttctaaagttcagcttatataaaactagttatttttaaagataatagttttagaggcatttgatgcagaatgtgtagatgtt

SEQ ID NO: 96225 - DNA, 526 bp, Oryza sativa
tgaatcaccactaggatgccctaactattataggtttaaatgcaattagagtatgctagagttctttgaaacaaatttctatcattatgttgacataccaacatcccaaactgtaagatcaatatgactctattaacactagtaaatgataggaagttggaggtttgtcccatcacctcatgtctatttttccctttttattcaaagaacttattggatttgtgccttatggcaaaagctggagatgcaaatcatatccattatcttaaaaaataaacttaagaatttacaaaggaacgtttgttactttgatttagtattggatatggtccaagtgagtggttagcaaaaatatcatagagggcaacccatggatcggatgtccacctaatatttcatgtatcttagcgaagaactactattgcctattgaaactagcatgtgtgttgttcgtggttccttctccagtagtttggttgatgtacatattattgctaatatttataaaagatatccatgtattaat

SEQ ID NO: 96226 - DNA, 1480 bp, Oryza sativa
  unsure (1)..(1480): unsure at all n locations
attgagccaaatctgtcaaattgaatccaaatttatcaaagttatctctaatatatcaaagttatgctcgttaaattatgttaaaaagtcaaaacaaacaaaaaaaactttgatacatttgggtcatatgagcaagggcaaccaggacaattcgccccttagttaacaccgttatcatgtcttcacgaaatagggtcgtcaaccttttatttttgattggaaaaaacgaggtcatataagcaaactaaaaaagtagggttaaattggaagttagactttaaaataggatcaaataaacaattgccccaagattacttcatacaaagaaagcattaatgaaatttttttgattggtcttatttacttatttggattacaacacatgaaaaaaaggtgtttttatattcaacaacgtatccagcttatttgaatgaaaaaaattaaactctacgatcaaaatcccataaaattcaagttgtatattacaatgtaagaatccagatataattcaagttgtatattacaatgtaagaatccaaatataaaacaactaaagattcaactattttagattgtatcctctatctatggtgaggcggtacacccaatgagaaaggatcgccttttccatgatgaggaagcgataggcagaggacatgcgtgcaatgagaagcgtcgtagatgaggaaccgcgctatcgctaatttcttctgctagcttcccattccttgcttctctgcagtggagctccaataggtttacctcaccaatatctgccagtagtttctcgcggcactactaccttctgatcacgtgcgagtattgccgcagagatgtgtatttcgtctagtaaatttgaatgtgtgtagttggtttattcccaaacgttgtgctgcgattgtcatgttgtaacaattttatgtcatgagtctagttcacatttgcatnttagatttattgaaacgtccagttcacaatgttatatgtgttagctcaacatgtgattntggattacttatgtgtcggtatgaatcatatctgtgcagttttgaagcaatgagcactaggagcagcgatgattctaaatgttcgatgggggagatatccgacgatgatatcgaagaatacattgaggatttcatcgaaggattcattacatctggacttgtacgaccgcaaaagggcaccacgtcgcgtgcccctactgactggccaacagtgggtgatgcatacattacaaaatattgctcggtgcaggagcatgttctgtatgtgacctgattaggtgattttacctaggctagtgacatccttcagttcaagtacaacttagtgtcttatgaggttagcgcactggaagcggaagcggtaggcattttcctgtgaactatgtcagggggtgaagctaataggagagcaaacaataggttcgaaagatcgggtcaactatttccaaatatttttaccattgcttcgagcg

SEQ ID NO: 96227 - DNA, 868 bp, Oryza sativa
  unsure (1)..(868): unsure at all n locations
tcctataactgctttgtcagtttaatattataataataattaagctttcatgttttacatatttatcatatattatagttttttatattttatatataaatanataanntncnncnccccgggccatgatgaatacttcttcttgcagcctgcagtcgctctagaggatccccgctcacctctaagctcctcatccccgaacactatcttaccctcttactccccccatccccaccccgaacacttaacttattgggatagcattatcgaagatatcaaggttattgggtttggaggagaagctcgctgaagcccgtatcgcacttcattgcataaacgttttgagacttaattaaggggggttatcatgttttttttctctcttatcgggttcacttcatcacttgtagaggatggcagtggcccgtcgagcagctttgaaagcccaaaaggttttgccaagttgggctcccgtccagagtccacacacctctcactcgatatcgatcatctcccgcctatattgcaagggaattccccaaactcatcaaacacgtgcgggttgaaagaaatcccaaattagtttctcatcagggtaacttcttcgaacagaattagtagtagcagacttggcgtaattgtgccgtctatccacgtagaaattgattatacttcagagaataagcgcgatccatacagcataaaataagcgacgcccgaaatttacaggaaaaaatatttggttcgaagggcaaaagaagataaatatttgctcaaaaataacgcattaaggcagaaccttctttcaaaatatggagagcgggatcattcaaattggatcatacgaaaagctttaagcgcaaatatt

SEQ ID NO: 96228 - DNA, 736 bp, Oryza sativa
ctgcgctttgagtgacaatcccatcgtgccagccgggcgactcttaggatcccccgtggcatgccatgtagataagaccacgatcaaacaacgctttggaccagaatgatacaataaactaagtttagggacctcaatgtgtgttttacaagttcgtgtacctaaatgaaacctcatgacaaatttaagtaccgctagtgcattttactctagctttaattaattacacaatactatatcaaacttttggatagttgatcgaattggcatgataaggtatcactttagaaatcatggaattgtttttgttaaaaaaatgaaaataagtgcatctcttcatctcaaaagccatatgtaagaacacttggtggactactaaggctgtgttcggatgccccttttcccaacccctctccctcgtttttcacgcgcatgctttttctaaatggtgtgtttttttgcaaaaagtaaatatacgaaagttgcttaaaaaatcaaattaatccattttttaaaaaaaacttaattaatcacgtgctaataaaccgctctggtttccatgatcacattccagatggtaaacttgttctagcgaacaccagcttagtaagaagaaagagcaaactttcaaacatgatagttataaaaaagatgtgcggtgggaggatattataccctaataaataatatgggggggaagatcccccgaatttggtgcatttccatttcgaacttt

SEQ ID NO: 96229 - DNA, 503 bp, Oryza sativa
  unsure (1)..(503): unsure at all n locations
tgttagagaaaataggatgcagacagactcagaacgccatcttctcgagcacatgatctacacaagtagccaattctgcacaaagttaagtaaactctaaactatatacattgaattttgcttcccaatagcagtgtagaagataatagattttctaattgcttttctttgtatatgctcattactgtccttggtttgtccttattcataacaagattgtttgcccatcctttttctctacaagatgggcacatttaaatgaactatttatcatataatccatgatggagataatgcgttgaaagctcagttagtgctgttgcttattaatttaagttaacctttttcttggngggtgccgagcagnctgtctatcaaagctcgccccttggggnnggggagngtaggatgcatagacaggatgaactaggngcgtgagnnnggtagaggtgaagcaagggagtaagatatcttaagtatcaattacgaacagtggagagcgt

SEQ ID NO: 96230 - DNA, 758 bp, Oryza sativa
  unsure (1)..(758): unsure at all n locations
tgtggncgccttcgnctttcattgacaaacctcttcttgcatgcctgcaggtcgactctagaggtcccctgtgctgaactgaatgtggtgcttttgcatggtggttgtcgttatgaaatttgtagagcggttaaacaaactatcagtttgggaacagcttgcagggttcaaatagtcagatgaaaggagaaatggtagcaggatgctactatggtacgagcatggcagatcatataatccgtttattatcgaacgcgaagataaactaggagatcattatacatcattattgttcgcaaaaaggaaaccaatgtccaaaatttctatgtgctctacaattgatctcgaatcaaagacgaacagagttagagctattccaataccattataaactacacaagaaacaagtctcttataggtaagggtatctcaacagtaaataatacttcacaaaaaagatgttcattacatgatgattttactactacagctgccgggaagattgccagtgaccgctcaagcctttttacattaccattcctccatcaatagtgaggacctgtatggtgacacgagagtatgagaccttcagaaggtgaaagggtcatcaaagaacacaaagaaacaccaattcgcctagtaccatcgaaaaatcacctgagttggaaaatttcatcgtatatgatattggcatgtggttttagaccctacatggtattcttatggacaaaggatttttacaacctaaggattctagg

SEQ ID NO: 96231 - DNA, 733 bp, Oryza sativa
acacatgaccagcatatttcctcatagcaaatctacgaggtgggaaattaggtccattatgtatttcaaaataaacagggtagaacccatgcaaatttggattatttggtttccaaaagagaaagtacttgaattgtattacaatactactactgatctcttcattaatcattatggtcgtatgcatgaatgaccaattgaacacatagaggaacacactagtaacctccacaatgaacattttctttattgttgttgtttctctcttccaatgcaatcacaatattaacctatccaattgtttagacatctaatgtattcagacaacttttcaaggcctcattaaaaatagaatttatacacagtttaagaattgttgaaaatacataaataatatcagagggtaataaatcaaaacaataatagcagaagaaaggctctagggactaaaatactacaagcacatgggcccatgaaccaaacaagtttatgcagcatttttttcgtcatttcggcaaaaatactcgataattgtgcaacatgatgaataccgctgcaaagtgtcatagaaaagcactggacctacaattatcaattatgcaggcatatgcaactcgaatggctttggcattaaacacaggaaaaggctgtaagacgagaataaggcatactagcaactcaattgcacgtcttccagatattatgaccagtagttgatttcactagtagaggc

SEQ ID NO: 96232 - DNA, 697 bp, Oryza sativa
tggtagatatacaattattctgtgacaactttagcagtttgaaaagtgggcccatgataatctagtaaccagtagctgaaaggaactgagcctcataaagaaacatcacacattgatcatatgaaatgcatgtactcataacttattatacagaaagaatgaaaagaaatatagatttgatggaaataataacctttccatcttggtaaatcgttgcagaagcttcaatatatgccacagctcggtaactattagaaaaggaagtaagcatatgagcaaatttcaagatatgccctagtgcatgaaaattttcttatatatcaaagttatctttcagagtatcagcagacagtcactaatgactaatctacaatcacacctatttatcaagtttgatgtttcttggagggtcgcccaaacattagttaaaccacaatattatgttttgtaaagttgttagggatttcataaataaaaaaaaatgttagggacttcatcaaaaaaatgctagggatttatacagaactaattagttcctacttgatccaactaggtaacttctttgatcatttagtgttggacacgtaatgttagggacttcatgaaaagaatgttagggacttcatcatttagtgttggacacagaagtattgagatagagttgcccatcaggaggattaaatagttgtaacaatgg

SEQ ID NO: 96233 - DNA, 661 bp, Oryza sativa
tatagggcgaattcgagctcggtacccattttgcttcttgcagacccatttgcttaatatgaataaaaaattgaaccccaagggctccttgctttcttttggtggggtcattatcaatactatggattattattcaggtatttttcttaataatacaatgtgtcccttaacacaataaaatgtttaaaacatccagtatgtaaaagtggcagtctgacccctattttgttttgctgcagctctttcaatacttcaaaattcttctgttgtttccagctctacatatccaaatcgctaaagtctctcaacagagttactctggtaataacaaacaccaattttgtttgatcagttgatctcgttggcttttctatgcactgtctcaatatagtttggtcgccattcaagtctcactacaaatgttgaacttggcctgacaccaaatatttataaaatgctacctgatatttttaatatttcatgtttcctgaccaaaataatcttgtgggtcctcgtataagttaattagtgacattcttgaagctttgttatgccacaaatgtcatggggggaacttcatttaatgatggaaagagcaagaactcaaaaaaaaaaacttttgtcgaaccaaacacgtcatgggtgcttatcttcaaaatca

SEQ ID NO: 96234 - DNA, 725 bp, Oryza sativa
gtgttccgtgtgcactgtaagtaaagttactgcagtgctgagatattgaagagcttcaatggtaccatcactccatcagaaacagtaagaaactcttccatccatgtgacatgttctattattctgtaccctatgcattttgtcatatagggcctgttgtattcacaggatcgaattctttacgcgggtaatttgatataaaacattagaatgacctcatttggtgggggtgcctaaggggattgaattacttgtgtttatcaaaagggattgttagcccttcactcttggcagattctctctgggaacagagtttggcacaattagctacatggatagttagacattgacacaggctacaaaacaacagttcctactgaaatcatcgatgcaccccaatctttagctgttttgtcataataaagcatagtgttgggaattactagagtgaaactcgaatcaatagtgctaatctgagatagatttaagccacatgcacacctgatggcctaaaaatgtgggtggctgttaacaactgagtcagaataaagctctgatgatagcatcatgggtataaagtggcgactatgggagttagtagacttcactattttcctttacctttctttgatataaaccttcatatgtagtcatatatcagggttgctgcatgttagatagaacacactgaaaatccaactcatcttgagttaaagctagagttc

SEQ ID NO: 96235 - DNA, 611 bp, Oryza sativa
aataaataataggagggaacgtacagggaggcagatcgcggcggtgctagggtttggcccgggccctaagagcggtaaaaaaaggagattggatcggactgagtggaaaaatacggggataaaaaaaccagatgatgaaaaaaaaagaagcctaatcggacataaaaaactggcgagaaaaatagacggacaaaaaaaacatattcaattaaaaccgattcctcaattaaaactgaaaaccgatttaaacacggatgacttactaaaatctcagcaaaaatatcttcaatttttacaatagtagagatttagacaaagaacaataatatcatattgcatgaaaataataattcatgaccgtcaaaaattatatataatcacttcaatatacaatatctcaatataatatacaagatatgagggcaatatatgtctgcaaaaaaaacaatgatccaaagttatttgattaacttgttgggggtataaaggcgggaaacgtgcgtgtggaaaatgagggagagagaagttgggaataagtagtataggacgccctaataatgttacctccccaagcttttttttttccccattttgtttaaaaaacaacaaac

SEQ ID NO: 96236 - DNA, 600 bp, Oryza sativa
aagaagaggaggagagagaaagaaaagaaaaagaatagaaaggctgacaggtgggccccatgaatagtaacctttcatattttctagatttaattcaaatcctattctttaaaagcccatatctcctaaaccgtagatccgattccagtgaaacttggacctaaattcatataaattcaaatgcttcattttgatgcctaattgctattttataattttatttgaatttattcaaatatcatttgaatttatatttgccttttgcaaatattttcttttaccccaaaatacccattagccactgaaaagctgccggttggaactttacgccttccacggggacgttcgtgtggtttactatcctcgacgttggactattggttgtaaagcccggcaaaaccaaacctaaggtcgaagtgctgctcctggcaccccacgcctcgatgcgtacagcggtcggagcttcactattccctcgacctccacagtacgtcgcgcagttagatctcgagctctgtgtaatcctagccgctccgccgccatccacggttgtcggagtaacacttccgcctcgctaaacttgcacaaacctcccatccc

SEQ ID NO: 96237 - DNA, 639 bp, Oryza sativa
cctgcaccccagtttgttgtcgattaattctgataccgtggatgtgttagacacgattggttttaaagggcactttctcgctggaaaagcaacgaattcccttggtagtcaatgatgtcctcttcgatgcttcgtcatggggggctggaaattttctttgcctttcttctggggtaactgggactggatggtaatgaaagtaggcatccaaaggctccaagcagtacaattgagtttgggagagtatgagtcttgagaaacaatctagaagaagaaaaaaacttgtttctagcttctagtttattttctagagttcgtaaatataagggctcgtttggattaaaggataggaacgccataggatctgaaaagtataggaatagagaaggaatttaagcgtaaaacagaataatgaaaaacaaaggagtacaaaagttgagggcatgcggatcacagtaagttgactgtctaggacttgcatgtacgaagcaaaaaaagagcttgtgatggatgattttttcctggacttttcctgtgaaaccagcaccaaaggaaagggaattttttttggatagtattcctccaaaaataattaatcgtatgaagcgggtgatcgctgacccccttccctatacgtgc

SEQ ID NO: 96238 - DNA, 878 bp, Oryza sativa
ccaactttatgaagacccaaaataggaccacttaagtgctactccagaatcaggctagcacacgtagacacagataatatcacagccaacatcacaaaagaaacctaacggttattaataaaatgactacgataagattatgtctacagtttaaatttattctgctacgaaggacctaggaatataataaagtagcagtgaaaataagataaatacgtagaagctccattcaacttgccacatgtagtcaattgtgacacacaacctattcctcgtcttcagcagcaaactcttcaggaaacaataaaaacatttgttctataattgggggcattacaaggtgagtatattctagaatactcaacaagtacacagaaatatgcatatgcatggctaacaaagaaggcaatggctatttcgcataaacaacaatttttagttataaacaaattatgaatagatttaaaacaacatttataaataacaggtgctaccaaccattcatcgacacatgatctatctgcacaagaccatatagctatattcattaaccagcacacagctcattcctggttttcacaaactgcccctcatgagaaatcaccaagcatgtccatgaccactgacgcagctattcgaatagattagtttaacactcaacagatattgtacagcttgacccataagatacatcatccttttaacggcaatgcgcaagtgtcacacttgaggttatgtgcagccaaggaatatgtaaggaggctctttagacactccgccccaacactgctttcccccaatgagacagctttccctcacacagcacacaagaaactacctatgggtaaccttcacacctatcatctaggtactgccag

SEQ ID NO: 96239 - DNA, 562 bp, Oryza sativa
attttaagtgtatgtaatttaatatgtaagatatggacttatagtataagatttatcttttttaaaaaaatgtggcaccatagtagatgggtagtttagtgaacaaccataagaaatacgccctccatcccataatataacacattcacctaaaatcttttattttatattatagtacggagggagtagagaatttgttgtatgccactgattttggccatattctatattatattaatgtatcaatgagtttgtcaagttctacaatatgccatcgtattttgtttaacttctataatataccatcgtcattcagttaggctccattagtgctattgtacaattttatcctaatgaccgaaataccccgtgatgaactttccaaatttggttaaaaattttctgaaatatcaaattataaatcttccaaagtttgagagcagcaagtcattgcaatggctgctgctgctgatattatacaaccaccagtcacatcaaaacgcaaactttctcgcagaaagccgagaggaaagcaagaataccaccaagaacggccaaaagc

SEQ ID NO: 96240 - DNA, 834 bp, Oryza sativa
cactggtgttcctgggcctgacccagtgctagtcttgggccgaacggagtaaaaacagaaggaaaaagtgcaccaaaggtccctcaacttgtcatcgagatacaaaaacgtcctccaaccgcaaaaccatatatgcggggtccctcaactatataaaaccagtcacccgaggtcccttggtggttttcaacctggttttgtctgacgtggcggctgaatcagcgtgggacccacatggaccccacatgtcagctagccacatcatcaccctctcccctcctctctttttctcccctctctctctcttctggtttggtgctcttggcaggccagtgccgccagccgacggatggcaaggagaccgactgggcgacgcgggagaggaggtccggcgacgtggcggcggtggcggtgatggcgacgacgacgcgggagcaggggagcaaggcagcggcgacgacgatgacgtgggagcaggggagctctcgccgtcgtcaccgagggcccaaccacgatcttgtagcaacgtcggtgcggcgatgaaggggaacctggcgaggagtgctagggccatgtcggcgccgacgtgcaattggtctctcccccctatccccccacctctacaagctcctctgtctcaccgtctccacatccgcctcctccccaccccgcgccggccgctcccggggaccacccatgccaagccccggcccagcccccgcctctcccccctcctcctcctccttctacgttgcgccctagcctcctcgacatggagcgtggctacgccgcccgccgcgccaacgtcgacgtgttcctcacctcgctcggcgt

SEQ ID NO: 96241 - DNA, 608 bp, Oryza sativa
tgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgtttagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggagtggaggaataggtgtagctttggtcaagctgcctgtggagtagagccgtctgcgccgtttatttattttccgctgcttagatccttattgattgagaggaactatctacctctgtaatgacattttat

SEQ ID NO: 96242 - DNA, 557 bp, Oryza sativa
aataggaaaatatctagtatatataaaaaaattaattagtccttcatatatatgaaaaacatatttcttttatatattaaccaatctgcatattcgaatgaaaagggatacagttaaatttattaccctcactatatgctgtatcatgaagggtgaaaacacaatatgcaataatagaggatatcaatggccagttcttgtaaagactcttctgtttatgtgaatcttcttcaagtgtacttcttgagttgtcaatcatttcaatttcaccttcagtatctttatgcttatgaagtgtctcctggtaatcaagattgtcaatttgataaatattttccctcgcggtcatgtcttaataattataatctcacttaaaagcttcaagtacacaagtcacagtttttgggcagtagtcatgcaacaattgagcaaaagaataaacacaaattagtttgttcatcctttaatcatattttcttttagacataatggaaatcaagaaaatatttttttaattagtggaagtgtttcatgttgggtaccgagctcgaattcgc

SEQ ID NO: 96243 - DNA, 527 bp, Oryza sativa
acatggtcgataattgaaaccgaatgtagccaggccaggcgattaaacaagtggagagattccattccattctcagactgcgcgcgagctagtgaccgaccgaccgcgcgacccggcggtccagccagttggcgcgcgcgcgcgagcccttaccgaccgatataccctagttagcggcgcctagctgcatgggcgcacgcaccaaaccaaaactagctgcgaggaataattgtcgctcgattgcttgcttgggttgggttggcaaccccaacctcgcgcggcccaccgcgtttcatttcccaggttgcttccgtgcccccagctagcctagctccatttcatttcatattcccctctctctggtcacggccgttttcattccatccctgcactgccactgccactgctcccccctgcaacttggacatgtggcttagctactcgccgtcccggtctcggatgatagtataagcgtgagggtttgggcaatctaggcaggagaggtgactgctagcgaggaaagggag

SEQ ID NO: 96244 - DNA, 840 bp, Oryza sativa
ctcacagtaccccaaatcagaaagggaaaattgaaaccatgccattataattttgcaaaatttaagatatgccatcctgacccacatgtcattgactcatgtgggtcctatatgtcattgagatatcgatggcatatctcaaactttgtaaaattataatggcatggttctaaattacccaattagaaacccaccattgaagcaccgatcatgagcctcggcggccgcggcggtggcggctaccagtggcgctagttcatcacgatcgagccttggagtgtgtgcccgtggccgttctgggtgcgcatccacgagactgagtctctcggcctcacgcgcggcgtccggccatctggttaattagtcatcctcttacacggccatgtactggttgtatgattacctcttttcgatttttgcattcaagagtaaatgagtaaatcccgtgtggtattcttttctttattcatacattgcactgatactgcctcaggcgatagctgtttcgtgcttatgttttagaggacaatgaccgaaatatgagcaacagccatcgtagcaagtgcttgtaagctaatttgtctgtccattctggcctgttttctcaacatagcaagatgattaaggagacaatagacaatagtgtgcacataatctggaaaaatgatttagttttactgtaggaccaatcaccatacaatcctaatttttgagttgcagaaaaaaatataccaattgtaaattgtttgacacgctctattaatttttttaaggtaactagtaagatgagggctactcaagatgggctaagtcggtcagctgcaagaagtgatggagtgc

SEQ ID NO: 96245 - DNA, 537 bp, Oryza sativa
aaagcacggtttaaatttgttatagtctactacttcctccatttcatattataagtcgttttgattttttttagtctaacttatttaaatttgactacgtttatagaaaaatatagcagcattttaacacagaacaaatatattatcaaaatatattccatgctaaatttaatgaaactagtgtggtgcttaaatgttgctaatttttttctataaacttagttaaactcgataaaatttgactaatataaaaatcaaagcgatttataagaaaaaaaaagtcaaaactactccctccatcccgagaggtaataacctattaccgaattatacattacatacaactataaatctagacaacctaatcgaattcgtgaatctagataatatctaatccaatactatattcttatattttggaagaaaagaagtgctccctccatctcataatatagcaacttagtaccagacgagacataccaatttgttatattatgggatggagaagtaggaaagaatttattgcaagtttgcaac

SEQ ID NO: 96246 - DNA, 741 bp, Oryza sativa
gggcatgtaacaaagtagtacactccgattgtaaacatgtacacaatctgcatttcttggttatgtgcgttgttttctacccaaataagtggccatgaaataacgaagcattccatgtagatgtgaaattgcatttatagcttctgcctttctatgaacagtaacacaaatgccttcttcaattcaaatctttgcatgcttgtgtacgtccaattaatactctctacgtataaactgcctttaagcacgttacagtgcttcatttagtctcccacagttgttgacaataacaaaccaagcgaaaggaataaaacaatgtcacgatactgttctctcatatgcgcgcgcatatgatatatagctcgggacaaaaccagatgaaccatttctgtcagcataagaacaaaacgcacagctaaacttttagaagaaacaaagaagcaatagcagtacttatgcaagtgtacaaacaattggtaccttggcgtttaattcaaatccaatgttcgacaaatcacacggccggttcccataccgattcacaaatgcaaagcttacaatacttgagcaaatctttaatttgctctctggtgtgttcagaaacgaggtactaccacttgtgatgaatatgaactcataaatggtactcgatctactataattcctggagcgaagtgcatatgcatgtatagctattactcctatatcatggatgatgaagatcatatatatgcaacctgt

SEQ ID NO: 96247 - DNA, 742 bp, Oryza sativa
tttcttgtgcatgctagcaatattttgaaggttatttgtctctagcatagcttgtatgtattctagtattttcatgagatttagattttgcttttaagggagatgatgcatgacacttaaattctatacttgaattaagcaaatatgcaatgttgatgctagcatatggtttgatttctaaatgctctatatatatgctttattaatttgttattctacaaatagtttaattgctcattgtgaaaaagagaataaaaatataaaaaaatgaatatcgaatccttggaaacagtcttgacgacaaggacgtatttaatgtgagcaaaataatgggtgctgaatccctggaaacagtcttcacgacaggggcgtacccggaataaaagagaaaaatatgagcaaacaggctcaagaaaagaaaaagttaaaaaattctcttggttattttgtgctaaaggttatttgagaaagagtgataaatgcagtaggtatatgtgtttagtgtttatttttcaacctatgtgcttgttaagatattgcattataaatcgtatgaaatcatgaactttgatagttgattcaagcttaattgtaaaatctttggttcatggttatactttaatgcatgctcgttatgttatcgatgggttcatcttctttttattgcaacacatgacatgatatgctatatgtatgctaagctcttatatattaatgaccatacttctatgcttgaggaatc

SEQ ID NO: 96248 - DNA, 555 bp, Oryza sativa
ggtgcccagcaaaaaggcaatgacaggttactcctcaaacataaactcacctatctacacataactaattagcaatttaaaggcatttcctaatctcacaactcttaatttcatctacacagtgaatgagttgtcgacgtgcaatccatctcaagacttttgcttatatatatgtacaaagctatgtcccagctagaagacagatggcagttgtgaaattacctaggactaaagaaccaagatcttttgttcatggctttttgtcatgattatcattgtatataagtattgccttacctaccttccttagcattgtatgatccaagatgctactgcatctgctaccaatgctatagaacatagtacatatatgcatgcattctagctgaatgacttgcctttatactatctaaatagttccagtaaaatgcctgccgttacattaacaagggacattttgacacccttcttcacaaatgctcacaattcaatgcttcaaactaattcattctttttcaccacctcaatcagcaaaaaaaacacagccaatttccc

SEQ ID NO: 96249 - DNA, 564 bp, Oryza sativa
gtgcacagtgctcccactacagacgtggtcttcaaagcacccattaaaatccacccataaacaaaaaaaaatgttgtcacacaaggacaagggaacgacatggacatattctcactatgtgcatcaaacactggctggctgtacacagcaacagcgagagcgagccatacaccacgcccacccaaaaacaaagcaacaacttattagctgcttgtgtttttggtcacctgcttgcgtgctctttcgtcaaccattcgcttgccatggtgggccttgttgagtatgtctgccattggtccattgcactgcccgtatcgatgattgccagagccacacgatgatgatcgaacggcgtatgaaccaagcaaccacatgactcgaaacccagccaaaatccagtgccggatgacgtgtcggcacccagcgagggccacgccagggcaaaagccatttcgagccgcaaatcccagctggtttgaagtatttaaatactcctattcatcaatattgtattaacattattaaaatttcataatttttaacaaatttttgttgtttaccacg

SEQ ID NO: 96250 - DNA, 744 bp, Oryza sativa
acatctatatgacagggaacaaataggtcgcaggtttggtggtatgaagaaaccaaatgccaattaattatatccatatgtgtagaacttatttgtccaaccatacttatgaaaagaaccataaagtgatgactgcatactgaatatataattaattaattacacttagacataaacagttgagttttaaggacataaccacataatattgttagcttttctaaagcaaagaaattcatattcaggagagtttatgcatgttgataataacaaatcaaataaagacaccgtcaagtcaaaagacatatgtggggataatcaacataacttatgtaactgctaggtcatgaaaaacattcaaggccatctgtcccagtaccaatatgttgtgtatagaaaatgttgaggtttgagtagatctggatgaaaaaattcaggggaaaaaagttgatgtctttcttgttaaaataagaagaaatatccaaagtctctatgtttccaaatagcaggtaaagttgcagcatgatgttttatccatattctgaaacaaaagtcaagattctataaggtcgtcacgattaattatcaagaattatcaattgagcaatattagccagactactaaccttgatgcgatgcatactttcagtgcaaggaagcaattcaaatattaacaatggatggtattttagattctaaagatctatattctctttataactgtttgccatgcgggctgcagga

SEQ ID NO: 96251 - DNA, 738 bp, Oryza sativa
tgcacccccaacattctataataagctacagggaactgaaacaagatacgaccaattgtttccttcttttgacatactccaaaaccatcctaatttccacaactaagtgaactgcgcaaggtaaactatctctatctaccataaacaaaaaaaagttttatctttagagatctagggtctgtatttagggaccttgtgtgagatgctcttacttgtacaaataactccgattctcctaccaattactctccaaaagtaatccttctatataatgatctaggagtaatttcaattggccataccagttcatctggatcatgcatgattcataatcacctcccagaagcataaccattgattgatttcacaaaaaatatcgcatcagcttcagtgaaatttcttctgaactcttcccagtaagctccaccttataattcttgcacatagcatatctattgcctcttcatcttgtgacttatataatgatgggaacaaaatcctcaccaaacatctccccagaaggatcaaggatgtactagttccatattaacttctttttttcctctcacaaaaatctctctcaccaagatttgatttcatgcaagtatgtaactctttctagaacagcaagccaccaacagatgacctctgaaaaagaacctctttgattcagatacttcttcctacgcaagatatgaggaattcttctccaggtttggaatccacttaacaaacata

SEQ ID NO: 96252 - DNA, 592 bp, Oryza sativa
ctggggaggagtatatcacgagctgacactgctgcagtctgcagagccaacgaactactccctatgtctctctctaaatataagcaattttgcttgaatgtggcatatcctgatacaatgaatttggacaggagctgtattagaatatgtcacatccaaccgctcctgtctagattcgttgtattatgatatatcacatccaaccaaaatcctttatatttatggatggagggagtagctagctagctagccatgcattaatcttcactgctaaagcctgtaaagaaatatatgtggccagagatatgctcctgtgaataatactccctccgttgtttctaaatatttaacgctattgactttttaaaatatgtttgactattcatcttattaaaaaaaattagtaattattaattcttttcctatcatttgattcatttttaaatgtacgtatatgtatacatatagataagacgaatggttaaatatgtactaaaaagttaatggtgccaaatatttagaaacggagggagtaatagccgaagatattcttctgaagaaatgataatactatgacgagcatcattatttg

SEQ ID NO: 96253 - DNA, 644 bp, Oryza sativa
ccctgctcttaaggttagccatagccatatttctcttgtgagtttacttcccaatacataaagttatactacaaatattattttagtgcttaaggttaactttacatgcacattggagatgcccttatgcctttaatttttaaggtcacggtaaattttttgcagaaaaggagagcgcctggccggccaccagctcactgttgcaaatagtagaaactcaacaattttatgaaaaactatactagaaacttgataactgcaccacacctgcacttctcatcttttgcaaattaaataaattatcaccttcagcagttcagttagttttagtactatagcacattgctaagctggatcttaatcaatcagtgtataatcatccatcatcagagataatacctgccaaaggcaaacaccacaatgatacaatctacaaagccccaaactgaacagattacgcaaagatatctctcccatgataatatgatattatgcacagatccatcaaaaccacagtgtcatcacactatctcaatatatcaacaatcattgcctgctttaacactgaccaagattaggttatctttacgcaaagagctttgttttttcatagctagattagtgcaaggattaaacgacacctc

SEQ ID NO: 96254 - DNA, 572 bp, Oryza sativa
cttttcagcgttgtatgctcgtttattgctatatgaatattctatctgccctcaaaaaatattctatctgcgggcaccctaggtaatataccgtccagtgtccaacgtgaccatcacatgtatttggataagtaggataaaaatacatttggtgatcacgttggatattggatagtatattacctagggtgccccaacactatccatctctctttccacaatcacatcatgcatatcacaagcacattctaactatctaagctaccaagactaagaaaaaaaagacaaaaacggagcccaaaacaatcatcgaagaagagcttatcgtaaggccgcacaaagtcttcgacttcacgagacaagtgttatcattgccgagcttgtcgcctagcgacatagcagctccaacttcacagctgttacatcatcattgccaaaggtatcgccaaaacgaacaaaacaacaccaactgcttgctttggacatcaacccaagccaaccaagcaccacttcttgcatacacttcttgcaaacagctaacaccagcacccctagagactacaacgtgttat

SEQ ID NO: 96255 - DNA, 583 bp, Oryza sativa
ataattataaaatagtctagaagtatagaacaatgaatgaaaaacactaccaacacatataacgctatggatcattgatgagcacggacaaccgtttatactagcgcgtaccatctataactgataaagcataaaatgcattggacaattcacatgtattcatctatgggttttccattctgttcaaaatcacacagacaatattaggtcaaagtttaaaggctagtagagagaggcgatccttcgcttaacttcatgtgtagttagtgtcactaacatagcacatcatactatgcatgtctctagtagggcagtcgcagtctcgcagataattatggccccgttaatatggggaataggtcgagcttattaaccgcacgtaaaattgatctaaaaaataatttgtaaataaaacttttataaacgtgttcttagcgatttaaaagtaaagattaaaaaataaaattcgaaagtaaaataaaccttaaaatcaatttaaattaaatttaaggtaaaaaatttaaattttactagctgataagtaagcggaaagatgaggctcttatcctttttttctcgtcgg

SEQ ID NO: 96256 - DNA, 570 bp, Oryza sativa
cccttacattttcttttaaaaaagagaaaaaaaagaaaaaacatgaagaaagcaatcataaaacaaaagaaaaataccacattctttagttaccaatgcaacatcttttttccaatggccaaatgcctttcttttactaattctttttatttatttcctacggagaatgtaagggtagctagatggatgtttcaaatgttgaatttgcatgcacgggtgatgcggcatgtagacgttgtatccaaggactatattaaataacataataaagtttagggacttatttggataatacgaaataccaaagactttatggatccttaagcgaaagtttaaggatcatgttgtttgttcacactttaattaataacactcattatttaatcaataaaaacaagaacaacaacaaccaaaaaaaaatcatcttgtaaaaagaaaatttccaaggctaccattcaaccagctgtccagattcaacttaaccctgtcctgtgagacgctctctaaccgccaaaacgaccagaccagtgtgtgcgcctcgccgttgacttgaccacgtgccatggcggg

SEQ ID NO: 96257 - DNA, 923 bp, Oryza sativa
atggattgaaaaggaagggaaagcatcaacatttcaagaggtagatttggggaattttatgagtctgtttatattagcaccaaattgaagagctattttaacatattcaagtactccgttgtactgcgccccggtcgctaccgagacaacatcaatgccattatcctacccacaaccgccatgccacaaccgctggatcgagcagtcaagcaccccatgtatttgcgtaaaccctacaatagtctacatcgatccttcttctaattgtgttgaggtaattttttaaaaaatcatcctaaaattagtgggctgcaccaattaccaatatttttatgtataatagttttgaacatggtgtttgctatttgaaatatgatgttgctctcatgaccaatgaagatttacattaactacttcaggttagatttgtaaattatgtagtttttccttaatgcataatcattggctgtgtttggtgctaaatactgcagtttcttttaattttgtaggaaaatctgtaagaaattggaataacagagcaaacctgaacattttcttggtatgtacctatacctggtattcatattgatgctattttattaagtgaatagccaatatgttgatctttcatctgaacctgaattactagattacaatgaattcgttgggttgatacatgagcaatacacataaattttatagcatacgctcttttataaattgaacataccacgttgtctgctacaggtcatgtgattaccggtatatcatgatcactttttttaattaggatttaaggaagttggaaagtaaattatgaacaattggtgcctacacatgctttggcttctattcacacgaggtaattagtcttgatttagactaaatataaagggaaccaattatacttttctagaagtgaa

SEQ ID NO: 96258 - DNA, 566 bp, Oryza sativa
tcgagttgccgtagccgcaccagttgctgccggggcactgcttccagcgcccaggcggcggcttcggcggcggcatgatctcctgcgccatgtgcatgcacgcgctgctcctcttgggcaccccaggggagctctcccaggaaaacggcacctgcgtgcgcagcggggaggcttcgcggcggcaccgcacgctggccgcgtccgccgaagcgcacgaccggcgcggcgtggggagcggcgagtcgagcagctgcgggagcttctcgccgtcggcgccattgcaccgcagcccctccttgtcccgcctggtgacgatttccatgggcattgcgccgactgactgtgtcggcagcatgcatcgtctcgggcgttcaacgtgtggaggggacgacgtataagagtacacgcgaagactgtaggtagaggtgcttttcccgcgaaaagtggcagtagcggcggttggacagtaaccttcgtgtatggttgtgtgttcatctcacgtactgttcttttgcctctcgctagctcgttcccgtgatcaaggtgcatgctcgatggccttaatg

SEQ ID NO: 96259 - DNA, 544 bp, Oryza sativa
atttacattgtgcttacattgtgaaacggagagagtagtaggtactataaggtactaaattttatactaaaattttggtatctctttaaggactgtaaaattactcctcccccacatttagagaaagtttgtagcaaccatagcttattataaaatctttggttcagtttagagaagcttaagattataagaatccgttggttggtaatcaatttgaatatgaagaagttgggttatataactagtttcttttctgaattatataactagagattcttggaatcttaataagaatccggactgtttgggggaattggagcatttgaaagaagtagcagtagctagaagctctttcaatcagggcctctagtttctccgcgcattaatttctcagttgcattgaaaaaaattgtagtagtagaattcacaaaataatctagatgtcagaaactgacaaatccagattttcgctgactactcgtaaaatactcataaattaaactgctttgaattctctaagctcccaaacagaggacacctcttt

SEQ ID NO: 96260 - DNA, 697 bp, Oryza sativa
ccaatgtgatagggacttaaaagttttagtcccatctaaacagggcctcactcgcaaagtcgcaaggcaccactccgcatagatgtgtatctgtgtgcgtcttctatttataatgagaaaaaaataaggaacaaataacctcccgtcctagcgaccttcctcacttttctctctctccagtctatatatctactgtcagcgaaggggagagagagattggggggggggagaagaaaacaacaaatcacaaccaccagccagcagaagtaacagctcatccatcacagccaaaaaaatacaaaaaaactaaaaaaaaaggaaaaaaacatcccgggcccacccgcctccgctcaggtgggccccaccccgccaggccagcatcaccaccagacctccctcctactactactactctctctctctctctctcgcgtcgcctgcgtccaattcaattcaactgcggcggcgacggcgagcgccccacgcaagcaaaatttccccagaaaaaaagcagagcgcggcggcgacgacgacgacgactacgcgaggcgacgcgagagcggaggagacctgagcgcgcgggagcgggatgatgggaggggtggcggcagaggtggtggtggaggacgctgccgcggcggcggcagctgtgcccgcggcggcggtggcggggacgggagcgggagggggggaggag

SEQ ID NO: 96261 - DNA, 515 bp, Oryza sativa
attcctgcagcccctaagcgcgatagtaggttttacaaactattttttcagggttaatggtccttaatgaagggttctttccatttttaccatacactagtaaaaattatggggttgttcagattggtgccattttaaactttaccaatttttgataaagttataaaaaatatgcatccatttaggtttttttttaccaaattttaataaatatataagaatcatgtaaaaacttggcaatatcgctaaattgctaaaattttagtattggtaagatttattttgactataatatgaacagtccctacgagagtcagacatgtacactcttagcttgagacaaatgacaaatgtactctcagataattatgagtggccagtcatatagtacacacctctagtcatggacgagttgaggacctagctaccgaccataggttccgtcaccattgagagcagatatccaaatacaccgcaccacatgcgtttcacgacaccgacggcaaccccccccc

SEQ ID NO: 96262 - DNA, 1504 bp, Oryza sativa
ccatttctatgagactatcataaaagtctggatgaagggcctaaaagacaagcaggtagcaagcttgattttgccagttttggcaaataaatggccggttgtggtgaagggcttgaaagaaagaaaactggaagaatggtccaaggtacactcctccagctgttgaacaaggcagactcagcatctgtccattcatcattcatcaatgccatgcaatgcatgcagacgcttgggagttgcaggaacattgcggttttttattttattattattattattatttttgcagctctgaacaatcagcagcaattcagcagctctctgccaaattagtgtggtggctactgtgcactgtagtgctggaggcggcaaaagccggatcggactgctcattggcatggtcgaattggtaataaatagtagtccgaacaatcacttctttttaagtttatactccctccatctacttttgataaccatatttcatcttgacacactgatcaagaataaataattctacttattatctatttaaacatgctactagttattcctcgtaaacaagcgattcattgatatttacatttgtcgatgtctatgtagccaatcttgtgtggaagaatggagtgtaacgcattaaatccgagaaaattattaagagaataggtggttggattgagatatgtctatcaaaagtaaatttttcagatttagaaatatgcctatctaaaatagatggagagagtagttagaaataaagtctttttaaacggttcttttcactacgtagtactactcccgtttacgaataactatctatcgacaatggatatactttttacatatatttttttaaaagatagcatcaaaatgatatgtttaaaagtgcaatattaataaagtacagtcaattacaaatctaataatagaactctgaagccacatagtttgattatctgaaagttataggtcgaagatacgcctcaatgtcaaaactgaagggggcagcaggaagcaagaagctagaagacgcgaaattgcagcggcgattctttgcatggagtctgaggcaacgtagggtgggacagatggctgctagggagctgaatagaacaaaattaaggtaggaaccaacgaacagttcatcgttataaagagatttcatgtccaaattttctagttattcttacccccagttaagtcaaagtttcttgcccctttttttaagtcaaagctataatacttttccgtgtaattttgagtgaagctattgggatttggtatataattctttgcctttttgttttcataagtacattaatattgcaagaaactttgggaagaaaatcaaatttggtgtaaaacccttgctttttttattataatacaatactatttttctactccctccgtcccataatataaaggattttgagtttttgcttgcaacgtttgaccactcgtcttattcaattttttttgaaattattatttattttattta

SEQ ID NO: 96263 - DNA, 975 bp, Oryza sativa
gtgttactattcagcatgtctttctccagacaaaggggttcatgcaagggaactatacatggaacattgaggactccaaattggacttaaagtccataatctgttctccaaagtttgatattggtgaacataaatggtatgcacacatggtaccagtaagttttatgtttgtttttatatgatttgaatgagtgtgttattagaacactaacagtacttgtctttaaaaagagaaaggtgtttctctttcttttttttaacattgtgtagttaaaccatcatatatatttgtctttgtgctgtgtgttatgagctagtgatcgcatgtatttatttgtgaaacttaggaaatgaaattctttttaccatgttagcaagctggattgatgccaatatatatttttaccatatatatgtttttatgatcattgtattgcaagtctcctactatttagcttatccctaagatgtactttatttctcatagcacatcttagactttcagattttcagttatgcgaccataataaatggattggatttattcttatgtcaggtaccttcgtgttgatccatatggtgattatcgcaaccgtgactatgtctccatctacttatgccttgatgataactccaacatgcctccaattgagtccgcgatcatggcagaattcatcatatccatcctgaaccaaaagaacggaaaacactcgcaacagaaaggttcatcatatcaactcctccagttttcaattgcattagaatttgacgcatttcgaaacagggtttacatttacaacccatttgttttttgtggcgaattaccttcatgtatatcaattttactttctccatctcttatttgtttttgtttttagtttttttttggcgaaccacagcccggaccgtgttttcttgcaaaggaattgcttggggatggcacaaattcattcggagagatcagatgaagaacac

SEQ ID NO: 96264 - DNA, 4113 bp, Oryza sativa
acaattgacctagaataattaaggcagatggtcacatcagactatcatagcacgtactccgtagtacatctgtggaagattggatcatttatatatgctagtactccaatgtactcccactatattttgagatagagccatagaggtagtggttactcacttggtcttaaaatgtaagtatttataagttatttagtcagttaaatattaagaataaggggaaatattttctttcttttacctttttgatcaaaatttgaattttgaattgtttaggtcccctcctaaatacttgatttacttgaaatgcttggattcatgtgcattggaatcaatgtcctagaactgtttatattgtgtataaaatttgaatcctaaaaatgtttatattttggaatagagaaagtagatgaaaggtatacgcttgccaaattcacttcagcagatatcaataatgccatttcagctttggttataaccaaagcggttttgaacttttaagtttgtttttgaataatttctggtgaactttttacatgtctctttatcaatcaagaaaatagagtttggtggcgaaagtaacaaaagaaccccttaagttaattttattattaaattctacaatctaaattaatttggctcagtggctgctctggagtctggatccaaccaacaaatggctctgctaattaatctgcagctcatgtcagatggtagctagctcttgtggattaactgtacactattcaatctctaaaaggtgcactaattaactttaaagaatttttcaccttatgttcttgaatcttgaactttcatatgtttggactgatcttaagcatgcaaaacctcgttttcaaatttgattttacttggttgtccatcatcgatccatgcctgccttcaggcccactggccactggcctccatgcataggcagcactgctatctgtcaaaaaaagaatgaagaggccaggtgaaccaagaaaagagaaaaatgcacctctgcaaaatgtgatttgcatgatcatagtttatggttttaattacgcctgatataaagtagatgcattgtatgcattatgctccagcactgtaagctactacatgataatcaatgctattttaaattgaaagtgtaaaatacaatggatatggcactgttcgagggatggatcagaaagcagttgcttatctttaaccaaaagtacaattattctaatttaataggtgcatatgggtgtaccttttacaatatttaatttgttaattcagtaacaacatgtctgcagccagactctcacaaaaggaccaagttgttgtatactactgctagcatccgggtatcatggaaaacaaattctttttgttatctttcttcgcctttttcttcctttaaaaatatatatccatgcatgtatggcttggaggaatcgtgcgtgaatattcgatttgcttcctttttttttctgaaaaatgtgaggaggatattcgtttagccaagaaaaagatctgaagcaaatgccagtgctatctttaattaatttgcatatccccacaagacattgctatcactagcaatgcaaactggttccaatcatagatgatgacctgtatatctaactgacttttatttccaatgacattttctcttcttttcttcttcaaaaaagaaaaaaaatatatttttaactaggttccactaccttacttttcttgaaacgggatctagaatatcgatgaataattttatatggtttaatttttttctggtgggtcaatttttcacgtggaaacgctagttttttaggcactacagtatgtttttttatggcaagtccgatggtgaggggaaatggggaatggaggactccgattttacctagtaattaatccctccgtttcataatataattcattctaatattcattaacattaatatgaatatgggaaatgctataatgacttacattgtaaaacggatgaagtagagattaaacattaattcatatcagcctatcaggtatattggatcattcattaagtatattaatggtgttttgctgtctcggtttcctggattttgacatagacatggctggcacccaattagcccagcctggtgttaattagctggatgactggatcttactatacatggcaaaagtgttcaccactttgatgtcaattattggagagttaattacccatatatatgcgtagtatatgtgattttgaaagtgtccaaacatgtagtgcaattttattgggagtaattaatacactgaattaaaattcataaaagaaagataaggtgttaccaggtcagagattttactttacttaaataccacatagcaatgtgaatacgtgtggtgaaactataccactttgatttatggacaaagttactgatgatagttacactaaaactaaataatgcaatcaacatggcctcagtaacatggataaaaaactactaaattattattgccgaaagtaattgggtgacttcgtcaagatcttactgttgtacgtgaagtgtgaacagtaccgtaccgtctaattttataaaggatgcagcgtgagacgggtatattaaccactaactcgcactaggacggcttatcaaccatttacaataaagcattaaagccttcttcatagtggagaaatgtgaaagcacttttaaagaaattacgccaaactatataaaattcttacgttgtaagaagccccaaatatgtatgattcactgattcacacagcattggatgatgatttagatctctctgatttaagttaggtgactttaaagacactaacatgtggaagatatggatccttccttttcctcgtaataaaccatcacataaataaaactaaccatcctaaagcctcaacaatcgtgaaaaactgtagatatagttcttggaaaattcatatctttctttcggaattacaaaactagaaaaaaaatactcccatcgttttaaaatataagtatttctggttatgaatctggacaagtgtttatctagattcatagttaaaagttgttatattttaagataatgtagtgcttattagaaagacattacatcttttccacaaagacttttctttttttactatgaatttgaataagtatttctctaggtggatatcctaaaatgaaatactctattcgtctcaaatatagcaacttaatacaacattagacaccacttattaatatgaatctggatagggataacgaatctagacatgattcatggcactaggttatatctattttattttagttaccgttatagtaccttctctatcttaaaaaacaaatcatgttcagatttatagcactgggatgcatcacatcccgtagtagtttatttttatgggacgaaaagagcacatcagaatcatgtgctttgaaaaagatcaaaaacaaaaaaaaagaacatccaaaggcaaattccttcttgggtacaaccatgtactctagtcctacaaagtaccacataattcttgccacttgccatctcttccctctccctccccatttgttcgattccccatttggccttttcctagaaccatcctccctcccccacaaaaccccccaaaaaaattacaacaaaagcaaaatggatttgaacaaaattcaggatgaaaccttgaattcaacactgcaccctcctactagtagtagcacctctaccagttacttctcaatccgtaccaaaatataaacacttctaaaataatatcaagccaaatatttttaactttgattattaatagaaaaaaaataaaaacaaatcaatcatgtaaaattgatatttactaatttatcattaaacaactatcatgctccatatgtaactttttttattttaaacatcgtacttttatagatattattagtcaaagtagtatctcgaagactaagtgtaaaattgtttatattttagagcggggagagagagctacccatcttcatcagctaatgatccaaaagaaggcaccaaaagaagaaggaagaaaaaaacacgaaacgcgcagtcgcgtctcacccccatttgccgcacgttgcccaactcctcctcctc

SEQ ID NO: 96265 - DNA, 656 bp, Oryza sativa
tggtgaacaaaatgtaacaaaagatgtttttttatattagtacattttagagaggtgcttagtgcattaattcagctttagctatataattaattaattaatgcaccaaaccactgtggggggcagtagcatgtaaatgctgcttagacagtaagatacgttaggatgaagctaacagttcaattggagcagagcagggttgagaatcagtacttggaaaagattgattgtgagatacaacaataataatatcgtaatcatcgagccaggtttttttagaaaaataaagtattgcaatcatatatgcacacgcatactaagactgagtttagatccaaaagtttttcttcaaacttctaacttttttatcacatcaaaacttttttacatggctgtgtttagtttctgaaatcggggagaagtttggggaaagttggtagtttggaaaaaaaattttgagagtttatgtgtaggaaagttttggatgtgatggaaagttgaaagtttaggggaagtttggtgtgaactaaacaggaccatacataaattttcaacttttctgtcacatcgttcaaatttcaaccaaacttttaattttgacgtgaactaaacacaacttaagggtcagcggaagagtaactttttttaaaaaaacc

SEQ ID NO: 96266 - DNA, 506 bp, Oryza sativa
aatgtgcatatatgaggtcaatttgattggagaatacacatgtaccattgaacgacaatacaaacaaattaagaacatgtgcttacgtacgtacgtacacgtagacgtacagaatttgcgaatcaaaattgaccaattaaactaggtgtgatctcgcgtgcatgcaagctaagaagctagtgctagagatttcaactaattttctcaacgctaactaactgactaacgcacgctcgtgcccatagttttgatgtgtcgtcagatcaaaatcgcgtgcccctgttctaaactacgtacagagtacatggtgatatgatatttcgttcaattcaaacattgattcattacattatatatattttcccaattcaactgtttaattaattaggttaattttgcccgtgtttatatataacggccagtactaactagtacatctcatacatgcaattaacctaattaaatcttgacctggcatgaatcagagtaagcgcagaaaaagaatg

SEQ ID NO: 96267 - DNA, 857 bp, Oryza sativa
  unsure (1)..(857): unsure at all n locations
agagggtgaaaaaaaactgaagataatgttattggattggaattttatcaaagatagctataaaaataaattaaatatataatactattggttttattcatgtgagatttgaaaacgtgtatacaaatatgctatacttttttctattaatatacatacgttaaaacgtgttatttgtttagcgtacaatgcgggctatattaaatatagccataacatttatcgcttgaattatacatatcgcttttggtgatatccttacacatttaatgttatgataagcctcgttcatttattttttccaaataatactcgctacatccctccgttccaaaatataaggtatttgggctggatcggacacattctaatactataaatctgaatttaagattcatagtcatagaatgtatcacatccaatcaaaatcctttatatgttgggacggagagaatatttttaacaacatattatggtgcactttagcccctaatgcttatgtattatcacaatncaatcttctccctcagtaatgatgtaaccttgcacgtaaataggagaagatcgtnctcatgagggtggtgatgggccacaaaagagagtttggataagtccaaggggttacaaaacacaaaaaaatggtgatccaanagtgaaaaaaaatccgattaaaaggcgtccaaagtggaacttcgattacatatggggacttaagtgggaantcactcaatnaaaaccatgatcacataacatgtgcattaaaaaatatctttacactttttacaaatattataatcaaatgtattagtaaaagggacgatatactcgtagctagaatagtatgaaacattttaccc

SEQ ID NO: 96268 - DNA, 562 bp, Oryza sativa
tataatatttattgcttacaatctttctatgtttgtaggacacgttctttttacagtgatcttaaatgaaacctgcataataaaaaaaatgcaaatacataagtgcctttaaacaccccgttttagaacttgttgatcttttttagtccaaacttactatttttgatttaggtcttaattctcaggcgtgtactgttaactgacttaatcccactttagcagctaggacaagaatgtgctcaacttctcagagttagctgaagacctggtatctgcacatcatatacaatgaacactggcaggagcaagaagttatactaaccactgctatcgatgttgacttccccaatcgtgcagtttttgggacctttagtctttccgttggcaatcttcaccagagggggacgagaagaataactggagaaggggatcgaggcgctgcagactgcagaggaggtcaaggggatctctagtggagatgcaaaagacgaggcgacggcgattcgtaaagtaacgttctatgcgtgccgccatcggatggagccatgcttcgaattatacc

SEQ ID NO: 96269 - DNA, 560 bp, Oryza sativa
tatggaatcacatggataatgcatttcttcatattccaaaaaaacatcaatgcataccaaatacctgaatctgaagacagcttgagtacatgactattattattatgtcattgcagttttcatagtttcaaagtttcccacaggcaactgtaccacaaactttgacaatgaggtagcaactattgttaatgttttaaatatgttcaaaaactatcttttttgttttttcgttttttgactagcaaagttcagccactaccaactcctcttttcaatccacgtaagtccacagatttgatcagccatttgtcaggtttaacttccaagttggttctagcccctgtcaatcattctaacattcttggacttccatagtagatggcatatggaacatgggacattagaagagtggaaatcaacttgtctacatttctaattgtgtcacatgctcattgtatgactgcaaaagggccttctgaaatgaatagaaccatctgcggtctctgaacttaaaattggaatgttctaaaggtcagcaaggagctttatgattacctaca

SEQ ID NO: 96270 - DNA, 653 bp, Oryza sativa
gtagccatgcaggacagcaagtgaaacaaatttcccagattatgtgccgtcaaattgaggaactatattgaccgggcatgcatgaaaataacgttcatgcgtaatgattgatggaatataatggcgttgccttgcttgggtctaaacgtgaaggaacatcgatcgatcatacatgcgcgatagcgatgtgactcatttaccgctgatctgatctgattctgatcgacagaaatcactgaaatgcatgcgcatgcgtgcactgcaacacaaacatattgattcatccatggatcgatcgacagatatatctagcttgagtttgaatgttgcatatataataatactagcagctcatttatgatttctcgatatatatatatatatatatatatatatatatatatatatatatatatatatctgatgctctcttgcgtgtccgtttgcactcgagatatgattgatatccacgaattgaagaagaagttgcattgcttgcaagatatatatgcgacagtaatcgtcacatctgtcctggagaatataatgcacaagtgttcattccagttccactactctactcttgatttctcactcttctatagatctttaatttctggtattattccctaataaaaatctttaatctcttc

SEQ ID NO: 96271 - DNA, 525 bp, Oryza sativa
ttttttggtcatcgacagatatcatgtgatctgcatgctattttctttttaacctgggaataattatttgtaacatcaagaagatcctgaaagaaaaaaaaatcaagtagtgcgcagtggtggaaacggaacgtgcaattagtagtgctctattgtatataatccataggattatctctactaatgattttttcgtcattgcattgctctcatgtgatctgcatgctgttttgttacttgggaataatctgttagtattataaagaaatattatatctattcttgtggacagctctgaaacagttcgcatttgattctacaatatccatttctatttgcaatatctttgcacatttcatcctttctaagttataccaaatgaaaaccagaagtttgcatcgactgctgttggcagctgtctctgtaggactatgttacatggaaggacacatgttttaaatccaattcatgatttaatggtgtttcttctgaacattgaaatttgatcattactacagtaatacc

SEQ ID NO: 96272 - DNA, 616 bp, Oryza sativa
aattcgagctcggtacccgtgttcatagagatagcatatgcatttatagaaggtgagtatacacgtatgtatatgagcgtctgcacgtataccgaaatctgcaaaaataaagaaagagaaagaaatctgaatacgaccactacttgtgcacaaacggaatgcgcacttacatcaataataatgtataaaaacagaggaaatatctgaaatgaaaaaaaataatgaataagtgtatcaaaattgactcgtatggtggccagcttgaggccctgacgcacaaaaatacaaaaaaaacagaggtgtcatcttcagttaatgctgatgatggtgattagcaacccaaaaaacccatctctgcgctgcacttcctttcgttccccccctccgctataaattacaaaacttcaggggctccacttcgctgcctctactcctcctcctcacctgcacctgcaccaacgcgagagatcatggcgaagagatcgtctcctgatcctgcatcatcttctccatctgcatcatcctcgccgtcgtctccttactcctcttcctccgaggattcctcttcgcccatgtcgatgccctgcaagaggagggcgaggccgaggacggagaa

SEQ ID NO: 96273 - DNA, 693 bp, Oryza sativa
cagtttcagatgtaactgatgaagttgtggttacagataagtgtctgttattattgtacaaaataagcgtaaatttgatcatatctttgatcttgctctaccaaaatggcacctcccctgcatcagtgatgaagatgaagttgggtaaaacgagaaagccattagcacatgattaattaaattttaattattataaacttgataaataggtgtatttgatattctaaagtaatttctatatagaaaattttcgcacgaaacgtaccgctcaatagtttgaaaaatatgctaatgaaaaccgagataaaatttgattcgaacatggccagtgtagttaatcagaaaagaacaatgtaagtaagtttcagttgccgttggtcggtgaccttgcctgtagttaatagtaagtcagtcaagtcgtgtgcttgtgctgttagctttcgttttaactggtgtgctatcaacttgcctagtcgtccgtgtaccttcgctttcttcatttgtccattaattgacgcagtgcaattgtgctgacgacaaaaacgaaatcgtccaacgaggttgctgagagttttctgcccccgtctcttttataattttattcaccaaacgttagcaagcagtctgaaactttgtttgattgtcctactccaaggttatgttctagctggtgtcattcatctcttttcaaaa

SEQ ID NO: 96274 - DNA, 630 bp, Oryza sativa
gtaccaaacaatggcaacagtaaatatctcgtaagaaaccttaacaagataccacaataacaagaacaggtgaaatatcaaatattttgcccaatccatggatgcaacccagttggaatagacattgttttttaataatggaataggacactgttgctggagtaaagtccgttgaggaatcaaataatatgagttacagattagcataggctaaagaccgacacagttgagtaaagacaatatattcagattatggttgacacaggattggataaaaagatatggacctgaaatttgataagaccgtaacagcctagccagttaagagtttcacatcatgtcatatttagaaaacaaggaaactaaaagagtgcagctagggcagaaaagaaccataactcagtaaattgatttccaagtggtattagcaatggataacatttcaatgttgttttgaaggaaaattggtatgatttgaccatttgatgctaatgcccatctaagcacgcctggctatgtgctattgcagagtaataggaagccctctacaacaagagagggagactactggttcattgttcgtcaaccaattaagtagtactaagtaggctgcaatgtatggatgtgaaa

SEQ ID NO: 96275 - DNA, 662 bp, Oryza sativa
cataaaaaaaaggaaaaccctacaataacttataattctccaggtaaggaccttctgaccccttccccccctctttttttttgtttcttttttgcaagtagcagggcagaatgtgatagaagagaaaaacagtaataggatcatagtaccagtggctgacttgcaagaaaccaaactttttgcaggcacaataaatccatctaaaattcaggagcctaatctttgggactagaaccgatgagtgagtattcctaaaaaagatggagttgtacagtttttattactcgaccatggaagatcacaaagacacagaagttagtatggttcaagggcgcatctgctataatgtgagagtccaagattttgctacccctgggctaacagtacagtgttctaggcttaattttggcaaaaaaaaaaaaggaaagaaaagaaaaaaaaacacagatagcagcctctgagatttgacgaatattgtcaatttacagtgcttagattacttttagtttttccgatgacggtgcttagactacaagccggctgtacaatggagtcatacaagattatgggttcagtcttaatagtaactcttcaactctgaggctaaaaacctaaacaagcaaatgctcaacataataaacataaaaataaaggatcgaact

SEQ ID NO: 96276 - DNA, 617 bp, Oryza sativa
atttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagaccaagttagaatatgtgaagtttaatacatacctcccatcatttttacttttatatccaaataatactagtcaaagaaagactcataaaaacgttagtctcatataattagatttgtcattaatcaccgaaaccaaattaaggcacttgaacttacagggaggcggtgagggctcggtgcgtaaaggtggtcataactgtgtaaaaaaaattgtgcccaaatttttagtagcgtaaaattgtgcccaaaattatcaaatgtggcaaaagaatgtaagttttgaaacattttttttgttgaaattgtagtttttcaaaattgcaagttgcatgtataaaatatgggcaataataaggtatgaatgtctttttgccaaaatttaacatcgttaacttgttcatctaaaatagagcaaaacttggtttcgtttttttaaaaaaggagggaaaacaaaaccctaaa

SEQ ID NO: 96277 - DNA, 534 bp, Oryza sativa
tgttgggctcttggcccacctacattgaaatatctatctattatattatattattaaaacagctttaaaagaagcaccacgtttgctgtgggggataaaaattctcacattaatcggagaaaaaggaaaaaaaagaaaaggagagtccaagtagaaatacaatataaaaatagatgaaattcggaattaaaaataattaatattgaaagaagtttccatataagtacccaatacgagaataatcaaaattcgaaataaaaataaaataaaatccaaaattagaaaagaaaaggataatccaggtaggaatataattttaaaatagctgaaattcggaattaaaaataagaaatattaaaagaagagtctatataagaacacaatacgagattaatcaaaattcagaataaaaataaagtaaaatctaaaattagaaaagaaaatgagagttcaagtagaaatacaatttaaaaatagctgaaattcgaaattaaaaataagcaatattgaaagaagtttccatacaagaaccca

SEQ ID NO: 96278 - DNA, 761 bp, Oryza sativa
attaaaataagttagtcacacataaagtattattcatgttttatcatctaataacaataaaaatgttaatcataaaaaaaattcaaataagacgaacggtcaaacgtgagacataaacagtgtaaaactccacttattttaggacggagggactactactaaagagaatcccataaaaaatgttatacaaatttacaagctcaaaaaactaaattaaacaaaaaaaagtcaaaataattcatcgtgtcacattcacgtacaaaataaggcgctgaaaattttggtgagcagaaaattaaataactagaccaaaaaaggcaacatatggcacacaaaaagagaagagaactaaattagacaaaaatttagaagaaaattagaggaacacatagctaaattagaaaagaatttagaagagcacaaaattaaattagacaaaagaaaaggagaagagaactaaaatagacaaaaacttagaagaaaataagaggaacacatagctaaattagacaagaatttagaagagcacaaaattaaattagacaaaataaaaagaaagagaaataaaatagacaaaaatttagaagaaaattagaggaacacatagctaaattagactagaatttagaagagcacaaaattaaattagacaaaagaaaaggagaagagaactaaaatagacaaatttagagtggagatgcgggggatcgaaccccgtgcctctcgcatgcaaagcgagcgctctaccatttgagctacat

SEQ ID NO: 96279 - DNA, 651 bp, Oryza sativa
actagacaatttcttgttgtagattgttaaacacaaactccgacagaagtaacgggcaaatctcctaatatcaagggataagaggccacgacaaattgtttatcagagcgagtacaataacaggctacaaattagctatatgcacatgtggagaagataagataagagagagaataaaagcggtctatagatttggagccaactgtaacatagactccaaagcgttatgtgtgtatgagaggtgggaccatattttaattgtgtagtatatatttatatataactattgtttagatgagttattaaatgggctatatatgatttgggtaatagttggccatactattaaacttgctctcaggtgcaacgagacacatgctttagtaattaatcgtttaattgcaagtacagtgatgtgagttaagcagggatgcagtcagcatcaatatgggttcattgggcattttttttctgtattgataatgcatagtgcccatattaccaaatttattacgctttgatacttgtggtgttaacagcacgtaccattttgctgctatcttgctttctgaggtggaagaggacggtaggtacaacagcattaaagagaaggccacatcatatggatctggaataaaaactttccggaca

SEQ ID NO: 96280 - DNA, 648 bp, Oryza sativa
aaataccaacgttgacctagattatataagatatccaccaccctatgaaacactcaacggcttgattgtctagatattgtccttcttttcatacttatagctgtattagtttagtttgaccttataagtcgtgattaaaatctcaatctctagcatgcttttttgttgctgattagggtttcatcggggtttcagctgatcttacctgatttaactactttatatcttatatgcttgattgatatgttaaatctgccctttatgttaagatcttgttgtatttaggtatattaagttcttgttgcacttaggtatattaagcttcctgtttgatatattttgcttgctttaatatcttaatatagagtggtatcggagtactagccgatacatgctagatttatctgatcggctatgctgtgaatgcttataatctccttgttaatatatatttcgatctaagtgatttatactgtctcggcatggcgaccgatctatcctaatcacttgatttaagtatatattgacggaagtattatataccattaatagctatagctgatcgaatagatttagttatttcttgcttatttatgactgccgatcaattcaaatatgacattggctcaaagataaatgatacgtcat

SEQ ID NO: 96281 - DNA, 666 bp, Oryza sativa
  unsure (1)..(666): unsure at all n locations
cgcgacctgctgcccgcctgaacatcttgatcttgcggcgctccttctcgagctgatgcacgcctccacccccgtcgcctccttggccgccgccgctgccatccttacagcgctcttccttggccgagccgccgccagagcaccgccgtcgccctgctacccggctgtcaagccgccgccggagcaccgcggcttgctgcccgcctacgcgtcgccgagcagccgccagagcgctgcggccttctgcccgcccgcgccaagccaccgccgaagcgccctcgtcgccttgttgctcggccgcgcgctacggttggcccgccactgccgcctattcgcccgccgctgccgcctcgctcgatgggtgggacttggagagttacgggagggaggtgaggaggtgggggtaggttagtggcagtttcacgtaaatatgtcaaataattaaagggtagtgggtcctttggggttgagtggagctgtggagcanaaaaacccagctccacccccttagttcattttttaggagcaactctacaaactccactctagaaaacttaggatctggaccgtttgctagcatttgctacaggattaatctgctacagggatctactccctccatcccacaataaatatgcttctggaatccaaattttggcctaaaat

SEQ ID NO: 96282 - DNA, 509 bp, Oryza sativa
tcctctctttttttttctttgaaagaatttcgaagcaagaggcataaatgaggtggagtatttattttgtggataatggataaaataaatgatggatgagagatgctagcttccagtgtagaaatttagcataatgtgtgtatgtcgagtgtgcgtgtaatcttgatcatgaaagtacgaaaagcatctcacatgggtcacaataatttgacaaagctcgatgtaatgtcaagcagcatatatatatatatatatatatatatgcttatatatgctgctatatatatatatatatatatatatatatatatatatatatatatatatatatatatatatatatatatatatatatatattacatggcgtctctgacgcgctaggaaatagactcttccctccgtattttccgtttttttctcctcctgccgcacatccctcgtgcactcatccagtagtaaaaaacttacttgcctttttccgcatccacatgcatccatcgtttcccc

SEQ ID NO: 96283 - DNA, 589 bp, Oryza sativa
ttcctgcagccctccacgtctcctcctccttttgacagtaccctccgatacctcacaagtatcatgcttgataccttggtaccaaggtctgatacctagatatcacccggtaccttaggcaccgggcatcaggtatcggtcgatacctagttggtaccaaaggtaccaggtaccaggtaccaaccggtacctaaggtaccaggtactaggggagcacatgtccctcacctcgccgtgcctcctcgacgccatcctccgccgttgcggcgctccctctcccacgtctccctcatcgttaccctctgataccccacaagtatcatgcttgataccttggtaccaaggtctgatacctaggtaccacccggtatcttgggcaccgggcatcagttatcggtcgatacctagttggtataggttccaaccgatacctaaggtaccaggtattatgtaccaggtactaggggagcacagaggaaagaaaaagagagagtcacttaaaatattccgttgcaacggtatccgccctcaataaattaatagtcacgtacttagaatttgggcgagcagtcagcaccaatcacgctgt

SEQ ID NO: 96284 - DNA, 528 bp, Oryza sativa
acagcgtgattggtgctgactgctcgcccaaattctaagtacgtgactattaatttattgagggcggataccgttgcaacggaatattttaagtgactctctctttttctttcctctgtgctcccctagtacctggtacataatacctggtaccttaggtatcggttggaacctataccaactaggtatcgaccgataactgatgcccggtgcccaagataccgggtggtacctaggtatcagaccttggtaccaaggtatcaagcatgatacttgtggggtatcagagggtaacgatgagggagacgtgggagagggagcgccgcaacggcggaggatggcgtcgaggaggcacggcgaggtgagggacatgtgctcccctagtacctggtaccttaggtaccggttggtacctggtacctggtactttggtaccaactaggtatcgaccgatactgatgcccggtgctaaggtaccgggtgatatctaggtatcagaccttggtaccaaggtatcaagcatgatac

SEQ ID NO: 96285 - DNA, 957 bp, Oryza sativa
aattcctgcagccaaactcaagctagggatggtacaattagagttcatggtctacttgaaaataatatgcatgcctattattcttagctcattacttgttgctggtggtgatatatccaatagggaccccatgttatctaggtaattgatgaatgagatatagtctgatgatagaaatcctactcttcatgttgcacacttgggaattttataaaaagaaaaaaatatatataacgatgataaactcctcattgatatttctattcctactagagccataggttgatcagtcatgattagcttgctacatacgctgcttgtcattacattgagcattgtcaagttttgtgacccttgtgaaatgcgtttcatactttcatggtcaagatcacatgcattccacatacacgcacatatgcttgacttctacactggaagttagcatttctcatttaccgttcatttcatccatagttcacaaaataaatactccttgttatttatgcctcttcttccaaagttctttcaaaaaaaaaagagagatggcatggctatgcaaaaaagaaagaaaaaaaagtgctcatacaagtatggagcatgatgatgaaaaaaatagaaagaaagaaaaagaaaaaaagagatagccatgcactctccaaaatttcaaaagagaaaagaaatagaggaggaggtatacaaaaggagttatttttattttcctttttccactcacaaattcatcatacacatacacatgcacattcttgaccagaaagtatgtcttgcatttccgtggatcctttatttgactttgcaatatatgtgatacaagtaatgctctactcttttccataccctaagctctacataaaccttattagatggtaggaaaagaaaaggcacagtcatatgcctttgtaaggaatcatacactttgagtgatcaagagaatctatt

SEQ ID NO: 96286 - DNA, 516 bp, Oryza sativa
ttaggcccgattgagatgagtatcatctgtgacgggctctagtttaggcccgataaaggttagtagtcatctgtgacgggcgctagttgtggcccgatagagataggtcatctgtgacgggctatagtttgactggtcggtgacgggctttacttagggcccgattgagatatattcattcgtgacggccatttgcccgattgagataactcttcacatcagtgacttctagcctgtgacggacgctgtgcctgattgagatggggcttaccgcccgattgagatgagggtatccgttctagtgcctgcctacagcccaggtctgagccaataaaaaatgattctgttttttatgcatggattttgataatgggtggtagtcatatgtaatttagaaaagtagtacatactctgatacagaatcaccatcagatattccattcagataacaatcctaagaattgaacaacaattcacaatcgaaaccaaacatcccctagttcagattaatgagct

SEQ ID NO: 96287 - DNA, 547 bp, Oryza sativa
catcccagctgaggcctgtttggctgtttgtgtttcgatgtggaataggccccaaacccgtccttccgtggaatgcagcccacgcctggatcaattcccacatccagcccaaatatgcatttagctgttcgtgtattgctgtgtattgcggctcgatccatgccgacccacgggtgagagaataatcctcacccgaggcctggaactctctcgcgtgcacgccgcagctcgcgactcctcctgcaccgccgccgctttctccaagccgtccaccgcctcctcgccgtcctgctgggccaccggcgccgccgccttctccgagctgtccaccacgtcctcgccatcctcctgtgccgccggcgccactaccttctccgagccatccaaccgcctcctttttttctcattcggccgtcgtcgttgtcgcctcatcgccggcgtcgccccggcagcctactcgcttgatcaaggttcaaagtcctctcctccttctcctccttcatctcatctcattttctttcccatcttctttcatccacttgttttg

SEQ ID NO: 96288 - DNA, 582 bp, Oryza sativa
agataaaaaaactactgatttgcttccagcctaccagatgaatgatatcttgaaattttaactgtaggattgatcaatacccagatttttcttatatatgtacctgggggcatcacaaactggtcagaaagtcagaatcagaactgcaagaacaagtctatagacctgaccatggaactagaccagaagtctagagattctgagaaattgcatacacgtgtccagtgcctgcgaagtcatgcattcagtcagtcacctatgaaaaccaagacttggttatgaagaaaagtttcagggaagacagactgctgaattctgattgcttcttgctattctttgacaattcgaatcttggggtgtgtttatagttcacgcgaaaattggaagtttggttgaaattggaacgatgtgacggaaaagtttgaagtttatgtgtgtagaaaagttttgatgtgatggaaaagttgaaagttcgaagaaaaactttggaactaaacaaggccttgatcaatatttagacagacagatcacatgagatgtggaacctgtcacggtcagatcagattgaccaatgagatgtgg

SEQ ID NO: 96289 - DNA, 655 bp, Oryza sativa
gcccgtaccataaggggactcttgcaaccataacacgctgtattttatgcgagctagggtatttccgctaatgggcctaggggggctggactctccgcgcggaatgcggcccaatctttttggatcccacaagcgtcctagaacaggattcaatctaatacctaagtcggatttaaccaaagtctgagcaattctactaccttcattatttaataaatgactgtgataactattcaaggggaaaatgataagagagtagtggagaatcggtttttgcaatcaattggatgaggaaacacataaaaatgcaaatcgatatggtggcggcgctaggattcggcccaatggaaaaacagaaaaaaaatagcgaaaccagaaaaacggtgaaagaaaaaacggcgcacagaaaataaaacgaaaaaaaaagaaaacggacgaaaaagcccggaaaaacggtgaaagaaaaagcggtgaaaataaaataaaattggaaaaggaaaaaaaaaggaaacggacaaatttttttttggccgtgccgggcttcctttttacaatcgttttttgccgcaactttttgttccgcttttttaagtaaggataggaatcggtcagtttttttggccgcacttttttttcgccccgggctttttttaat

SEQ ID NO: 96290 - DNA, 718 bp, Oryza sativa
  unsure (1)..(718): unsure at all n locations
agtctgggatgttcccactcagcaactagccatgcttcaccgcaggcggcaggccgtgttggattagacagttctatgcatagtttagtaactgatcacgtcttatgttttatcacttgcaattgatattctttaacaaaaatgtaattatcacttctattttccaaaggcaatatatatatactcttgttttcctcaaaaaatatatgtactcttttattatcgtttccctgcagataaaaaaactactgattcgcttccagcctaccagatgaatgataccttgaaattttagctgtaggattgatcaatgtccagatttttcttatacctgggggcattaccaactggtcagaaagtcagaatcagaactgcatgaaccaagtnngtattaagggnaaatttttccccctttttggggggaaaaacatggaactagaccagaagtctagagattatttgtcccaagacaaataatctggtcattcatgatatcagattcatgctgaatgagcatgaatgatgttcagctgatgtttgcttgggcttttttgatccgtgcatctactgactaccgttagacaacacagcagatcagatggcattgctactttgcttattatatccagctagggcagcttgacacacaagcgaaaaatgttaccatgtttaatttgcctatacaaaaaaaagaagtgctttcactttgatatatata

SEQ ID NO: 96291 - DNA, 609 bp, Oryza sativa
tgacatggtgagcactcaaaaagaataaaatcaacatcacatcacaaacaagaaataagacactcatagcataaatgaagtgcaatatatataaggagcagctaagagcatctaacagtcattacatccacacaactagagaaatattacatgtccacaagtccataagagtagaggccaaaggactgccaggtccggaacttccggataaaatacccggaacttccggacaagctgacaggaatatagagcgagggagctgccaggtccggaacttccggataaaagaaaggggaaaattttccccccccccggggaacttccggataaacagacagagcaggcagcaaacaacaaaaacaaaattttgaccctcttcgattgcaattttctccccctttggcatcaaggcaccaaaaagagacaaaatacaagggaagaagaggatcaagcctcatcaccatctccatcagaaggaatgatctcggtgtcgccggagtgaggtgagtcaatgtcttgcccggcggcgtccactgcctcatctggatctgtaggcacattctctgtaggtgcatcggactctgggtcagggatatcatcaccaccatc

SEQ ID NO: 96292 - DNA, 688 bp, Oryza sativa
tgaccaccacggacatcgtcttaccaccaagccgactcccgatccatcaccgcaaatactatcccgaggcatcgagtcacctacacatgaatcaaacaaagaaaccatattccgagaccaagctatcaccaacttgactcattgttagcaaacaatagtaatacatatgtatagtatccatctagaagtcataaacatgaaacaaactcagatatccaaagaaacaacccgaaaccgaaaccgacacaacgttggccgtcgcatagcaccggtctgatcagccacactagcccggtctgaccggaccccgtaaaatccaatcatctcaaaatccacttcgtagattaactccaaatatcaaaaccaataatcactgatgtcaattgttcatcacaaaaataggaatcaaaacacactttgatcttactggggaaatcgccaccaccgccgctgccgatctgagctcaactcctcgccaccctcgaagctcctcaaaacttctagaagatccttcgtagtccctccaagctatttctgttgtcccttcaagttcgattcccccacaatcgatctaaagatcgggtcgtcgtagccattgctgcttctcaactatctcaggctcctccaggaaagtccaatccgtggtaatcctcctttaatcctctccttctgcgcctgacctattttt

SEQ ID NO: 96293 - DNA, 585 bp, Oryza sativa
gttaaagacacaagattcatacctcttggcttggagaggacaatgttgttcttgacttcttgttcccttatttgattgctgttcttgtgcacaaaatagcaggggccaactattgtgggtcctctgatcctaatccttttgcagcagcagctgcagctccatgcctcccatcacatggcagacctgctacccgctggagcatatgttcagaattcagaacgactggatcagtgaaaagctctgttgagtagaatatcgacttgcgaaacgggatgtcaggcagtaacagttttgacttctaccggagattctccttttggatgcaagcactctttacgcatggagagaagtgtactccgtaagtcctttctactacccctagagtactaatcttttattacggctagtttaatagtatagcctcactactagtctccaaattatctataactaatgtaatagtcaattcatacaatagttgcttactatactattaatacctagtcccatctatcatacacacattacatcttagaattcgtgctgcagctggctacagatctgtagcccgccgcttttctctct

SEQ ID NO: 96294 - DNA, 575 bp, Oryza sativa
taggggtgaaaacggagcggatattatccgatccgatccgctccgaatccgtccgaagtgaggatatggtaagggtctgtagatatccgtccggatgcggatgcggatgcggatagatgcatgcggatgcggatgcggatatggtatcggtaatatccggcggatacggattatccgctattttaaacggattatccgataaacgttttggcggataatccgaatttcacagcccatataaccactcaatttggcccatttgacatgagcattttcatcgtgtaaagattcagcccatccatgtccaccttatccatcaatctatccaggagttcagtccgtgactcaaacgacgtcgcgtcaaccaatttttttatcgagacttctcttgtttcagtcctgccacgccgccacctgacgccctgacttacgtgtggaacttctatgtacttatgtgatactgttttttctaacaattgtgaaacttttatgtcttgcgtgttatgtgaatgcgatatatcgtgatgtcaatactgtatgtgtcgattacatgcttttggacagaagacaaatca

SEQ ID NO: 96295 - DNA, 640 bp, Oryza sativa
ggagggagtatacacgtatacaaagtttgtatatgcctatacaaattttatgtacgtgtatattttttatacatcaaaactatatatatatatatatatatcatattttttatatacatcatatacacacgcatatatatactttatacacaccaaggtttacggtagtgtatatagagtatacgcgcacatataaagtatatacatacgtactccctccatcccataatataaggcatggtcaaacttagcacggtcttcaaaactaatttttgacttataatttctcatatgctataaggtttattgcaacaaaattataatcatcttaaagtacatttaaatgttaatctaatgatattaattttagcaaataaaatttaatttatattataataattgttggtcaaatgtttttaaagttgaatcttgtaatatgagcacgctttatattatgagatagagggagtatatactaatgggactagaggggcaggactgaccgcgcgggtgcagccccgctcggctggtcgccgatcaggcatcccttgcacagctctagatctcatattcaagttggatttaaagtttgtatgttaaattatactacctccattttttaatagatgacgctgttgac

SEQ ID NO: 96296 - DNA, 718 bp, Oryza sativa
ctgcagcccgttaccgatatctacaatacgcacttctagattagtacaactaaaaccctaaaatataatgcattgattcaaacaaatttttaaagaatacacactatttaactcaatagtcacatataggatctatgaatattacctgaaatcggcgtctgaatccggcagggcttcgccccttctctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactgacttttttgcattcgggccccttgccgccccaccagagggcggcaagggttttcctgcaaaaaaccctccctccatcaccgcccgttcctcccatgtttgccacgtcagcttgccaccccagaggtgggcggcaggggctatttttgcaatttttttggtcgatagattatttctgtaaatattaaaaaaaatctaaaaccgaaaaaaattccccatcattatgcatctcaccaattgcaacggacttcacgcaagccatttgctcctttatataatagcaccaaattatggaacgatgtccatctgttctcctcaactatttcatcgtctaattcacatccctcaaccacaaaatcacatatataggccttccaac

SEQ ID NO: 96297 - DNA, 765 bp, Oryza sativa
ggcagtggcagcagaagaacatcgtacgccggtcgctttcccctcctcccccacccgtcgccgtcgcaggagaggacaagtgtgaccaactggtgacacccacaggcacgtttacctgttaccgcaagagagacgttttttcctcgcacgggcacgcgtgcgcgtgacgtttttctcccacaactgctcgactcgatcaagatgacggggctgcttgctgctacagtgttgttgacgcggccccctttttttcgctgctgattgatgcttgcgcggggcgggaaactgaggcttcgtgaagcttcgagacgttggccacaaagcgtcgcatcgcacgcaacctggcccccgccacgaagtgggccgatggcgtcttggcgcatcggctggctggcggccgccgctcgtgagtctcgtggcccctcgagcggtcaagccacggagggagataagaaactcatgatgcgtagacgaggttcgtcaccggagcgttcagggccgaataataaacgagcgcgcaccaaagccggtgcacggctgcacgctggtcacacgttctcaccgcgagcctgtgtgtttaccattcgatcgggtcatgtgtggagccaaaaaatggtttcgatatttagaatattattttaaggattagttttacataagcagctatcttttacattctaaccctttcgaaaacatatttcagaaatggacgccaaactctacactagatattgttgacgccgaagttaaaccgcccacgagaca

SEQ ID NO: 96298 - DNA, 630 bp, Oryza sativa
aaaagtgagaagaatatatcaatatactcagtgtttatctgtgttttccttgagaaaaaaaaacagaaggaattcactacaaaatgaactttgaagcaagatggacgtgattattatgatcaattcatgtataaaaaaattcatgtcagtactcatattcccaaaaaaaaaccaattaattcagataatttatttggctgggtacacaattcagattaattttgtactgcagggattagctaagtccaagctaacataacctaacctacttgtgaaaactaacaaaatgctcaacaagaaacaaaagacaaagaatgttttttttttcaataaaactgggtgaagaggatcactcagaattaatatttgtaagtgtcataatcatctttagatacatacacattaattcactgtaatttctagtgtgaaatatttctcttgccgaaagcgtgcaaccattgcatactgtgatgtttgcgtgcacttattgaccacttttttcccataataaacagcaaagcaaagtgagaacaaatgagcattgtaacttgctccaatatattttttttcttgatggccatacacgccatccttttctttttaatacaaaaaacaagccgtctattttcg

SEQ ID NO: 96299 - DNA, 813 bp, Oryza sativa
cggcagacgcacagacgtccagcgacgagcaggtgggattgggggccccttgaggccttgttcgctagctgtgggaaataatccaaaggaaaaccaacccatgtggggtttgggttgtccccgctccccacactcaatcccttccccccaatccccttgttcccccaatctcctggcctctattcccctgtttactagctgggatttccttgttggctagcagtttggagtagaaggtgggattacaggtgagattagaagggattactaccattcaaattcagcgtgagaaactatcatggaaaattcggataaaatttaaaaagctggaaggtcacgaaagtcaaaataattcagaaatgacaagataaaaaacgatcatgaaaatggaacagaaattcaacgtgcaaaataattctaaaaagcgtaaagatagaaaatcatggatttaccacagatggattctaaaaatagtcgagaatattaaaaattataattttggatagattaaattctacaagcagtaaacatccaattgccattgtgcaaagcaagctacaaaataggttctttgaacgtaatatatctctatccgatcaaactaaataatatatctatgtctgatcaagcaagtgttaatcctgtagaaaaaaaaggttcctgcaaccatcacagctacatgaattaagaagcagttaggaaaaattgtccttcatccatcgcatttcacaattcaagcggtctctatgaactatcttgcaaaagattccttccaatgggcacaactagcaaatgggccatggaactacacaa

SEQ ID NO: 96300 - DNA, 663 bp, Oryza sativa
ttttgcggacaaggccccaataggttgcaggtgggctgtaacctatccctcgtgcaaaaatcgccaaagtgttggattgttcattcaccaataagtaatgtgagctgggtttcatttttgtactttgtagaggtctcataaaccaccatgaccttgctgcttcacggattgttagtcgcctttcctctcaatctttattgggattctaaatatcaaacctaaatgtcatcgtaagagaggtttattcatagtttttattgtttcatcaaccgctatcacactacttgctagctcgttaccctatccctctttagcatttaccatcattgcgttctatattacattatttcccttgaactctcattttttatataattttgaaatttatcttacttttatttcaaattttaatcaatgtcatgttgtgttctgcgtgcatgtttttttaacataattgtcattgcaaacgccaacgctccctcctttcccgcgtgcgccgccgccccctgcctccgtgcgccgctgccgctccctgcctccgcgtgtcgtcgtcgcccagctgcagctcagtaggcgacgaggtgaggatggggatagggttgatttgtaataggggtattttggtcacttcgtgctagcaatttttttctttttcctaaatga

SEQ ID NO: 96301 - DNA, 628 bp, Oryza sativa
atgaccttgtctctatctgtttgtactccacaagcgcttctatatacaccacacaggccgacatatccgatcgtgcactttctatctctaacataaccatgtgcaaaggcctctacggaacttgtgcatgtgatgcatgattggttcagagctgagagattacatagcggtagatgttactatcgccttgaccccttgaatcaatagctattgataatatccagaggcagactagatctgatccaaatcataagtacctacctcatactgaattttctgatctgacacccccaaaatggtagcgctataccaaaataaaacactgccaatctgatgtgcatcgcagcttcttgctctcttgaaagaaaggatattatggctgattcttgtcacactcgcgttagacctagcagacgctcgcattaccggttcataggactcaagacctgattttatgtcatagtccgcgcctaagtggctatgaaagttagatgttacatggcgtgttactagagagatctacgggatgtgaattatctgaccgattatgctaacactgactgatgatctctggcagaagcaagtcatgctgatggcatatctgactctagcaatcttttgcatgact

SEQ ID NO: 96302 - DNA, 665 bp, Oryza sativa
agttgcacgagcatggagaatccaatgactggggcccgaccaggttcacatgaggggatccgggagcaggaaatgcaactgccctttttggatcagtaaatttatgcgacaaggatcacggccatcgcccaatgggctcagcacggcagctctccataaatgtccatgcttctgagcgacgcatcctgcgcttacgacgaccactgaatgcgtcgatgctgagcgactgacactagtactgctaagcacttcaatgaggagaatggattaatggatttgactacggcagtcggcaggcgagtttaaggcagaaataagcagatgaagctagcaggcagatggtacatgctcctgcatggtgtaatgaagaaatcgcccagaaggcgaactccgaaatgttttgcgtgagatctgaacatctctgcaacaaatgagtgcgttttgacctggaatcttagcattttggtagtaatggattagtcaaaaaaaggataaacatgaccctagccaaagtttttgtttgttttttctttgattcaagctgaaatagcatgagaccggaacaaatccatcaaaaagcattgaaaatgcgcgctttcttagctggacttgactaggagattgacgaacgatacagcaaatcagctcagcgaaaaagcagacga

SEQ ID NO: 96303 - DNA, 571 bp, Oryza sativa
tacgggcagaggccggagatgtaacacatttctattatgtaaaaaaaatatacatgtttttattactctaaaagtaaaagctggaaaataaactttgattaaaaaaacctaaaatcagctctaaattaaaaattaaaaattaaaattttggctgatatgtataagaattagcgtaaagatggggccggtgaatccctgctgctgcgcgtacatccaactgagttttctgcgatggacggtgacactgctacgcgagttcagagaagcttgtgaccgccatttttctcaattcagagaaagtagtaattcagcagcagagctgagagaacagcggaggagaagcaaagctcaccaccaccaatggcggcgatcgccgcgcctccgccgcagcctcacccacccgcgtccgcccaccaccaccaccaccatcgccgccgcgcccgtctcccccgcctcgccgccgcctcctcctcctcctcctcttcccgcttccgccgccgcttctcctcttcctcctcatcctcatccccttcgtccgcgccctcaccctccccctcctcctcctcctcct

SEQ ID NO: 96304 - DNA, 627 bp, Oryza sativa
gggcgaattcgagctcggtaccctataaaacatgtacacctcaacaatagactagattaatagtaaaccacttcaatggtatgtctacatgagtatctatagctctctaatccattgcctcgtttttctctatagactatctccatgttagtagatagctttgctctctctctgcatttaatctcttccaagtaggaaaatatgctgacatggatctcttgtagagagcttatagataaccattgtgggtgcccttaacacctggttacacctgtcatacacacagcgtcttggagtccgtgttacagctggctacaaatctgtagcccactactcttctctctccttatttatctccttaaaatatgtttataactgacttatagtctgctattgtacctgctcttagtgatgctctaaggctgtgtttgagggagaggggattgggaagatacgcaaaacgaggtgagccattagcgcatgattaattgagtattaactattttaaacttcaaaaatggattaatataattttttaaagcaacttttctatagaaaatttttgcaaaaaacacaccgtttagtagtttgggaagcgtgcgcacggaaaacgagatgcttttctct

SEQ ID NO: 96305 - DNA, 570 bp, Oryza sativa
gggaaggttcgatcctcggcactagggtttgggtttttggtagtggtcttcgcccgcacacggtttccgttgagttctcgtgtcgcgtgaggctaccagaggggaagaaggtgatgccggagaggaggaagaaagcggcgtgggggcagtggccctgcggtggggaatggcttgctggcttgccggtgctggcacctatggcgcattacaggcagacgcgctcgccaagcgtctcgcgagtgcgagtcatggggaattggggattgtgtgcgatggcggctcagtggattggggaaaggtgggattactgtttgagtctatgtgtttggaggggcaaatctaatccgttgtattttcatctgataatcggaaattcgactgatttaggggttaagaacattcaaataataggtagtcaatctattaatcgttttggaatcaaggggcttgcagattcattcatgcagcatctagcctttttggggttgattggtgcagtaccagccataacatgtcattactctgatcttggcttctggggataatctagagtcgacctacaggcatgca

SEQ ID NO: 96306 - DNA, 848 bp, Oryza sativa
tcatattatctattatctagggagtaaataccataaaaatatatttcctaaagaaagtgtattatagaaaaaaaaactaactcgacacatatactctttacaagttatagagcatgctgcttagaaaatatctaccatacaacactatcgagttagtgagaggaactatttctacatacagttggaaaaggaattgaagaagatatttccatgttttttccctaatattagctagtgcaaacaattcttttaagataaaactgatctcatgttatcatttctttttggagtttagttggacaagttacatagagttgtcttgaatgattgtgatgtgttggtggttggtctggtggtttagccaagccaggaagtccagggggggcacagggctaggagaccaggaccaccataagtatggctcaagaatagagattgatggttcccaggcctaattacctcatgatgataaattgaatatttgaatttactagttatcattacaattatgaatttcaaatctcactgattgtccatatctcctttttattaaaaaaaaacttagaaaacccatgctcccctgtcatggaaatatgttatcgatatattcatttttttcgaacgcacaaaataattgcacgtcaattatattagaagaaagcagagtgtttgatacacaacgcaatcagcccaacatgcttatcgatatattcgtaaagccgagaaaatcaagacatttgaaaattaacacaacggctcaaattaattagtcaaatgttactatatctgatatttataaacaatccaggtagtagcatgtaattagtgggtgagttgaactttattaa

SEQ ID NO: 96307 - DNA, 1770 bp, Oryza sativa
taaaatttattatattacaaaaataactaaaaagaactcaccacatttcgctttgaaggctagagattctcgcattaataaaacagataaatatttaaacggttagattgtgatgggttcaaattataatagtgtaggtggattaatgcagttttatgcaaatacacagttatatctaattttacttttaacataagagtcgttgtatatgaaatccagttataactttaagttttattgtgagaaaatacaattgaatctatagaaataaaatatagagttgcatatcaaaactaattttacttcaattaccttagttccgcacaaaattgcacaggatatcccctagtctaaaataatatatcagttaccaatgtttccgactaaagtgtatagacatcgtacattagtaaatcacaaatatgtggcaaacatatcaacactcacaatgtaattccccatagatcgagtgaggggatgaggaaacatgggcggcgtgaatggattaaagcgaattagtttacatttcttttttatttgttttgagtgtaaagacagatgacccttgtacgtaagagagtagagttgacatttcaaattcaaattttttacatcttaaatttacattatacgtgcgggtaatcggcatgcatgtatacgtacgtgccgacattacaaacctttgttctcactttgatgtttaccggtagtggcgttgcatatgctgcgtacaacacgacaccaatttttttgtaacgaccactgtttttaatgtttcacagcataacacagtcacatcgctctccgtgtgtcgtgttggtttatgaggctaaattaatatatgtttcgttcgtcttatccgatcaatcacacgttttcctctctattaaattaaaaaaatggacttggttttctctcctatttttaaacgaataccattgttgtcccagttaaacgacaagaaaacggttccttcaagttttcatactagtatacatcaaattaagtagagataaacttggttcctgcaatcatgaagagtgcaaccgcatttctccttgtcatttgttattaaaaaggaaacaccttccaaacaatcaaaactggaaattttcacttcggtttgatgtgaatgccaggttgcttctattaccaatctacgacttcatcgtttcgcttagtcagggaataaacaaaataacatatttgcaaatggaaaataatttgtgaatagttatatatatgtgtgtgttcttagcgatttaaaaacaaaggctgaaaaataaactttgacgaaaaaacctcaaaatcaactctaaatttaaagttgaaaattcaaattttggctaataagtataagcataagtgaaaaaaataagactgctatacatggccatttttttaaaaaaacaacggtctggttgaggttgtacacatgaacgagtggaactttttttaaaaaaatggaatagtatatcacgtgctaaggagaaagagaaaaagacaaaagcgcaaatggagggagtttaactagttggagatatatatacagaaatagtttccattttgcagtcaatacaaagggtaaaaaacttgcggcctcgcagaaaaaacctgtgtaccagggctaccagcttcagattaataaatcattgaaattttcttttctggatgtggattagccgcgatgactacttagggcaagaaaacatcgggggcccctgtgacacggagcagttaataagacagcatcatcgtcctaacttcttg

SEQ ID NO: 96308 - DNA, 500 bp, Oryza sativa
ctattaaaattcctctaagtagcaaaggccgtgttcgattattagtgttagaaactaaccctccagcacgtaaaacaaaacggttcattaatacataattaattaagtattagttatttcataaaaagtgagttaacatgatttttcaaataactttcatacatatattttttttaaaaaaaaaacacaccgtttaaccatttgacaaaagcacacatgtgaaaaacgagagagataagtaggaaaatacgatgaggaatatttcctccgtatcaaaatataagtatttttagacttcgacacggttctaaagatgcttatttgacaaacgatatttataaaagtaaaatattttaaataaaaagagttacatactgtgatagtttatttaatgataaatctagtaacatcaatttcttttatgattgatcttttttattttttttcttattaataattagagttacaaatatttgacttgacactatgcttaaaaaata

SEQ ID NO: 96309 - DNA, 502 bp, Oryza sativa
tgttatccctttctattaacagagttagtttggatgtaaggctatttagaaccaccaatttatggctaaaggcaagcaagattcaatctatacttgacatcttcacttttatatctcatcccccgtttctcctgaatggccaccacgggtagggcgtagaacaggctgccgaatactccacctcctgtgtcccactcatacctaatttgttcgctcaccggtgctcataacatatgatgtgcttctactggttgtataaggaatctctatatgaaggtcattaaatggaacccactattcagggaaaaaaaagtattcaagaatgttttatgtaaggtgtttacataataggcagatcacctctccgcaaaattgaaggtcgcaaagcatgtatggtatttaatataagcggcaccaacatagtgaaatgcacaaaacaacggattgtggtgtaatgtgaaaaatatcctcataaatcacattgaaataatgctttatatcc

SEQ ID NO: 96310 - DNA, 598 bp, Oryza sativa
aaagattccaaatgaactaaagctcatacacatgtcccatcctacagcaatgggggacctaagaataactttctttgccattttctattgggttctgggggttggctttaattagagccatatatatatatatatgctgctgtttcttttcaaaaagctacttatgctgcagtggatttcggttgaaaagcaaagtaggctaatatatttcaaaatgcatgaaataccaaaatagtctgcctattattattatgcacccatgtatagtccaaaaaaattacataatttctataaaagtggaggtacaaaatatgaggatgtgactttttttcttaactaattcattcttttcattcttaagtgtacaaatcctctcctccaaaactctatttataggcaatgtcttgcccacattacatattagtgatgggccaaactagtgggtaactaggctaaacttctacatgccagtggttttctaacattttcccttttctaacattagctctcactgcgagatgcattcgcctcatcaaaactccgtaaaaccccactgagaaattttggagaaaaatgagtacatcgcatatgtttgtaa

SEQ ID NO: 96311 - DNA, 564 bp, Oryza sativa
tcattggtcctacgatttttttttagtatacatgtgttgatttttaggggatttttttggagtatatatgtggtaatcgatttttccatacaaccccgttcatgtctcacctaaaaatcaacatgaccacatatatactccaaataatcgtagcatcaacgagcacattgcacacatttaacactacaatcaacaaatcccaatttgcaacggtcaaaatcacgaaatttgcaaaaaataaaaaattggttctaagggttaccctccgatctacaaaattccaccaatcaaaacgaaaaaaaagaggccacaatggaggagaataccttgctcttcgattagcccaaaaaatctcatgaaaaacggctccaaagtgagtggatttgaggaggtaagggaggggggagagagagaaagcgcaacagccctgctcaggctggggaggggccgaatgggtgggtagggggagggggtggggcccgcgcagttaagtgttgcccaccccccgaggggagcgcgccggtatggctggcgccaggggggtggggggtgggtggacggggc

SEQ ID NO: 96312 - DNA, 541 bp, Oryza sativa
ccttcgatctgccaaggctgaataaagttgtcctcgatgagcctgtccatttggttaaatttgtgctggttctttattggaactagaccatatatgttagaaacttttggactctggtcttgtctttgtctgttaatggatcttgtgaaaattgcatcagctggtccatctaacatagcactgctaccataaagatttacccttaggtccgttgtcatcaaaacttcaagttttttttattaatatttagtaatgtgtggttttctttacaaaattctatctactggatgcctttgcactaaaattgactatttagttatttaaaatcttggaagttaaattctgattgaagtaacatgcttggattctatataaacaaaaaatgcttttgaaagtcaaaataaaaatgcttgatgcttggcaacttggcattatttgttgtggggttctattaggctacattgtgagctcatgggttggacttctttaacccatgtttaccggagtaataatcacatgaaattcataagttggccatgag

SEQ ID NO: 96313 - DNA, 513 bp, Oryza sativa
accaacggtcaatggtggcctgattgagtttgcagttttatgtatatgtatatatcaccaacaaaaatgtcgttacaatgaaacagatggatggttggttcagtatatttcttttttttaacaaagaattaatagttcagttttacccgagtgtcagatttattactcaatacaattcttataaaaaaatcctttagttaattgtcttgcgcactgcacatactaccaacatttggcaatttatattggtatttcctttgtattcacaccacaataattcgtgtagttgctactgtctaatttgttatactccgatgcagagttatattttatctaatgttatattttattttcctattactatttactagaatatgcaagggaaagaggaatcaataattaaaatattgatatggcaacttgcttcttgctggtgaataaacacttgaacaattctagcagctaacttaggtgcggtcaatcacagaatatttgttattgatcatatagttt

SEQ ID NO: 96314 - DNA, 520 bp, Oryza sativa
ataatgcaactgttagaacacaggcacaaatttaaagcaaaattaaggtaactctaatctggtggacaatgtccatgttaaaatttacataaataaaatgtccatgttaaaattggctcaattgaaaagcaaattaaagaagcccaaatagagagctccatattctacttttctgtaacaagtgatatcagagcattttaaagaagtacggacacaattaaggggaatgctacatgacaattaagaagatgtacatcagttaagtccagctttgcgatggaggacgccagttggatgaatccatgtcgcgcggccgacctagttgccgccgaggccagtggcgttcttgacggcgtcggcggcgccctcctgcgcggcgctcgccgcgccgtgcgccttctccaccgcctcctccctcctcgcctgcgcgtggcccgccgcctcgccggccttgtagctgagctggttggcttggtcggccatggcgataggggtaccgagctcgaattcgccctatagt

SEQ ID NO: 96315 - DNA, 533 bp, Oryza sativa
cgagctcggtacccgcacacatgaagtataaattaaatgcaatttatcctcaaagaaacaatttgaacctggacctcattctagaattcgccagtttccacacgggcaagttaaatagttagctgactgagattttaccctatccaagaagaatatatggacaataatttacagtattgctcttcaggtgtcttaacagaagtatagcttgtactagtatgttacaatattagatgctagttcatatgtaagttaacattgctaacataagccatagaatggatgtggatcctgctatgcactaatgcacatgctacttccattcaatcagccacaatttgatcaaacaaacgatcatcaattgactgcagcaacaaagttatacttcttatatcatcaaacaagttcttttcttcaaaatggaacatatactatctagaagacccctctggcctcccctttgctctcacaaggcagctacctgcatcctacatctagtttcaggaaaaacaaaaaccaagcttagcgtatca

SEQ ID NO: 96316 - DNA, 518 bp, Oryza sativa
acaatctggattctatccgctcgttcttgcatgtttatgaagtgacatatcacatattaatctactccctttgtcccaaaatataagcatttttagctatgaatatggacaactgtgtgtctagattcatagccaaaagctgttacattttgggacggaggtagtatcttatcaaatttttttcataactatttggatgacatacaagaaagagggattaaaaagagtttcccgtaggttcacaaattttgtaactctgaacaggtaagtcatgacaaattatcagatgctgtatttgcttaaatggtcactttatgtgttaactgtgaattttattcaggtctataaagcactatagagggtaaatataattttcttcctttaattttaaaaaaaaaccccccttttttctatcgatgagagaagtttgactaggacaaactaaagaccttgaatttgggaaggagggggatttctagcttatgtttcttttttctggtaatgctcaataacatctg

SEQ ID NO: 96317 - DNA, 1256 bp, Oryza sativa
tccccataaaactctatactccattctttttaaacttggactccaatccaaatccaagtacaagttcataccaatttgactcacatcagcacacaatagtatcgcatatgtatagaaaccatctaaaagtcataagcatgaagcaatctagaaattccatgaaaacaacccgaaattgacttcaacccaaagtctgttggtctaaccgtcaggctacccagtcagaccgaatcaccaacagtctaaccagcaacacctgtccaatctaatcgacctccaagagccgaaagaagtaattaacttcttattccattatgtaacgaacatggttatcatgacataaaagaaaaactaattgactaattattgagcttcatataacattctcacatgttgcacataaatcacacatattgttggttagtgcgcatatgcatcaatgcatgcatccaagatacaacattacagcatttctccttcggatacaatacttaatttacactatatttctccttcatgcttcctgcaggggtatagtagacaacatcaaaatgcggtgttgctcactcactttaagagagagagagagagagagagagagagagcattagcttgctcgagtagtcccttgacaactttacaacgacaatatactgtcgttgttggatgctgccttgctagctattgccagtaaaaacagcacgcctttgaagagtgaaaagtgcttcctcttttgcccttctacatacctaggagaaagtttaatactatagccaactattggcttcaaattatctttagtcaatttaatagctaattcatataatagttacctatcaatatatactacacaatcaatatctggttacacctgccatacacatatgtatcttaaagttcatgctacagctggctataaatctgtagcccactgctcttttattatctcaaaatatgtttatagttggcttatagtctactgtacctgctataagacgattagcctttttttttatcttaaggattaaagttatgataaagcaaaacctagagtgagtacatgctcctttttttcttttttttagcctctcccatgcagatgcatgcgtgtggtgttgtctgccattataatactcatagtatgtagaaagactatataagatgttggctgttgcaaaacaccttttcatctccggtgcgtgcgtgtgtgtttgttgctccgtgtggggaaagattagctagcaaaaactcactta

SEQ ID NO: 96318 - DNA, 591 bp, Oryza sativa
cagtaagaaaagtgagcaagtaaattaatcttatttaaatttgcctcaagaaagtgactctattgatctgatcaagtgatcgatcagccgtgttcccatcttgaagtatcaccatcgagaattggtattttgagatccggggtgtaaattaatccctctatgtaacattgaccgcgattgaatctagcgatatcgacgagtcatacctgtttttctacggcatttccatgaaaactaaaaatcccagaacatattttcctgcaaccatagagttcacgaagatgatcttacagtggtctgagttgcgggacgaagcctttctatattaaccctaacatgatagtttatttttcatattattttttgcctttttagtctcttttttagtctattgttagcctgttaagtgatgtaatggttgtgtgcattcctcgtttatgttaaagagtcacaacttctcttattttttaaaaaataaaagcatgttgtcagtattacaattacatgttcccatccacacttataattattcgaaatagacaggggttagtcctaaaatagacagagcacgtcacgtggtgcaacagccct

SEQ ID NO: 96319 - DNA, 526 bp, Oryza sativa
attcctgcagccccaaggcgaatgtggctattccacttctgaattctgttctctttggatttgtttgttgactgaacatccttgtcaatagagaaagaaacttcctgcataatggttccagatattcaatttggaaaaaaaaaacgatgcctaacatgcttatgatccaaacggagggaaggcttgaagaaacgagctgggatatagatttggaagtttgttttaactttgattttcagatttttttttatcatagtatatttcttattgattttgaaatcgctataagaacgtagacctagagaattcaagattttggccaacagaacgtcaagacgttcattcgaaacgcatgaaattttcctcaatagccttcgaaacgcatgaaattttccagtatcttcgtagtaggtttgatcagttcctaggaaaaatatctcccttaaaaaaaagaagaagaaaatcctcgcgtgcaaggagatgcacggcatggacggacgcgtgatcgccgtcgacagggttagca

SEQ ID NO: 96320 - DNA, 532 bp, Oryza sativa
tattgaattcctgcagccctcttgtaaccactaggctacaggccctttcgctaaaaaatgaccattaaattaacatatagctatgtgaaagtgtcgctcaggaaaaaaatattaatatttggtatatattatactatatgatatataagattttgagatttgactgtacatttttcttataataaattatatgtttgaaaaaggagagagtacaaatgtcataatgcatttataacataagagagagttcttattttgttatatgaaatcaaacagtacctcggaccatcacctactgtttttattacaaagaaactgcatactggctagaaaaaagtgtgcataatttaataggaactaaaaagcaattgttaaaaccaaaccctaccttaactaatccatcatattttctttgattaaggaaaagaaagaatatctctagttttatagtgttggttcttccctcgtctacgtactcaactactgaagcacaaatggtcgttgtcaagaagagttaaacttagcagttaga

SEQ ID NO: 96321 - DNA, 502 bp, Oryza sativa
ccacatatttatcctgtatatatacttatatagttcatccccactaaatatagttaatattatttctctcttctcttattaagtcacattaccttaattatttctagtcttttaatgatagatatatagttcaaattgtcttttctttcttctctcttaaaaacatgcaatctcaattacttttagctcaaaattatatcaaattgttttattttgtacgtattatgtaacttaattttctacagcaacgcgaccagatgttcatatagtatcttataaaagtatgagcagtactagaatactaaaactggagaataccgaatgtacttacttataaactgtaggggaaattaaagcacttaaaaaatgtcctgaatttaatcatattaaacatttatataagcatctacgtctagttcataaaaaacgcgttcgcgaaaatagttcatataaaaagacctatccccaaatttatttattctttttaagtttttctcccatt

SEQ ID NO: 96322 - DNA, 543 bp, Oryza sativa
ctttccccatgttatcctcttccttctcatccccaacctctcgttcaacttcttctcaacgtctccacgctgcatacgcggctacggcgtcatcagccggcgccggtgccgccaccgccgctgtagacggcggggctgccgtcgcggatggccggattctggtgtcgccggcgacgttcatcagcggcgtcgtgtggcagacgcggtggccgtgttcctggtggcactggcaatggaggcgtcgggcggcgtcgaacggcgacgaccgcgcgccgctgttcttcagcttctccccgacgacagatggaaaaggaagcgtagggtggtgctcgtcgccggcgaggactaccatgcgctcgagtggtggccggtgcagcagttccgacagcgggatgcggtgagcgccggcaaccacattggcggcaacggggcagcacgacggaaatgcttgagacgccattacctgagagggttctgagctcggcgacgaaagtgaagaggctgcacactacatgttttttgttgcacatagtgtgttcctga

SEQ ID NO: 96323 - DNA, 591 bp, Oryza sativa
gttgttttgaaaaatgccatcctgagaaaactattaaaatgtgtttccgttaataagccttttgtaaaatgaacacacgagttactccagaactcaacttgttttgcaggtgcaccgatccatgatttttcgtttgacgatctcgtccccacggaatgatgtactttcatgagtgcaatgaattcatacaatgattccctcgcggacatcatctgtgctgactgccgaggcttttggtggtaatgtcatgaatcatgaagatccaagtggcgtctcttatgagtttatccagttcattattcagtctaaaggcgagctaagttgctttggatgagaccgtatagtttctgggaactgaaatgtttgttcatggggtgaaggttatggcagaagcactcgagtatttccatgtagggattgtcgtatatatgtaatcttttgaagggtaatcagtgatgtaaataataagagtggcataaattttatcaaggagtattaaattgattgtgctgttttttgggggatatgcgacagttctgatagaatactgttgaaggcaatgaaatgcaagtcatcttacacaactctgca

SEQ ID NO: 96324 - DNA, 688 bp, Oryza sativa
taaactccgtaccgttcgtttttttcattcattttaattattgtccgttgcaggcttgcagcagtcacatgagtgcgtataaatgcaccgatttcaagcccggtgctattaatcaatagattcttcttcactgtggttcgacaaacaatgaaactagtataactatagtataactaggtgattcctcacgctttcccgtgctttgttgtaaaatttactaaaaaattctcaatatgttttttttacaatcaaactaggattacgaagaaaaaaaacaaaacattagggtttatcagtcaaataatactcgtgctttagtgtgaaacatattgataagtatatgttaaatattgtaaaagtaatagatagatttgttgaaatattgtgcaaatgtatgacggagacggatgatggttggatgcttgtattttgatttgtataattaaataaattgtagatcatttgtatgcttgtatgagattaaatatataattattgctagtgggtgatgatgtggcatggttgtatattaagctttagatttagtgtgctttaactttacagaaagcatagatttcgtataaaatatatgttgcaaaaaagcgttgttcctgtccatgaggttgtacctcgcggtacttgtaaaaacacaaatattaaaaaatgatctaatatcaaataattaaaa

SEQ ID NO: 96325 - DNA, 554 bp, Oryza sativa
ggcgggcgggggccggatggcggcggagggcgagagggcggaggcgacatgggacctaccgtttggccggcctcacgcgcgcgaggctggcaccttcgcctccaatgaccaacaacgagcccacctgctacgtacgccgccgccttatcatcctcctccagttggctcctcccctcctgtgagccaccggcaacgctgccctagatgtgagccgccgatgctgccattttcgattggggtggggcagggttgaggatcgggggaagagatggagggatggtgagagagagaggcgccagcggtacggagctcggcgagggagctctagggcgcagggctggctatgatggggaccacggtgacgtgggcaggctggtgcacctgttgctcccaaggctgcggcgtggtgttgacctctctgccgacgtcgccgtctccgactcctgtccatcgaccgaagtggggcggagcggcgggcgaggaggatgccgccccctgctccgggctctccttccccctcataactcaccaaccatgaagctcgtcgcctgtag

SEQ ID NO: 96326 - DNA, 582 bp, Oryza sativa
taatgccaatacaaacgccacgtcaacaccacgtcggacggagactaagtcaacaccgccatgtcagcgaaaccgccctccaaaccacccggggagtcaaaattgcaccggttttaatagtttaggggtcaagatttctggttttacggttcagggttacggattagattcgggtcactttaagggagttaaagtgaacttatttctaatataaacgatcatgaaagatatgcatctattgggctgatccaatcagtgtgcagcccattaggatatatctcctctcattatcggtccaattgaatcctcagcacccagccccacgctccccaccctccagtctatcaggccaactagctcaacggggattgcctgtacctttattgtgtaattatagtacaatcacaatacaattagattgtaatttttatgtaattacaatgtaaatgtatcttcaactttaaaaaattttctccaaaacatgttatttctatgaaatgaaggttgtggggactgaggtgtgtttggttgagctgtggcttttgaaaaaatagctgtgggctgtggcttttcgaaaagtag

SEQ ID NO: 96327 - DNA, 537 bp, Oryza sativa
agtttactaacaggactataattcgacaagctggtgtgcttattcttgtccgtattgtcattgacttgtcaacaactagttattgtacatgcatcctatgaccacttagattattgcaacaagtacttgtcaggcccagcttgcgcctgtaatgtccggaatctcgataaatttatcccgtatatagcgcccctacgtcggccggcccgacgactgtaatatacagtcagtcaatggtttcaccaataacaatgtatggtatactgacgtttcccgggaaaaataaggctgatgcaacggagggtaaaagggtcccaagcgtgcccacagccacaggaaactaagagcatcccaacagcattccaaaatttcatccccaaaattttgttttccaaaatcctaaaagaaatttaaggtgtgaaaataatcatctctccaagagatgacctataactaattctctataactgaaaagtggaccctataaaagctaccaacaaaaatctgtttcctccctcctcccgcaagtgatcatgc

SEQ ID NO: 96328 - DNA, 631 bp, Oryza sativa
aaacacagcttttctaccacacaggcatggatttttctcagacaagtcagtcaggtcaccaaccaaacaagcccgtagtctctggagggagcgcagggattggagcccccatcctcctgtctcatcctcctggctggggggaagagcaggacgagcaacatctaagataagctccgggcatctgtagagaattagttgttgtaaaaagttggagaggtgtgctgggaagatcagcatcccatcgtcatcttcttgatccatggctagctggggtaccactccctcttcctccaccagatcctctgctacttgctgctgctgaatagattcgactgcttgtgtatcctccagctcaacagcagttgtttgctgctgttctacagctatacacatccgtgtaatcttgttgcagttcataagatacaactctgagagctttgggagatgagagagaagctgtgacaatgctttcccacttccatggtgctagaaatagataggtactcaactggaacttgcacttatagtcactcaaactttctgacagatggaacacgacacttgaactatcaagtctgagtatcttcagtgaagtcaacatttgaaggtaacaccccgccaaaggtgggca

SEQ ID NO: 96329 - DNA, 594 bp, Oryza sativa
catctagcgtggaggaaaaaggcggtgcttccgaccacggccgattcgaatgatccagtgagaaaaaaaaattccaattatttcaaggggaaatgctcatgagggtgagaggatgcaatttgtggaaataattttattttggttgagggaagatcgagtaatcaacgttggaacaggacacatatagatccttccattcttctcttccaataaattgggattgctccgctgctgtctgggcaggaatgcagctcgacattgttgccttcctgtcagggtgaagcaacaggtcctcatggaccgtgtacttccatctgtggcatcggcatgtgcccagccgaaccaactgcagtaccaccattcattcgagcttgagaatgtgcagacgtgcagatggtcgagctcgtcagcgtgctgacagccacaagctcgagcctcgaggatggcatccggttggcgttcattggaggaggaagaaaagaaaggagaggggggctggaggtggaaaaaagaaagggcaccggctgtatttcacatgttttttttaaaaaaaaagaaaaccgaggagattctaccagagttgtggacggaatg

SEQ ID NO: 96330 - DNA, 660 bp, Oryza sativa
aaaaattctatataaaagttgcttaaaaatcatattatctatttttttaaaaaatatagctaatattcaattaattatgtgttaataagctacttcgttttacatatgtgaggggataccatgaggaaagagttatctcctagtgttgtatatattggaaaactgtaattttgttttgtggaccaaccgactatatttcttctcaatatatttgtcaacaacatagacgaagtttttgtccatccatgtaattatgaacggccagaacggatcaacaggctaaatacagagtacttcatttgttctaaaataagttaattttaggttctactttttatcctaaataagtttactttttaatctatctgtcaaaagatgagttttattccttcaataagcatacccacccatcaatatttgtcgaaagatgagttttatttctttgatacacatactcacccattaatatttccttttcgattgatgaagaacatttttattttttttcacttcattttaatttgtgtttcaatagctaaatgattttgctattcctctgtcgcgtgattttttcttacgcctcactcgcttttgtggtcgttagatgcttagctgttctgttaatccctaaagccatactattttttatttaccatattt

SEQ ID NO: 96331 - DNA, 595 bp, Oryza sativa
ggccaacaatggatcaaatcgtaaaagatctcatggtatacgacgatgaagattatcacccagcatacttttgaccacttgtaatcagaatatatatatatatatatatatatatatataaataaagcgagcaaaggcttagtcccctgcccataggtcccacgctattcttagaagaaaaaacagtaccaaaatgcaaatatgtcattctgtatcatgtgtgccttacaacatgaaatagaaatgttagatatattcttttcattttctgccttgcatattttgtgtgtacttggcattttcagatgcagcctagctggtatgggagattaactacatggctataaaaattcatttcatgtttgtgtggtacaaagtatgtcctttgcgctattttgtctaaattctctgggttttctgaggttgtataagaattttttgtttattgactatttgtaaaagaaaagaaaaggttatgtaacttaaacttccagacatggatatacagtatagcaacattatatttgtcttctagtttgataaaccataagccacataacaatctcatgaaaattttagtgaattttgacaaaca

SEQ ID NO: 96332 - DNA, 658 bp, Oryza sativa
aaaaatatataataaaaataaaaatatgttcaatattaaatttgaatacaaatttcgatggattaatttaggcttggtgtattgtgacaaaattaggggcaatagtatatttttcctaattgcaaaataccctataaaatcaaaaatagttggctagcattgttcattagccctctaggtgtttgatttggttccctaaccaccacccctcctctgccgcgctccccctcaattctcgcgccgcccctacgtgcgccgcgacgctgccgccctctgctgcgccgctgccttgcgccccgcgccgccgcgcgccgtcttgtcaccgccgtcgccgtcgcgccatcgccgtcgcgtcttgtcgccgccgccgcaccgcgcgtccccattgccgctgccgcgccgcgccgccgtcgcgtcgcctcgcgcctcgcgcccgcacgccgctcgcccgtcccgtcaaccgcgacgcgagcctgccgtctcgcgccccgcgccgctgctgtgcgccgtcgccgtcgcatcccgtcgccgctgccgcgccgcgcgctgtcgccgtcgcgtagccatcgcagcgcgccgcgagccgtcgccctcgcgctgccgcgccttcgaagccccgagccccgtgctgccgcgcgccgtcccatcgccgtcgcat

SEQ ID NO: 96333 - DNA, 689 bp, Oryza sativa
  unsure (1)..(689): unsure at all n locations
caaaangggggcgaagaacaganccccgcgaccgggatattttattgagacacgaaccggcacaaaactttgttggtttttaaaaaaatcgngaaacccaccacacaaaagcccaccattttncagtgcggcagaaaccggttgcattgtatttttcgatgaattgacaatgtacatcctgatgaaacatacactaagatcgggcgacatgagaataagaaagggatcgagccatcgaggagaccaagaaccatcaagaattgaaatactattctcgggaaaccgaaacaagggtgtaaaccataggcaaccgatattcccccctgatgactgagaacaacccgactggtcagagaggggccgactgagaaggtgctcgggacacacaacagccaaatcccaactaactcacacaaattgggcgaacgggacctgggcctctggctatcaaggagaaaggcgcaagaccatccccttaccgtggaaatgggttataacaaggaaccgccgcggcaaagaatcggtaacttgggaggacctgaccaaacggcacgaactgcacagggaaggggctcctccacaataaaagctcaccccccaacatggaaagagaagcccaaagatatggggctgttcaaagcaacccacctagctaaaaaattcaaaacatttaacaggagcggtgttac

SEQ ID NO: 96334 - DNA, 674 bp, Oryza sativa
gtgtcctgttccaacgttgattactcgatcttccctcaaccaaaataaaattatttccacaaattgcatcctctcaccctcatgagcatttccccttgaaataattggaatttttttttctcactggatcattcgaatcggccgtggtcggaagcaccgcctttttcctccacgctagatgcttagtgcgcgaggaagtccaacagcttggcatcaaccatgctcaatctaacagctccgtgctccaggccatctcgcctccacgggaccatggttccgcccttgtctctttctccctgagatcgaactccactactgccgccctccaacatgctcctgcagccaccctcgagttcgctcccgcagccacaatagaccgtgccagctgccgctgctgagttcatcgactacaccatcctacacctcgcctaccgctgtgccatggaggatgaagaagacgtaggggcaagggggaataagtgacggaagttctaacggagtgttaaaagaagtaacggagatcacttttgatgctattgaagtgaaccacaaactttcgatgctataaaaacaaaaacaagaactttcgatgctatagaaccaattttaccttatttatatgattcatgttatgacagtatgatacttgtgtgtttgtcagtatatctgattgt

SEQ ID NO: 96335 - DNA, 739 bp, Oryza sativa
cataacttcaaggggacaaggaggtataattttgtgtgtgtgcatgaaaagtaaaggggaacaggatgttggtgaacagtgataatgttcccacgttgaaacaggataatgtcccgcactgaaagaatgagatatttatattgatgacttcacagatggagcacttgtgagagatgaagcagaggccaaaatcttcaatgcataagggtactccaaggaggtcacaaaaatcaaggactgagaagaagaagactccaggattgctaacaacgttgacatccatcttttccttggttggctctagctaagggaatgacctcagcctaatagagtgtgtttttctcttcttatgtaattcaggtcttcctgaactagaaattctcctctggtatcctaaactatgtgtcctcactgttgtctctgttctgtaaaccagaatatccctttagggtgttaggaccctcaacattctttgtagaacagtttcttcatctcagtctgccatttctcaaagtccagattttagataatggtgtaatgctaagaatatctgttttttccagttctcccagaaaaatgcctaggcttagcaccagattatgctgtttgatcctgctaaaatactgatcctttatctcttgaggcatttaaacccttccctcaagactcaacataaatcctccctctatcctaacacctattcacttcagctcatactgctggaaagccagcccccaag

SEQ ID NO: 96336 - DNA, 534 bp, Oryza sativa
ttgcctggtttttttttttttgtgcatctttcagctctagaaccggctggcctgcaggcacaccagtagtgacttcacatctttaatctgctagtgctagttgtctgagggtaaggtttcatgctcaaccgctcaaacaggacctgcaatgcaagtgtcgtatttttcttctcacattcttgtaacataacatcagtgcttggacagcatcgaccaactggtctttcttctcccttgcccggtcttggatccatggatcgttttcctgcagctttctgatcgatgcaattaagcttgctttgccttcagctatcgtcagtgcttgactgaccatgcgagtataacgtatctgcctcttcctggtcaatatcgttacctgccatggacaaaatgtaaaatactccaggaaaatccattatatatctatatgatacccacaaaaccttatttttggggtgtactcctaatcttattgtatactccctccgtactcataaaggaagtcgtttaggacagcgacacggtttccaaaac

SEQ ID NO: 96337 - DNA, 642 bp, Oryza sativa
agcagttaactagttggtggctaatcatcccctgaaacctctgacttgttttgcaggccaagttcggcaggagattactagatgtctgagttgtcggctatcctgaactgggtaggcaacttgctgcctggcagctgtggcccattatcaagccatcaagggatagaagagaccatgagggtcttgcttcagtgagagatgcaagagggagcaaggacatgacagcgagaaatgctgttgcctttgcaagcccagaggttggccctgattctgctcctccagtatcatttgccagtccccagcactgccatccaccagaggaagctgtcaagttcacttgccagatactagttagtttccaacccagatactagttagtccccagcactgaggcagatgtgtgatgcctttgttggaaagctggtgatcccagtggtcttttctcttttgtttttgtatgaacttgaacaactttgggcttgttttcaaaccaggttatataattacctgacttcaacataaaaaaaagtaacttcacgaatgatattattggaccatctttgtaataaacaagtgaactctgactaggcttgtccgcaatccagaagttggaaactccattaacaaagaatccatggatcc

SEQ ID NO: 96338 - DNA, 3230 bp, Oryza sativa
atatatatatatatatatatatatatatatatatatatatatatatatatatatatatatatatatatatatatatatatatatatatatattctccattatatatatatataaaattcttccatcccttaaaaaaaaacttaacgtggtactagactgtgatacatcctaatatgatgaatttagacatgggatatatgtcatattttaatactaagttaagtttttttttttttgagacgaaggaagtatgtatatatcctagataggtagctatatatatatatatgcatgcgtgggtgattgtgtggacaatattggcaggcaaattaacctagctgtctaatatgccaagctagctagctagtgtacgtacatgtgtcttagtgattgaacctgtccaacgatcagagccactgagatacgaagcagtagagatatattagctagatatagccctttgattaattaattacatgcatatatatgtgaatgatttgtcaggaagacatacattacattagttgatcgatcgatcgatcatatcatgtcacgtggaacacgatctcatcattaattatatttgtatatatagtcctggaatgcatgccctccacacatacggtctcacaacaattaagttaagctattctttggcagcatgcaggtgtagctagcttcgaatgcatttggacagacaaaataattagattcagagtttcaaacgaactcattctctcaagctcttttcagctgtttaatttctaaagcctatctacacgggtcatgattaattaatttaccaacctagctcgcataaatgtagttctcgatcgatcgatcgatcatcgcgtgaagatcgatgatggccatacatatgtatcatggtggaattaattctcaccattaactgaaagattagtgcacacgcatgcagatccaaagtaatatatatacatttggacagttatatatagagagagaattgaaaggcgacatagatatatagatgatccagacttattctgatcagttctaaagcctagtagctaatcagtacatggcctgattcgcgccaaatcttctcttctgtaatctctgcctgtgtcgtcttatctgtcccacttttaacctgactggcagcagagaataggatagcagaccaaacaagtcatgaaatggccctcatataccctttaatttagactgtttttttcctaagtaattaccatgtttataggtgattttagtgcggaatgttgggtaaaaagatgatgaattggtggcgaatccagaatcctttacttggcatatacacgttgttctgtcactgtgggatctctctacaagttcaattgagttttgagagcccatgcatgtttagaatgggtcgggccatatctcctttgcagtttgctcccccggcccgccaagtaagccgttcgctgcatgctgcgtgcctgatactatgggccgtcggatcgaaaataggcccaggtaaaagtggccctaaactccaaacgggcaccatgcatctgtatgctttctcggattcaaagtttgtgtttgctattactcctagagtattatacattttttacccacgatagaacaagttgataggttggttgatttagtacgggaacatataaatgcaataacttgttaagctggtgtgctctaatataaaaaacttaataatttagtattttagtgtagtaacttggctaggtatgtgctattttaattagttaacgagtgagtctttttccacgatatcaagatgtcatcacatagtactcatgtagatattgtcttacaatttttgatgtaatttataagaattgtgttgctcatccattttacaccacctgtttggattttttttccttcaccatctcaaatctcaaccgaaaaaatttctacacactagaatttagttgacatttacttactagaatgataaaaacatattatactcatacaaatctgcatgattatattaaaaaataggtacttaaaaactgaacgtgcatagccacataatgctcgaaataattaagttgttgcaccacttattaagttattgtactatattaaacccatttgctaagttaatgcactattacgcttatttctcaagtttttacattaaattatacacacctcaaattcatgtaccatgaatgcaatttatttatttttgaatgtgtatgtattttaatttgcataattgtacctgatttttttcctttgtattagtatacctttattatttatacgatccgcgcatgggtcatggatcccatttgttttgtgttttggtgatctgatctcatgaccgaacacgtacctaatgacgacagacaagagaagagaggcaggcatacaaatgccgcgcaggaaagaatctgttaatcaatttaattaatcaattaacatcaactgatagacgtactatgtgtagcctgtactaactaactaattaacaaatgcaatgcaggcatagatcgattggtgcacgtacgcactgtaggtgaaaggaaacctacatacatgtagtgtacaatttaattagtgcagcgagtggaccattgtacctgaacttgccccttctaattgccttttactgaggcaccagcttcattagctcttaatcattgaggcagcaattaagcagctgggaaaataattcgcaatccttaattatacataggaccagtgatgcaccaattcttgctttatttcattagtttcttgttgagagaatgagagagcaaattagcaatgcatctgatctactactagtagtatgtatgtagtgctacctgaatgcctgcaaaagacaggcacatgtgacaagaaattaattaaagttgcatcgtacactcccaacgggccgagccagccgtggtccatgcaatgcaatgcatcaagaaagaaaagattgaccttatgtgaccgcaactaattagatatcaacactgtatttctatcatcaaaccaacctaccaattaaacacctcgtttcaaatgtaattaacctgtgccgtacctacaccagtatgatcgatggggatacttagtacggtttaagagacgacggttttcagttaactgaaacattaactagctagatcctaaaaattctgagaaactgggaacatttttgttaggactgtcaagtgtgaagagatcagccacctgattagtgattaagctagtcgtgg

SEQ ID NO: 96339 - DNA, 640 bp, Oryza sativa
  unsure (1)..(640): unsure at all n locations
ccctgtagaataattaatagtttatctgcagaataatataaatttaattttaaaaaccacgtttgaagcgtaatgataaaattttgaataataaaaatatgtatagatgtttatctgcagaataataataaaaattttaaaaataatattaaaacccacgtttgaagaagaagaataaaaatatgtatagatgtttatctgcaaaataataaaaaattttaaaaacacgaaatctgcaaaataataaaaaattctaaaaacacgctagaaggagggcttgaacctccgaccttgtggttaacagccacacnnnnnnnnnnnnnnnnnnnntccagcttatggttacaaatttacaaactctgataatatcttacttaaagccaaagaatattctgccctgcacttgcacggactgaatgctgtcgttgacactggcatactactgactctattaagcttgggaaggaacatttgcaactgcgccttctctctctctccctgtgtgggcttgtttacttttttaccatttataaattttgacatttctaacatttggtaagatagcaaacttaattataacactaaggccgtgtttagttccaaagtttttcttcaaatttctaacttttccatcacatca

SEQ ID NO: 96340 - DNA, 537 bp, Oryza sativa
atttcccatggaaaatgctgcgtgggcattatgctaacatggatcaaaataatagtaactccactaacttttataaggctgacgcttattttttaaaaagagtgaaaacacagtgcaaatgcagacgtccacaactcatgcacatttacccctatatacgtatatgcacacactatctatatgagtatctcctgtaaactggattgacaccatatcttaagaaaccaagtcaaatattaaactttatcgttgatttaccacaaagtatattattaatacttttaaatatgagcgtactggtatatgttctctccatatattagatatgctcataatttgactaattaacaggtgttctactagtaagaaattaacattactagagatttccagcatattagtatactaacgtatactcaatccatccataaatataaatatttctagtgtttccaatttgtcaacaattcaaagaaccaatgcatttatatcgttgattggtagttgtatcgttcggtgtgatattgtccaataaag

SEQ ID NO: 96341 - DNA, 1104 bp, Oryza sativa
tatcacggcccagtggcctttcactagaagcaaaaacacaatcctattgacatgtatgactcttcctatgttctgtattcttcttcctctgtttcacactcttcttcctcttcttcctatgttctatattcttcatcctctgtttcacactcttcttcctctatttcatactcttcagacccctcagaacagtccacatctaattcagaatcctttaaatgaaataagcagatgagagaaaacaaacaattagtcatcggtacatatggtaaagcataagtaatattgcttataggccatagtcatattgaagcatgctaaaagattaataattggagattggactggttttgttaagggaacattgtgccggcaaaagaacttaattccagagtcttgtggatacaaaagagggcatgctagacaacaaattgaagaaaaatggagatattgcagtatatatgtatgctaggtaaaccatttagaaaacatgccatgctatgtatgaaaatactggaaataaataaatgaaatgtatcttgcagactttatattagcattcaatcatccatccatgcattgtgagcaaccattgttcactaacagtaaagacatcagtttcacgctctactacaataaatcattgaaacaacaaattatacatttgtcaaagcaaatgtacctctctttgtgactcccaccttgaaagtacctcctcaggtatgtccattccaagcttctcatatactgcctataggcatgcaagttaaatttgctaattggatttttctgtgaggggaaaaaaaataaatgaatcagagattaatttagtagttattacctttagcattccacgatgttcttgtatcattccacgctgttcacgtatcattccacgctgttcagtcacttcatggcgaagttgtgcattctcacgcactacagcattgtaagaattcgtagatccagatattccagatttcttatgtttaacagcagcaagaacttcagttttcttgaaaactccgttgcccattgcaaaccgtccatgtttcagtccaccaaaagctttatataccacattcccatctaactcactgctca

SEQ ID NO: 96342 - DNA, 1749 bp, Oryza sativa
acatgtgatgaaaaaaaaacaatcaaaagtgttgatactatatatgaactattgtcatttatttaccaggttttgttgtatagtgcagaatggaagagatcctccctgctgttgagcatagtcttcattagcaaaacgtgcatcttgacctcttttgcgcttctccttgtacttatctgatgtccaccagtgacaaaagcacttccaagcgtccacattaatccaatctaatttgcatgtcatgtactgctcaaaattgagttcaatggcgctggcattttttcctttgatccctttaccatagtacttcttcatagcatctacacgtgcctggcaaattatctttggaactctagcttgacatagttgtcaatattcttgtccagctcctccatgtcttcttcttgggtagtgaagaatgactggaaaaaaaaaggggggaaataagtgtttactatattatgtggtgtccctacatagctatgtgagtattggcagaaagctatgcaatcctaatacttggaatgggaccatagtagattgaacttctaacactttttctagcaatacagtaaaatcttttgaggaaaacacatacccagaattcatcttttactctattaccagctgtcatgccattatgatccttctccccaaagtagtgaccccatgacatggccaatctctttcttttacgttgtccaggacctgcatattctttaaccaacccaggatactctcgtcttaaagatgtaccaagcacagaacctgtttgtcgttccatctttggcttgaaatgtgtgtaagcgaaacccctatatacaagacgtcacattagtatatatagtgcaatacaaattttatacataacagataaataaagggatgtaaggagctacatatgcatctcccctgggagatatctcaatcctcttataattcctaggtcttgtaagttgtgttgtccctcttgtattcctttcctcctgataagttccacctccagcagcggtagaaatggtagacccactaacatccctcgaagatgatggttccccgcgtggatgcataatacgactcatctctgcaaacattttataaataacattaatcacataatttattcttactgattatgaatacatgaagtaaaaagaacaataatatgaaagttcattttctaggactgaaacaattcttttcatacagaaagtaaacatgctgagaatgattttttttcatcattgatatagaaagtaaaataagaacaaccaaaacagtggcatgtcaaaattcattcggatcataaatctcatgatttgtctgatcatcattttcgttttcctcctcgctgtcgtcctcttctatattttgagattgatgatgtggtgctgttgttgcctttttttgttgcttccttagtagttcaagctctttagggtcagtgatttcatctgaacagtcaacaactgcagtgctagcttctaggtcagctccaagatcaactataaatgtactgtccagaacactctcttgaaagaatggcatctcatttgttgtcccatcttgatcattggaatcaggaatcacttcaagagcaggcaatctatcacgaggagtaacatgataaacaatgcaccagtcatgcagatctgttcttgatgagcatgcatatggaacgtaataaacttgcttgacttgatttgccatcacaaaggggtcaaaatttgacagtcttgaggtttgctt

SEQ ID NO: 96343 - DNA, 584 bp, Oryza sativa
tgcccttatttagccaaacatatataattagttgaattgtaaactaatgctggctaaatcgaataatcttgccagttggagaggataccatttgttacaggggtagaataaaatctaatgctgaacatttactctgatactacaaccaactactctaaaatcacatattatattagtcctatcatataagtggcggagaagcaagccacgacctagcaccagtgtcttctgggttagttcttggtatgacaaaattaatgtttaccatgatattaagtcaaaagactgagtaaattgcgacataaagtactagcaaagaaaagttattacaaaccacagtttatgatattaagaataatggacagccgagccaccacccctgctaaatttgagctcaataatagggtagtagctattagtgtacaattaattaaattttgatcattacaaacttgaaaaataaatttatttgatattttaaaggaacttctatattaaaaatttctacacaaaacacattatttagcagttttaaaaaatatgctaatgaaaatcgagataaaatctatatcttaatcagaaaa

SEQ ID NO: 96344 - DNA, 3593 bp, Oryza sativa
tattatctaaaaatattttcaggttgatggtgctattaacgccctgaactccagtggcatatttgcaagtggccagcctatcaggttcaataatccttactataccggataaaattttacatgcacatatcactatgcatgtccatgtaaacaaccttttgtttgtgatctactttcagggtgtgcccttcaaagacgccgatcaggagcgtcgcgtcctactactccacatcagctaataccatgacatcgaactgaccgtcatctggcgtgtctccattgccgttcaattgatcgacatcgcctggagatatctgctacatatatatatatatatatatatatatttatttatttatcagttcatcatatgctgcagtactgcatgtatggtgttgcttcagctagttgtagtttcgatccctgttgagtttctccttcaaagaacctgcatactgtgaatctgtgatcgaccggcctgaagacagacagctgaaatggattgatttcttacttgtccctggtcatgtatgtgcatgtgtgatgaggagattgcttggttgtagtgtacctgagactgtatccattgttaattcctccagagagttgtgttttctgttgtctcagctgtgtaccaaatatttatacttggtcggctttaatttcttaattagtctctttattgatagcttggcatcaaatggtttcaccagcatgggtagtaattcttcttttctctgaacatggtgaaaattatagctgaacttcgaaagtgcaaggctgcagacacatgtattgatacttttctttgtaggttaactaatgtttatctatgtgactttaattgcttagaacatcaggcagccaaaagtactgtaaaggagaaaaatggcaaaggtcgatgtaagataataacgtcagtcaaaagagcatttgttttgtcactgactatctaggtatatatattcttgagtaattttttttaagaaacgacgctcacaatacgtgcacacttagagcatttgttttgtcactgactatctaggtatatatattcttgagtaaatatatattttttaagaaacaacgctcacaatacatgtgcacttacccctatgataacacacacatcttgaaattgacaaagttagaaaccgaatgagcaaaacatgaacgagatatatttatcttcaacgtaagtatgagttatgttggattgcttgagattcattcgagggtgtatagatcttaacatggaacaacaattgtaccctcttgttacatattataagacattttggttttttcatctcttgtctaactaatattcatgtaaatgtggatatatacatatatgaaacatatacataaatccatatataaatctattcaaaatctaaaacgtcttgtaacgcgaaacaaagcaaaagtggctagtactccctccgtccctaaatatttgacgccattgaacttttttaaacatgtttgaccgttcatcttattcaaaaacttttgtgaaatatgtaaaactatatgtatacataaaagtgtatttaacaatgaatcaaatgataggaaaagaattaataattatttaaaatttttgaataagacaaacagttaaatatgtttaaaaaagtcaatgacatgtcaaatatttagggacggagggagtactaaatttgaagtttagaatgaactgatgagagcatctccaacaaagggctaaaattaaagccccaaaaatcctatattagggacagccaaaaactaatttggcctataaaacacccccttctctgagagatgcctaaaattttagttcccaaaattttaaaatttgccacatcatcactggtgggcccttctcaactaattttgtgcgggttcgttattatgacgtgcgatcacggaggggaggtcgcgctggaagctcagatcgcgctggacgttgtcaagttcagtgttgtttgcaatttgcaaaagcttggatgcagcacacagccaatcaatacaggtttagggaaaaattgctgacggtgacatgaaagaccaaggcactgcacatcatcagttcaattcggatttgaggatcctgaagattgcagaatatttcattaatgctctgcttatgtgaaaactatgtcaaaatatatttgtcagtgattgatccagtcgtctccgccgtgttgctgcatgcatgcacttcgccactcctgtcgtcggccatccatgctttgtggcatgaggtgccatacaatttatttccgagatcgcgcggaggggactgggctttggtcaatcgcgagatcgcgagtaatcctagtcgcgtgcgagatcatgactgagcccgttcgtgaggctatataaggcgcagcgatatgatatctaacgaaggacacagtgctgcagacgcacacagagctgttcctctctcagcgccggcggcattagcttttcgctcaactaggcaacggcagcgagcagcaacgattggtgacaggtacaagcacttgtacagtgcgtataaactatacgagcacaggtaaaattttttgctagcaaccatgtttttgctttgttgaattttttttttatgtttttggtctcacaatgtttttatggaataaaaaacataattcgatatgatgaataaatatttggaaaaacggaaggcctagctaatgctctacacgaccgtgtcatcaatctgcagattaatatctagacgaccctcaatgttatgattttttccggtcaatgacatttttctttaatttgatctgacaacgtcgcaaggggaaaaacttaatttgttgtgatgaataatggtttgacagttgatttgatccaagatgagtcgtcctcgctcctcgtttcagcggcttgtggatgaatcatcgtctgacgatgacgacgatttttttttttgccgcggcacaaatcgtccatagctattggcactctgtcaatgcaccaagatatggtgggtctgtcatgggacataaagtggttgatcgcaatagagaagcacggcacttgagattataccaagactacttggacggaaagtcatcagcattgctaatgttgttagagcaggtacaatagcaggctataagccaactataaatatattttaaagagataaaataagatagagaagagcagcgggctgcagatctgtagtcagctgcagcacggactccaagacgtaatgtgtgtatgataggtgtgaccatgtattaatagtatagtaagcaactattgtatgaattgactattatattggctatagatgatttggagctagcagtgggctatactattaaacttgctctcagtgatatgcatttactcctcaacattgccagctaattaatttaatataataaaaaattatagtggaccacctatttaattgacctattatatatagatggaccacctcgctattgtctccatattataatataatctccaaacaaagcaaacgcagaaaataaaacagatcgattcgactcccccaattagtgcagccgaagagaagagaaagatagccgagagagagggagattaaatagatgaat

SEQ ID NO: 96345 - DNA, 620 bp, Oryza sativa
ttttttgataataaattctttcgtctgaactggaccgaaaatctaacggaaaaggccactaatcaacaagggcttgaaataaggtgccatccaatttctgaatttcatttcaaagatccactgaacgcagtggtggatcaaaaagaaatagcagtgtattctgagcaaactagatagaattacagtctttcccctcccatttatatatcgtaaaaaatttcagtggggttttcgtggggtctctcatagtcttcacgctaatagtggggactcgagacctgccgcccccacactggatccgcctctgactgaacggttaaattgaaaaaaaaacaaataccagttaaaaaaatcgacctaaaaatttacagtgggaaaaaaaattccacagaggtaaaccacccaaactagagccgtgattaatgccccagtatctgtcatcaaattgccaaagccgtgataatcactgtaattaaagtcagttaattggtttgaatcttctcttctcctccgtttccccgtataaaattcagtcgagtcccagccacacacacgcgcacccacacacgcattcacatctcgcaatctcacatcgcattgcgagagcggagcacgcggtc

SEQ ID NO: 96346 - DNA, 2375 bp, Oryza sativa
  unsure (1)..(2375): unsure at all n locations
cccacgtgtaaattgtgtaaagaatacgaccttagtgctacgagaattttaactcagttttcatttattttctgcacaattgacttgactagacatgaccccattttggggtgtgtttagttccatgtcaaaattagaaatttgactaaaattgaaagtttgaagaaaaaaattgaaagtttatgtgtgtagaaaagttttgatgtgataaaaaagttggaagtttgaagaaaaagttgggaactaaacaagggcttggtgctccacccaattctgtcagaactaaaaaacaaaatatcccccaaatatattcacaagtcatatgcttatcatatatctatctatctattatatactaaaagtccattaaactttctacaaacgctcctaaactgccacatggcatcctacaaacgctcctaggctgccacttggcattattaaatctcaccgtcgattttcacttaaattagtggacccgttattttataccattggattagatctattattaaaaaatttcaactttctctttatataatttaagcgctactactgttgtcatgtatgtacaggtttatacgatgtcttctcctgtaccacatggcatcctacaaacgctcctaggctgccacttggcattattaaatctcaccgtcgattttcacttaaattagtggacccgttattttataccattggattagatctattattaaaaaatttcaactttctctttatataatttaagcgctactactgttgtcatgtatgtacaggtttatacgatgtcttctcctgtacgtacttacgtgcacaaaaacaaaacaatagtttacgtactattcgctggaaagaaaagaaaaaaccatacgcatatacataaaaaagacgacaaaaaaatacatcataaaaatcgatgatctttaaataaaatataattttctaaaatatattacatcacaaatataaatatatatagttaaactaagatctataataataatataaaatatccaatcaatgttccttgaaccatcttctaaattatttttaaattatatatctaatttgtgattctgttgttttcctttaattaaattataagttatattgtggtcttaaatatatcacgacacatggggctgatatataatagttagtttttgataatctattatatactaaaaggctattaaacatccttaaaatgttctcaaaccgttatatggcattctacaaacactcacatctcaccatgtgtcactctagcaaattatagaaaaaacaaaacatctagccatcgattttcactaatatccggtgcacccatattttctaccctcggatttacttaaagaaaaaaaaaagaaagaccaacaccccaccgctgccatccattacgttacgttaggtatatgtacgtagttacgtactccctctgtttcacaatataagtcattctagcattttccacatttatattgatgttaatgaatctagacatatatatttatctagatttattaacatcaatatgaatgtggaaaatgctagaatgacttcattgtgaaacggaggaagtatcatatatccctgccctcaccctaatacataagggcaacatgccctcctattttcaagcattttcttaattaatattggaaaacatactttctaataaattattttaaacaactaaatcatctaaatagctatttttttatccgtgcacgggacgagattatttacaataaaatttagaattcaatacctacattaactacattttaaaagtaaaataaatgtattttcttgggtcatataatgatagagactacctattggtcactcgatacatatcaggaaaaatcacatagatntttaaaccatatgagtggcaacatttagctcatattagtaaatacaacacccgacacattttctaataggtctaaaattatatctatattttaaaaatagataactaaagactacgatccgttggaatatgcctcagaaaaaaatctccatcccttgtcctgctgtacatataccttatttgatcctctcgccttatattttttaactaacaacctaatattaaaaaaacatagctaaatggcttataatttctaaaattatatttgatttttaatttgttttaactattattttatttacagttaattaaataattcaatatccattatagttgtattttactatatagaaattaaaatactcctatgcagggcaactgaatgaaaatgaaaaattataacagaatgaaaacatgtattatttcatattaaacaatctacgcaatgaaaaccaattaaacacctttagagcacacttaggtcaccatatgt

SEQ ID NO: 96347 - DNA, 784 bp, Oryza sativa
  unsure (1)..(784): unsure at all n locations
ccgccacagccagttcttcctccgttctttccctagccgcccgcctagggttcggtcgccacngcgttctcctcgcccaatctcccccaaaaacctctctaatcgaaggtgatttgtgcgacattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatctatttggttgttattgatacatttgacaaaatgtatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtggagtttttttttatcaataatgtgtagtatttgagtaatgtactaatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatga

SEQ ID NO: 96348 - DNA, 3236 bp, Oryza sativa
ataaatttaatttcctcagttcaaatcattctcattagtacattacccgttgtgtgggtcataataaaacccactaacagatatactagaaagtattgctctttacttctctacaagtagcataaaaaaattcagaataatgataggtgttaaaattcagtactgtactagaataactcagtaagagcatcaccaagagtatcccaaaattttgtttatgggaatcttaaataaaatttaaggtgttaaaatattgagccctccaagagattggctaaaattgactccctaaatctaaaaagtggtccctctacaaaactaccaactgaaatctgtttcaggctctccctcctgtgagattatcacgctcgcccgtgtgaccattgatcgcgggaaccacttggtggtcacctccctgtcacccctctccacgcagtagcacgtcagcaaatctgatcctgcaaacaatcaagcaaaccactacaagtagcagcatcagcaaagtccctaattaccaaccagaaccaacaacatcgtaccattttcaacaatagcagatcagtagcgtcaactcagatcagcaaacgtcgttcaaaaaaaaattcagatcggcaacagcatggcaattagcaatagcatggcaagcaacaagcagcagatcacaactagcagcaggtcagtagcatcaacaacagcacatcatcagcaacaccaacatcaactttcaacaccaccaccggcaccaacaacattattcagtaccaactgtagaattcgtagtagcagattagcagcgccaaaactagcaagcactagcagataccttcgctcatctccatcatcgagagaccaatcccgatttgaggagaaaccaactcgggccgatggaagttcgcctggctgtagtggagatggtgccgctgccgccgccagagcaggaactatcgacgccgagaaagctctaggcagcggcgcgcgcgtgagatgtgggcacctgtaggacacctcgatgcgacggcgaacaacctcgtgatgaaccccctgtcgagaacacttcacgtgcgcgtgggaattcgcacgacggcacgagagagggagattgggagcgagcgcctctccctacttgtggagaacgaaaaattcggtttttgaactattgggcgcttggctagggattctgttggactgggtttttgaacgaaaatctccaatttcaggataaccatatacagatattgttggtgatgctctaaggaactaaagatacaaaatcatcgagagtacaatgcagcagcacaacaactcagttctcggagcatttctcttggcaattaagagaacagcagcagctccagccttgactgctaaggaggaaagggatttggaggtcttcagagaggctcaccgcaggatcgatggggaagaggaagaccagattcaagctcatgagccgcctctgcctccaccgttgtgtctcctcactcaactattcgactggcccgagctcgtcgtcgctctatcaatctccacgcgccgtgcagcctcccccctcctccatggatctggtttggatctagaccatttggtgttgaagtggagatgtagcaacgtgagaaaagaggaaatttaaaggatgtatatgaaattgtacacagcatggtgcggggggcatttcataaaatgtaacgtggggacggttgggctggcaaggcttcatcaggctgcacattttggatccaatggtccacgattgagtttgcaagttttcatataggttgcagtttccactacatattttctccttttttcctgtcacatgtgattttagtaagagggatcacaggtaaaagataaagttatctatctattatataataaaagttcattaaaatttctacaaacgcttctaaaacatcacttagcgctctaataaattagagaaatccaagaaattctaaaaaaagcaaaacatcttaccctcgattttcacttaataggcccattattttacaccattagatctattttaatagaaaaaaacaaaataccatctaccaaaaatcctctctcattgctcactttggcctccttaatttctagctagcaaataataaatattcattaaattaaacatcgtgtatatcaatatattatgtaataaaagtccattaaacattcttaactgtgctcctacctaccacaagatgcatctaataaattagaaaattgatctaaaaattctgagaacaaaaatggaaaaaaaacttaccgcactctcacttagatcgatggacccatttgttttaaccattagaactatatgtagagaactttaaaagtaaaaaaccactcgctgccccctcccagtcgcgtgcgtttgcggtgcacactgctctgtagctctcctctctagctcatgctctctcctcctcctttaatttagctactaaattaatcgagaaaaatcaataattttatatactaaaacagcaaaaattttcaagctacaaatctcattcctaatctagcaataaaatactataaaaatttgacagcatatattgagtcatcatatatcattccataaacatacatatctaaattaaatctacaatatccaaacaaaaattacaaattcaaatattaaataatattttatcgagagacaacatccctaccctttcatatgtcatgcgaattaacataaaagtatgaaacagttcaataatacaggttgccccatcatacattgtttttcaaacatttataactaattggatatagaattaattcaagtatgaatagtccaagtcgcggcataaaaaaccggttaaataatatttgataggacaacacgtgctcaaggaaagaatccaattactctatattttttttgaaatttgctcgagtaatccaagcaagcctaatagtcgctatgtccgaaataagtccattttcacccatcctacgtataccgatacaaaacataaaagactaaaatacccttactatatcaaatcccaatgcaattatttctctctttttatctactcccaatatatttatcctttaatttcacaaactctaatgcaatgattactcaaaaataaacttatttgaaaacaaacggtgtgggggcaaaataaagttattatagcagagggagtaatcttttacataggtgttctaaaatatattctttgttactatataatcgactcaaaaagctatttagt

SEQ ID NO: 96349 - DNA, 599 bp, Oryza sativa
gaaacctacaaatatccatgaattccaaccttagcatctagtgcttggatatttgtatccctgatatttcttaatcgctttttcttcagagcaaaccagctactgatggtttcaagcagttacggataggagcctaggagggtgacacctcgccatcatcaatcacagaagaaagctagctagttgctcatcctaaagtggactgctatatatattatgctgcaacaatgtggctagctagctaccttcatcatccatctatccaattaatttcaacacagagagcactttttatctattaggtgtcaggacaatgaatcatgcacaacatattcaactccattcctattcgatgagttccgatgaaacagcatgatagattctcctccaaatgaggacagagcaaaaataggacagctggaccaatccattcagtcagtggtcttcaatgtccacgcacatgtgctaaaaatcacggaaattgcagtccatttctctgaacttttgaagtgatgatattataatttcacaactgaagctggcaggaacttaaccctacctgcagtgtgttggcagtgtgcatgcaagatcaaactatc

SEQ ID NO: 96350 - DNA, 705 bp, Oryza sativa
cccggaatgcttagaaggccaaaacaacacgcttgaacatatatcaatgatatactaaaagtgcactaagcaccatctaaagtcaattagatggtaacatagtttaaagcaaatacacggaagatcatttagcttgcttggattattttagcacatattttaaaaaaatcatgaagtaatcggattttctctaactaaagccattggattttctatgcattggtggtttggacttcatattttagttgtatttgcttagacagtgtatatctaatttagctatatgcatgtttgacaaacaacatatgatgatgcaacctgtattggattatttcgtaattcttttacagcaattcaaatggcacgtaaaagggcagggtgttctttcttaataaaaaaaatgtttcatagttcactttgtaatttttgtttggataactattgatttaatttagctatacatgtttgcagaatgatgtatagtgatgtaatatgtgcagccaacttgtttaaggtatttgaatcatatttggatggtatgcaaatcacatgggctgaatgtgtgttgatgtgaaaaaacacacactggcctaggagatctgcttaactccagtgcaggtcctaaatcttacttttgggttcgtcgtcaacaatgtggtcgaatgccatattttggatattaggaaaatataaggatacggatct

SEQ ID NO: 96351 - DNA, 645 bp, Oryza sativa
aagtatttctggcgaagtttatccttaccttagccttctcgagccaagtgccataaagatggttgctgtagaggcaactccaacccactttaaccgcgcacatgaaaaataaaggggtaaaacaaggaaattctaggtcagatatatatgtcctgtggactgtggcacagttgcaacagagcaattgcataggcaaatgagggcagatcatcatgtacccatagcctgttggtgctatgttagcatccaagcattgccattttaactattaagattcttcttcttatatttgacaagtgaaataaatttagtgactgaacatatatagaacgatgaacagtctttgtatgtttattcatgccatgggggaaagagaagtgtgatctgaagttattggatagatagctgttagttgtagcatgcaaggcaatgcatcctggaaccaacagaccaacagagctggggatatttcatctgctaaatttctgggaaaatttattgtgtggtaatcaatatgtgttcactctttgcaactggtacacgctctctgatgttcttgatatcttcacagtgatgcagatcttgttgacacagataacttaacaaacatagtcattttttttaagaatgaagcatgacatttat

SEQ ID NO: 96352 - DNA, 713 bp, Oryza sativa
atgccattgtaaagtcgcagaaatgccatcgacaagtgtgagttccaagaaatgtcattgtgcaaacgattttgtcccaaaaatgccatcgccgttagggttccgaccattttgtgccgttaaaacactgttcatcctatagaacataacggcgcggaattgacggaaccctaacggcgcggaatggacggaaccctaacggcgatggtatttttaggacaaagtcatttgtatgatggcattttttagaactcacacttgtcgatggtatttctgggatttggacgcttgtcaatggtatttcttggattatctgtttctaaaagcatggatcaaatttacctaaaaaatttaggcgatggcaggtcttttgctgtcaacataaaccacatgtcaccaaagtaaaccatattctgttccctaaaaaaaaagtaaaccatattctctatcttctaccgcggcgacaggtcttctttatggtcaccatattctttggctggatttgcataaaccaatgacgggtgatggttggagtgatttgcggaaaccataatgacacaatgatgttaaaatgacatcgatgcccttctttcgagtttatgcgcattgcattaagccttgatacggtgggagggggtacaacttcgcaggcgtcgaatgtgaacacgtgggaacatctgcatttggccacatctaggaatgaacaaaattgg

SEQ ID NO: 96353 - DNA, 729 bp, Oryza sativa
acataactcatctcttctgtagtgtgtcaatcataatgcattgtgtgttctgtgagtcatggccaaacttttgatctaaatctaatctactttactcggatgtgtatccatgacatgactggatttcttgtagcagcgcctgatattgcagctatgtggtgtattcttcttggttgtgtatatccacctgttgatataaaggtcagatttttatccattatctaaaaaaatgtggtgtatttgacttgtcctccacttgctcttcatctgcttgtgtgtatgctctatccagctattgcaatttcagaatctgtcacgcgatgaacgcggcctgtttggaacatcaagctcgatttgcgtgcgaatctatctgtgatttttacgttttagtacatactaatactgagtcgctgggtgatcaatctaacatattaaaggggcagtaacacctgctagtcagaaaataatactctatccgttttatattatataaattgttttgactttttccttagtcaacttttttaagtttaaccaagtttatattaagcatctagaacatcaatttagttttattgaaatgagcatttgatatgttttaataatatgatgttttatgtcagcaatgttgatatatttttctccaatcttgatcagactcaaaaaaattgagtaggacaaaagtcataaccattaatagtataaaatggaggtagtatttacagtatg

SEQ ID NO: 96354 - DNA, 655 bp, Oryza sativa
tttgggtgaggagtaaggggaatggccatctaccagcgaattaattatttgggttgggctagcatttgtatttaggtcagaagtaataacattcactgctccttagtttgttggcacggcacaggggacaatatgcctataaatcttaattcactactttcttgagcgaaacgccttgtacaaagtactaataggcaaagagcttaaagacaatctacatcagctgctcctcaacgagaaaatgagacattaacagaaacatttttttatttaggccatccatgataatttcttagctttctttacagagatttggtaaaaccttgtggaattctgaagtgagactgatgaaacttctgctaacttgtcaactaagtcctatgctaatgggtggactaaacgaagcaattaaccaattaacttatcaattatcaagggcgcattgatctaacattcaaacagttagacctgatcagatatgagctgctctgtacaattaaataaaacgttaggtcagtgtagagattcacgagtcacatcatgacatgagttcccaaattgtctaccaccaagttgggtaggaaaatgatggctttgcttaaaggagctctagaaaacccaaagaaaagattgtctaatttcataaaccacacac

SEQ ID NO: 96355 - DNA, 516 bp, Oryza sativa
actgaattatcaaaaagtgcacgagatgagcatgccataaacccaaaagactcagcatcttagcatcccttattataaattgcttcactggccagcggcaaaaagatcgacttctcctgcaatctggaaaaatgaagctaaacagttttaaatcctgctgagtaattgaaccccctctatgactctctgaactctgagctgctcagctacagctccctagctgatctgtatgaaaaagacagcttcgctgtgcttggattaatttggaggcgactaactcgagcacaggtcaagtgattggcaatttgatcacaatgcgggaaggaagtataactatattgctgtagcacacgctcaactaccaagcttctacactcgcaatcaagctctgaacgaacgattgctctgcattgcttgagcttcgcgggcatgaacgtgactatcgtcttcttgctcgcctcagcaggcggccatggggaggaatttatgcgtgaacctatatcctgtcgccgccgc

SEQ ID NO: 96356 - DNA, 900 bp, Oryza sativa
cgtgccgccgcagaaggacgatctccatcgatctgttcgatcgtgggatggataactaaaggtcaaggagtcttgtgcaaatgtacatgcaagcggtgggcgtatttttgcaaaattgctccacctgctttataccctttggattgagatcggagggatgccgttgcacgagtgcatgtgtgcacctaatgagctgtgtgcacctgatacattgcccagtaagaaaagcttacgggaaactattctaatcccttatgggatgttcctttatttgctcaaaaaccatctaaacggttatgaaaaattctgaaaaaatttgacaacattcatacaacacatatatacaactccacaaaatgttaagtccaaactcaactcacacgtcgagatataaaaaagacaaattcagcgtatgaatagtagcatactgtttatatctaaatttgtcttttttgtttctcgatgtgtagatcgaatttgaacatgaattttggtggactagtaggtatcattatactctacattatcaattttttttagaatttttcataactatttgcatcaaatttggaagaaaaagatatatgaggggatatcccctcgagggattagaatccactcccaaagcttacagttgtagtactctgtttaacattggagttctggcttcgaggtgtgtacttggccaatagaaattttcgataccaaagactagcctgaatttttagttcttaaaatttatcctaaaatattatcttttcaattaatcgtaaccttctgctacttaatttttaattttgatactgtttttatctttcgaacaaaatcacttgtttcattttactacttccttaatatctgtatcgatgggagtagtagaatacccgtatggaagggagt

SEQ ID NO: 96357 - DNA, 1579 bp, Oryza sativa
cgtgggttttggaagtttttgatggtttgcgatggagtgatgagtgtatgctctgagtcactgacacgtgggggcaggagggaatcatgctgaatcggcctctgacaaaaaaaaataattggaggtgaatcgtgctgaattcccgagagaatctgtactgtttggtactgtagtatctttgatactttacgcacttggatactttacgccttcagatggcgtttgcggaaaacattctttcccgcctccgtggtctgcctctcccccgttgcggcggtggaacttattttttgcttctttgctgctgctgctgctgctgaaatgaatgaatctctgaagtctgaatttgtctgcccgtgccaaacacatgccgagatctgaattgacagtttttgttgagcgtgtacaaatgccatactgccaaagcgaactactcatatcagagcaagtctaatagtacagcccactactagctttaaatcaatctaatagccaattcatacgatagtaacttacgatactattaatgtatggtcccacatgtcatacacacagtgtgtcttgtaatccgtgcaacagctagctatagatctgtagcccgctactcttctctctcatggtttatcccattaaaatatatttatagctggtacatgctattagatatgttcaggcaaatccaatcttgttttcagagctctgtacatgacgcgatctctgatggatatgcaaatattgtacactactatcgaactgccttaagactttcagtctctcgtttgagagattgtattcacagagtttgtaacacaacaaaaacattagtactgacatttacagcacagcacaatatagtactcctacatgctgttggtttcgtaattaaccgagtgattcgatgcttaaacgcgtgcgaaaactgtcactgccgctgtgtcctagtcctactcctactgccaagcttaccacttgccaactaggcggtggcgtgaaagctaatgatgacttgctagttgatgcttgtacgtactagtatctgcccatttcgtcgtcttccttaggcggtgcagccaccgaggaggattccagctagctctgatgctactgacctcatcaagtcatcagtgattcagtgtcatgtgatgatattcgttttgagtgcaaggaaatttactgccgagcttttagatcctcttgctgtttgatcgagaggagatgatgtggctggttttgtcggatcgagtttgatccggtttggccacatccgaggcaacctttgatctgttggatcagattgaagattgattctgattgccaagctgctgcttcatcatgtgagatattggtcaaactatgccatgtgtaaacaacagaagtattttgcgtttaaggccatgttcagaggattcggtgtaccagctgtttcagaggactgcacttcgtcagatgatttcttctctagattatgttagtttaggatcaaggccttgtttagttctaagttttttttttcaaacttttaactttttcatcacatcaaaactttcctacacacataaactttcaacttttacatcac

SEQ ID NO: 96358 - DNA, 605 bp, Oryza sativa
tttttcaaagctttgcattccatagttcaagtgcaagttttcctatgttcagaaaaggtgtaaaggttccctggatgattttatgcagaaaatggtaataaaactcaaataatgacaactgtaatttaatgaaattcattataatggattttgacagataataagacatcagccccatgtggtgttgtagtcctatgtaacatgaaatgactgctatgctgtctccagaggtgacagactgacaagtttgaatctaagagattgcataattgacatgttaccaaattaagctgaaaatctaccgcaaggaattcaggtaagaatatttcggagaatcaagtaaacatgaaaaatatgatgaaatgcctacagtgccaaagaaaacccctttttccaaaccataatatgttgacataaccaagacgctaagtagtactaagtactgtcgacccaaggaattggcaattgtggagagaactgtcacatagactgctactacatgctcaggccactgtcccaataactcaactgcaaataaatacccactgactcaaatttgccatatgaactttgaaaggatagggtaccgagctcgaattcggcct

SEQ ID NO: 96359 - DNA, 533 bp, Oryza sativa
gccgatcaacttggggtactcacacggttgacggcctgacgcggtgcgctggtgcggctttggctaagcggagagaagcttccgcatccgctatagctgtggccggccaaccaacgcgccgtccgggccgcgcgacgtgacgacggcggaaaaacagtagaaaacgggaggcggaatcaaaaaaaggtggggcgcgagtcgcgcgacacgggatcgcgatgccggggcggcatggctgcttgtcgctgtctgcgtggtagggatacacgcgggctggcctgtgagcacttatagatcgaggctctgtttatattctaacttttttttcttcaaacttttaacttttctatcacatcgaaattttttacacatataaattttcaaccttttcgttacatcgttccaatttttttaaacttttaattttgacgtggaactaattaaatacagcccgaataagtgatagtgaataagttttcgcatcatggttcgacttatcgtatctaaagatacaagtggattgatacataaac

SEQ ID NO: 96360 - DNA, 1049 bp, Oryza sativa
tataaatttaaaaattacgtttctgtgatattttaaagtaactttatataaaactagtatggtggcccgcgcagcttgcgcggctggcatcattatattttctctcgtataatagcacatatattttctcattatattattcaaatatattaaaatgacaacataattttaaattttgcaataactttacaaaactactaatgtgtaatattcatattgtattttatatacgtgttagttattaattatttttaatatcaaattttagttatttgtaaattatatatattcctatattgactctagacccgtcttttaatatttctttttttaaatccgaattttctgtaaattgtatttctatatagactctatgctcttcttccaatattatctatttttatttctgaatttttattatttctaattgtatttctatgtggactctaaactcatctttcaatattctttaatttttaattttgaatttcagttacttctaaattgtattcctatattgactttaaactcttcttcctatgtttttcttaatttcaaattttagttatttgtaaattatatttttatacggactctaaactctacttttaattttattatgtttattccaaattttagttagttttaaattcctatatggattctatactctatttctaatattccttattttttaattccgaatttctatttttttcttaattgtatttctatatggactctacactcttgcttctaatattccttatttttaattccgaatttctttttttttcctaattgtatttctatatggactctacactctgcttctaatattccttatttttaattcccaatttcagttatttcctaattgtatttctatatggactctagtcacctcttctaatattccttattttttaattccgaatttcaactatttctaaattgtatttctatatgggctctgctttttctttttctccgattaatgtgagaatttctaggccatgagagcgaacgtggaggctcctttttctatt

SEQ ID NO: 96361 - DNA, 653 bp, Oryza sativa
agatatcgtttgaatggtagatctgagattttgtaaaaattaatatggtatattataataaatatttagacccttaaatgacctcaaataataaaatagtcaataataaagttgtagatctcatcgagctctacaatgttgaatataaaatttgtcttcatctgattccgtatgaaaaagttatgtatatatacgtgttttttctaaaatttgctcaatgtctgtggatatccgaaaaaaattccggataatttttgaccgtttttcgattccgatggataatacccttactatattcgttttcgtttccgagaaaaaaatatccaaattcgtttcagaatccaagaatttccggataattccgaccgaaactatctaaatccaaaaaatggtccggacggacgaaaactatccgaaccagtttcatccctagtagagataaatatagcatctttgatttctttaatgaaaacatccaagttatgattgaggataaggaaggtcaccaaatcgacagcagcaagccccggtgccacgtcctctcgttctttagatgatttctcctcgtaaaaatagtttatggcgatggcgatcggcagccatgctcctttgcctaaaaaaccaagagctcctttggtggcgcgccgcctcgt

SEQ ID NO: 96362 - DNA, 576 bp, Oryza sativa
ttatgtagaaccatgatacttaacaatacatgttctacccaaccttttggattactttattttccaagaattatagcttggtgtcttggtattggtatttccagtattctctagaatctgtcctttaatgcccttctgcacaacatatgattcatgtgagaaaattctaaggtggtttgcacatccacttatcagctattgtctcataaaaaatgtcttgatctggatatcagctacagatagccttaccttagtaaatagagtgtataactgtaatcaccatttcattaggttaatttttgtaaggaagattttcattagatcaaccctattaggaaactggatgtctgggccagtacccagaataagcagagtgaaactagtatgatcagaagtttaaattctatgaatgtacctatattagtatgtgtaatttctatggtactgagtcttcaaaaatcaaattcagtcttcatccctactattataaagagggaatcgtctctcacctcacataaaagcctctttccttcataaaaactgtccaccctaaaaaaaactgtttactaataaagc

SEQ ID NO: 96363 - DNA, 647 bp, Oryza sativa
tcatgctttgaataaacaaaagatagtttatgtgatcttgaatcaacttacttaaattttctgaggcttggctgacttgataataaaaaaaattcattgatcacgtaatggcatcatttgctctgcacgatggattaacataaataaatacacaatatgtatggttgagctatgaaaaggttatcctactggtactggacggtgatgccacattgtgagtcactctaagagttcgtgtgttgtgtcttgtaattcaatagttattgcggaatttcttgaagatgacagcgcaagatggtttttagtcaacttttaggtttgacaaaaaaatattttcccagtgaaatgccaagtattctctctttatcatccagtatttcctttttcagatgaaggaagctttattaaaattaagataattacatcaaggagctacttccggcttctgtataatattattcttttgcagacttttgttagtaagtctactcatttttttgaccactactcgtaatcgaaacaatcaaatttcacccaatagaaccgttatacccttcaaggcagaggtggaataacctcgcccttgctcgctctacctcggtttaaaattcctccaagtctacacatctatctattatatactaaaa

SEQ ID NO: 96364 - DNA, 2917 bp, Oryza sativa
actccctccatttcacaatgtaagttattctagcatttctcacattcagattgatgttaatgaatctagatagatatatatatgtttagattcattaacatcaatataaatataagaaatgttagaatgacttacattgtgaaacggaggaagtatatatgtatatttagctacagctagcttctctctaaaaagaatagtactccctccgtttcacaatgtaaatcattctagtatttgtacattcatattgatattaatgaatctagataatattaatgaatctatctagattcattaatatcaatatgaatgtgaaaaatactaaaatgacttacattatcgaacggaggaagtagctagtaagtatatatgtaggtaaccgaatatatagatatataatgatgatttgaatagctgaagagtactgcgattaagctgttgcctgaaaattacattcgtgaattctactgaaatttgattagctgcagagagtacgtactgtaatcgtcgcgtcaagctgttgtgtgaaaattacactagtgaattttatctgtgacgtacaattatcttctagctagaggggcggccgggaatctctaggtgaaggattcgatgctttcagcaatcaaatcaaagccgacactccagtagaatattgctgtcaggttgtgcgcgcattttatatattgaaagttactggaaattcaacgaattactttcacccctctcaaaatgtaaacctttcgaaaaaactactccttccaactacttttaatagccattctacttaattaattctacttatcatctatttaaatatgctacgagtcattactcgtaaataagcgattcattaatatttacatttctcaatgcccatgtagtcaatcttgcgtgaaggaatagagagtcatgcattaatccgagaaagtcattaagatgatatgttgttggattgaaatatgcctatcaaaataaatttttcagatttgaaaatatgactataaaaaatagatggagggagtaagaaataatcattttttgagttacttcaatgtggtcaaatgttgatcgagttgcttttccaggaaaaatagttgaattgctctgattttctttccaagcatttcattggttgaagatttatatagcttttcatgtattggaattagtatacaaaatacttatattgtgataaaaaattaaataataaaaatacttatagaacagtgggttaatttactacttaacacacacaacatttacgtatatatacggttccggaaaaatctcatcatttaaaaaacaaggataaattaattggcagatatatatagagagatagcttaattaagtaaaaatcagtgatgcctactgggaattaaggattatatttgttgtggcctaactcaatcaaggcaacaaattagcaagtcaaaaatagtgtcgtctgtggtttttagccgaaaagttgacatcgccaaattgttttggtttatttgaatacctatgcaactttgatagcaagccaaataaaaacgtagcgaataactttatcaaaatttttggcaatcaaataatcaccaattagtttttgccattgccaaaaatttgcaaaggttacaaatattgcaaagaaccaaataagccctaattaaagttaacatcaacatccatccgactcttgtaagatttacatgcaatcgccggaaggaggaggaggagggggaggtgatttaaagatattttgcggtatgtgatggtgatctttttactactactactatgcaagtacatgtcctgatgtccatacactaattaattaatcacctagagaggcaatgcacatggcgatgatcccgcggcgtgagcggtggttaattaaatttgatttgctgttcatttgatggactagaatttaaattagttagtagtattactactacaaatcgatagagacttgtttaattatgtgtgtaatgtagtagattcggggcctcatcggtcgcccatatattctgtaataagctaaaacattttattataagataaaaattaatttatatgtaaacttttatatatttgtttgtagtgattaaatgctaatattaaataaaaattatattgaaaacatcttaaaataacattaaaatcaattttaaaaattttaaattttagcttattaggtgagagacgatgcgtgggcgagggtgatgatatatggatttgattggtgaagcgaattgtgatggaaagggatgtacagcgcgatggggcccaagcacgaatcttctggcagcctaacttgcctatcacgaaacctttctttttcatttatccttctatacttttttttcctttcccgaattttgcgctacacttttggctctattcggctgcttagtgcagccgatccacaatgcagctacagacacaacatattgtacagcatcacgataacaagtgaggaatagggcctttaactcgatgccatataggagtatacaactgctttaaccatggtccatggttagtgatagtatattatgagtataaaaataattcattttcaagaaaaaaaatgatgaaagagaagaggatgaatgaagctgtttattaatcccatgtccctacaaaacaatatatgagatgtgacgcatctaatattacgaatctagacataagtctatttaaatttataatattatgatgtgccatcttccgtactagttttttatttttatgggacgaagggagtacttcttttctaagaacttataaatacatatatctagtgataagctagaatagttagaataattcaaatagagatgatgtacaacactcgtgatgaatgttagtgaaaataagggaaaatattatattaagagatgtattgatcggggtactatct

SEQ ID NO: 96365 - DNA, 676 bp, Oryza sativa
ttaaaagatgggtttatgtacttcttaggttatgtcatctttttcattttttaatgtatgcatattgtatgtaccccctatttatttacaattcctaattagtctatatagagtaaattattatatatatcacacattttaatgtcaattttggtgtaacactatattatcttcgatgcctcttaattggttaattacacttcccgtcaggcagtagaaatctctaactttccttctgttcatgtttttgctacaagatttctgtgttccaaataagaccttaactaatatttacatcgcaagtactagcgacatgtgtcgacaaaataatgatatgctttacatctcgaatggatgtcggttaggatacgcatcaagtctcaaaatcttgtatatatgaaaacactaaaattttatatgtgaaatttgattaaaactgtcttcgtttagttaattatatttttaacatatttatgaatatatcattacaaaaacaaaaatcgaacataggcattgaagagactatgtcagtgtcagtgtcagtgtaaattcgggagtatgtcatgcatactaaagtttgacactcttaaatttaaaactagaggttaaattaacgtgatctggaattgacgatagatcaaactaaatgatatgcagcgaattgttgcaggatata

SEQ ID NO: 96366 - DNA, 504 bp, Oryza sativa
cagcatcggaaagagggtattagctaagtataattattactaggatgtatgtataatatgtgtactagaagtataggaatagatctttctatattctttctacttagataattatgagtaagagtataaatgcttctgcttagtgtcactctaccccatgaattatattaatccctcttagactatgggtattacaagtaatatataaattattagtacggttctctctattataatcttcccacgggattaaacaaatatgatacccttggaatactctcgggtgaaatgttacaatggtatatccatgtgcttgcggatgaacactataaccataatataccagaagtatttctgcaccattgctggaaattatatttctagtaaatgtcgttaagaaatatcaacaatatcatatatgaaatattaagttatgactgctgaaacatcataaaaatacttaccaaaacattctaacaataccatatgcaatatttgtaaatg

SEQ ID NO: 96367 - DNA, 690 bp, Oryza sativa
  unsure (1)..(690): unsure at all n locations
taatttagagattttataagatgggtgattttgtgaagtgagctgttttggttgaccctggcggtcagaccggctgagtgtcgcctgttagaccgcgggtgttgcggcggtcagaccggcccgcccgacggtctgaccggcatgatcctgatcgatgtcggtttcgggttgtttgttggatttggcttctagatgggttctatgcgtatggatactattgttatactaatgtgagtcaagttgggacgaacttgggctcggaatatggtctcttggttggtgcatgtgtaggtgttgcttgaggcctcgggagagtgttgccggtgaaagatcggagtcaacttgggagaagttgatgtccaggatcaagagatcatgcgggatacttaaggctagaggacaatgcatgtggtgatgaagaaatccatatgatataccagaggaattgtgtacgtatggaaagaggagtncggatttgtagggagtccgaattcgggaagtttgatagagataaggaaagagataagttgtttacttgcaagagagggtttcctacatagttaggagtcctagctaagttgtgttagattcgctggctttgcgcagcctacctcatatataaatagagagagagggtgagggcctctcgttgtcagagaaaggaggggtgagggggaggagatggggaga

SEQ ID NO: 96368 - DNA, 624 bp, Oryza sativa
catcaccgccgtgttttgccggcgaaagggaaggaagagaagaaagagtatgcgacactaacgtgcgggccccatagggtgacttagcggattggaccaagccaaagcgccaagtcagcgaaactgtcctctaaaatcgtcgagagagttaaattacatcggttttcacagttggggggggggggtgtttcaatctccagcgccaaatttgctatgagatttcatcgttcaagataaatagatggatctgttcctttggacgacattggttttatgcctttatccacagtatatcagcaaagaagatcctttgattataaaaatccaaaaaaataaaggttttatgtatacctaagcatgatttcagccatgggaagcttgatcaaatctgcaaggaaatcatttctggtttacccatgggagctgaactaccgttggcccgttgcaatcatctgaaggataagctagatcatatgtcattcggaagcttccactgatcgaagaacgagatacatcactatgacggcaagggacaattatctcctacgaataagacctgcaaaccttttgcagacgattggtagtaccgatcatatgaccgatgcggaaatccttttataaaga

SEQ ID NO: 96369 - DNA, 1158 bp, Oryza sativa
ttgaaatttggtagcaaattaaagataaactaaatcaccagtacacgaatagctcacatagagcattcttggaggatggaacaaaaaaaaaacaaatatcttccaggtcactagacacgttaaatacaaggggatcaccacatgcttacaacacacgtactgtaatttaattagctggagtacataatactccctccgttcaggttataatatgttttgattttagtcaaagtcaaactgttttaagtttgaccaaatttgtagaaaaaagtagtgacattttaatctaagacaaatttattataaaaatatatattcaattattgatttgatgaaactattttagtattataaatattactatatttgtctatgaacttagtcaaacttgaaacagtttaactttgatcaaagttaaaacaacttatgacctaaaacggagggagtaatggttacaaacacaatgcaagtcgatcatcacaaaatatgtgtcaggggcaattgcgcaacggaccatattctaaggactaacgtccagttctatttcggctcgtcaggagatgcttgttcaaaacgttctccgttcacgttcatggtttaactgctatcagagttttcagacattctgctattagctctgaaccaccaacagaacatcaggcttttatatatatatataattagctctgaatgtagtgaagatgagcatgtgacataatcgaacatcagcatttttttatatatatataattagctctgaatgtagtgaagatgagcatgtgacatgatctctcctgtgtatccgtcactcttgcgtttactatatatggttatgtttgtcaacgccaggttgtggaggcacttgttcaagacagaaacttcaatcaggttttagattgccaactgagagaatcaaccacttcctttatgacattctgatgaccatcattcaggattcaggagggaattaaaaaaaagtgacaagcatttcagagaactcgcaacagcagctaagttacatgatataaaagggaggtcccaatcaacaacgatttaaatcatagacggtccaaggttaccacagcttgttagaggcatttgattacagaatcatttccagtccatttggaattgagtactattactcttctagtcgtc

SEQ ID NO: 96370 - DNA, 514 bp, Oryza sativa
ctgagcaaggcaagtcacatcacccttgagcatattgaatcccagtttataaaatttttttgatttaaattattgcattatcgctttatttaaattcccgcgttatcactgttttttttagccatgcctatttacctttgttaagacattattattgctattgttattattaccttgttcaccctaggataaacaaaaccccaactagtggacattatattcatggttccactagtatgaatttaggtagatgcttcgctgattaattaggcaacattaggtggttttataactttaaactttgggaattctcatgtcatttggacactttggaattgttggattatggtggaattggacatacacctctcttcctctttcaaaacccctaaagcctgttttcggtggggtttgggtgcatgccagttatgggaagtagcaccccggccactataaggattaagctcgggcctctgttgcaaagcactaccgtactaaccacatgtctaatggg

SEQ ID NO: 96371 - DNA, 1885 bp, Oryza sativa
aagccccggacgccgctttcgaaagagaagactccaaccctgtgcaaggcaaacccctttgatcacattgcccctatatttttaatgatatgttgtttgcaaagatgcattgtttagttcacacgattaacatgtttaggcctcggattgtttatacaaccgacggaccaacttagtagttgcacttatatttcataggttgatgtttccatacctttgatagctccacaaatatttgcgccggtatcgttatacgattaccgaggtagtttcgcttagccatgcttacgttattgccgtgtgggaaacttgggttattccaaatacatgcttaaaaatctggtacagtgtaccggggagttgtgaaataaaatgtgttgtgaaagtggtgatgatgcggagtcacgcctttgtggtttggctacgtattattgttaaggaccgatttctttgggaaatccatccgaacacgttacagtgcgaccacacagatatttatgggatgcctctggttaagtaaattgttatcacatgggagttggtgtgccaatggttgtggaatgccgaggatgaggagacgaagtattacacatttattgcccatcatgggtgtctttttgcctctattgtggcgtgataccagtaagagtaggaggcatcctccgtatttcctgagtggatgacggctgtcattgcctaatactcggctatggatcttagcccaactaggtggcatgcgattttcatgtgttagctttggaaaggccttatcacgaacttccggtactggccagtaccagtgtaagtttcgtgtcgtgtgggtaaagcgtgcaacctctgtagagattaatgaactgttcgaacagtcgtgcccacggtcaagggcgagtgtaaggtgtttctcatagtgtagatttgtttgacaaaggtttgtgaaaaaagtggttactgaaaagggaacgttaccagagtccgcctgtgtagcagacggctaacctttgtggttaggaacgggtctgtgtgacctggggtgtcgtccgacaccgacgtgttgttagggccatgatggcgttgatgtgctaaggtaattgggtgaactatgtgttgttgtgatagtgaaaacgagttaatgagggaacaaattaattgttgttcgttaatcttgacaaggttgttgcaaagcaaactttgtggaatgggttgaaggccgtgagcctcctcccgacaactaaaacttgactcactcactaggagttttgtgaaataaatcactttgccaaaaaggcagctttcgcaaataaaacataagcctcgttgtgtaacctaaacatgtcattcttccccctggcttgctgagtacgttaagtactcacccttgccccttataataacctatagagtgtgaagacgaagatgtcgacccgaccgccgaggagtatctccaggagcaagccgagtatgaagacttctagatgtttcgtgcctagccccaagcctcgcttgtggaataagttagttgcctaggttctttgcctagtgcatagttgcttagtcgcttagttctccgcgctattcacttctgcgccgtcgcttttatggttttatgtaatgttgtgttgtttatctatgggcctgtccatgatggcaacttatgtaagtactactatccagtgatgtaataaagcagtttactttgattccacatttattctgtgtataccagctaatgtatcctgggactggtactatatcacaggtaatgcataacactccggtgtgagttagctgtgtctatggctaacgaatgacaagacgttactgctcctctctctcccctcagcgcccctctcgataaccgatgtgatggttcccaaccatcgtgtcc

SEQ ID NO: 96372 - DNA, 514 bp, Oryza sativa
caaaatatttgaacaaatatagtggtcaaatatgacaagtatactcaagaggctaagcattatgatttcctatgtatgcactgaatttcgtgcaccacatgttattctgcgatgctttgtggctcctagattgtgtttgattaagattgcttgataaaaaaaactataatggtaattaacatagaaacaaccatccaatcatgaaaaaggaaaataggtctgactggcaggtacattgtacataagctgattggctgaggttaattaacttatttcccaatgccttgtttagtgctttcttacctctgtttgtctgctgagccaaccttttggggcaaggttttagttggcatcatgccccaggaatagatagctgacaatttatttgcacagttagttgaatgtggaacacttcagtttcacttcttacctccatgttgacatgatatatatctttatcctgaagcattgactttggaagttaaagtgatacccaaatagtctgagaaaagat

SEQ ID NO: 96373 - DNA, 715 bp, Oryza sativa
actagaggatcccccgaccggtcttataggtgctggtttgcttaaaaccgacatctatgaagcttttttcttctttttacaatataaaagtaagaactggtgcatataatcactcattggcactggtttataacaaaactgacataattaatcccccaaatcataggtgttgattctttttataaaccggtacctgtagacatcacacaggtgctggttcttataataaactggcacatacaagtgcgatgtcataggtaccggtctttatcatgaaccattacatatgggtatcacatatgagtcgtttcttaataaaaaccaacacttataagcccaaaggtgcatgcttactattgaaactgatgacgtaattcatatatgtgtgttttttatctaactttttcatataaagtcgaatgaagaacaacgctataacaattgtagagctcaatgatatctacaattgtgtagttgatgacttttttatttaagatcgtttggatgtccaaaaatgtgttaaaaggtctcggatctatttgcataagtgattttttcaaatttctaaacgatatcgggtaaagacaaaaactatatcaaagttgtagctctagatgagatctacaattttgtaggtgataaacttttcatttgacctcatgacagtagtctcaaaagaatagcatttattttcaatacatgaactgtttgtacg

SEQ ID NO: 96374 - DNA, 770 bp, Oryza sativa
atagaaatatagaatagtgattatgataagtttaaggtcagaagtgtgcctcctagtgcataaacaaactgcctgcatgtgggggtatgatgttcttttgatatggcatatcccctcctgtgccactatataaaggcccctcactccaacttccctctcataccacacactagccattacattctacaacttgtctatctccatctcttccatcctttgccctgcacccagcattctcatcagactatgaagattgaaggccgaagggggcagatggggaggctcaacagagctttcagggagaagagagctaggttctacatcttccgccgctgcgtcatcatgttgctccgctggagcgattgatcgatgtccattgcggaccttgttttccattccattctggatggaattttttttggctctgccattttggtaggatttagctagaactgaggtgtagttgctctgtatagtttggcaatgtaccgctctgtagtctgaaggtttcattttgggagatgtcctttttctctagcttgtgagagatccaactctacagtcttgagatgtccccccctcttgtacaacttgagaaaaattgatatggaaaatcacttcttaattgccctacaacttgatggttccgtttgctgttgatgatgatcgccactgtggaaacttgcaagttgcaagacttgaaattgagtgatggcactttactttttttttcgaaactgcactttttaaatgtttgcagtgatttgtat

SEQ ID NO: 96375 - DNA, 521 bp, Oryza sativa
caggcgctcaactggggtataagccgggactccacctaagacatcttctccaaagcttctcttactgaagaggggaaagattgagcaagaatgagtacaaccacagtactcagcaagccacaccggagatgcataattaatgcaaggggggtacaaggggataataatataggggttaagttttgcagtaaacagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggttccagctagtcccaagccaacccacgccaaccattccacattttagttggtgagcaaattttaagaattagaacactgacttgggtacattgctcagcttgcccataaccgagggcgcggctattcgaatagattatactctgatcagaggtgtacatctttacccacaagacac

SEQ ID NO: 96376 - DNA, 625 bp, Oryza sativa
agcccactatgcttactgttttggcacaacagcagattagtgttgtgtgattctattcccttgttgggtgccaaatgtttgaccattttgcaagtggatagtgatgcaattcccaattgcttcacttaatcttttttgttttgtttcgattaaatgtttttgggtgttgatgggattagctcataatccattggatagttatgaacttatgatgttgtgtccttttgctcatactccactaggggattgtcatttcataagaacactctcccttagtatttaaatatatatcactgttgactttattcggtcaaaactttcaaagctttgatcatcaatagctctccatatatttggtttggaaacataaaaatcatgcttatatgtttttctttattttataatattacactttttaagaaaatattatcattatattctaatagaaaaatggttgttaaactggcatagattgaccaaagtcaacgatgccatatatttaaatatgtagatagtaattgtagaaacaattaataatatttaaaggacagtgtcatttgtggtgattgactaataaagaagtgcattcatcatgcacttttactgcatgtcattggtcatatac

SEQ ID NO: 96377 - DNA, 692 bp, Oryza sativa
ctgatgaccaccctggcgtatcacagttgtatgctattttcttcaatatattgatgtataaaaaaaattatgcttttgttaaaaaaatgattaaaataaaatattgttttgtgtcttagttactactagaggaacacttacattttgaaatggagggattattttttttaagaaacaaatggagggattacttaggagcaagtggtcaaacatatctgtaattatttacagaaatctaagttaataaatctttttacatacacgtgttcgttttccatgtggcaatgcatgcgtaggaagctggtagctaggacactagccctccagccttgaccgctgaagcacatgcaggacgataatatatgatgcaataatcgatcgagttgaccgcacgtctcaatgtatcatgcatcagctccattaatttcgatcgacaaatatatatattagtgcatgctcttctggttatagatatttatgatttaattaaacttttgaaattatgaccatcacttatttctcacattttaagttgtttttaaagaatatatatatatatatttggcttgaaaagaatcatcatagtatcacaaatatattatatttatgcatatactctaatataaaattgatggccaaaaattgacaagtttaatcaaacttttcctaatcaagcatcaaaaacatctgcg

SEQ ID NO: 96378 - DNA, 683 bp, Oryza sativa
cttcttctgtccaaggcttgacacctccgagacgtgcagcatatttgtctggtcagcaagttgactatctattgagtcttcaccttttccttctctaatatcaaaaccatcaaaagcatccacccttgtgggttgatcttcatatctcttagcatcctgtctaatacccgctgacgaagaactcacacttcctgggcccctgaaagacaattttctctgaacaccttgagaatgaactgcttttactttacccacttttctctcaaagggttttaagggcgaacaacggagttcagcagaaaatactaaaggctcattctcatttgtcagtctcttttcgcattctttatctgagtgtccgataaacccacagaagaaacaaaagtgtgggactctttcatatcgaaggtgaaatctgcgagtctcctctttgccttgcacctttatcttaatagctagcattcttcttagggggcgattgactgggagatccacccgtatacggaagaaatcatgcttattgcatccatcctcctggacatccacttcgcgaactttgcccatcttactgccatagagttcacctcttgctctgttcatcataactaggggaaggtcatagatcctgacccaaatagggactgtatccaagttcaccatggaagggtttaacaagccattaa

SEQ ID NO: 96379 - DNA, 517 bp, Oryza sativa
ttagctaattttttttaaaaaaaatagattgatataagtgagttcaggtcaactcggtatggcaaaccagactttgaaacgaaagtccaccggttactatttatttgacctatgtgggttgacccactttggtctctacccctgaggcgcttgccggggaaggacaagtctacatctccggatggcaattaggccttctcctgctaatgggccggacacgcatcgctacaaaattcggcccaatttgaattcaacgggcccggtgctcccgggctgggccggcctcttcacacgcatggatccacgtgacgtcacgccacgtcatccaccattcctccattcttcccaaccatctccaccttccccgcatccgcagtcgccgccgatctccctctccgctgtcggagacgacgcggccaccaaaccctagccgcagcagcagcagcagccgcccatggcgagctcacgcgcggatccccgcccgctggcatgaccgcagcggccgccgatggagccg

SEQ ID NO: 96380 - DNA, 647 bp, Oryza sativa
gctatctaattaaaaatggtctcatcaatggcatgcagaatcgcagaataatcgtggaaggatataaaaggagggggcatcatggccacgtcggtttgtcgtcggagaccggagctgacttgtacatataccggctggactagtcaatccaatgactctgaccaatcgacgatgaatattgggatgggatcggcatcggacggcccggatcacgcggcacaagggctagtccttttcacatgcactaattaatcatctgtagtacagtattactcctgcttcttaatcaatttcacactctaattgacacgcacgcacatggccatcgttgatcatcgatgctatgaaaagaatatactccctccatcatccataaaagttagaaatatctcactttgagtttttctaaataagttattattatttatagtctttatacattcaagacttaaatgaaaaaataaattaaatgtttgattagtatctaagaagtcatctaaatactcattggttgcatgcttgcattcacttcttaattttgtaacatctaaaatgatttaatttcttcttgttcttggtgacaaaaataataggtgtaacttttgtgaatggagggagtataatcgacatggatgcatgatgtatgc

SEQ ID NO: 96381 - DNA, 742 bp, Oryza sativa
aaaggagaaatattccttgcatgtagtagttgtttgtatgtactatactgttgcaattctcccattggtgtatacaaatacgaaattcatgtgtttactgttgcactattatctacaaagggctaccagagcaggtataatagcaggctataaagccagctgtaaacatattttaagtagataaatgaggagagagaagagcagcgggctatagactgtagcacagactccaagacgctgtgtgtatgacagatgggaccagatattaatagtgtactattgtatgaatgagctattagattggctataaatgaattggagctagtatttggctatactattaaacttgctctcattgtcgggttcccaatcgacactagaattttagcaatgatatgataactcatgggaggagccttatagctaggtaggtgttgcagaggtctttttagtcccggttaagattattaaccagcaaagacgacacatattattgcatgctaaaactattaaacacaactaaacatgttgtatcaagatagatttcccatctaaagtattatggacactgtaaaatcaacactagtctctctaatcactttagggccgtaccaaaaataggtttcccgtctaaagtatcgtggatacagtaagaccaacactgatagtctcctcattaatcaatgccgattaatactgccgacactgatggggtattattagtgtcaatccttgaacacat

SEQ ID NO: 96382 - DNA, 545 bp, Oryza sativa
cttacttgttgatgagatcgaatcagtggtttcagctccctcctcctctgcctgcatctgcatgtccctactgagtaaacatatggactgccattagagtggaattaatcaagaaaaacacgcactcatttgtagtcacgcaggttagctagcaaattttgtatgggtcaattattgccaatatatatatggtcataggtcataactagtgtgcattgtaatttgctttgtcacctatgtacataatttaactatcagctagctatatatatatactttctctagttttaaaaagatggcgtcgttgatttctagacatatatttgatcgtcagttttattcaaaagatatatgcgaatatataaaatataagtcatgcataaaatacctttagtaataaactaagtcttaacaaaagtaataataattatgacgaatggtcaaatatatatatatatatatatatatatatatatatatatatatatatatatatatatatatatatatatatatatatatatatatatataaattaacaacac

SEQ ID NO: 96383 - DNA, 522 bp, Oryza sativa
gttattacgtctgacaaagagaggttccgttaattgcagagaatgactcgtgtgagcactgaccagtcaaagcatgtacagctcgttgagtagggcacacgtgtgaatagatgcctttgcatgcgtcgccatagctacttaattacaattataatagtgtagtacatgattacatctaaattggtaacctttctcctctctgttttgtaaacaagtacatctacacgttgacagcagtaagtgcgtgtgtgaatagtgattcttaaaaaaaaaaagactactgactactgcatgtatgagcaacaggactggtgttttctcaagttggtttgattgagtatgcatttgtatttgcagataacaagtggattccacacgcatctgttaagttatatttacgtgtaattattttacgcgttcgtgaaaaatacttggttttctttgacagatgattcgctggattattgttatagcggattatctagttggttataagaaatctaaatattaaatatttttaaa

SEQ ID NO: 96384 - DNA, 581 bp, Oryza sativa
ctatttaacaaaaaattacagatatgccaaaaataatatacaacaaaataataatgagtacatatttttttaataaaacaaatagttaaacatatgttgaaaatcaatggcgctgtaagcatctgagatgatcttgtcttgaagaagggcaaaatctcttttgaaaaggcacatggttcttcctttccacagtagatagcaaaagatgaaatcactggttgcaacaggtcaagctgccgctgtcaatctatcaggcctcttttttttacttgttctatcaacctgttcttctgtgatattcctaaactcctatggtagcgaaagctaatcgaatcccgtcagacaccatcttatcagacaaagcttgcaatctagtactctactactatatggcaaaaatcattttgtttaggggatggaatccctaacttttatgaaacataaaagagtatatgattctttgaagaagctacaaattgtcatatacaatttatttactttttaaatgtcaggtggtgcatggacacattcaaaacctgtatcatttgcacagttgaacttttcatcttgcaagagttatt

SEQ ID NO: 96385 - DNA, 630 bp, Oryza sativa
ttgtctgcgtctacaaaccaattagtaggttcaggctatctgattcatatggtccatttccatagatgtgaactagacatagtttttagctgaggtagggtcgcaatttggcgattggtatgaattcccaagagtatattcatccaaacgccaagcgagtaatcatcacctaaacaagtggttagattttttgaatcttgcttcagaatttggtacagttgttcgatctttctctctctttcagttttgaccttgtgaagaagtcgcaatatcatgcgtgccaaccttgtcaagcgacggtacttttgcacagtatttagatataatcatttttatttaagaaagagatggcattaagtacaccctttgtcccaaaataagttcatttgtaggtttctttgttcaatgtttgattgtccgtcttatttttaaaaagttatgattagtacttttgttgttattagattataaaatatgcatgaatagtattttatgtgtgacttacatttttaaaaaaaattatattttttcaaataagacggacggtcaaacattgacacaaaaacccacaaataaacttattttgcgacggggggtgtagatgatataatcacttcaattgatagcaac

SEQ ID NO: 96386 - DNA, 636 bp, Oryza sativa
caaattagtctcttaggtttgaccatttggcttatccgacagtcgagatgctctgataccaacgtgtcacgcccggaaattcactagtgaatttccgggcgtgacagggagagagcgagagcacaggctgaacagccataaaagtgcgacgccccaactgtccctcaccgcatttaatgcggtaagggcagacgtgcggcgcgcctagctaacctctgtccaacggatgtgaccggcctgacaccgtcacatccgatggatagggcaaccatgtcctcacgtcgcccttgtacccggcggagtgggggtgggtatgacccgtcacgtccaagcgtcactcgaggaagggctgtcacaggtcatcgttcatttatgagggaatgacagggctgtcccccgtgtcaggcgggggcggcgcctggttccactcgagaaccggttgttgcttagcttccgggagaaggcacggtttaaagcccaggaaaagtggagtgggatccccctccgatagagggtaggtagaggcggcgcatatggtatccccttgagctataaaaggaggaccctgcccactgagacagaggaggacgcctagaaaaccttgaactccagaagagaggaagcgagtgcgctttc

SEQ ID NO: 96387 - DNA, 564 bp, Oryza sativa
ggtgaagtttttttggtgtttgcgagaagagcggaaaaaacccaaaatgtgtgttttttgtgagagagagcgggaatttgtcgcccccccctcttcaatatattttgagaagcgccgccacccaaaaccgccgcgttggagatatactcgcgatgacaccaggaggggcgccgcggaagagaaatatatatgtgtgtttcgtacgcggagtttggccctccagagcgttattgtttgcgcgtataaggacccgaggggtgcgcgtgtttaaagcgggggatttttgtgccccccccagcctcatttttggagagggtaacggccgctccccccaatgttgagaaacgcctacaggggtggaggttattaaagaaacgcccccccctttcccgaaaggaaagaagagggggaccaagttttcccgtttaagcggcaagggttcggaaacagaaaagcgcgcacaaaggaagcttcccagggggaaaccggccgagtattctttaaaatcccgggcgggtttcgcccccttttgatttaacgctgaatttttttaattgcctggca

SEQ ID NO: 96388 - DNA, 1334 bp, Oryza sativa
  unsure (1)..(1334): unsure at all n locations
ggatcccaagctttattgattttcgaacccctatcaaatgaaacgcgagattgcaaccccccaaagagaaaaaacggcagcggaaatggcgacgtcccgatcccccacgcggcgtgatggggaagaactcctcaggcgtacgcgcattggcagcgtcgtcaccgcgaaagcgccccccaaaagagaggaaaccggttacaaatacggaaacattaaactataaaaacatatatttaactttacataaattaaggttgtactatataactatattttagccatgcactcaagttagggatttgattgaagagtcaatcaatctttaacctgtgggtcaagtagatacatgccctataaatatcgacatatttagaaatacggtaattaccatattataagaaacggtaattttcgcaagaatacggtaaatacgaaaatgatcggtacaacagcaaaaccatttccgtttctgtttccatattttttaccattttcatatttttttggtcgattaccatttccatatagttccgcccgtttaaagtcaaaaacgaacgccagtcggccgggaattacccgtaccattttaacctttaaccaaacgatggggccttagcatccacaagtcaactttcatctcaaagaaaaaagaaaagggattgaagcttcatgccgagtgaaacatgggatgctgtagtnacacagacgctaaagaatggagcattacaaatttnacacacantgatgaanntcatgataccaancctactcgaataggctggcagatcatttatcatacaggctactggaaatcatggtnataccacgccaagtttgcccaaggtgagattaactcgttgggaacatgcaacttgttttcggcccagaaggtattgagaggcttaattctaatgccgggngtttaantgtatcattagaaaaatacagcttgccgccttaattcaggtagtctttgaaaacccacttggttgaaatgaaccatggtttttattacccaccccttaggtggaacttggaaattcctctgggggattattttccccaaaaaaaattatttccccctcttctttgtaaaaagggcgcaatggggggtggttgttaaaaaaaaagaaggtgtgtggagcgaaatattctggggatttttttgggccttttttaaaaaaacagcggggggggacaaaaaaaaaaaaccccccccccggccggggtgtttttttttttaaaaaaaaaaaaaaaaaaaaaacgccccgggggggggtttttttttttttgcgtcacaactttttttttcccccccccgtttcttttttgtt

SEQ ID NO: 96389 - DNA, 860 bp, Oryza sativa
cccctagggaaattggggggcccccgtgggggggtggcccggaaaaactcttgagtttatacccgtttaaaccaaaaagggcaccccttcggggtcaaaagtgttccatccacaggggcccaaacggggtttggggtgaaaaggggcggggcaaagcccccttgaggggggaggcagcccccagtgttaaactctaaccaacccgtttaaaaatggggagcggggataaaaaattttccctaacggacacaatagtgtggtctaaggggaaagcaaggcgggtgcgcgcacattgccctaaaaggcacgtttgtgttctattcccgcaaatgcctagccaacaagcaggtcgtaacagtcaccggaaccgttcataaaccggggttaacttgggtaacagtgcacggcataccaaacacatggcccgttttgtcccggtttcacagacaaaagactacatgtcctgcttgccatacagattaacgcaggcaacttttaaagtctgcaactcccaagagctagcagtgtacccaaatcagtttagagtcaagtgcttgcggtctctagtcaacttgtgtcctgtaattcacggaactgtcaagatacattttcaagtctcaaatttatcaacgtttatcattttggtcgtaaattgacgcgagcctattggattcaacgtggtgattatctggcatgccacatgaacactaaagtgacatgtgagatagatatcctagtgtgtatcctctacatcttctgtgcctaaccctccgtcgtagcccgtgtccagtttcttctcagcatgaatggcagttaaaacgacaaaacggaaagggcctgttagttagtccaccagcgca

SEQ ID NO: 96390 - DNA, 613 bp, Oryza sativa
  unsure (1)..(613): unsure at all n locations
acaatgatgttctganatctgttttggatatgcaacttctatatntgcaaggtacctgcagcttatgaagcctgaaatcctggcaaggtactaatgaagacaagcagttccatgaagtccttatataacaacagtgaagttctatattgttttatgttctattttcttagttagtatcttgtttagagaaaaggctttacaccctgcttttttagtaagcaacaagagtacaggcatggtgtcactggggacgattccagcttaactcttagtgtttgcaggtttcctatctgttacgcctttaatatctcaaagagtacagatttaataggcaaagcccagagaagtactagcacccaaaaaatttgttgctgatgttgaactgaaagtaagaaccagactaggtaagcaaaacctatgatccccagaaaaaagaattaagtctgctcacaactacacttaggtgtcaaacataggttgctacgggaccactgaatttaatttaagttgataaaaagataaagtatgatagcannnnnnnnnnnnnnnnnnnnnnnnnnnnnnnnnnnnnnnnnnnnnnnnnnnnnnnnnaggnggnttcaatcaagggcgg

SEQ ID NO: 96391 - DNA, 1387 bp, Oryza sativa
  unsure (1)..(1387): unsure at all n locations
gctggntttgatgaaactcnnnnnnnnnnnnnnnnnnnnnnnnnnnnnnnnnnnnnnnnnnnnnnnnnnnnnnnnnnattgccagatgcagaggaaataagcacgaagcagcagctcatcaggagaacgccgacgaaaaggattgtggccatctcgacaatgaacaattaatagttggtcgtcgtatgattcgagtctttagatctgcatataatatatatatatatgtttttctatatggaaggtatgttttaagaaagaatatatgtttcctttgatgctgatcgaagctcacatatatgaattatattttgaaatatgcattatttttcgtagttttacacatatatacatgtttctaacgttgttgtgaaaatatacttttcccgctgaacgggaacgcgccaccgcaccggcggcgcagcttgaagacgcgggaccgtgtcagtctagcggtgccgcgatacagttgtgcggaaccgacgcagttccgcggattggttgcgcgggattagtggcatgcatgcattagcagtaagttagattacgtgcgtagtgtagcatcctgtgagccggcattccattggctggctcgtgcaaagcatatgcacgtaagcatgcatgttttggaagagcatgcgccattccgcatcaccaatctgcggggacgcgacggtcctgcaagacacagncgcgggaccggcttggcaccacgtttccgctcttccagaacacgggaaccgacccgttgcgcaggnaccgcaatgttggcgctcgttcacatgcgtgaacaccccgggtgcgggtaccgagcacttccgcaatcccatcgtgctgtaccggataattgggctaaatcttctttgcctatttataaagccaacattccacaggaaggttttattcaattttttccacaatttgccttttttccggaaaaatttcccccaactgggctttctccctttaacggcgcaaatgggggggaccctttttcccccgcaaaaaataaatttggttttgggggttttaccgcccctttttggggaaatttaattcccccggggtgttcctccttcctctctggggggaaaggccgtctttaatntaaattaaagaggcccggtttttcccacaaaaatatctcccctcttaaaaaaattttgccccctttgttttattgggaaaacaccacccccgccgggtttaggggaaatattttaatgccccgccgcccggggggcgcccactccttgagagaataacctatcccccccacctggggcccaccctttttttaatattaataaaaagggggggggggggaaaaccaaaaaacccaaaaaacccanttgttttttaccaataaaatataatatatttcttc

SEQ ID NO: 96392 - DNA, 604 bp, Oryza sativa
tctttttttttcttaatctcattgcgcaaattatttgtattttgagaatatgttactctcataacttatttgggttcagagacaatggcaagagtctccagcgattggaatattactgtgagtattgaaatggcacaccgcacagatcgttcttcttttgacatatttttttggacaaaattcttttgatctttgccacaaatcattattgtcggaaacaatatcttgatctagtagacctattttgtttcaataccaagatctagtagtcatgatcagagagtatatatttagaagtctgtccattcagattctttgacacaatgtttatacatgacatgaaaaatttcttcgacaatattgcttcttgtagccagctcttttggttgtggaaataagtagagaactacagtctagagacacactctgagcttctttttttttttgaacgaattacacactctgagctttcagccgaaaactaacaatcccattcatatttgctcttattcacggccatttctcttgttcagacaaaaagcataatgaattcaaggatatatatatataacgcaatgaactctccagtcttactatactgcaa

SEQ ID NO: 96393 - DNA, 584 bp, Oryza sativa
tatatatatctctacttctctctcttctcctaatattacattgtatccatatacatgtaaggattgctatagttaaagtttatttatatgggtcccatctatatagaccacttttgtcatatacattggtgatgccctaactagcaggtcggttgtattattagccttgctctaaagacagcaaccctgagaaatggggatagtgtatctttttggcattaaatataatcaatttgtattaattataattaatttgccttatttgtacatttgtacgtacgccattaatatgcgctttttgccatccttgcaggcagcagtcaggttcattgtctagcatatatgcacatcaatcaaattaaatatcgacattaaaaagtctataaaaaggctaggtgatgcacaatcacattcgcacgccctagagttagatagacattttgagatcgattttgctcgcaaaacaggagaaagagaggcatatggtgctcaaatcccgggcacctaggggtttgattttgctggtgttgatgatcacactgcaagcagagtcggaagcaagtcccagctgtgacgatctaatc

SEQ ID NO: 96394 - DNA, 4010 bp, Oryza sativa
caaatttaatataaaattaattttgaatttttaaaataattgaatcttgtcctaaattgggagattaagggtgtgtttgtttcacggttatatatgcataggatatggccattcatattttgttggatatggtggtccaattttttgtttagttcgtatggatatggcgatccaatttcttgtttggttagaggtatatagcatggataagaaaagacaaaagttagtgggacccatttgtcatatatatatatattatcaaaatataatcatctgagatctttttttaaagatttaattataacaaatgtaattgtgtaatcaaatcataaattagataaacgatttaggagaaaaacaaatcatttggagcttgcttaacagaaaatcaaaccaaccatagccaatcagaataggacacgtcactcagaccaaaactggatgacttcatctagccaaatcggccggatgcactcatccagcatgttgagggaatattcccttttctgggccacctaatccaccctgctcttcaaccaaacaccacaaaaaatcgggcagccatctcccatccaggctcatccacccaaccaaacacacctaagaggagatttgtctcgttctccgccgcacgcttctcaaactactaaacggtatattttttataaaaaatttctataggaaagttgctttaaaaatcatatgaatccatttttaaaacttaaaataaaaatactgaattaattacacgctaatagcccacctcattttacgtatcttctcaatcttttcttctcatcttcttttaaacacagccaagtatcatcttctttgacatgagtaactatggactcatatcggacagggctttctgggactgggttatggggcgggagggctttgggcacatgtcgatcggcctaggccatatgtgccgatgttacttatatatttggatatataacctacatatacatatatatttggatatataaccgatacaaatcaataatcaatgcatatatatacatactactagtaaatttccatcttaattaagacagaagtcattatctaaaaaaattaagacagaagtagcagagtacttttgagtcgttttatgtcctgttctagcgataaaaatttctcttcaagctagtactttctaagtacttttgagtagctaacttttggcatcttgctgcagacgcatcgactttgatgagtgagtgcgtctcacatcgttgctaattaagcttgctcaacgcatagttaccgcgcgctagcttgctcgaacagtgggccccggcaaggcttctggcttcatctgatacgtccatttcagaatgaatggagcagatacgtccacgtatatgctactttcgccctgtagtccattatatccaaattatccatgcacgcctacgctggctgcggtcgaaaagtgatataccctttctcgttcgaaagaactttcactgttgaccaatataaatataattttagctagaaccatcaataagttttaaatagttaaatcatgttgtacgaaaatttcacggttatatttaggctcccatcggatgacctaatcagtcaaagaaaaaaaccaaaatttgaattttcaagcttaattttgagatattttcaacgtagttttttttaacgttggcttttaaatcaccatgaatacatttataaaagttttacctacaaattcatttttattttctaataagccgtttaatgggatcgatgggatctttagagtgtaacacacttcatcaacactttatccaatttcataattcttgatgttttagacaatgacacgatcttcaaaatatatatttgtctatattttttctattataatatatataatatatttttatttttattgtagtactttataagctaaatttatatatgttattctactgtatttaaactaaatattttaaaagttactgatagttcaaattgtaaaaatttactgatagtcaactatatgtgtctagaacatcaagaattatggaaccggagaaaatataatatatttgtgatatttaattatatatttctcaaaaaaagattaatggttaaagtttaacgatgaatattatgtagtgaccagttatttgacgacgaaggtgtatatattaggctttcatatatataattgcgttgctatttacgcaattatgcattacgccgggttatctctaactgcaggcaaaaggggaaaaaagggcagggtccagggatccaatgcagctacataaacatgtataattcctcggtcacatataaaacaaatatattattctagaactacaaatctaaatttatcttctgttcagattcgtagcactagaatatcaattttatttttttaaactatggttacaccaaaacctctgttgcaaatatacttgcatgatggatgcatgacctaactaacagtgcatgtgacgtcgacacgagacatcacaacatatatactaggagtcatcagccatacatgattcagccagaataaaataaaataaaccagccatacatgaagatgccaacaatgcatgcatgcatgcaaatggagtaatatatacggattcatatttatttttgtttaatgtcttgcagtgaatatattaatgtgtatatatgtgtatttatacagctgccctcactcacctaacgcaacttcaattctaagggtatataaaattataaataggcgacgacgatgacgcagcgaagaggccggaacagtttccaattaaagtttgctttacgatcattccttgtgacttcctcattcagcctacctagcaccgttcaaaaaaaaaaaatcagcctacctagctaatccttccattcctcctcgttttgggtttgtgataaattcaaatttaccaagttaatagaaaaatatacttttagcaatatttcaacacaaaacgaatatgctatactccctccgtttctaaatatttgacacagttgattttttaaacatgaccgtttgtcttattcaaaaacttttgtgaaatatgtaaaactatatgtatacatataaatatttaacaatgaatcaaatgatagaaaaagaattaataattatttaatttttttaataagaagaacggttaaacatatttaaaaaagtcaagaacgtcaaatatttagaaacggaggaagtatttaatagcggacttaaaaaaattaattcggtgctccattttaatttacttgtcgttctataacaaaccacacacaaaactagtaggcaataaattacattgctatattcataaattacattctaataatctttttcaaagcaaacattaaaattccttgtgaggtactgatgaaagaactttaatgtacgtgtttgtctatttgcataaatattttttagaaagcaagaataatcaatcaaattacaaaattcaactgcatcatatatgcatgtaccctgtcccataaaaaaccaacctattactggatgtgacacattctagtgctacgaatctagtcatacttctgtccagatttattatactagaatatgtcatattcagttttagattcgtttttttcgggacggagagagtataaaactttgccgcaagcttattactagggagattttcatattattgctgcttttaattttacctaggttagttagaaacattcagacatgtacatatacaaccactatatagagtacagatcgattggctagctagctaggtatactactagcacacaccgacacacgtaaatgcaacttaggccgtgtttagtttgtcccaactaccctaaattttcaactttctatcacatcacatcacatcacatccaaaacttttttacacatataaacttctaactttttttttttaaacttccaactttccttaaacttctaactttttttcaggaactaaacccacccttatacacagtgatctgtcttctgtacaccgtactagagt

SEQ ID NO: 96395 - DNA, 674 bp, Oryza sativa
cctgcagcccgttgtgttgcggcgtgcagtgcgcgtgagtgcgtgggggttctagttggggaggagacggaggaggtgaagagcagttaaggccgtatcgggtcgggttgggttggtgcaccagtctgcccgcgtggctaacgctgtggatttccttccgtttcagctcggatcacggtagattacgataatcaaagtgaggtttagtggtttatactatttttatactgtactgtagtatatgccaacttgctaagggtctctgattgtttctttttttttcatttagtttttgacaaggtatgtgatatggaagagattttttttaaccactcgcatgatacggtgcgatgttctgttgatagagcatgaaaaaattttgatagagcatgaaaaaattataagattacaaccatataaggtcgtaaccaggataaaaaaaataccaccacccacataccgacagcaccaacacacaggtccgggagaaccagagaagcctatcaccgtaccagccgccgctaagcgtgaccgaccaccgctagactaacaaaggaacacagaagagatcgccaaaaaaacgctcttacaaccaacacaaagcctaactttatcctaaagcgtccttgcaccaatttttatattgttatatacgtgttcaacgattatacttg

SEQ ID NO: 96396 - DNA, 823 bp, Oryza sativa
tttgaaaggaactttttaattaaagattcatgtaagcgagagtaataataagaccatttctcattctaccacaactagcctaactaaatcatccatcactttatccatcaaccattgtcgtcaataatgacgattactaatccaaagagaacagttcacataacaatcctaaaacatcccttcagaccgaaaatagcagctcgattgcagcatttaaccacttcatttgcttccacaagcaaaagcacacgaaaattcaaccgccgcatcaagtccagaagaagaagtaccgcaagatatcccctgccaatccgcacaatcaaattgaatcgatcgacccaacctaaaccccccacacgtttctcaccacccgcccaatctctagtgcacagtacagcactgcatcgaaatcaatccccaccttgacctcgcttccaccgacaaatcccatgttcaccccgaacagtacttagctcgaatcatcgcctccgcaaacagtgcaacgaccaacggccaccaaccaaaagctagtgcaacacgtacgagcaaagcatccaagcacgaagcgcgagcgcggagcacttaccatcggcggcgacggtggccgcgagcgcccgccggggcaatgccgccgcggcgatcagcagcagcagcggcagcacgagcaccgccgcgggagcccctctccggaagcagcacctccctcccgctgccatccgcatcgacgcaaactctctctctctctctcccctccagcaattaatcagcggggcctccgccgaagcagcatcagccagatcaacccgaagcgatcgcggaagaa

SEQ ID NO: 96397 - DNA, 813 bp, Oryza sativa
aatatgatctttagtcccggttgatgtcaccaaccaggactaaagatcctcgcccccctgacaaactactgacacgggatgaaccgggagtaaagatgatttttagtaaaataggtgtggtgtttttaaccgggactaaagatcatttttagtcctggtttttattgcaaccgggactattgtggattttggtcgaccgaccaaagatgatttctccaccagtgcataattccgattaatcgtcatccctattccggtaattcattaaacattattctctcatgcgacaactgactccttgtttcataacaccgttttacattaaagaaatttgatatctctcaaggaccgtagtctgtaaaggttatcttttcttatgctcaaagtagaagaataaaagctcataccttaaaattatttttttgccttattaattccagttgctatccaagttagaggttgtagcttgacaaataaatacattccaaataagtcctaagtattgttgagttgcataccgtttttgacacacaaataccgttttggtatatgaagtactccctccatcccataatatggctgtgttagttccacgccaaatttgtaagtttgaagaaattggaacgatgtgacagaaaagttggaattttgtgtatgtagaaaagttcgatgtgacggaaaagttggaagtttgaagaaaaaagttggaatctaaacagggcctctactatcttttgtaaaaattaagaaagtgacaaatgaacatgtgatgggataaaaggtgatgggtgaaagagtaaagtaatactctct

SEQ ID NO: 96398 - DNA, 701 bp, Oryza sativa
tgagaaaagacgatggtgtctttctattattagtccaacagaagaatattgagctttctgcatcctatctttaaagattgtgaacatatgatcattgccatcctttagacgatcatatcatcttattttgtgttttataaacaccatttttttggcccttttagaagatgaaaaagattcagctgggaatacttggataggttcagagagatgttgtgcatgagggtgagctcttgatccaaagcccaacccctggcataagagggtgaaaaaaacccttgtaaaacatattgagaagaacttatgtctgtgccaaaagttttaaaagattgattgagagttaggtcagggttagctgtagagtttgtgcccaccaaatctaataccactatttttgctagcacctttttgctggaagtagtattctcaacagcttacccgagtgcattagaaccttcaccacccctctgttcccaagtactatttgttaccattgactggttaggttataatgaatgaaagctaatgtttatgtttaggatgcaacacaatttgataacacaacatctttttgagtatttataatttttttttccaaaatacaagtgatcaaagtttaaatatgaatggtgtccgctgacaagtatttgggaacggagggagtactatattttgggaactctactagacctatctatgct

SEQ ID NO: 96399 - DNA, 672 bp, Oryza sativa
atatttgtattaagcttgggactgaagaagctagcagtgctattatactttgttgtttgttttcatttctctatgaatacattacaacaaaaattatcaacgagggatttcccagctggttgagtagatctcaaccattgtctcactaagacattgtgttccctttctcttagttacactggagaacaaatatttatagtgaagagtattgtttatttgtttctccttcatacaaggtcaatgaagtttggcaaatcagaaattcagaaaatactccctcagtctttttttatgtctaacgccattgaattttgaacataactttaataattgaattttgaacataactttaataattgaattttgaacataaatttaataattcgtttaattttaaaaaaccatataatcattttttattacaagtacattaagcatggtttctattttttacatacttagattaaacgaatggtcaaatgtatatataaaaatcagagatttgttctggtccagcaaattatacctcaatgcaccagtacttggtggtacctgattgaatctaaccgtccaatgtccaagggcatgatgggaatggatcgggatcaggtgcagtccctatagagactgcaactttggcagtagccaatctgaaccgttcaaaaaaaaaat

SEQ ID NO: 96400 - DNA, 554 bp, Oryza sativa
gctcgccgtcgcccagacaaggcggagaagaggcggtgggtggacgagcaggtggggcttcacctggcggcgagggtttgggacggctacagctacggcgccggctacggcaagggcggcgccgtcgacgtgagccgctacggcgacatcggcctgaaggcggcgctgggctacgagttcgagcgaaggtggtggttcgccgagatggcgcgcctgctcgccttggtcgacgaggacgacgcggcggcggcgccgtcaggcaacagcggcgacaacacgccggcggcgaagggtgtgtctggaagtagtagtaattaattagttggttcgtccagctattgggtgtctctctctggaggcctaatatgttgttgttaatagtgttcatcttttaggtttctgtcagtatatattttgcagtgttcaattgttcatagttctgtaaaaaaataaaagttgtacgagactacgagtacacttttccaaagcggaactgctatccgactgtcgacagtttttacgagcgaaaactgtcaaattttttagccattgat

SEQ ID NO: 96401 - DNA, 768 bp, Oryza sativa
cttccctcccatcctaatctcatgtatatagaaaaccgctcactagatgtttggctattccccaacgcccgcgtcgctcgccccagggcgacacgggcggcgacaccgcgcgcgccgccacaaacttctcctcctcccctccgcctcgccgccgcccgagcagccgccggcaaagctgcgcggcggcaaggacggcggcggcgggaccttctccctctctcgagaagcgcggctagggcaccggcgggacctgagcaaagcggacgacggcgacagtgtccggcgccatctgggccggatgtggcggatccggctccgccggaggtggatctggccctatcgcggccagatcaggaggggcgtgccgctcttggcaggaggcggcgtgggaggcggcgaccgcgaccgttggtgggagggacgacggatccggccactctggcggcggatccagtccccctggatggctgcggccggcgggcggaggtggccgacgccgaggaggtttgtggcggaaggcagtggtgacggcgaccgacggagtcgagagggcggtgacagcagtcgacggagacgcgtaggcggcggcagcagctggtcggcgggaccggcgacggcgtgcatggcgcggcgcgcgcgagatccggtggtgctggaggcggggtgggagatggtggcagggcacggtggctgtgctggcggcggggtgggggctggtggcggggctgagtggtggcggcggtggagcctggtggtgatggcggcagc

SEQ ID NO: 96402 - DNA, 775 bp, Oryza sativa
tatttttttgttaattaattactccatctatcccagaatacaagctttttttttttttttgactctgacatggttttcgatatgttactttgactaacaatatctataaaagtaagatgttttaaataaaaagatttgcatattatgataatttgtttaatgataaatctagtaatatcaattttacatgattgatcttttaattttttttactattaatagtcaaagtttaaaatatttgacttgtcactttgttaaaaatgtttatattttgagacggagagagcacataagagaagtccacacattggaagaaacgaaaattagcacaaattcgttccgctaaaattctattaaaagtgcatacacatgtgtgattattgatttaaacaccctgttgattggagatatgcacccatgacttcatcgtcttatctacgatcatccaatgcttgactcgtccaattcttatactttatctttactagtaatatgtctatgcgttgcaaaagacactacaatataaacaatattcctaaacggctaaaatgcatttctgcagatggatgtagcaactgcatgccctcaggtgtatatagaaatagggatttcccagacaggtaacacaaccacacgtgaaaataggatttttacacacgacacgtttacccgactgaaaaataaagaatttttgaataaataaataaaaattccaaaaagaaaaatcctaaaaaccctaactcacgtatctttctaaatgcgcgcgcacacctta

SEQ ID NO: 96403 - DNA, 770 bp, Oryza sativa
gattgaagtgaggagagaatttagcagctgtgtataattaatcagagaatttctttactgcaaattaagtgttatgtttttgtatggtcagcaattgctattgaatagcatatataatattgttaagagtaaatttcacaaaactattaatattttgatcaaactatcataaaaatacttatttaatttatgtgtcataaaactacatatttaacgttaaaattatcacaaaaccgaatatcacgaaactactatttatattgaagttatcataaaactattgagtttaaatccatagcattgccatcatattggagctatgataattgtagttttgtgattaaattggcactaaacttagagttatgtgataaatttgctacttgatttttatttttgtgacactctatattaaatctatagttatgtgagaaattacacgttaaatctataattttgtgataatttgatcggaatatctattgttaaatgatatgtgacatacaagcatatgagtttgcaagtatatatataatctaggattatgataattgactatgataaaaattttgacatgtaaataaatttctgctggaagaataatcatcttataagtgatctttattcaataagctgacctagtttctgcaatgtcgatttctggggaaataattaaagctaatcatgcctatcactaaacagtgtaaactttttattgaaagcagtagtatcaataaggtatagtccattatacgaaatagtaataacgt

SEQ ID NO: 96404 - DNA, 619 bp, Oryza sativa
agttcagttcttgggagagacaaattttgggcgaaagctctgccttcgggccggcaacaacgatgcctgtgggtgccgttttttcctcttggggtgttgccgcttttcttgtctctcccaattactttcttcatgtgaaaaccttgtcctggccctctgggacaggcgacagcggcacctttggtgtcgtacccttttcgaaggtgtcgtctcgaagaccttcagtttcgctcgtgcagtgggttttgttgtagatgcgcggtgtggttgtattttctttttctggtctgtggtcttccaggactatagattgtatttttctcctgttttatcaatatatgaaactcgcgctgtcttgtgtggttcgtttaaaaaaaatagaaaaccgctcaaaaaaaatgaagctgctataattaacttgcgatagatttttgttctaaatcattcaatttttgggccgtttgatatgctgagatttgtgtttgacataggaaaaaagtttcacgcattgtgattgctggaatcaaacccttgacccaacaattgcatgcgcacatacttcccactgagctatcttggattttgtaatttatgcttcacctggatcctagttacgtgg

SEQ ID NO: 96405 - DNA, 784 bp, Oryza sativa
ggcgaattcgagctcggtaccctataggggtgggactttaggcccggttggtgttatgaaccggggctaaagatcgccgagatctttagtcccggttggtattaccaaccgggactaaagttacgatcgggactaaagatgcgcggggggcctgacaggccctgacagcatttgaaccgggactaaagatcaaatatgcccgttaccctttttaatcaggactaaagatcatctttagtcccggtttttgttgcaaccgggactattgtggaattagcccgaccgacgaaatatggtttctccaccagtgatcaagtgtcaactgaaacactgttgtctttgactggagagagcacctacagtgcagctaaaaattgttccattccgtatcataaaaattgttttaggtatgtcctaaattaaacttcttcacgtttagaatgagttttataaaaggcgtagtaacgtctataagatcaaattaataagttttattaaatacgtctttatagtatatttattttatattaaaaatattccttttttttaaaaaaacttggttataccttagagaaaaagtttgacttgggataaacttaaaaaaggcttatggagtagtaatatggaatgcaggcagtaccatgcaggcagtaccacagtgaatagattaaaatcgaagttagatcgatcccatcatatgtctagttcaataaaattaacttaaatgtatatttaccaaaaacacttaaaaacaattttaagtatatatatataatgtaagttt

SEQ ID NO: 96406 - DNA, 878 bp, Oryza sativa
cagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttatagg

SEQ ID NO: 96407 - DNA, 767 bp, Oryza sativa
cgtcttccttctttagtactatcatctcgagtgtgctgatgtgtgcctttttgcccgatttctctgcatcttgtcattcaattaacaggctgttgcatcatctcgcaagttgcaactacatttcggttatagccattatatctaaggcatactctctcatttcggttatagccattatatctaaggcatactctctccgtccccccccccctaaaaaaaagagaatatgtaaccctaggtcgagttttttttggacggatggagtatgatttaatatgctgtgtctactaaattacggaatttttcaccaacaaattcaaaaactagaaatttgttctcatgggcaagtcctttaaacttaagggagtcgtccatggaaattgatttccaagagcggtcgttatttcgcttgcccaaatcatgtgatttttacaaggccttggttgtaggcgggtctaaaacaccattgtaaacaggttcttgaccgccccgcacaaacttttttttaagcagtggtgatctatgaacggtgggagtgattgtatttgcgcaggtggcagtgaagcctaagcccttctctccactaggtgcagttactcattgtgacacatcttcatcactagttactgacttttatatcatcatgtaggtcgaagctatcttgtttcaaattatgatatcatttatgccgacaacactcactctttgtttctttagatctagctctttctctctttggatggaccctacaaattttgaatgcatgt

SEQ ID NO: 96408 - DNA, 610 bp, Oryza sativa
aaaggagtttatgttcctccaaacaagtataacaagaaagcagaaaattaaaaggaaaatgggatggttgacagcacaatgtactatatttttagttgggtaagccctgataagaaggggaaaagtaattcacaattttccgattacccccttctgcaattactagaattgcgatcctgaatcaaattgtatatgcttcagtagaattgaactctaggatcaaagcgtagaatcttagacctattccaaagtggcatgagagtccgtttgatcaccgtggcacctaatttgattcatttatcgtttatcttagcaccataatactgtattcctcttaataacataataccgtggaatacatgcattattgactgattttttttcagcaatgtgcagtacattccatgggttaatggtaagcatgtttattagatcatttacacataatttggttggtaaatatactccctccgtcccaaaataagttcatctttgcctccacttgtttgtcccagaataggttcatttttaagcaatcattacattgtagtttgtgaaagtagggggacaaatgcgttggaagtaagtgggggacaattccatcgggatt

SEQ ID NO: 96409 - DNA, 563 bp, Oryza sativa
tctgttctgttgttcagtgagtggtactcataggtgttatctcctttatgtactctgtttgttcagtgagtggttaccattggtatatcatctcactgggtggtaacaattggttgttaaaatcacgattctagttatagggtgatttctacgattccacccaaccaaacaactaaaatcatatcaagaatcatatctggaagtctcgcaatcctaaaaaaactcaatgaaggggcaagtatgtcccccttgagttggctttaaagaaggggcccccgaaaccttgtgcagggaagtgggtacgaagcccaccgagacctctactgggtgatctaccactgagctacagctcatccacgaatgcttgtaatcccagtcataggatcactagtcgtgtaggatcgtataagattgtaccattctgggagttggcttgtgtggtctttctcaggtttggaaagaattagaacttctacgttgattactttgaagttattatttgatgaattagattttctctttaaatttggaatcctgaaggatgaaaaagtaaaaatggatta

SEQ ID NO: 96410 - DNA, 584 bp, Oryza sativa
ttgcgccataggtctgcctcagggaaggggggatccaccccgttgactactccagccattgcctcccgtcggatctagccattgccaccgccgaccactcccgctaccgccacctctccaactcgatctggccaggggggaccagatccgccatcgggcgaggcggatctacctccgacgtggctggatccgccgcgcttaccacctgaccactgcctcccgcgacctgccgctactgggattactcgtggggagagcgtcccgccaccaccgtccttgcggtcagcaacgtgacgaaggacgaacggtcaaacatatgctaaaaagtcaacggcgtcaaatatttcgggacggagcgagtatcatgttctacaaaatggcttagaggctattgttcgctaagagtactgctgcatgtattggttacttagataccggtcataaaattactgaacacataattattatatctctaaatacatgaattaaaaaattatcgtgaagaaaaactatttgcgtaactgctcctcgactcctcgtttgatagatccgcatatttcgcaaaaaatgaagaaaacatcccg

SEQ ID NO: 96411 - DNA, 522 bp, Oryza sativa
taggggataacttatatctatgaaatataacggatcatgacttaggtattacgtttccttatgtattatggaacggcctaaagtcctggtttgataatattgtaaagtagatttagaaaaccgataccatattggttaaggtttctatcttgtaatcctgacccccatcttatataaggtgggcaggaagccctctagagggcatgatacacaactagatcatcagatctataatacacccggcggattcaaatctccaaacaggagtagggtattacctcttatcgagagggcctgaacctgtctaaatccttgtctccgcatccatccactttcaggtcttgtgcgctaccccttttattattgccgaattcttgtttcgacaatataccatctccatctaattggaaatgccatgtatagtacatatataggatagctatacaatccacttacaaaagaggaaccgtacattctacctgatgacacaaaaagatggcaaatctacttatgcaaggagca

SEQ ID NO: 96412 - DNA, 750 bp, Oryza sativa
tttgtacctttcaggttatattgattttgggtctgttcactttgatgtcatttttaaccatactaatttttctgttaaagttgtcaaaaaaatatctacgtttagtttattgccaaatttggtcaatacataagaaatcctgtcaaaattttagcaatattgccatcttgctaaaattctaaaaattttgatattactaaaacttgttaaggtttattttgactacaatctgaacagaacaggctctttaggcaagctgttagaaaagcaaaagcttctagaaggaaactatacatcggtgtgcatggattctttttaccagcctggatgttgatgggtgagtcaacactcgagacaccacaagcgtgagtgcgtgacatgtactgcatattccaaatggagggatttttacacacaaggacaatagagtttagtacttttggggaagaaatgaccggacatttggagttaacatatgcattttttactattgttaccacaaggacaattttcatgaagtcattatctttgactgagtacacccttttctgggtgtagaggttttaatctattgttttttaagaaaataaagtatttatcttattagtacaagttatgattttattgtaccgtttcatgcaaatagatgatggtgaaattttgtcaaataaatatgacattgtgctatattgtagtactatagtatttatagaaaatttcataatcatcagggcgcgcacgtttttcctg

SEQ ID NO: 96413 - DNA, 515 bp, Oryza sativa
ttccaattatatatgatatgtcatatatatatagaagtgttcttctaaaacaacgggcaaattttataaacacttttcatggcaaattttactacataacactttaagtaatttgatgttggacaataaaagtgtacgatgaagaaaggacacattcaaatatgtaatttattggatagtacaggcaccgtagctattattttatttaggttcaattggagagagagtttttttttcaaaaatacaagaatgacttttgagccacaagtttctaacctgatgcaaagaagaaatttgatatatggcagcaatatacttggggcgatagtagattgcaaattgcataatgtgtagtttgaaaatttggaaaaataagaaaagaataaacaattgattttttctaaacatttgaaaaagtaaacaaattggaaagttgtaaaatgtactcgtggagtcgtggtcgccattctagatttttgaagggggtcgggcggaaaagatggcattgttcggtt

SEQ ID NO: 96414 - DNA, 820 bp, Oryza sativa
aggcaggtctacatttcacaagctgaaaactacagtggccagaaatttccccacacacatgttctagaataattctctttgtttgtacagatttgcacatacaaaccctgctaccaatgtgcttgaactgctgatataccacattttttgaacaacacttggttggagcagtgcctctacattgggatgattgaggctgtttcacttccaaacaaaaagaagaaacaagcagctagcttcaatggaactgtccaattctgctgtcctctcctctgcacaactcacataaagaaaaaaggttggaattagtattatatgcatgttgggactagggttgccacctgcttaatttcaggtttgggtccttcaccagcatcatcagtcccctaattattcagcactcatactacttgacagtttccttaatcattcttctgcttgacaactagtaccagatgctatttattaatttaccatgaggtttcacgggtaactgaaacaaatgaaaagctagtgattgttgccacccaatagcatgggacactgtggcaatattcacattcaccaaatcccaaacaggccaagcaaatagtgccatactgccatcaccttgttttaaacaagaaatgggtgaagaataaagggtagcaatgcattgctttcatcaccccactatcttttttgatcaaattggagctcgatttgcctgccctttctggaggtccacttaggaattgcccatagaaagaaaagaccagatcatagggacaattcagttgaggaataaagagatgcaagtattaaaaagacaggagtgatt

SEQ ID NO: 96415 - DNA, 572 bp, Oryza sativa
agtgtatgcactgtgcaacggctacaaaaggtactgcagtgaccattataactgcaatggcttacaaaaccgaaaacacgcatgtaccaagcgctaagtgtcacaggtaagctatcaatatagtaacaaacaaagcaccataaatgcacaatatcaaaaagaagcagaaaatagtgcaaaatagtaatcaataaaccgaaaaggaaatattgaaacatagtacaagacagatgggaataccttatacgaaacagcacccagtgagttgacaacgcggcagaagcaacgtaaccaagaaaatgccacgcaagacagatacccacaaaagacaaagacctcgaccaagaaatagaagaaagtctaggaaaggatagtcaccaataaagttgaccagagctgcacaatagaaagagatcattagcaaacataaacctgatacagaaggcacaacaaatacatgagatatttctatatcgtttaaagcaaatatagtagaaataacctaacctgcctgattgaaccagcagccccaacattcgctggcaaaatcaatcaagaacccttgaagcatc

SEQ ID NO: 96416 - DNA, 519 bp, Oryza sativa
gctgcactacactgtagcgctggcagttgcatttgcagccaaccaagtcaaaaaaaaaaaaaaagatggcatccgcaccttcgaatttctcactttctcctagcaaaacgcacaagggtccgtttgggatagtttctaactgttgcagtttttttcaatcaaaagatcttccaaataatttattttttttagattttaagaagatatagttatagaatctagaaaataaactagaatccagaagctggaaaacccagcttttttttagtttctgagaaactggctaccaccagttacttttcagaattttaagctccctaaacagtcctgaaagccggtgcttctcagattctccagagcctgtttagcatagaattttcggctcaattgtcatctgcaggctagaaataagaacatgtgttcgctgtataccaaaaatcatcgaggcaattaatctcgcgtgaaaaacatatataggaccgatcgatatcggattaattagttcatcatattacttct

SEQ ID NO: 96417 - DNA, 647 bp, Oryza sativa
tccagcaccactgttctaccttccctaattaaggtacttcgctagtacttcctctaatcttccctttgcctctggagtcttgaccaaaatcaaagggcacaaattaaatgtgcaagcacagtaagcagtggattagtatttattagtacgtagtcgccgtagtagtagttaattctagctccatgaataatccatttacatgtatttatagtttgttctatcctcctcatctttagagaattagcagtgcactatccactcccaatcattgggaaaagtttgacacaataaacagagatgcatatatgtaccttggtattctgtgccaagtatatactccaccattcatattagcaccacttgacatgactagcaacaatattgaacatcagttaccatatactcctacatagtactgccttcattttacaaagatttcatctctgcctatcttttttttatggaggtagtagtatattttgccatttgccaattcttcttttctctctctctctctcttttttttgtgattgctagctccattggttgtgtgattgctttagttttttagttattagctactaatacaatcacatattaatcatcttgttgatttttttctaaaattttataaccatttagatgac

SEQ ID NO: 96418 - DNA, 598 bp, Oryza sativa
gcatcggcttgcttgtgtgctgaagctttgtcccgatttgttgctggggttcgtcgatctgggagggaagctacgagacgactacgttcaccttcggctcgcaagtgctccacctcctctgcctccgcgctgcttccagttagtacctcctgctcctactcgttctttcttgctaagtgtagaggtatagttatctttgatgtggaaatggttccagaaagctgctctattatgcccaattgtgatgcaaaatatggttaatttctacttagctagtctgttctgggtgaaattttcttggctggaagcctgaaaccactgctaagatagcctagtttagaggcaaaaaaaaaaaaagcatagttggttgagcattatactgctcagtatggttgtcattttggtgaagaagtctatgtagaacagcgctgttctattcaaccggcttcatttacagaatcagctgttactggatactaaattagtatctccactcctttttagcttgatgatcatgaattaaggtcatagcatagcatctaccatctatagattactccatcatctttgaatttggtgttacatatgagttcaactg

SEQ ID NO: 96419 - DNA, 1429 bp, Oryza sativa
  unsure (1)..(1429): unsure at all n locations
gggagtaaagtcagttgtaagcacatgtggagtagagaagagaagaaagaaggaaagcgatctacagatttatagccaactgcacaacaaactccaatacgttgtgtgtatgagagacgtgaccatatttttttttgatcaagggctgcgcccctattccgttactagaaatgagcagagctaaaaggttcgaggcgtgaccatatattaatggtttatagataatataaacaaactattaaattagatatagataatttaaagtcagtagttgactatactattaaacttgctcttacttatgttagcagatttgcagataccaaccgcgctagctacatgtatagcccgctgttcccgggatcgattcaatcaatcctgcgaagtcaaagcggagcacatgggtagcaccaaggagatgcagctgctaaccacatctattactcttgtttgaaaaaaaaagaggagaaaaaaattaaacccatgtgattgccgatgctcttattaacttctaacttgacaatgcccaaaggcgacccaaggtcctttttatttttggtgaactctttcagcctttataaataaaccacacatgtggcttgtgaagactgacaacacacttgaccaaacaccttcctactagcaagtgagcactacataagaaccctgtgaaaaatcatgcgtcccaaacgccgtggaatcanattgaatattccatttgccagataaagttcagctccctgaaaaatcaatcaaaatgaaaaaaaatacgaagaagaaaaattcgaagtgcagacagaaacagccaagaattatcccaacttcctactactacggagtactaccggtggaaggtgtggggtccacgacgcgccccgcgccatcaacggaacggtcgcgaaaccccttcccactatcctccgccgtccgatcgagatcctacggcccgcagcgccgcccggagggaatctcggggggagcggagtcgagtcgtgtcgtgtccccggatcgcacttgcccctgtgatgactctcacctgacccgcgatcctccggtgggcccactgacatgtgggccccactttttccttggtagggcccacccccgcgtcgccagtcgccactgccattcaaagctcgcacccgctcgcgagagaagaagagagaaaagagaggagagagagaggcaaacccgcaccaaaatctctctctctcccccagatttgcgccacattttcctcgccgaatcagcctcgccgccgtgggtgcagctgccgcgggatcccggcgagcgagcgccatttgagccggctgccggcgggtttgcgttttggaagctccttggtaagacctctagctccctctcctgttttttctgtgcgttttttcttttttagtttctctctctctttttcttttgtgtgtgtttt

SEQ ID NO: 96420 - DNA, 962 bp, Oryza sativa
ttaacttgaagtttagtatgcttatcttgctgaaagtatcatgtaataatttgagattggctcatcctcttggctttgtttcattctttcctgcagttcttgctgctattctggtcctcctggagatacatgaggtaccatttatttgctcagagaaatgacatcattggggagttaatggtagcctcgcattcccaggacgaaagatggtcggcgtgacagttggtttgtgtcctctgacaacctttcaggtaacacaacctctatcagtatggccagcaatgatatagccttggagttcgagagattatctttacagcaacattgtctgaaactgattgagaccaacttcaaatgaacagaaacctaatggacctggacctggacctgggcctgacttgcttggagtttgtacaatcagcatcagtgtgcatgcatccctgattgctttatcatctctggaaacctgaaatgatcaactacttacctaccttataatcttgttgttcagtgttcttcattctgcaacatgtttggaaactggaacgacaccagatcagagaagagcagagaggatccgagagctcaatgattgggagctcaaggaggagcatgggataggactggagcaatcaacgatcaagagatgactacactttgagctgcctctaccttgactggcctgggagctaaactagctggagccgatcgatcttgccggccggcatcccggctagcctgcctgtgggtgtggctgtggctgtacctgccggccttgccatcttgtccctcccagctccggcgacacgcctgaacctccattgacgacgacgaatcgtacgttgctgcatgcctgtgatgattggtttctctccttcatttctgaaggctccacttcactttgaggccggccgggctcaagctaatttcgccgtacaccgtcaactcttcgttgcaacggc

SEQ ID NO: 96421 - DNA, 554 bp, Oryza sativa
gcactaggctgctgtcgcttgctcactcatccgaccaacatcacacagctcccaccacatgtcgtgagaatttcaaacctcatgccttccttttccccaccgctgcacatcagtccttcctctatcagtctatcctcggtcaccatccccattcccacatggtgcaaggcatgagggcaggcagtctggcaatgggcgtggaagaggggaatagaggaacccacagcagaatgggctgcagccttgccctagctcggcaggcagccaaccttttgctgaaccagcagcaatgaaggtgaggtcaatgattcataggccgaagttcattttctccgcattagatgttttccaggcctttcagttaactaatctgaatactgctattgtctcggctgtaaccgatctaaattttttggcatgcgacacaggaaaagaattaacacctgtctttgtgctagatgtactaaaaggatgtagttcatgtgttatgtttaccatttcctatgtagattttgttgaaggattaagaaaataaaaattatcatatttgatgg

SEQ ID NO: 96422 - DNA, 781 bp, Oryza sativa
cagagaaagaaagagagagagagagagagttggagtagtatgtgagagctccaatgaatgtgtcacagatgtccatcagagtatcagacccaagaacaaagacaaaaggattaaaaaaaatagagtagccatagtaaaaagaggatccaatgcaatgcaatgtgatgtgaagttttacccgggaagtttttacataggatccttcttgtgcttccaagttttttccacccgtgtttttgggcgtcgcttcttgaaaggatacattttatctgtagcggtttttcactggttgcttcttaaagtatttgtcgagtagtagcagtattcatttgtgtgattaattagtggtgagtaaacagtggtggtgagcagctctctctctctctctctctctctctgctgtggcttttgcatcgcatgcatgcgtgctttgcctggctggttgcctctgctctgctctccctccatttcgaatttcaaattcacagccacctccgctcccccaacgcctagtttttttttcctctcctcttccctgcaaagccaaagccctcgcacgcgtgcctgcctcttctgtgtctctctgcgacagccatcgccaccgacttcttcgtcttcctcgttggtctcctctctctctctgtgttcttggtgttccctgtgctgttcttgggcaagaagaagaaggagagcagatgggagggtcagggaagtgggtcaagtcgctcatagggctcaagaagcctgacagggaggattgcaaggtgagagatgggtgttc

SEQ ID NO: 96423 - DNA, 662 bp, Oryza sativa
tttaccacttatcggaatttgctacatatcggctattacttggctagttgttgtctccgtagcaaattagaaattcacgtactcagtgagttatttatcagagatagtcattgatgataagtatgaagcgctcgattgatttatcttgccttttttatggagtagtgattgtagtgtgataacacctttttgagatataaaaaaattgatgtgccttttaccacttgttgaaatttgctatatatcagctaattagttgttgttcgtacaccaaattagctaggaattattgctctcggagagttaccgatcaatattgatgataattaagtatgagatgtcaggtgtgtttgattgatttatcttacttaccgtttttatggagtagtgatcgtatactacgatgatttctcatcacctttcagataaaatctagtaagtctttttaaagagaaaaaagaacttgtggtgtgtgatcaaatggcgtctaaacattcaagacaaatccttttctacacaataagttacatatgctattggttcccgccaacatttcaatactagattatttgtctctaatttgtgaaaaggaatctactgaaaaagaaaataacaggtgagagagcacatgtattattttagtggagctaattcatttcata

SEQ ID NO: 96424 - DNA, 725 bp, Oryza sativa
agtttaggctgtaattattttgaacctcgctagactctttacccctctaattatggaagccgcctttggtgagattctagacaagttatagagtacagttccagataagatgtactccagagtacatgaaatgcaagctatgtggaacacaaacccagccaaatgcaactgcattttggattctagattgccttcatatcaaaattttcttgtcagtgcacgctatatcaagaacatgcacataattaaacaaagtgagcctttattaaaagaaattgtcagaacgaaaacagaaacaagatttctgcccccatcaaagtggggagagagaagaccactttaggtgctcttgcattttttaaacattcttgaactaaattggtttatgctcttgtaggttttctttttgtcactctcatacaaatgtacctacatttgtgtgtaggctatatgcactaactcatgggccctttgttttgctgttttactgggtgcaggtgtaaagggaaacctgaagagacctttgaaatttcatgcgcaatatcctcacaagcgggggggtgaaacaatcagcaggagcgataatcctatggacttgcatgagccattgcaactggatattggatttggtttgggaactaaagacgaaactgaagacagcgataatcctatggacttggaatagccatgcatgcccctttggagtgaaactaaatgggcataaa

SEQ ID NO: 96425 - DNA, 734 bp, Oryza sativa
gaccattcgttttatttgaaaaattagtgcaaatataaaaaaagataagtcatatgtaaagtactttggataataaagcaaatgacaaacaaaataaataataattccaattttttttgaataagacgaatgatcaaacattgacaaacaaaaactcaaaaagacaagtaatatgggacggaggtagtacccaagaagatgccacaacctgcaagcaacatttgcatatgcatcaatgcaggtgggcagctatatatgtggcctagtgcagtacacactgctggtattgtccctaggtgtgtgcatatatgcaacagctacagtttacatagcttgtggaccaaaatgcaacaagaaaagaaaaaaagacaagggaagaaaaataaatcatagcatataaaactagcaagaagccagttatcttacaagctataggactgaggcctatagatgtgcaaaattgaagttgcatacatatatacatgtgtgcaaaagtcttttgcttcattgtgcagtgtggattggctggggagtttgaatattatggaagattctgttccacatatgacaagttgctttaatatgatatgttttgtagtagacattttatgagtacatcacatgacctttttccatctccacatgtggcccactgcatttgtggccaggtctagatctatctttgactgccaaaaatatgcattaaataatgagagaaatttaaaaaatgatgg

SEQ ID NO: 96426 - DNA, 752 bp, Oryza sativa
catgatcaaggtcttctttcattaggtaaagccaaaatggagttactatatacttcctccgtcccaaaatgcaagcatttttaaggttggcacgggtattaagaaagtaggtgagaatgattgaagaaggtgtgtgattggttgaaaagagaaagtatgtgaaaaagaatggttgtgaatggttgagaggagaaggtagttagaaaaatagcttcattttgggacaaagtactgtgctagatatagctatattttgggacggaggtagtactaatgaagcaatcagtgaccgtccatggtgattgtcggaatcagatcctgagttcatgaaactattttggtctgatgcaaagttgcaaactgcatcctttttttgcgtgccattggacacagagcaaaagtattattgcagtgacaatattacatggtttgctttgttcctccactggagatgagctgaatgtgcgctgagtttctgtagtggaatctctgccggcatcctctcacattttgttcatgggcatggcaagaacaagttggctggtaatagtgcctattttctattcgaagtagtgctctcgttgctgtttgtttttcgaacaagttgctctaaattgtgacgcaaattttcgttcgatttaacttcccgtcttgttaagcttggccacatgatctgtcactgtatggaatgatgcaaagctgctgctgatgctgtatttctatcggcgtgtttgcacattgggctgtttgac

SEQ ID NO: 96427 - DNA, 768 bp, Oryza sativa
ccagcttcccgtgagtagcaacgcctcggagtcggagtcagagtcggaggcgaccgcctttggtcgccggcggcggcggcggcggcgccttcttccatccggcgcaggaagctctcgcgcagcagcatgtcctgctcgccgccgccgtcgtcgtcccggcggtgtcgccggaaaaagaagtagtgcatcattgcaacggccatggatggatggatggatggctagctaggcgcacgccggcggcgagcggatggccggccggggtcgacgacgacgaacgcggcgggccgagcagcaacaggagaaggagagatgagatcgatcgcctaacgcggggcagagcaaaaaccagcagcggtatgtgtatatgtgatgtgatgatcgcgtacgtggtcgcgctcgtgtcggattggaatattggacccgataacgagctcggtttcgggaggacacgaatcgaaggagtccaggttgttttatgccactgccacgtactccgtatgtggtgaccacgatttgaccgctggctaactgattcatgtaccatgttgaatcacacgggaaatgctccgaacacatgttttgatgtatcacatgaaaaaccaagaaatttagagctcatttggaacacaggattttgaaaacgcagtaacattaaggactccagcgaaacatcatatttacaaacgaaaaatgatttgtaaataaaacctttatatacgtgttcttaacgatctaaaagcaaagactgaaaaataaaccgcgatg

SEQ ID NO: 96428 - DNA, 608 bp, Oryza sativa
atgataatggtgtgaacgaatgaatcaaacattagaaagttgataagtcgatctaaagaagtttagtaagaaataccgatgaggaaaaagtttttataaatatatgtgccgtttagtaatttaagagaagtgtcaatgataatttacactctactcataatttataatctgttagctagaactaggcataaacacacttgtaggccggaccgctgcaccatggaccaagtatataaggtattgtcgtctctattatgtgatatcccataatctaatgggagaaataaccgaagtgtgtctctgtcaatctccttataaaaatgttagtttcacaagtgttctctatttcaaacgtgtttccccaccatcaataatcgctatggggtcagtccaataatttcaacaagatagaattagctttgatctgcaaagataaagaaaaaaaaaagacccgaagaaaagctcattatccttacccaaccctccctgaactaaaataatcaaagataagatcacagaacaccaactttatctaaattttcttttgatctcttcttctcccatcactttatatctccaaccatttgagttgttaattaatcaacaca

SEQ ID NO: 96429 - DNA, 825 bp, Oryza sativa
cgagcaaggcgggtgttgaaccaaggacctctcccccgacgagcatggcgcatgccgttgagccaaagacatctttttgtttagtcatgcccgatgtatagtagttacgttgtaactataatacaatgtagttaggttcgaaagttttttactcaaaaaacatggttcgaaagttttttactcaaaaaacatgctaaagacttttagacagacccataaatacaaatatttatactctaacagttgagtcaagttggtcaagctgagtcaagtcagagaaaatagaaaaaaagagaaagccaaccaaagcacaaccagagttctccgcggggtggagcgctaagaaagaaaaaagcgttatcgctatacgaaatgaagcagcggctagcacgctaagataaaccacttgaatatatagttttacgatagacagatcaaatacgcgtagttatgtgaaatttattctaaaaattattatcaataaattattcttttagtctctaataatcgttaacttgtattactccgttaaaaaagatacaaccttagccacgaagctaatcatatttatgtccagattcgtagttatgattgagttttttttttttaacggaggggtacgtaattaacttgcatgggcatgcccggaatgttccgcccctctctcaaaattcaaaatactacacgtactccacgtatatactacggggaaagaagagtcacgcacacgtgacaggtctcagctagtcaagcgagcacgaagccaaccgccacagttgggagacggcgccaacatctcgcgagacgatccaacggtaaccacac

SEQ ID NO: 96430 - DNA, 2738 bp, Oryza sativa
cttttcacaaatactgaatgataaaattcattgaagaaaaaaacgagcgaatggttctcgtgcgaaaaacgcattttcttgggttagaaagaaagcaaatgctgcgggagaaagagagatgattatttgaagcgccagtgagtaggatctatcacccatcagactaaaagacaccagtattaagctcgccatagccccataaccctgcagaataaaatatttaaatgtattagaaggtgtaagtatgtgcgaatatgtatgaaggtaattgagataactggatttatatttagggtagtgattttcaatcctcatatgacccagaatttggcactaataattactccctccttattatattatacatcgtttgaattagatttgatcaagttaatagaaaaaatagcaacatttgtgacatgaaattagtttcattaattttaacattgaatatattttaaaattaaaatattacctttttttttgctacaaacttaaacaaacttaaaaaatttgaccaactaaaaactcagcagagggcgtaattaatatactagctgctcgtatcggttaagctaattaagttacccggacgaagcggcagccagccttgaccgagaagcaacgccggtcgttggctcgcgtttggtcgccgccggcggcggcggcgtcgtcgcttcttccatccggcggaggagtctctcgagcagcgccgcctcgctgtcgtcgatcgtcaccgtcgtccgtcgaggagcggcggcggcatcgtattgccggggagcatcagaacgggcatggttggccgccggccgggaaggggcgccgatgagcggcgcgcgctgcggcggatggccggacggcgccggtcggtctggtcgtcgttgacgacgacgacgacgatgaacgctgcgcggcgcggcgcggcgcgtgcgtacgtgagcgatgtgagatcgatcgcctaaagcgcgcgtaggaagcaaaccaaacaagttatatatgaccgatcgcgtagtagtgcgtctcccgtgtcgggtcggattcaaattaagggtttatttggtttggagccaatttttgtcctaccaaaattttgttactgccaaaacattggtaaattttgacactaccaaattgggtggtgtttagtttgaactattgcaaataaaatttggtagcaaaccaaacatgcaattgctactattgaaatcaaacatgcaattgctactattgaagttaccaaaattttagtacggtaataaattggtatcaaaccaaaccagccctaaacttttgtgtttttcgtgaagattttgttactcgagttcgaaccaaaagacgtaccccacccccgttcgatctatgccacgtgcacgtcgagcactatctgaccgtccacgggataatcaatgccacgggagtagaggtacgagcgcacgcgtgcccgagaggccattgggagctaccaaattataatccctacatatcgaaaacggaacgatataataataaatgattaattgattaattatcctctgcctttgagatcaacggcaaactttaccgttgctttcctgtaggccacccatcttgagatcaacagctgcaacagcttggcctcaccagttactaattagcacctacttaatcaataaaaccatgcgtttctctgcggaaaaagaatcaacaaacaaaataagcggtggcagggtgcgcataacaaaagagatcgaattgctttaagtgaacatgggttcttttactgaataatatgacaagagctttggtaaatcactttttatagtatgaaagaagctagtaaaaacataaaatatagatttaaaaaggataacaacgaaaggtacaatatggtgacatatcaaataaagagaatagtcttgcatcataaggtggtaattaagattaattggctgctccatcaacgaaggatttttttttcttctcatgttatttctaaatgaatggagattggatgttcattcatattgttggcgtcaaaatgcgagagggaatgtattgtgtattcctcgtgctctgtcatcacagattttgtatgttgatttactagcagacatgcccatgcgttgcaacgggtgaaaaatcgtaatgatatatttttcatgcataaccatgtcgatgacaatcagaaaatcagaaaattgaaacatgttaaatgtaatagcccaacctcgatgatggttatggcaaccttacgatgtttgctttacctaaaataattgaattattcatataacaacatgcatataatctaaaatattcttttaatctcattcttacaaccaatcaaatcctacactgcctcgtatggtcaagtctacacaaaatagagtcactatgcactcttctctaaataacaattacaatatgtttattttctaagattatttccatataacatgttatcaagaataataatagttatacttcaaaaaatagtatgataattatctacaaagatgtgcaaggtctccactatagaagaatagatgacgagtcctggagatggaaaaaaagtggttgcaacctatccaaccagctgtccataaatttagcatttttttctaacggttcttttcctcgtatgcttgtttttttttgcttttttctcatgtgtttttttggactattgaacttttttttctagcgtgtggtcttttgcgcttttttctgacacttttttctcacgtgtttttttaaac

SEQ ID NO: 96431 - DNA, 672 bp, Oryza sativa
tacggtcaattcgctcggcgtggcggccacgtggatttatttggatgcggttaccgcgatggtcgtctcactgacaggtggggccctccgccgccaaatcagaaattactgcaccatttctgtttcagttagttacaagtgatttggtggttagcatttttatcgagagatatttttccgcaaaattcatccatttcaaactttcaaagtagtgggcttcaaatggattgttattcgctttgaagtattcgagttgttttctacacattttttctcagaattcatgtgaatttttttccagattggttaagataaagagccctgcaaggtgaagcaaccggaggctgattaccattttggcccgggatgccatggcatgtggatttggtaactttggaatattccttatatgattaaggccaaaaggtgacattaatcagcatctgatcaaacaaatcttagaacgcaaataatccaaggtcaatcagaaagcaggcgcttgtacagcgataggttgagatgcgtaaagtgaacggaacagagagcacgaagctcccagacttcagcgaaatattcgctgacaacataaacgctgtgatgtgatattcagcgaaaatattatagctgctgacaaattatgaaatctagcacaatggttttgacacaaaaaca

SEQ ID NO: 96432 - DNA, 568 bp, Oryza sativa
cacaactacatatttaataataaagtgtcaaacaactgcagattttagagtctatatccatagcactattgagattatcaaagttatagttttgtgataaaaccaatgttaaatctatatgtttctattatgattccttaaatatatagttttgtgataaattttcttatatacactttcttaaatctgtagtttcttaattctgtaaattgtgatagattgttcaaagggactatctaaaattctggcgacagattttttagaaaaaaactttcaaatgtaattacagtgtaagttatatgtaattacagcgtaatttctatgtaattacagtttaagtaatgtgtaatttttgttttaattcaagtttggataactgctcacttggttgagtcgtgatgcgtgcgaccagttggtcctaggatcgaatccccgttcttgcagttttctgtgttttttatctctggcagaccagaaatcgaaagatatccatagaaaaaggttgttcaaatatctatagatttgtaaaatttaatctacgatgggtaaaaatgcttctgatgtggag

SEQ ID NO: 96433 - DNA, 755 bp, Oryza sativa
ccattcacaactggattggggtgtatatgggaattttattgaaatatgcaaagaggtgcgcccaactaaacaatactccaattcactttcaccatgtacatcactttcctgccaaatttagaaagatatgaggattccaaatacagattaaaataatgttccaaggtaccaactgatccgtctcattattttttaaagcataccatatacggtcaatatagaggatgcgaacccgacaataaagatatagagagagaggactcaagaaaacctccagtagctgtgtcctgtatgcatgtgcagcaaaatgagtaaaccagaagcttctttggttattttcccatttatttaaaggtaaaagcaggctagagtggcaatggtttgatggagatcaaggctgataacaacattatttccatctccttataccaaatttaatacgtgtctgtttcattgcatgcatattgaagggtgactagtatacgacttgaaccatgtaatttgtaaaataaaataaatacgtgcatgttaacccacttcttacttagaagatcactcaaacctacataagtgtatgtagcatgtaagagccatcgagcaatgtaaggttccatgccatatatgcatgagttatatattgaagaaggaaaagaaatcatgttttgttcgcatatgagaaaaatgcaagctgtcgttgtcttctcatttcgttcttccattttgggatatatttgttttctttcgtgcaattactg

SEQ ID NO: 96434 - DNA, 544 bp, Oryza sativa
atagacaatcagtgtgctctctagtctctaccccttctgtgtcagatgttgatttgataaaactaatttagtattataaatattaatatatttgtttataaacttagtcaaatttgaaatagtttgattttgaccaaagtcaaaacgtcatataacctaaaacggagagagtacttagtagttagatccacgctggaagttattctgctctcttaccatgtacttcctccgtcccaaaatgaagctatttttaaggttggcacgggtattaagaaattaggtgagaatgattggaggaagtgtgtgattggttgaaaagagaaaataggtgaagaagaatgttgtgattggttgagaggaggaggtaggtgaagaaataggtttattttgggataagacactgtattagaaataggtatattttgagacggagggagtatgtgaattgtgggtagtacacatgactgcaccatatgtacgttgcaatacagcagaaatgatcacgagatgcgacattgcttcacattttgcatgaatatgctga

SEQ ID NO: 96435 - DNA, 508 bp, Oryza sativa
aaatctagtggtgcggtgtacgcgtgaatgcctttggccttgtccaggcactacatatccttccagctgtcctacatcatcctgtagctgcagctgcagtcccacattgctcagtagatccacccctggccaccacatgtccttacatctaatatgttaatttcttctaaaaggatagcattgatgatagaaagcgctgtcacgccatcattgggcaagcaaaccagcttatagcagttaattggtgaaaaacattcaactccattcctttctccaaagataaaaatagaagtacttagatgccacatgtgtctgttatgattctaaatagtactccactatttagtagtataaatacaggaaaaggtttccattataagtttattataacatcaacacatggacttaaaatcttagagcagctgaagcatggcattaactctgcccatgatacagggcaaaaccaccatgtgcatcactaaaacactcactagtgcaattcacagaa

SEQ ID NO: 96436 - DNA, 825 bp, Oryza sativa
ttgggccaatagtttcttttatattttataataaacttatatacaattaaaacttgtgcacaaaacatatttcctccgtttcacaatgtaagtcattctagcatttctcacattcatattaatgttaatgaatctagacattaacatcaatatgaatatagatatgctagaattacttacattgtgaaaaggagggagtattgcttattatttcataaagcatatgctcacgaaaaacgagcaaattaacgcaactgtatgaacacatggtaaattggtgatctttttttttcttctgtgtttaggaggggtttctctagcacacaaaatgaagcatatattagcgtatgattaattaaatattagtaaaaaactttaaaaaaactaatataatttttaaaacaactttccaataaaaaaattctcaaacaagtaccatttggcagtttaggaaacgtgcgagctgatgagataaaatcccaatttaacttgtcttgttatgacttcgagtttgtaagtcaatttgacctaagtttgatactgatatgagcaaattaagccacgaggtttgagttttttttaatgcctagaacatcctagtttggagtaatcccttcatcaaaattcgttgtgttagcagtggttgggctttttttttttttaccgagggtgtgtactaccggctaaccaacccccaacaatgcagggaattgaaggccctgggagatgggagaaggacgcacaggaggacagacgtgacagcaagcgggccccaccacaccgctcggaaacgcaggacacgttcctttctttgaattggtgaca

SEQ ID NO: 96437 - DNA, 584 bp, Oryza sativa
cacacatgattatgttttgatgaaaaaatacaaattacttttataatattctaaattacttttagatttcactaaattacttcttagacatataaaggtacatttaataaatcgtaaaagtagaagtaacttaaaaaaagaaagttactttgtcacgacattaaaattagatccgttatggaggtaaaaatatgagtatatccagaaaattaatttaatcagtacaaattatgcaattcactaaaaatgataataaaataacaactcacaacattatgattatatgaggtaatttaatcaaatcggaaagtaatttatatatatgataaaagtaacttacatatataataaaagtaatttacaacatagacatttctttcatcaaaacatagtaatgtaaaatcctgttgtaaagatttaattgcaatgaacacaatggtataattggattatatatcgggtataagtaatttaaaataaaaaactgtaaaaagaaaaaaagatatgtataatttggtatactagtaggcaaccagctctaagatgaatctctggtcaagacaatataacttgcggtttcaacg

SEQ ID NO: 96438 - DNA, 1010 bp, Oryza sativa
  unsure (1)..(1010): unsure at all n locations
gatacaatatcttgatttgttattacctaaaaaatatagggatggtgtatgcatcgggtttattgttggagtaaatatagtatgagaaaattattattttttttaaagttttgatgtacctatgtaatatgatgattattttggaatggagggagagtatgatatgatatgactatggaggttccataattaaacttagcaccacgtgtatatatgttctattcgcatggattttacggctgatttaataaatttccgtgtcatcattggtaaggaaaatcattttttctcctgaaaccttggtgaacccgaattgttttcttcacactagctagtagtagattttcaacagacactcgctggcctcagccaataaggacgaaaataaagcagcattatctctggttctagtgcaaaacaaaaactattttcagtcttcagatgccacacactagctagggttgttgtgtgacttgggaggtgtttctaaaatcagggcagaatattattttgggaagttttagaacaatataatgcatatattctgaaaaaaaatcaccgaatttctggcatttcagtacagctaaagatatacatgcatggttttgacttttgattgtacttgtggtttgatctcatacttttaaaaaatagaaataaaaattcaaacggaattaaaaaatccatctttaattaagtacatttttttaaaaaaaaatgatatacaatatcttcctggccttgatggacgtaccctacttcgaaatggtgctatgtatgcactattatgcaagatgagtagggctcttttactttcaagccnagcttttttcccacacgataatacacgagacactaaaaaatgatgacaattcaacatgtattggatgaagaaattatccgtttagttatttatcattcgcttgatattttcttatctgtcagtcacctacacctggacaataaatcgcctaaacttgcacaagcctgcttggcccaaacatgcacaa

SEQ ID NO: 96439 - DNA, 580 bp, Oryza sativa
gcacgacccctcccctctctcttcccccctccctccctccctcccagatctaaccggaggcagcggtgcggctcccctcctccctccctcccagatccagcagaggggcgatggtggtggtgtcggccacagcaagcgacgccggtggcagatgggggtggtgggcggattgttttttttttgttgtttgcgaagaatattttcgtaggcgggtggttgttgcgcctatgaaaattgagatgtcgtatgtgaaaatgatttcttgtaggtggtgttgatcgccgcctacaaatgtcatgtatttttcgcaggtttttaagtgcaagcgggatagatggccgcttagaaaaatctattttacctatttgcaaaaatctgtttccagtagtgttatattagtggaaccaatttgtggctgaaggggtattggctttttagctatgacgttttcttttaaatttggcgccctctgcggggtatggattagagcgtaattgagtacaccaacacaccctacactcatataccacacacacacaagtggttccctttgtgaactgctgtatactccctccgtttc

SEQ ID NO: 96440 - DNA, 731 bp, Oryza sativa
cttagatgacgagttcaagtctcaggacaatcagagaggtagacagcttagaggtgaaggaaacaaccagggcggcatatttggagcctcttctgcacctcctgtgtacaaagggaaaacacagttacttcagagtgggggtgggaaaaaaatatcctctaagaaaacctcccttctgaaaaatatttgaggaggtgaatgattcttgcacttctctggtggtttgggagagaaaggtgacaaggtggtggaacaagagtcccaagagctgataaatcccattgagatgctgacccaggaagatttagagggaactcagaatgattggctgacaatgggtgaaaaaaacttgttggatgatgagatggagaggtgtcaaattcccactgattctgacatagaaaggttgagggaggaagaaaatagagatgatgaatagagctttcaagaggtgtctcataagaagaaaagtagggggagaaaaactgaacctacaattacatccaggatgagcttaaggaatagggagttggctgatgttcctgtcaccaggagggctagaattctcactcagaagaagaacatggaaggtaatgcttcaaacccttttgctatttttcagctgctagattcagttgagttaaataaaattgctattgctgctaagatagatttgggtagtacttctactgagattgatactaatttagaatccttgaaatcaaaagaga

SEQ ID NO: 96441 - DNA, 1233 bp, Oryza sativa
gcccctccccttactactttacctccccttcttctcttactactacaccataaaaatttgaattaaaattcaaatttgaaacgggtatgtaaactttttacttataaaatttgggtctatagactaatatttgaattcaaattcaaatttgaaacggcaaattcaaatttgaaacgggtatgtaaacttttgacctataaactttgggtctataaactaatatttgaatttaaattcaaatttgaaacgggtatgtaaactttttacttataaactttaggtctataaactattatttgaattcaaattcaaatttgaaatgggtctataaactttaggtctataaactttagatgtatagaaatactatatataaaaaatatttgagttcaaatttaaatttgaatcggatatataaacttttgacttataaactttaggtctataaactttaggtgtataaactttagatgtatagaaatactatatatacaaaatatttgtattcaaattcaaatttgaatcggatatataaacttttgacttataaactttgggtctctaaactttatatgtgtaaacttgatgtgtataaactttaggtgcataaatttattaaaataggaaagtaatacggtgtcaaaaaaagaaaaccaggtggagggagggagggagggggaggggggggagtgaattgatcgctgcccccatcgccaggtgagcgatcgcccatttgccatttcgtatgaaaccgaccatgtatcaccgattctatccttttaattttatgagcgatgacgatgctgatgatttatgtcttatatagttaggaagtacaaattttgtaagtataacttatagcgccatctatttatcaatttaccaatttttttcttatttatcaatcactgtttaaacagtagatcaatatgcaaccattcacatttatacatgatttcttgtggtgaagcaaacgatgttctaacctactctagtgcaaattcttactagcatgaaacataaaatatgacttacgtaaacataataatgcatctggattaaccctgaaaataaaaacaaagtaaagtaaaatatgcatttcatttgtgttgaagttgcagtaattttattttgtgcatgtttgggccaagcaggcttgtgcaagtttaggcgatttattgtccaggtgtaggtgactgacagataagaaaatatcaagcgaatgataaataa

SEQ ID NO: 96442 - DNA, 2049 bp, Oryza sativa
ttcatatttcttgagatggactacatttaagaaaaaaggtaaattaaaaatgaaaggttgtgattgatgtacctaacaaagtaaatgaataaattaaatatttttttattgatcaaggtaaaattgatggggtattgtagccttagagcaacaacaatctatatagcaaaagtagtccatatagatgggacccacttatatgaactttaactattgtaacattcacaatgtatatagatagcaaatagtattaggaggaaagaagaggtagagacaaataatatattttattctctatgggcagcctatatgcttatgggtagcttttattatttctttgctatggactagttccacaatgttgctaggtgtctgaaataaatattgtattgcttatgaaccacttttagactacattgtggatgcgctcacataactggaaggactattaaccttgaaaaaaatattaacctcacatgactgaaaatattttttaccttgaaggactggaaggactacaatattttttaccttgataaaaaaatattttaccttgaaaattaagggtgaggctacattcaatatttttttctttatttgatcagttaatcaattagccggacgtggtgttttaaataccctagacatgtgagttctcaaagatggagtatttttgaccttttgtctagaagcctccagattgacccaatggattatattctcatatattgatccaacggtccttttgttttaccagtctcatccgatggtgcttgcaatttcagaggacgtggctcattcttctttcaagcagcttgctgctttcacctatctagatttagaatactcttctttatacatttatggtattaaaatacttttcgagtatatggatgccaatttatattatgttcatgttatattgaatatactgctagcttatctgggagatgctttggtgcgggtataatgtttgcttatgcaattactctatgtcatgacgatgatatcaattagagtagtatatggtagtttaggcgtggtgcttagatcattatttggggttatatgctgcggatgagaggtgggccgctgatggtgacagctcagtacggatattcctccgcgcgtgtatatagttctaagttaatttcctggggaaggtattcctctgtatttagccccggttgtatggtcatgacgggctgtcgtaagaaactcgacagttaggggtggcttcacgaagtaccaggagggcatcggatagagaatattagctagtatatcagataactagaatgtatatatactatgtaaactagaagtataggagtagattctctttctcttttatttccacttagcttagataatttagtatgagaatgagtagcttactgcttgtgtgtcactctactcttggattatcttaacccctgcttagactatgattattacaagtaacatataaattattagttaagttctctctaccatgatcttctcataggattaaataaatacgatatccttgtaatactctcgggtgaaatgctacaacggtatatccgtgcgcttgcggatgaactctgtaaccataatataccaggagtatttctgcgccattgttgggaattatatttctaggaatatcgttaagaaataccaacacccgttccacctgagactagagggaggaggctaccccaggcgccacgtggccctgccccgaggggggatcgggcctgaggtagggcggcggctgccccctcctcgcttgggggtcgggaccgtcctgaccgagactagagggaggaggctggcccaggcgtcacatggcccctccccccctcccccgagggtgtatcgggcccgaggtagggcggcggccgctccctcccgtgactatgggtcgggcctccccgaaaccctccgtgggtcaccacaccacatgtggtgggttaggtgggcaactcacacgcccacctacctgcatttatggcgacctgaccagctgtgccacgccgtatttaatgcagcgtgcagtgc

SEQ ID NO: 96443 - DNA, 1463 bp, Oryza sativa
gcatctcgaatagcctctccatctcacttctccaagtcaaagtttagcaactttgaacaaaactcgcactccaatagcctccccatcccactctccaaaccatttagatggccaaactccttccctcactagccaaacttgggcccaacctactccacttgccattcgttttccatccgcgggacctaccaccttccattcacttttcctctgttcgggagcaacgtggccgagggggagagccgatggtcgagccgcattggtggcctccgcgccggtggtcaaggcggtgccaagatctctggaagcggtggcaccttgcagtacaagctggtgaagaagcaactccgccacggaccactggtgttgtcctttggcccagcatcgccgtcgcccttgccaacgtgagcaagaaggcccacaccacccgtccacctgaatcctcaccgctgcctccatgcgatctccgtccctacgtggatttgaccgacggcgtggattcgggagttgcgcggtctccgccttcattcgacgggtcgtcgtcgaggtcgttgtagcgagccgccgctgtcgtcgtcagcctctgcacggtcgccgtcgcacgagaagaggaccgagagaagaggaagagggagagaaagaggaggaagaaagtgtagtagaggctggcatgtggattccagtgtcaaaggcttataatggagagtgtagatagagactgttggagtgagaaatgagtttggcttgactaatcaattggagagctgactatataggtgtttggagagactgttggagatgctcttagttggtgggtcaaacaagcaggacatatctgatttaatcgggcctgcaattggcccattattattgatgggtcaacatgactatttgatagtacaatatatatcctagatttatgagctgttataatggaatatatgtaactttgtgtcactaagaaggaagagcaagcgttatggatgtagcatcttcaactgattcaaagtaactacgaattttttaaagtttcatgagcttggtacgtgtcgagaggtcgatacttgagtacaatgattgtccgtgcgtagagaggcatgaaaaaattgttgaagcgttcctacctccaaagaggccgctgtacgtgtttatatagcaaaaacaggaagagtacagatcagattacaatccgagtctgaataagttctttacttctatctaccgcaccaacctatagcaggagtacatgactctatctctgaaacagtcagacaagaaccaaactaagactcgacaacaagtctgaaaattatctctatgtttaacactccccctcaatcataacttacacaagttaagattgtttctgaaattattcaacttgttcaatgactgggctttggtaaaaccatcagcaagctgatcatttgatgaaataaaccgaatctctagtgatttctcag

SEQ ID NO: 96444 - DNA, 633 bp, Oryza sativa
tgcacccccttagcaaaatcttttgataacaatggttattaggtcaatttttttttaccataaacacggtattacggtatgcaatttggtacagtttaaaattttctcatttatacccatgtgctatacatttatcaatatatagaattatgccttaataaatcattacttatgcaagagacatattttggctgtttcaaccagtcaatgtattagttgttcataaccatctttccaatgcaggcaattcactggctgactcttttagttgagaaagaaagcagtcacaattatttgccaatttttaacatatttttaagtggctgcgggagtaccacaaagcagagtgatattgaaggctgtctagagaaaatggaaacttattttcttgggaagtctgaaataacatattgtgagctcctgaaggtctgttccaacatcctcaatatgccaatatatgtttctcagaagttcttttttcatgacattgtaaaagtattagttcatttagttggactcctgttgcagtcttgtggatgtgatgcaaccataagaagacagacttaccattttatttgctgcctatttggccctatttttaatcaacatttgattacgttgtttactaattca

SEQ ID NO: 96445 - DNA, 710 bp, Oryza sativa
ctgcaagtagcttcatcagagagctgaagtagctcttggagaaaatctccttctgagacaaatgagttgacaattgtaactgtggaggtgataagtacttcttgagttgatgagctcgtgtaaatttgtacctcccaggttgcctgtatcatagttttgagcttgggatctagtgaatttgaagaacaaactcaagtttgtcttctctctatatcatgtacttcctccgtttcacaatgtaagtagggctagcattcccatattagtatcgatcatgctctatatcaatttatctatatctgtgtaaactaacatttgctgacgatggctgatgctattattagacatttaccgttgcatgagaccatggatagcattgaggacatattcaaatgagggcttgcttagtaattcactgtctgctaaccttatttataaatcgatgttatgaaacttgggacgtatatttatcatgtggatgctctgaaatatcttgcgtaattggtacttgaacactaatgagctaacttataataactgttgtgaatgaagctttattttttggcacgatattcatgaactaagaagtaatgctgtggctttttctgcagatttaggaaggattcaccagatcaaggtactctatatcatctcttctcactaccctacctattttataatttccagttttggagcccaatgcaaggtgc

SEQ ID NO: 96446 - DNA, 626 bp, Oryza sativa
atccttgcagtcccatgaagagtttttgggcaagctcctcctttagtacaagtgctcccacgtataatgttgactttgatatcaatacaatgttgcagtttgtgacataattttctttgttgctttttggttgactaaaactttccatggaatgcagctaattgcctcctgctagcaagatacttaatagttgcatcgttaaaatacttgtgtgatttttcattcatatttgagtagggagcagcttgttccagttagctttcctttccctgtagacaccaggtcaagtattcctgtattaatcacatttcatttcaacttttgattctgatatggttcaccattttttacaagagtctgtcagatttttaaatgttccttaattattagtaggatttttcatataactaacatatgatcttgataacaaatagaaaatgagtgttttttcttttgatgataccatttgctttaatctgtagctgcaactgtcttgcagcttgtagttttttttaaaaaataaaataaaataaaaagaagaaaagctaactccgaccaattcctagtaccaatcctagtttgcatccagatcacctgtgttcctgtacttttagtatgctaaaggg

SEQ ID NO: 96447 - DNA, 1790 bp, Oryza sativa
gtgtgtgcattatgcctacgtaaaaacgtacatagagagtaccgcctacaacacagtttacgcgtacgtgatggctgatatgctatttcgcgagtcgtgcacgccctacgcgtacgcagagatcgctaggtgcctacaaggttcacccctgcccgtgcctacaaggctttaacgcaacttgcaaaccactgtatgctaggtgttcacggtgtatgtggatggtttatgcacacgatgggattgcgcacataaacaggcatgtcgaacgtatgaatagaatcgatgtgtttacgtccgcaatccgaggacggtggtggcccgaggacaacaccttgacaaaattataaattatatatatatatatatatatatatatatatatatatatatcacattttcaatattttggataatgataaggggctaacaataaattaaaaccgatgctgtgtttggctcataatagtggaaatataaaggactattatataaaatagttactgccaaaatgggcttcataatggattgacagtgggatttactcttatcgttattcagtacacagttgagaggattacctgctaagtttaggtgggcctggcccatcataaatattttctttctcacaacatataccagaggagtgatatctatcttatgtggttatttactttgtattttctatttgtagaccaacgtaaaccagatgtaaccacaatcgcttggttttagctaggatcttctacatcagatcatttgtaccactatttacgtgtgccgatgcaatagctttctctaaacgcgatctacaatagtaacgcgatatagagcgtaaaccataaaaactagcacgtaactgaactttccactcgtctcttagctttccggggattcctttctcctctccggcgaactctaacaatgcgtacgttctttcggtgtggaatcacgactagagtaaactaacgattagagtttatgttggtgtccaaatgaccataatacccctcgggtaaattaaccccattatttactcagctgacaggtggcgcttcctcattggtcgcgcctacctttatgcagctttatgctgaccgcacttaaaaaaaagctccaatacttatggagtttttgacagatatcaaggagaaggagctgaaattaaataagtgatggttgtatttgttgagacgagtaactatatggagaaaatagaaattaaatgagaaatcattgtgattgtttgatatgagagtctgtggagaagtagctatatgttgagacaaaatatatataaacacgaagtagcaatattttaagacaaatggagtatctatgaacacaacaggaaacctaatgttactatttataaaatgtcttacatatttttaaagcaaatgaaaaagaaatactcccacactccctaaatagagctatttctatcattgcatcagtacatagatagagtacatgtttaaattgttcgcccatgtgaactacacatgggtaggtatgactagtagtgtgacatgatcaaatcagcatgggaatataaatgtaaatgagataataccacatggatggagtaaagcagaacaccgagctagccagctaggcctccgctgtattatcatcttgcattttgctcagtggcagcaaaatgacagtgtgctttcccttccttttctttcactactagaaaaactcttttcccagtcggccgaatcatattttcgcaggcggacaagccatccgcctgcacctcaatgcctgcgaaaatagttgatttt

SEQ ID NO: 96448 - DNA, 625 bp, Oryza sativa
tttcaaacctattgtattgttttgtagtatgatattgcgtttaggtgaagcctataacagcccttcctccagaactgtgtagccaacccatccgatgggcgggcccacttacacataccactccgcttatacttttgtcctcgcttcgtgtaaaagggttaacccgagagtgacatggttggaggaaagaggccttataagttggtcctcactttgtgtaaaagggttaaacctggggtgatatggttggagggaggagtccttgtaagttggaacatggttgtaaggaagaggccttataagttgcttcaagagaccttataaattgcttctcgcttcgtgtagaagggtaaacccgggagtcatatggttgaagggaagaaacattataagtttgttccaaaccttgctaaactagcaagctgtaggccgtgccgtaaaattcaggggtcctgtgcaaaatcactaaattgataataataataataataataataataataataataataataataataataataataataataataataataataataataataataattgatggatcttctttttaatatatttgcatagctcctttcttctattggtttttttcttctta

SEQ ID NO: 96449 - DNA, 552 bp, Oryza sativa
cttttctctaatactataccggaacgctttatctataatgatgtgtttgaataatggattaggagagctgggattgagaaatagaaatgagtggaggaatatgatgaaatgagtgagtagaataaatggctagcttattcgttttagaggatttgtaaagggaaattacaggaatattcaatcctttggaatgagcactatactatcattcgttttaaaggaatgcatgaaaggaaaaattcctatccctccacttttagggggaaaacaaaggaaaaaaataatccactctaacccaatgtttttaatccttttggactgtttgcaacccaaccatataaaaatttcctatgttttctaatccataggtttgcacatgcattcctatattacacgttttctgtattcctacggtttgaaaatcctacaaaccgaataagcccaagattgaaacttaccttttgaggggttgaaaatcatatcccaaacccattatccaaatatggcttaagtgtttttttaactctttgaaatgttatcccaaaaaacttt

SEQ ID NO: 96450 - DNA, 577 bp, Oryza sativa
actattatatgaattggctgttagattgactatagatgaattgaagataatagtgggctatactattaaacttgctcttacaaaccggaacacggagtatctagatttatagttatagttagaagtttgctttatttttctaaatggagagagtatatctatagtctccatttcaaaataaatttaccttttttatatgaatataaatatagactaagatcatatttatatataaaagtaacttatatatgaatataaatatagactgaggtcatatttatatatataattaaatttatttttaaacggagagtgtatctactatccacaaaactaattttgaatctgatcaaacatatgtacaaatttatttttataaattgattttttttcttggaaggaacactatctactcccatgcgtcgccggctgtatctgatctgcaggcacactaaaataagagtgaaaagaaactgcacgatgctttgacgatttctgtatttgcatttgtgtgattgggatttaataggggagatgcgaatagtagagaagtcctttttcttagcatgcctggctg

SEQ ID NO: 96451 - DNA, 539 bp, Oryza sativa
ggagcacagcagttcccgttacccatcggcaagcaacaacgcctcatcccgtggaagtcaccgtgagcactacgatcctacgatccattcccatggcttgctcctagagtacagcaagatccgcaagatgtgctctgtggcttaattttctgggagttggatagagagaaaagaaaggcatgaagagggggataagacaggtataataagaagtttaaaccagcgatagcgcaaccaacctgacaaaactgatgagctgaatgaaaaaaaccagaaaagagagtgcaagccgacgataaaattatcgccaactaaacacaagctccaagactagagaaaccatagaaaattttatccaacacaaacgtgggctccacacacgagatgatgtgcagtaatgagcgagtgatggtctggtggaaagttaaattagtaaaaagaaagagaaaatccatgaaataccattgacaagcactctaatcccagaaatgccattgacaagcgcaatttactcaaaatgccatcgtacaagcgttttt

SEQ ID NO: 96452 - DNA, 540 bp, Oryza sativa
ctgattgagtctgctgcggacgctcgggccgcggctctcctgacgtcgcgggctcgacgctgacgcacataggtgcggccccacatgacagcactggacaccgaccagtacatgtcggcacagttttaaatccacaaagtttcatatccctttctccttggcccgatcagcgaccccgtaggttgtttgcaagtgtcagcacatcacatcctcttgggtttcttcttcgatcatctgacatctcggaagcttctgaatttttcaaatcacgtaaagctcaagtgtccatgtcactgatgcaagcagatagattagctcgttctcttttgactgagatcatcattaatgaacaagttattttggagccaaagtgtttaatcaatactccagttgttaattagtagatactcctactttgctgtgaaggaactaggaagccatgatcccggatcagaaaaagggaacgcagtctttagcctgaaaaagtatgttacacgttgcaatcatcgaaaattaagcaaaatgatcatcttagaaaca

SEQ ID NO: 96453 - DNA, 623 bp, Oryza sativa
tttcatcagcggcagcagatgtattgctttatttaggtgttgtttagcacaactctatattctagatccaacgtgatataccaaatgtttgatgcggatctaggatataggctatatctccctttgtttctaaatatataataatgctatttacttttagatatggcatttaaaaattcgtctagtgcaaatataagaaataaaatcacaattaaaataaaacaagtcagaataaaataaataaaactaatatagtttttcttactaggacaaaatgaccaaacatcatgtcacgtttacaaggcagttagtagcatcatatttttaaaatcggaagcagtatatatctcctattacatgtaatccttatagcaggtacaatactagcagattattagccggctacaaatatattttaatgagataaaagttaagagagaagaacagcgggctacaaatctatagctagttgcagcacggactctaagacgcaatgtgtgtatgacaggtgggaccgtatataatagtatagttagcaactattgtatgaaatggctattatgattggtatagatgaaatgaagtagtagtgggctatactattaaacttgctcttagtaatt

SEQ ID NO: 96454 - DNA, 602 bp, Oryza sativa
gggttacgggaagaacgtggctagcaaaaaaacatttttttcagaaaaatccaattgggaaagtgggctggtctgtttatgtgggctctgaaccgtagggtgaagggctcatggcgctttcctgtgcaaggatcggtatgatatttttcaccagatcttgataaaataggtcgaattttacaacttcaaatttgaattctcgaaaaccattcaagttttacgtggaatctacttccatcccaagtaaatcttcagaccctcaaaatttgacggttttcaaccttaggtaatatagagttggtgggtttggactataaacgtgaatctattggtgggtggcgtaagagatgatgcgaagttagcgagggacgacggtggctcggaagtcagaactcagaaccatagatgatgaggatgctttcagataaccttgagtattcttttatgaaagatattatagactattgattttgacacaagcacacaatcatccctatgaatatgcacacacactttacatctatctttgtttcgtaagaacacctttaaaaattgagccagtatatattgaaattgatgaagttattaaggtgcttcaacat

SEQ ID NO: 96455 - DNA, 570 bp, Oryza sativa
tcaaactttaaaaccgatgtaaaccgagtttaaaacgctctgcagacctcaatcttccatctattatatcatctatctattatcttattaaagtaataaaaaagaaagcctccacgttttctctcacggcctagaaattttcatattaatcagagaaaaagaaaagtagagtccatataggaatacaatttaaaaatagctgaaatttggaatttaaaataagaaatattgaaagaggagactagagtccatacaagtatacaatttagaattaactgaaattcggaattaaaaaaataggaaaactataagtagaagttagagtccatataaaaatgtaatttagaaataactaaaattcaaaatgaaaaaaaaacaagattgggagaaaagtttagagtccatatataaatatgatttataaataactaaaagtagagtccatatagaaatacaatttaaaaacagcttaattcagaattaaaaatataggaatattaaaagaggagactagagtccactcaagtatacaatttagaattaatttaaattccggattaaaaaatagga

SEQ ID NO: 96456 - DNA, 576 bp, Oryza sativa
gatttttgcaccattcggcaccaaagattcattccctgccgacaggcgacaggagccctgaagcctgaactaaaattggccgcgcaaccacacatttctgcagggaagacgattgatcgatcctctcttgctctgatcacacaagacaatgcagctgtcccgacaacgttgtccttgaatcgtcgccaaccaaaagaaaatctcttcaacccaacagcgatttgctcgaatctcattaaccgcgtgaaaaagaatatatatcttcagggatcgatggaaatgaaaactttgaccattttcgttttaacaatgttttgtaattctttgaaaaatacaccatattatcgaactatgataacctaactagactttttttttgttcaaccaaatatgataaatctaaaaattgttaatggttgaagttgaaacaaccctggtcagaggtgacagttgacaaagtaaataggagccgagggagtatcgttatcttctctctaaaatggattccgattaatcagaattttaatactggacacatcataccagggatgcagcctctgtcctgtccgtgtgatc

SEQ ID NO: 96457 - DNA, 630 bp, Oryza sativa
accaatcacacggacaggacaggaatttgcatccgcacgatctgtctaagattaaaattcgaattaattggcatccgttagtgataatgataagatgatgatgctaactgcaagtgtttctgtaatctaagatgtggtttgaggagagtgatatctgaacataagaacatttccatcgatatctgaagacttttctcctacgcggttgataagatttcagtaaatatatgctagatttcggtagacgccggatcacacggacaggacagaggctgcatccctggtatgatgtgtccagtattaaaattctgattaatcggaatccattttagagagaagataacgatactccctcggctcctatttactttgtcaactgtcacctctgaccagggttgtttcaacttcaaccattaacaatttttagatttatcatatttggttgaacaaaaaaaaagtctagttaggttatcatagttcgataatatggtgtatttttcaaagaattacaaaacattgttaaaacgaaaatggtcaaagttttcatttccatcgatccctgaagatatatattctttttcacgcccttaatgagattcgagcaaatcgctgttgggttgaagagatttt

SEQ ID NO: 96458 - DNA, 563 bp, Oryza sativa
tatatatatatatatatatatatagagagagagagagagagagagagagagagagagagagagagagagagagagaaggtctgaggtgggggaatcccggaagccgggcagattcctgagaggctgagaatagatgctttggaccacctccagtccagattctgttctacggattgcgaaattgcggcaggatatacgcatatgcgtcatgtttgatttctgaatcgaagtaaatttacataatttttgcaggatttagttcagttcctaaaagaatcatatgaatttcctcctttcttttctttttgcattgatagatcggatgcccaaataagtcaaagaaaaaactaaaatttaatttttcaaacttaatattgagattaattttaagatattacaatgtagttcctttttcagcattgattttgtaagtgacaagaacacgtaaaaaaattccctaataagacgggaataggagcatacgatgggactttcaaacaggcaaagtggcaaacggctcatttttcaagtcccagtgcaagatttaagtaagcaacatttag

SEQ ID NO: 96459 - DNA, 516 bp, Oryza sativa
gatatatatagtgtttaaattcattaacattaatatgaatgtggacaatgctaaaaaatcttataaactgaaacgaagggagtaacaatttctccaccaacattctcttcccaaccaatcacaaccctccaccatttattttttccacctacctccactattcatccaattacaaccctccatcactcacttctacctactttcttaataaccgtgttcaaccctaaaacttcatatattctgggacagagggagtatgtcataggcagcgaatgacaaattattagttgctatatcttgaaaatttcaagtaggagtacgttaaatgtcccgctacggagggagtatgtactgatccacgtcctcgctgatattcctatcgtgtgtgacagatttctttttagacagcgtctggttggttggatcgtagtactactactgttgctgcatgagcgtgaacaacgcgtgatcccatcatgctttatcctaacttctctgacgagcatgtagtagacg

SEQ ID NO: 96460 - DNA, 522 bp, Oryza sativa
cttgagagccgagagcctcagctgaaaaagctaagaaaaacaaggaatcttactgcgaggctgcaacaatccccaccatccccacctccccatccttggaggagaagagaggggagccggcaatggacgacgaggaggacgccaatccactaccgagctccattactgctgtcgccgtcgccctccgagccctcaagccccatctcctcgtcgtcggctgggaggggaggggccccagcgagctgactaccgctgaggcgcgggaaaggagagagttggctatggtggagctcaagttgccagccactgtcgctgacctttggctagatccaggcggcgccgtcgagctctaggccgaatcccgctcctcctcaacgcttgagaggagagaggcgatgatggtggcagccgagcgcacacgccgctggtgtcgaggtcgtcgtcctttgaggaggggcttcgtctcctcatcgcgggccgggagaggaggtgcactggcatgcgccgcaaaacttgtcgtcg

SEQ ID NO: 96461 - DNA, 618 bp, Oryza sativa
agagagagagagagagagagaaggtctgaggtgggggaatcccggaagccgggcagattcctgagaggctgagaatagatgctttggaccacctccagtccagattctgttctacggattgcgaaattgcggcaggatatacgcatatgcgtcatgtttgatttctgaatcgaagtaaatttacataatttttgcaggatttagttcagttcctaaaagaatcatatgaatttcctcctttcttttctttttgcattgatagatcggatgcccaaataagtcaaagaaaaaactaaaatttaatttttcaaacttaatattgagattaattttaagatattacaatggagttcctttttcagcattgattttgtaagtgacaagaacacgtaaaaaaattccctaataagacgggaataggagcatacgatgggactttcaaacaggcaaagtggcaaacggctcatttttcaagttccagtgcaagatttaagtaagcaacatttagatgcgtgccaaatgtagtcataaatatttaagggcccctgaaatgaaaaaacataggaattttgataggaatgtaagttaggaatgtaagtgtaaaacagatgaattacc

SEQ ID NO: 96462 - DNA, 592 bp, Oryza sativa
cattttttgtttttgatagaggattatagtcagaaattggttggttaatttgtttttataatttaattgtacatggatgtctattaattaaatgtacacgacttggtggattttctagattccattaccccacttgctctctttgacaaaaatagcaaagaaatagtacaatggtgctcagcctagtacagatatgtacatagaacttgctctttccctgtaaaatagggcagagattcagtaaattctccgcggaagttttgacttggaaatcaaattaacgcgaaatctttgacatggtgtcagccatgtgcctaaaacaatcatatacatggaactaaagagagattcagaatcaatcaatcagagtatgaaatcgtgaagcagtaaacaaacctgcacaactgaagactctgcactctaaactatgtcaaaaatgctctttctccccgctgttcttttcccttgtcatcaaggcaaaaaaaaaaaaaaacaataaccaagcaggggactactactaagtcatgaccatgttgagcagcagatggcctacatagcaagggcatgcatctgatcatctgatgggtactat

SEQ ID NO: 96463 - DNA, 646 bp, Oryza sativa
cgggatggggggcggcggctgctggagatatgctactcctagatctctgccctagagccgcctcccggacctcgcgccgcctccaaaccctagcgccatgggagtcgaggaagacgagcgctgtctctgctcggggaaaaaaaaatcgtctcggagatgatttttctttacccgggggtttggcgtggatcgggcggagaattgcccccaccccggcccaggcgaacgcgtatatggcccacggaagaaaattacacccggccgggatggcacacggggatttcaggccattcccccccaaacccagcctaaaagaacaaggccttaagggacaagatctcggtccttggctgtgacaggcacgcagggggggagggatgaggaggaggagtaaatacctgaccccctttggctcctccgtttgcagcaacaaaagatcgccgattcgccgcgcgtacagcgcgatcgcggcacgtgtgcgccgttccgtatccaaatcccgtggattcgatcaatcgatcgatctctgcactgcacagctgcgcctgcagaatctcgcgacaccttgtacttccatttttttttcctctcctaaactgcatggtgacctcaccggcaactacagccacctgtgtatatatataga

SEQ ID NO: 96464 - DNA, 703 bp, Oryza sativa
gatcgaacctacatcaaataagtacatcaaaagcaatccttaaatatggaccacactactgctaaatctgaaaatcaaatgatatttgaaatctacaaatcacaaagtcacaagagagtgtattgcaaaattaatgttcttagctctgaccatcttatatgcattagaaaatacaattgaaaggtacaacaagaaacacaaatgagcaaaaatctaaaataaaatagttaatctttccatcaaattatcattaaggtattatatcaagtacatatagcattatcacaagaaactgtgactgataactacatggagttggtaatagatgcataagtatcaggatatgtgaaaatggttttggtagattgttcatgaaaaaaaaaacactttcatacaattatgtttttaatatttctataaatatatagtcagaaaataatgataaaacatgtgaattagatactgtgaattgcctaggttggtaccacagcctggatctcattttaagagtcgaaggttaacagaggttggagtcgatattcttatgatcttatccaagctttctgcttctaatttgatttattaccaccaatccaccattcctttttactcgatgttttggacattgacaaagtttacaacattacattaagccccaatcatttcagtaatgattaatggcaatagcataagcattaaactt

SEQ ID NO: 96465 - DNA, 501 bp, Oryza sativa
cactaaacaatttctagaggaggctatgctcattcattccccttggtaatttttctggaggtcactaactataccaggaagccccacaaaaatacgaaaaatttcatctcctctgtggcccctctaaaatttatgaaatggttgatgtcctattgttctaaaaatcccaaattctagtcttctgaaatataaagtgtgcatcaaattgaacggaaatataagatgttataatttcttcaaatactagtttattttccatgaattaatatgctttagttttttatgttggtttttcaagatgttttttttcattttttgagtttttttagaaggggagcagttttttaagaagagaaaggaggacaactgtgtttctaaagcagttaagaataagaagataccgcgttcacgcttaatgtcgcctagtagctagttctgacgtcgggcctcatgtaattttcaaatacgacacttagtactatcatttgtactaggcgagtt

SEQ ID NO: 96466 - DNA, 596 bp, Oryza sativa
ttaaaaatcaactcatgcacagatttttaatttttataatagtagagataaatgacctccaccagtaaatttcatcttaactgccccatataccaataataagattaaaatagacttcacccgttgcaatgcacgggcattttttttagtacttaaaaaaataataggtgctttcgtcgtccgtcaaaaaaaccggccaaaaaaagggcgaaaaaaagaaaataaacaaattgtccgatccaaaaagagggcgaaaaaaccggcttaaaacaaatcgtgcgaagaaaccaggcgaaaaaaggaaaagaaaaattaaatccgtccgatcaaaaaaggggcgaaaaaaaggaaaagaaaaacgaatccaactccgtcaacgcagtaaaaaagggcgaaaaaaaataaaaaagaatctgtctgattccaaagaaaaagaaattatatatgacgcggttaaaaaaatatcaaatcctattatattatctctatctctactacttaaaaaaaatctctatctctaactctaactctacttatatgatatgagctgtttccgtcctctgtgaaaaaaaatcgggcgaaaaaaaaacggacga

SEQ ID NO: 96467 - DNA, 686 bp, Oryza sativa
aaagttatggaatgggttttgtcattagtatacgtttaatatttctaattagtatttaaacattcgatgtgataggggttttagtccctgatccaaacagggccgcttctaatctctttctactccagtacatttcagttgctttaatttatgatatgtgtagatataataacctaaaataagctagataggaagatttggttaatagtgaccaacatgtgtttaacgttgttttgtttaagccatgctgcgggcggcgtggagccgtgcatctatgtcctgttcttttctcaaaaaaactgtataaacttttagataaaaatggtacgttttttaaattgctaaacggtatgttttgtgtgaaaactttctatatgaaagttattttaaaatataagattatttttcaagtttataaaaattaaaactcaattaatcacacattattatcacttttttttaaaagacacattattaccacatcattttacgtgaaacacttaatttttatctcatctccatttttgggagatttaaacaccaccatagtcaaaagttaacgcagagctcctgaaagttttcagctaaaaatatgcttatgctttcgatctacgtggacttgcttagctatgaaatctctgtctgcacattccagttggttacgtcgaaatagtagccccatattg

SEQ ID NO: 96468 - DNA, 1674 bp, Oryza sativa
ggagaacaccaaggaagtggaagatgatccttcgcacacagcacactaccgggctcttgcacaattaaacccaaaaacatggagatggtggagcaaaaccaacatagcgcacaaatggtgggtaacactagcaaccgacaatgacaagccccgccaaaggcatgttcgtacactcgtcctactaattgtatggaaaatatggaagaagaggaaacatagagtggttcatcacaagagctattggtgccatctttggccgtaaaaattaatcggctctaatagcagtaaaacgacagatattattccctagtttctccctttccccttttgtacagttccacaccatacttgtaaagctccctttgcactcctatattcaatgaaatttccacaccttatatcagtccattaaaaacattcctataattcaaatttgtacacaatacaactatttcttcgacaccatttttaatgcaagtgaatcaaagcatttgggtgcttagaaggggaatttaaacaattaaatttttgtatttgaccaataagatgaatatttctgtctaaatctttgtaagaaaacctagcaatacttacatttagaaatgaagtaatcagtatgcgaacgaatcgtcagtttagaaagtactccatatgtcccaagattattgtaatctagattactgagctagattactataagctggattataataagccgacatagaataagctgttagttgtttgtttctctttattagctgttagccacctactccctccgtcccataaaaaaccaacctagtacctgatatgatacatcttagtattatgaatctggacatacataatactagaatcttagaattatgaatctgaatatatgtccagcttcgtaatactagaatatgttacatccggttctagattcgttttttatgggacggagggagtaataatctaaaagaaacacctttagagtggattatcgtattatagtaatttgacttatagactgtaataatctatcataataagctatctcgttgtttcagtttactcataataatccagattataataattctaagctgaatcaaacagagcctaagttaatttctacggtttaaaatatgttccaagataagttgatttttttaacttataactatcattagtctataaatcgagaagttttagtacttcaattctccatatctacccgctcactaatactactacttttattctattaacaagggacaatttcctttttcccaaccttgtaaaatttttcttgggaagtagggactcgatttatttgggagaggcaagggctgatctacattaattatgcttccctgttgcctagcacatccggtaaaatctataacttcaatacgaatagctggtttaaatgataaaccatccgtcctaaaacatggtttatataggctttcacctagagatagctgtgttaacagaagtgcaccgtacgtactgaccacgccggtttgatcgagtcgatatgacctggccaaacggctatagttaacatcgtatggtggcaatgctgtcattgaattttttttcatttacataaccctgtttagtacgacaaactgcacaaatcaacgtcgtcctccttgcaatatgccaactcgcctagtacaaatg

SEQ ID NO: 96469 - DNA, 669 bp, Oryza sativa
aatgttaatatttggcacatgaaaataacatcattagaaatttcacaaaactacagatactttaaccaaattttcataaaactacagatttagcgtctaatttatgacaaaactacatatttaggatggaacaccataaaactatagattagataacaaatttatcacaaagctataagtttagtgccaatttaatcacaaaactacaatgtttatagctctaacataacggtagtactagggatttaaacttcgaaatatgtagttttatgataactttagtatttaaatatgtagttttgtgttacttatcattaaatatatattttagtgataaattcggtgttaaatctatagttttctgatacaacaccttaaatatgtagttttgtgatagtttggttaacgtatctatagttttgtgataaaatactttaatgttgttatattttcaatatttttatgatatatgattataggataggcaaaacaatcaaacaagtataatggagaccatggcagtatcctacattataagtaagaacaaacaaacgtaatattatgctttaagttcgtccatgggaaataagatatattagctgggagaggagagaggacccgcatgttattaaatttgttctcaatagaacgacataatgattagagttt

SEQ ID NO: 96470 - DNA, 564 bp, Oryza sativa
taaaaaatcaacaaaatagattaatatgtgatagatcactctacaaacaggtaagttaaaattcaacttttacaagttgaaaaaaaatgtctacttaacatatattcacaattaaatttatttttattgcaacttgtataaattaaaatttgacattgcatgtttgtggagtaatttatcacttattaatttatcttgtttttttttctaatttatcataaccatgtgggtgacaagcaaacaacgaagaaccccttaagagtttagaatagttcccctatttgttgcttacctttttgtttagataatgaaaatggtttacatctccgcctcaccaatgttttttaaatgaaaacgaaagaaaaaaaaaagagtaatgggacaagttcccaactcctctgagaagatgctgcatacactaatagaaaaaagatttttcccaaggaggcccatatcattatataggcaggccacattttcggccacaaacgttacgtttgcctgtatagttatgaacggggatacaatggatatccatctgcgaaaatgcaacttcgcatgtga

SEQ ID NO: 96471 - DNA, 1190 bp, Oryza sativa
caaaactgctctccaaaacctcttggagtcgttgtatccggttttctgatttgagaaggggtgaactagatttcggcctattaaagggagtcaaagtgcactttttccatctacaaaaatacgccagtgggctttcatcctaggagtggtccgtgaaaactggatccaacagcccaactgtgcttacgtttcggcctttccccgccatttgcgctactggccgtgctccccgcccccacgccggcgagcgcgttgcagccttgcaggcgaggcaagaaccaacctatcgccatctatcttcaagaaaaaagaagcatatcgccatcgccaccgtcgccgccggggccgagcgcgcgcagctccttcacggtggagccgacggtagctagcttacgctcgccgccgctcatgagcaaaagaagcaatgtgcgtgcgtcgtcggtgcgcggacctgcatcctggcgtccaaggtgtcgccgcgaacagctgcagctgcaaatctgcaggtgccgcatcacgtgtacggtgtacccggtactgggctatactactggctaacaggccggtgagctgaaacaactacttcctctatcaaaaaaaaaaaaaaaggataaaccttgagtttccgtgtctaattttgactgtccgtcttatataatttttttttataattcgtattttcattattgttagatgataaaacatgattaatattttatgcgtgacttgtttttttaattttttttataatttttttaaataagacggatgatccaatgttacaaacggaaatcagggtttgtcttttttttagagacggagagagtataaaatccaaactggccagtgcatcaagaatcaaacgtactacggggcaccggatgcctgagacacggcaatgccggagtagatataccgtcggcgtcgaccattgtctcagggagtcacagatgtgtaaatttgttgcgtgttgtcaggcggtcaagatcctcgcttatccctgcctctgctgctgctacagtgctctgcacccatccaatgtctgcatccataagatttgctccccaggccggcaccaatttttgacgatctacgagcttcaacagcaagcagggctagcattcatcaattcaacccctcactcatagagtcctaggactactacactacccttgttcctgtcctgaacc

SEQ ID NO: 96472 - DNA, 644 bp, Oryza sativa
gaaataatatttttttatcgattttagatgagcctgtagtgattaactgatttaaattgccttcctataccagtgaatcagtgattcaaagttagaaccggaggtgttaagtactcctacttgaggtatctaaattttacactaaaatttttggtaccttgaggtactttataaaggatggtaaaattaccttaatataaattatgagatccacatacaaaggttttatttcagatgcagaaattccgtgtgattaaatatctgcattacatttgtcagtcgtcacttatcatagtaaacgtgcagacagctctcttttaataattgacatgtttgtacgaatgtgtaacgattgagtcattggcacgacactttatgtagtgtcatgtccgacgagatctgacttgcgagaaagcacacacatacatgcatgtacgaattagcatccagtgctttaatgcttttgcaggttgaaattgtaatagtctttgcttcttaattcctccggtctaaagtataagtttggtcatcattttcatactctcacgcatatggcgatgctcaacttaacacaccacaggggttaaaccaaatcacttggtgacgtcttctttgccgtatttttatctaacaagtagattttg

SEQ ID NO: 96473 - DNA, 748 bp, Oryza sativa
aaaaaatagtgacctattatttaggccctgtttgtttcagcttaagtttattgtaatctacattattgagccagattactgtaagctgaattataataagccgacatagaataagctgtgagctgtttgtttctctggattataagctgttcgttagctgttagccatccaataatctaaaaaaacacctttagagtggattactagattatagtaatctggcttatagattgtaataatctatcataataagctatctgtttgtttcagcttattcctaataatccagattataataattctaagctgaatcaaacagtgccttagactcgaaggctgtgtgtagattggttttagtagttttaatatataatttggactgcaagcttcctgcttgtgctatcaagttgaatcttctctttttcctgataaatccttttgttttcatcttaaacagacctttacatgcatatatgctattgattgcggcttatttccattgatttgcaggtcaattctatggaacagctaagcgatgaactgaaacaacggtgttcaaatcttcataaaggatgcaaaagattcatgtacattaagctcccaactactgttttttttgggcgagctactaactttgcagcacaggcgtacactcgatgcagaatgcgtagcatgattattattattatttttggtttaagaaagacatcactctaggtttatgccgatgtaagtcaatatcaagttt

SEQ ID NO: 96474 - DNA, 591 bp, Oryza sativa
catgttgttcatcgctactgtcttcatcttaaaatatacatatactatcttaattttgatcggatataatatattttaggattataaatttgaacagaaaatctgttcatagtattgaaatgtataacatcatatcaaaataacttatacggagtactttgaaaacgaaggtagtagcaaactattacggatttaagtggaaatggacttctacctatattgtataattaagttgtgtataatttagtgctaagctgtatttaagacggcaggagtaacatataaggatgatgtgttctttccttttcccaacttctatccttattaacttatacccttattttccgagcgcatattttttaaattgctaaccagtgtgattttttttaaaaaaaaattctattgaaaagtttacaggaagagaaagcagcctccgtaaaaaaaacatgccacgacggcggtcgctgtaaacatgactccgactcaggacagcgatggtgataaagcaactttgctctgcaagctttatgtaactgcacggaaagggagaaattcagttcaagtgctgatataaagtgtacatacaatgtg

SEQ ID NO: 96475 - DNA, 570 bp, Oryza sativa
acatctattccaaatatagggtactttgattggatgtgacacatcttatctagattcgtaaatatactattaagatgtgtcacatccgacaaaagaccatatatttgaagatagaggaagtaataatgatgagtacatgcatgtgcaaaacatcgaaagtgctttaatttttgggcaataatgaacatgtcttgttcggcttgaatttttaatatgcgcactaatctatatacatttgacagtaaaaaaaaaagatagtaaatatttgacagcgacgagccaatgacaaggcataatatatacgcacgtaaatggaaaagaaaaatccaattcttttttctagttttgccgttttgtgccactagccccgtctgttgtgcgctcggcgacaccttccccgtcgcagaagccgccaaaggggagcaggcgcggatacaaaaccccggcttaattatctcccactcgtcaacgaatcagcgcgccgcgccgttctgttgctacgcacagtggcatgaaacgggttcgttcgggattcctcctgcctgggggatgtaaccgacaaacccgcga

SEQ ID NO: 96476 - DNA, 546 bp, Oryza sativa
aacattatctaaaaatacaattaaagatcctccaacttttcctcgagaagaaactctctcgtgtaattttcttattcgagtcaaccagctttcgtgtgctcatgttctcaaaaagcaaccaagaaaaccaaaatttgtccggcacctgtttacccggagctcgagcggatcttgctgctcatgccgacaaatcttgttgcccttgccataatttttcgtggggtttttatcccctgccgaaagcgtcgtcgccacgggcctcttctttggcgtgttccgacgtgccactgttcacagccagaacaaaccaaacaccttttacctgtacaacacataccccacccccccctccccaatccgtgctcccgccgaacgtgaacccgtcacgcacacacgcgtgcgcgtaccttgggcacacgtactgcacacagtgcgcatttatccgcaaagctatcgaaaatttcaggtctccaggatgattcaatgcagagaagagctcattctctaaaccgaagtactagtatctcagtattgaattaatcaggt

SEQ ID NO: 96477 - DNA, 532 bp, Oryza sativa
ttatatagttaattactcaactaccatgatttttattctatatcttaccacttttttgatccatggtccatactgttttacctctcaatacctctaagtagctcgcaggtatcataaaagctcttgttgtataaattttttattttgtataaccttttgataaaagctctcgttgtatcaatggtatcacggtttttattttgtacaaaccttttgattgatactcctccgagaagcaaacgagtacgcatgcacttggagttatagaagcccattccccaaatccagtcaccgatccgttaggttccgtgttagctagctcccagagcgtgccggcgacatatgtatcgctgccgaccgccgtgcacacagaatccatccagtcggtgcgcggtgcgccgtgtctcggtcgacaagcgacaccggacaacgacctcagctccacgcacacgcacgtgatgattggattttggatcgtatacgtaccccacgcattacgccaatataggctcgcgtaacaacatcaaacacg

SEQ ID NO: 96478 - DNA, 580 bp, Oryza sativa
ccccaagatttgtcggcatgagcagcaagatccgctcgagctccgggtaaacaggtgccggacaaattttggttttcttggttgctttttgagaacatgagcacacgaaagctggttgactcgaataagaaaattacacgagagagtttcttctcgaggaaaagttggaggatctttaattgtatttttagataatgtattcacaaaaggatctttaatttgtattcatatagctggtgctccattgctcctactttctagggagataggtgtgttcttttgagttcaatgtaatggaacatacaaacaataatttaactattattacaagattaaaaagaatggatttgaaatagcatcttataatgataactatatatgtaaaaagtttttaaaaaaatcctcctatttaggaactcgacctatgtgcatttttgttcaattttgagaaaagaaaaatacaccgataatatgtaaaacggacactcatattgttaaagtctcgcaatcgaaacctcttccaatgtaaagcattcaatgtcttctattacgtatcatctattttgcacaaccctttaaa

SEQ ID NO: 96479 - DNA, 567 bp, Oryza sativa
atttctattcactttctcctctagactattggtggttgagagtgatatgtgagggagggaagccaacaaggtgaacaaagaggaggaaggggaaagaaactagaggagaggcaattgaaatctttctttctcttttgcttgccctcttttgaatcaaagttcacagctttcacttgtcaactgcagcgcttctcgcttcatgatgaaatctattcccttcttcgtttctttttttgcccctcaagttaagataaaattttgcttcctttttgctctcaggcacattaaccatatgtgccatgtgttgtttgtacttcaactcttcaaatgtaaaaatgctctatcagttctgccaatcttgtttaattcgtgcattgcaaacgtaacaaagtaaaaagattcagttttccccatttgtttatttcaatctgttataggtagggataatcctaatgctaaaattagctcatgataccctctgatatgcaggcatcccttcggcaaatgtggtgatggaccgaccacaagatcctttcaactcacgaggtatcatgacatgtactccac

SEQ ID NO: 96480 - DNA, 2484 bp, Oryza sativa
gtggtattgacatggcaattttatctcgaaaaaataataaaaatagtgggacccatatgtcagctacacaaaaaataatttaaaaaggtgaggcccacatggtcccacatgtcagcgtcctttttctctctatccccctctctctccccttacactgccaggagagaagggcgagcggcggcaccgagggggtgacgggtggagcagcgatggagcggcccggcgacgggcgatggacgtcggagcgacggcgggcggcgggcgatggacggagcgacggtgggcgacggaaggaagcggagcagcggcggggcgaaatggagcggcagcgggccgtgggtggagcaacaagggtgcagcagcagcgcgatagcgggcggcggacagtgggcgaagcgatgccgacgacgccgcactcaccgccacccaagctgagctcgtcggctcccctcccctctccctctccactctgggctcttcctcttcttcctctcggctctccgtacaccatgccccaagcttgcttaccgcatatctgtcagcaaagggcctttttcctgccaaactttttgtcaggaaaacttttgccgacagagcgggtctgtcaggccaaatgctgccggcaaaagtattttccgacagataaatctattttgacagatgggttgacagtggtttttgttctttaccgacagacaatatttcccgacagatgaacttttgccgacatatggacttctgctgacagatagtttgataggaatatttacctttgctagcagataatatgacacctagactttacaacgcaaaataataataataataaccgagctagcttattgcagcaaccaatactgtgacatgcatggagccctcgcacacattttagtagattacataattcaacatacaataacatcagagtgcactagcgcattttaaatgacaaaagatgagtcataatggtatgcaaggaaaaagatgctaaaatcgctattttatccgggcttacatgtcgtatatagattacatacacataatagtagaaaatatcctaaaaagcatcgaaatggagaacacgggtacacgcttcacccttgtcaaaagttcacatgatacatcacctgtaatgtaaataaagtgtattgctcagatatacaagtcagatatataaggtatagctgagataagaaaaggagaagctctttcgataagaggcaagcataaaatcgatgcaaaaaggaattgcttgtatggaatataactatatagttcaaacaaattcgattccctactggtcaaacagaaatgcattagtatcgagcactacaagctcaatgagtactacaaatactgaagactaacttagcttccatgtgacagggggatttcacttgtagttaaagttgtagttacaaggcaaaaacttgcaatagttcccaatgctcacattctaaatcttgcactatccatttaataaaaaatgccttgtacatagaagaaatagctatacaaatcatatgctcaaacagatgctaacaaatcttacaataagaaaggggcatgtctcctgtacaaaaatgcaaaaggcatcccaaaataaatgtttcttgacaatcaaaaaatacctctctgtacctcacaatgaccataaaagtcttgccaatcaaataagtgtgtcattactcatgatcaataccttttttaggggttaggacggtactatttggtgatagacaggagtgtgttattctttcggtcgaagaataatgttatatgctcataggtttatgccaattcataaccaataaccagcagcatcttccttctagatttgtactttagagtttagacaaaataaaagtagtactaatgagaccacctttatttcatctcttccattttaccttacagctacttggattttatctcgagggcttgagtttttaatctctgaaccagaataaagtaacacacatataagcttatagcttatactccatatatgcaatttatgtaagataagatgagtagccatcttatgtaaaatgagcatatctgatcagcaaaagataagaaaaatcaactaaaatgccacagaatgtttactcagtgaacaggaatatataaacagataaaagttctattataagttttataaaattttataaattttataaactcaaacgaacatcatcacctaattaaaactaggtggaagcacaagggtaagtatgatcagaatgagccttcccagaagctgcagacaacggcgaccgaccacaacatcatccactccccgactcctcgggccgtcaacaatgaagtatgcaaaatctgtctgacaatctgagccaacaatatattacctccagagacaagaaaaaaagcagaaacaaaccccatgattttcttctatagtgcatgaccaaattatttttttaagagacgccagcagctccatttaaaccgggctgcagg

SEQ ID NO: 96481 - DNA, 506 bp, Oryza sativa
cttaaccatcattgtgattcttaaaatcatacccaatcatcattgaggtgttgttttatagtttttagatttcccatcaaccgccaccattctaccactttacatcttgtatgttattcatctctttgtcgttatttgccatcgttgtgttctaaaatagactatgtttcaatatttcttgttttatttttatttttttgttatttttaaattgttttgctactgaactcttatttttatttttctattttctaattttatatttgtatttgttttaaactttagttaatcttgtgttgggttctacatggattgtttttcaatatttctttttttatttcaaattttgtttatttctaaattgtattcctatttaaaatatctatttttctaattttagaatttattttatttgttgtttcgaattttaattaatcttgtgatgtgttccatatggtctcttcttttaatattcttttttattccggaatttagttatttctaag

SEQ ID NO: 96482 - DNA, 712 bp, Oryza sativa
gacaaagataaaccagcatttggcacagaacagctagtgacaaacaaattaattttttaagaaaaatccgtcacaggtgatacgcaaagatttgtttggccagactagctttgtgcttctgactttcttgaaatggggagaaattaaccccattcatttgggcatgcattaatttttttgccaaaaaaaaagacagatattgtaaactgactttccattgacacttactttcagcagaagaaaatggagttcactcacacggcagaacaaagaaattggcatgccccatttaaaaaagagagagcatgcacgctggatggaaaggtttttttttttgaaagaaatcgctgcatggaaagtatatctgttacagtctgaaacgttaacacgtatatgaatattcaggtgtattattcttgcccccgccttttctatcgaataaaatcccatggacctggacggctagacggccgttcgtggaaaaaaaattttgtcacacaaaattaaggtctactctaatacagatggcagttggaaaaccagtgttaatatctatcttggaccaatgagcatgggcaaaaaattcagatatgccgctcacatttcacgccctgttaatacatccttatgtggattaagacatgagtgtcggcaattccaaaactagtttcacattttaaatttaaacttcatttcgaagcacaccatttac

SEQ ID NO: 96483 - DNA, 697 bp, Oryza sativa
gacgacgctagagcttgcatcactttgcattaacgatgaaaattcaagttgaattatagggtatgtataatcggcgaacgatcgcgaatcgggcgccatgcacgaccacgtttccatgcagagcaaccgctttagccgaaagcaaacatttcccattccggaactctgcaccgagcctagagtggttcatcctaatagtgagatgggacagcccaaaaaattgatacatacactctatatgcaaaataatgaaatatataaaacttcatgtatagacatataatatgcgtacaaatatagtaaggacatgcgaacaaacttcttatgtacaaatcctgcccatataaatttgaaacaaattcaacggcgtgttaaagtaggctcgagaaagatatatatatagaatttcattacgtcagaaaaaactatacatagcaattttggacggatatattatacaaaaatgtgcatttaaactttgcacggggaaagtatatagctataaacttaggatatgcaaagacaaaaccaaatataaagtgaaatatgtggggtagaggcccatgagcatgctggcagcccactgtaaagaaaaagcccagcttaaaacaagagcccacacatcagtccaaaaggaataaggcctatggtgccttacacaatacttgctcctggtaaaaacataatcctaaattgt

SEQ ID NO: 96484 - DNA, 532 bp, Oryza sativa
gtgtttgaaaattcatcggtccacttcatgtgatcctctttagtctttaggatttaaaagtgatatttacactgtagcaaaccccatgtttgaaggcttgaagctggcaaaaagatctttaacaactttgttcaacttttttttttgcgaggaacaactttgttcaacttgatgctatgataggaggaagcttggtttggcgctgtgcaagccttgcaaaatacacaaaagccagttcaagcccatggcgcatcaacggtgtcatgggacccatgaactagctatctacctagcatgcgtgccagctcgccaatcaacaatgttccatcttgatgggtccagcaacacgttctcgccaatgattttgcgattttaatctaacgtggaacaaaaatcctgtccccttgagtatctgaatcattttcttttcattcgttttgcctttttttttttgccccttggataattcagagcacaggacccagctctccgggcgcttctgatgatctgcagaagtgcagagtaacgggat

SEQ ID NO: 96485 - DNA, 522 bp, Oryza sativa
tggatgtcaaaagaaccaaatacaaaatactgagatgtctaatagccatatacatatacttcgttaacagtgacaaggagaaacccaaaaaaaagtggcaatgtaccatcaccttcaaacgaccaagcgtgccagggattaatccatgtacagaatagcaaacaaacaatatagggacaaatattggggcaaaaagcttccataactaaaacaagagaatgtcaattcaatcatactgccagtcaattcaatcaacatcatctgatgcaacactaatgttgccagattctcaaaaggaggttttcactctgtacttcctatgacaagctaaaaaggaactacgagtctacggctatctattctcctggaattgtagggttgtatcaaaggcaaaacggtaaagacttcaagattgcagcaactaaacttaccttcaacaactcaataggattagcaggtgggttagtaccctgctgacctttttgcttctgggcattcacctgtacagcaaaatgagagtta

SEQ ID NO: 96486 - DNA, 545 bp, Oryza sativa
ctggcttttgggtattttgcaaggcttgcacagcgccaaaccaagcttcctcctatcatagcatcaagttgaacaaagttgttcctcgcaaaaaaaaaagttgaacaaagttgttaaagatctttttgccagcttcaagccttcaaacatggggtttgctacagtgtaaatatcacttttaaatcctaaagactaaagaggatcacatgaagtggaccgatgaattttcaaacacccttcgacggcctgcattttaccagccttttaacacttcatttctctaatctaataaaaattttccgcaacacctcctgataacgaacgaactcgctatcgcttttagtttgagtaggggccggaaaacacaaaggaaacggtgaatagtgcactgcaaatcacgcccaaattgcccaagttattggtcgccgaagactcggccaagtgaatgactcgtggaaaaaatctcgttctagaacaacacatgcgcgcgttagctgcaaagcctgcaacttaatcaaccgtgaccagttcaaagttcagagatg

SEQ ID NO: 96487 - DNA, 657 bp, Oryza sativa
agactcggcgcccatcccttctcccgcatgcatatagcgcgcgctgtgtgaaaattttcctaccaggttcttctttgcgcgtgcgcctaccagtgagtcaatccatcacgccatcagcttcatattcacagcatctgtctggtatatcagccatgactcccgccagcttccacagagtaagacatttatttctcaacgtcagcgccagacccatctcctatcctattggacggacattagtcggcgctcctccagcaacaccaccgactcgaatcggccgtcgccccaactcatctacaatcgtccatcgaccgtgccgcatcctccagcacagcctgtctctcgcgtcaaactggagtagcgctccccccggtaatgtgcaggcgacaaaggccccatgcgatgcgaccagcagccgtcgacaaccggaggtgcacagtctctggcattcatagaatcatcgtgcacctcggtcggagtcaatttctgattgttactgctgctcaaatctgcagcttgctattgctgagaactgcttggtggtggtactgaaactttgatgtttgctggctgatgaaaactgatgctcttcactgctaaaaactactgcgtgctagtactcaaaagtcctattacagctactgaaatatcatgctg

SEQ ID NO: 96488 - DNA, 692 bp, Oryza sativa
caggtgtttgttgaatgcaattcgactgggcacccatcctgaaatctgtagattgctgcacgtttgccttattgattttggaagtaactggtaactgaaaatgtatgtgctggactgctagtagaacatgaactagaaggaataccccttgatgaacatggcaatcaagaagttaagaaggtttcttgatcttctatgactctggtagcttgtaaagacaaaacactgaccatgtcaatgtcaatgcaacttctataaatttatgccattcgatcttaaaatgttagcctgaggtttagttcttatcttctatcttagtcttggggacagatgcatgtttggtcttacaatgatttactttaattatattgattgcctatagttaattttttattacattgttggcagaagataaatacatctaagatgtgctgttttaactttattgactgattatattccatatttcattggtttgtgattttccaagttgatatctagttgactagtactaattgtactttccgtttgtttcatgagtgtactctctatttcggttttgtgattattgaaactaaattctgtttcttggatataaaataaataatatatgtggtttatatttatctgggtgacattccgattctgaaaattttacatggctttatgcaggtccttaatgtgtcttgggg

SEQ ID NO: 96489 - DNA, 3092 bp, Oryza sativa
ctaatccacatatttttatttcgctattttcttttttttcattacttttgaaaaagatggccgtgcgttgcaacaggtgaaggtttttttattttattattgtaatatacagtttagttaagatgaaatttactatgagaattcgcttggatatatatatattttttaagaaaatcatgagttgcagttaggatcgtttcaagttagcatgtgagtttttttactgagattttttataggacgaattttgtatttccaaaagcgaacgaacgtaaaaaccgactcaaaatacggatatgtatttctaaaaacgaatttaaaaaccgactcgtacacggatgacgtaagtaccagctaaaacatcttcaatttttataatagtagagattgatagaatatcatcttgaaccgtgttaattacccatcacctatgacagattttaaaatttaggaagagattagacaaattattttagaactttgaaaatcaatcaattctcaaattcttatagtttgttagcattaaaaatgttatgtgtggatttgtcttaaaaaagtactacctccattacatattataaattatttaatttttctcttaatcgaagctttttagtttggtcaagtttatagaaaaaattagcaccatttgtatcacaaattagttttattaaaattaatattgaatatattttgataatatgtttgtttgcatgaaaatgttagtatatttttctaaaaactttgtcaaacttaaaggagtttgattaggagaaaaagttaaacgacttataacattaaacggagggagtactatcaaaattttataaacttattttaatttaaatatgatagtgaaaatttcaaaagcttcactaatctgctctaaaagttgaatatttataaacggatggattagttccgtgtatccacacacctgctgtactattttgtggcccaactagaaagaaacatcaggcggaggaaataatctgctgggcccttagcaggcgaaatattgaactaacctactgggctctagcgcggagtcaccgataagaaatgagaatttgaaagggaaaaaataaaaatatatctatacaacatacagtatagtacggagtactcagcagcagtaataaggagtataacttacatatagtgggagtgttcggtaagccagctgcaacggctacagctgtaactgtggctgcgcatgtcggctgttgcgtaactgcagccctggtagctgaacgggcccagtaaagagtacttactctgttccagaatataagaagttttagagttggatatggttattaagaaagtaggtaaaagtgagtggtggaggattgtgattagatgattagtggaggtaggtgagaaaagtaaatggtgaagagttatgattggttggaaagataatgttgataaaaaagttgttataatttgggacggagggattataatttacatagatgatataactaggatctaaccatccaaagcaagttgctggcgcagcagtagtgcatcagtgacgcaaaggaaatattgtgatatccaatctcccgttcgcgtgctgctagatgaatcttggagcaaaatccagtggtgaatgttctaaacaaaatctaacggtgaaaagaaaaaaaatggttccacactacttcctccgtcccaaaatataagcatttttagcatagcgccaagtcaaatatttgtaactttaactattaataacaacaaaataaaaaagatcaaaaatgtaaaattgatgttgctagatttatcattaaacaaactataactctttttatttaaaatatcttacttttatagatattattagtcaaagtagcatctcaaaaaccatgttagagtaaaaaaaatgcttatattttaagacgggggagtagaaaactatcgccaataatttagcgattccgaaagataaactcattgggtcggtccggttttgctcgaggtttaatttattctttgtttgctttgcacaggaccgacacagttcgaccgacaccattagggcctgtttagatcccacctcaaaattttaaaccatatcacatcgatcgtttgaacacctgcatcaaaatattaaatacaggctaaaatataactaattatatagattgcaactactttgtgagataaatcttttaagcctaattacttcatgattttgacaatgtgatgctaaagtaaacaatgctaatgacggattaatgatgcttaataaattcgtctcgcggtttattgacggatactgtaattgtaattgattttttattagtttccgaacactctatgcaacagtttatataatatccgatgtgacacaccaacaactttacatcctggattgtatttgatttgtgtgaaaattttgcaggaaggtgcttggaaagcatggttagagagctcttgtaactcttctcaagttcttttaatttcttggaaaaataaataataataaatcatcaattcgaacttggccttggcccttacatagactaggcacaactcgtacaagcaaacaaaaataggttcatccctccacgggtaagcatgagacgatcagacgatgctccaccaagggagcaaagccttcctgtggatcacgactgacgtgtccacgcgggcccgcctggccgcgtcagcgaccgactcgcctctcgccacgtggtcacctcccgagtctccacatccaagtctgatacgtactgctactcctgctagcagatcgatgactgaacgtacgcaaaatgattcatgcacgttgcagtgtacccaatacaagttatacaactatatgtcacaagagttgtatacgaggaataaagagatgaccctttttattgatggccaaagttttaagagtttgactgttcaaatcatttctaagtaaaggatgattacgggcatgagatttttactgcaattttaagctgtgctgtatagtgtaacggttcggatacacaaacgcatagctgctggaagctgttgcttgctggctggttgcaacgtagccgtgctacgctaggttgtccgaacaaagcatatatgttcag

SEQ ID NO: 96490 - DNA, 549 bp, Oryza sativa
gaacagcttggttggttgatattgcagcagatatcatgcataataaattgtacaggcatattacggttcaattttgattgtaagatttctgtttgcaaaagctaccagctacgaaagtgtgagccatcaattggatgatttgatatgtgaagctgaagttggataagaggcttagacgcatatgagttggaaaaaacagtagcagtagtacccaaaagatctgtgcaaaaagttataccgctggaacatcatgagcagaaaaaaacttagtaaatacgaactgctgcttgatttcagcgaaaataagtttgaggagattcgctgagctaccagcatgatatgtttctaccgaaaatacaagcctacccatcgtaatcattagttatcacttagtgctaatacttgatacgagaaacttgaagccgcttttgctcccgaaagagaattgtctagtgaccatacttctggaactcccactcgctgttgtctgcatagataaaatagaaaagtaaggcacggtgaacgagcagaggtaacaaccacaccaat

SEQ ID NO: 96491 - DNA, 587 bp, Oryza sativa
ggcgaattcgagctcggtacccgttaaaccattcagccagggtgctaaatctacagcaaatttggtggtaacccgataaaggttcactagttaaaatttattgaggtacctcgagttcaataattgaaccaaatattttcagggccacagaaaatataccacaatcagatttttagcacgaatcgctaaaaattaaagaataaggaacattaatatcacctgccccaacatttacactacacgttaacggatattaaataactgcattctgaggcttcaattatctaggagaccattttgccacgtaaaacatactaaatccgaccgttcctagaccgttttatgcccagccttatcccaaacatgaagtaagttccaaaggttgagattagaccatccagaatgcatgctactgggtcaggacagatccaaccttcattgtccgtcataaccatcaaatctctatgcccagaatatcgcgagctgtacaaacacactaaatttcaccaagccgtttgctgcatgccctcccaaagggccaccaaatctgtcatcgcgcgccaatacaatcctcctaagcaagcggc

SEQ ID NO: 96492 - DNA, 586 bp, Oryza sativa
gtacccgttaaaccattcagccagggtgctaaatctacagcaaatttggtggtaacccgataaaggttcactagttaaaatttattgaggtacctcgagttcaataattgaaccaaatattttcagggccacagaaaatataccacaatcagatttttagcacgaatcgctaaaaattaaagaataaggaacattaatatcacctgccccaacatttacactacacgttaacggatattaaataactgcattctgaggcttcaattatctaggagaccattttgccacgtaaaacatactaaatccgaccgttcctagaccgttttatgcccagccttatcccaaacatgaagtaagttccaaaggttgagattaaaccatacagaatgcatgctactgggtcaggacagatccaaccttcattgcccgtcataaccatcaaatctctatgcccagaatatcgcgagctgtacaaacacactaaatttcaccaagccgtttgctgcatgccctcccaaaaggccaccaaatctgtcaccgcgcgccaatacaattcttctaagcaagcgggctaatataagctaga

SEQ ID NO: 96493 - DNA, 581 bp, Oryza sativa
ctcacgacgctcgcgtttaggagtggcccgtcaccgcgccgctggtcgcctgggcgttgtagtcgcagtcgtcggctcgtcgcgagtcgcgacacacggcggcgttgttttcgctcgcgcgcgcgcggcgcgtgagctgcgcagaccagctcaccagcgtcccccgcggacgaagccttgcagaggcggcggctggttgcggaggggaccaaagcgtgacggacgcgggcgtgtttgatgttgttacgcgagcctatattggcgtaatgcgtggggtacgtatacgatccaaaatccaatcatcacgtgcgtgtgcgtggagctgaggtcgttgtccggtgtcgcttgtcgaccgagacacggcgcaccgcgcaccgactggatggattctgtgtgcacggcggtcggcagcgatacatatgtcgccggcacgctctgggagctagctaacacggaacctaacggatcggtgactggatttggggaatgggcttctataactccaagtgcatgcgtactcgtttgcttctcggaggagtatcaatcaaaaggtttgtacaaaataaaaaccgtgataccat

SEQ ID NO: 96494 - DNA, 594 bp, Oryza sativa
tcccccgctgcttacgcgggcgcctcgccgcggagggtgaatgagtaaatctctcgcttctcctcctctccctctctctctctctctctctctctctctctcgcaggatcggttacgttccgcgctgttttggggggtttgggtcgctgggcgcactaatacgtttagggatcttagtttcatcgaccaaacgcccgaggaagcggtggttgctgtggtgagggtcgtacgggcgcttgaattcccagtgtatttttttcctctgccgcgagaacctgcctgcacattgaaacaagccgttagggttttgatgagttgggtagagttaatgctgccgacccgccctgcaacaatgcccacgtattcgcaccgattttacacgtttaaccaactcctcatatttccgatgtgattttgcttcatctgtttttgtgaaaattaggggactgggatttcatgccatatagttcaaacccaagcattgtttcttctgttaagttcatattgtggtgctatggttctcattgttaaactttccagaggaatgtgccatatctttgtactagtctaactattagtgcattatcatttgat

SEQ ID NO: 96495 - DNA, 676 bp, Oryza sativa
  unsure (1)..(676): unsure at all n locations
ccgcttgaagcgtaataccctacttttgggcttgggttattgaatggaaaacaattatgcttggaggtgccaaaaccaaaccccaagtcccttcaaaagtccccccttccaccattaggtctggacctccttttaatccttaaggggtaccaacttgggccccaacacacttaccttacttccggggaaaaagtataataattttggcttaaaaggcttgtttggcctttgaactgggaaacccaaccccccttcttttgaataatggggcctgtaaaatctggccgcttaacccaaggggggcccttgtcatcaacatttaatgggggaaaaactcttggcctctattacaccgggaaacgggaaccctgctttgaccaaagaaggaagaccgacttcggctgggaataaagtataaaaacctctcaccatcattatttgatgggacatgtncggctgcacgtcggctgacatacgcgatggtgcgcctgacatactgggtcccatcggtcattcgaccgggcacaaaaccgttgagtgcactgcacaccgcattaaatgccgcgtggcgcgaccgctcgggtcgccataaatgccggtaggtggacacctgtaagcggacacctaacccaccgtacgtggtgacctaaagaggggtcgggggagcccaccccta

SEQ ID NO: 96496 - DNA, 751 bp, Oryza sativa
ccagtccagtccagcaggttgtggttcggccgcggtccacttcgctcgcgatcgtggcctggccgtcgtcaaattcaaattcaaacccccaaaaaatataaccatatatcggacgaaaaaggggggattttgttcagacgtggtgtgtttcatctttcaacggatgattgcatcacaagggaaaatggaggactcgcacaaaaaaaaaagcacagatacacgtcctttttgattgggttgtggccaaccttcctctcgctttctctgcctcctgttgccgtgaaaactgaaaagctcactggtcagtttgatctcgcaccgtactagtactactttactttggacgtatagatgctgcttgcttctccctggtgcacggagacaacaagcaaggctgcaggacggatggagtactgtttactcggttgtctcgtccgtcctagccagtgaacgagcggcacgtccaagcgtagggtacaagtatacacgtacggtgacaaactttgcaaaaataattataccggattctcgacatattatagtctaattttcaagtaatacaataattaatataacttaaaatagctagaagtagtaatataatgattaatatgacttaaaatagctagaaatagagataagctattcggtatctgagaactgccgtcactatactcaaagtgctatacaaaagaaatagattttttcttaaacatcgaatctatgttatcaacgattattatgaacacga

SEQ ID NO: 96497 - DNA, 652 bp, Oryza sativa
aaactaaccggtaggtgaaatctttgtcattcctaacccccgccgagttagtccgtttttgctccattgtgcagaatgaggaggcgattgtctcgtctgttcaagggatccggctcttcatcaagtcatcatgacgagtctagtactcgttcatcagccgatatcatgatggaagaagccgaagctccacgacaactcctgaacgacgctgaccttgaccttgtcggtgatcgggagagacaagcctactacatgctggccgaccgggagtatgctcacacgcgagagtactcactggagttgctgaaaaagataggtatggatactgaatttcgttctatttggaaagctgttggttggcagaaatttgctgtggtatatgagcctggttctcatttgcttactttgcaatttctgtgcactttgaaagaaatggaagatggaatttccttttgctttttccatgaggagtttacacttacatggaaaggcctaagcacacttcttggttttcacgatacctgtaaaatcgatctccagaaaggaatttctgggttcgagaaaaataggttttgggaagatatttctggtgctccaatttgcaagaaacctaggacgaatgatatctataatcctacacttaggctcatgc

SEQ ID NO: 96498 - DNA, 557 bp, Oryza sativa
tacgtggccgtatacttaatgctcgagatatgcttgcccaaaggagatagagaactggtgtgatcaatcacaggacaatgtgtagatatgggatgggatctaagcgaaaaatggtgctgttgactatattcaatacaaaacatgcataaggcaccagataaattactaggaaaattcatgatcttgaaaattaagagtatatagaatgaaaagaaagctcatcagtttcaataaaatgatgaacggtcgcatcatgtacgataattggtcgttgaactaaaagtaggaaggagaacattacatattccctgcccaaagaggaagtgacatgcactgaaactgaaacatgtacaatttttacactactaagggctgacgcattattgtagatcaattcttatgttttagactatgaagtatactagtaagtctaacagctctactctgacacttacgatatagtggatgcgatatgacactgattgcaggaaaaaaaatgattgatggcgaccattgactagtgactaaaagatctgattaaggggaattgctcttgt

SEQ ID NO: 96499 - DNA, 521 bp, Oryza sativa
caatagagacaattttccataatctaaatcatacgcacttttcatactactttgaaaacaaaaaaaaagttactactcgtggtattttttaaaggataaaagaaaaataaaaggtggtagtatattttagtggagtctggaaaatatatccatgtcggctgttgatgaaaaagaaaagaggaaatacaacaagcactagtagtagggcgtatggaataataatactggggcggggtgagtagctaggagaggaggagcacgcgtcgtcgtcgtcgtcttcctcctcctccgctcttctcttctcttctccgcatcgcattcattcaagtctagtctctagtagacgacgaattcgagatcgaatcgatcgatcagatccctctcctaaactataccaaaccctagccctaacctcatccacctctccgcccgcccccctccctcccatctgccccaaaccctaacgatggcctccgcttccgattcggacgacgccgacgccgatttcttcgacaagctcg

SEQ ID NO: 96500 - DNA, 648 bp, Oryza sativa
actaatgagactaaatagttcagaaaattttgacataaatttctaaaatgaaacaaatgtaataaattaaaatttttatttgaaatttaataggaaaatattttttttatcgggagcatttataaaaaaaatatcgtgggttgtcctatctttgcatgattgctcctcatttttatgactttttaaaaaaaataaaataaatacatatttttatttcattatctaaaaataaattttgtcataaataatgtatcaaagagcaaactcataacaataatagtgtcatgcgacaaacttttacattttcaatggtgtaatttataaatttctatgttcattcaaagggtaaaatggtcatatttatagaaattagacggtcaactaacgctcaactgatgggaggggtatggaagggctaaaaatcaaattttgggtatataaagaagcaagcaaaattcaaaggaatagaaaggattagctaaaattttagggtatacaaggaattttctaaaaaacaaaatatgaaattcctttccatgtgattttagaagaaaaacacaggaaagctattatccactcaaagctcattttttggctggctcacacaggcaaatcacctcatgaacggtggaagcaacgaaataagcc

SEQ ID NO: 96501 - DNA, 526 bp, Oryza sativa
tgttcttgctgtttttctgtgtgtgcttagtgctttgctttggctacccaagcaatggtggccactgctttttgcaacaactctttttcatcaggtcagaatttgctcacctaaaatttttatttagagtcagctcatcagaggtatttggaatcttttcgaattaaaaaggcatcattatatatatgatgtttatattttagtagcatttatctgataactgtaaaaaaaaaagggtctcacgagatactcgaagttattgacatattgttgggcaggaaattccagaggtttcaggccggccgtaccttcaatatttgtttggatttaagatgaaattaagaaatgattttatccgaaataaaaaaaaagaatttgagaaatgaaatgggaattgaaagcaacaccgtcttgagttcatcctgcttgctgttatcaaccacctgaaactctgaattgaacaaaaaaaaaagggcagatgacagcaaagaacaaatgaccatgcgtgcatcagaatttcgttggc

SEQ ID NO: 96502 - DNA, 656 bp, Oryza sativa
taaacacgcattcatgtggtaaaaatacacaaatcatatatgcactcatgtagtcggcaagaaattaaagatataattcctcatcaacaattaggttgacaacagctctcaagtacccccaacttgcagccgtattgtgtctgtatatatgcatggtattatcatctcattacaaacttgtggtatcttatgctaatgacatgggctgaaagataagttcacggatgcaaatgggatacccgtccatgtctcaaatgatgagtgtgcctagcaggggaacaatataaggatttattattatttttaaccggattactttttaatatgaaaaataaacacctaaaacttataatttccaattctaaagttttttgaccattccagtgagatagcagaataacacacaacatttggcaccaattggactggcgcagcaaaaaccttaccatgctatgaatttttacttggcgcggcaatattaaattataatatagttcattaataaatataatttgtaatttgtaataatagttaatatttaagtaatgataagctaattgagtatgttttttccggtgagccaaagcggctgattgcaaccgacatattgagggggtgtttggtttatttcctcattttgccacgtcatgctttag

SEQ ID NO: 96503 - DNA, 723 bp, Oryza sativa
ttttcaccaaccacgtgcattgatctttagcctaagcatcccgcatgatatcttgatcatctggacgtcatcttctcccaagtcgactcccgatccatcaccgacaacactcttccgaagcattaagaatcacctacacatgcatcaaccaagaaaccatatccgagcacaagttctcaccaacttgactcattgttaagaagcaatagtattacatacacatagtatccatctagaagtcataaacatgaattatccacgtatatccaaacaattgaccataaaccaaaaccgacacaacatcagccagtcagactacgtgctggctggtttgaccgcacatataccgccggtttgaccaactaccacaacccggtctgaccgaatacactgtgtcagcagtaatccctattcatcacctaaaaattctaattatatccaaaatcacttcggtaataatctccaaatatcaaaaccaataatctcatataccaatagttcatcacaaaataacaatcaaacacgctttggttttacacatatattttggaaaaaacaaaacatgaaatattcttaatacttttgaatggagggactaattaccagctatcagtctcctagaggaaaaaaatgattatttgatgttatagagattaccactttgattatgcatgtgatttgccattttacagattatctcttttacgcatgatccgacccaaa

SEQ ID NO: 96504 - DNA, 663 bp, Oryza sativa
agtatctacgcactataaaatcatcgcaacgatctccgaacccctattattggccgcataggtatatactccacaatctggtcacactagcactagcagtagctcagcttttttttttttaactccggtagctcagtttggtcatgtttgaaggagtttatgtctgactaaaattatttttttaaaaaaaaagtctttagctccttcaaacggtacaggtttttacctagaatataatttaagaatttatagttgcagaattcgaagaataaatttaaaaatcaaaaactgggaaatatttttatattcctattaagtgtctatttatctgcttctctgaattttgagctccgtagatataaccttattcggtccttctccaacggtactagttgggtgggagtggtggagagagggagacgaccaaacacaatccagcttttgggtggagggagatggcttgatgagatttggctgtagatgcagggaaaaggaggtagaccctttttgttggcactgtcggctctaatggaaaccttgaattatttaaggagatcatgtcctcatgtggcccctaactattagccttttcgtaaaaaagcatgcgtgaagagcgttacatagaaatagcagctgacagatgaaatcatacatcaaacccaa

SEQ ID NO: 96505 - DNA, 737 bp, Oryza sativa
ttacgcccaagaaagatcatgccattgaaaatgatatggactcttatttaataaatcagaaattagtaattaataataaatatggtggcaaaaatatcaagcttagactgtcagtttagtattttattaatctatttttaaaattcgaaattaataattagctagttgtaactgacgtggactctcttttaacataagcaactacactttcaaaggaaaccaacacgttaaatataatattagagctttaatatttatagtgtcaatattcattaagaaggggtgaaacgatgatatgttcgcacgttatccgtaggacctctcaaagaaagaaattgaaggatatatgaaacgtttgaccattcgtcctagttaaatttttcgtgcaaatataaaaatatttatatcatgcttaaaaatatttgatgataaatcaagtcatattaattatataaatttttttaataagataaatggtcaaacgtttagtaaaaaagttaacggtgttatacattaaaatacggagggagtattaggtagagttgtcgtttttgctacggtatgtttcaggtgttagggcaccaacgttgcaccaacattattttcaataggtcccataatcagggtagttagtaagtttgtgccaaatccattatgtgttatggatagggtggtaaacaaggcgaggcactattgaaaataaaatcctctaacttcagtctctctagtgagtagaa

SEQ ID NO: 96506 - DNA, 756 bp, Oryza sativa
cacttaaaaaggcggcacgcgaaaatcgattttttcgtgcggtcctcttaagtcgaccgcacgggataatgaggaatatcatgtgcggcgacagcccggcgctggtcccttattttcccgtgcgatttcagttactgtccaccagaaaacaaaagggcccgtcaccccggaaaatcttttactgcgtgcgtgcgggcatcaggtcattggatcttagcgtagctagctatcatcatcatatcaactatgctcatctgtcgcccacagctctatctggatgcctccatgcatacatgtgtgtgaccgagcagcggaagaggggaggtccaatgggggagggacaaggggtgcggcgctgatctggttgccgctgggaacagatagatatcgatcatcgcccgccgccgccgccgccgccgccgccgtcttccaggcgatcggtcgatctaggtgtgcgtgccgcatgcgcacgcgccgtccctttgtcgaccggtagatcggcggtggtccgtcttgatcaatttcttcttctcctttcccggcgcgccgtgttgcatgctgcaggggttttggctctattcgactcctcgtcgtcgtcactttgtcacaacccttgcaacttgcattgtcacattgtctcgtctctcatgtcatcgtatacaaacagcggcatgcagcgccagccatgggtgcctagctagatagcacggctagctggcatgcatcaagatcattcctcccaactaaactgacgaa

SEQ ID NO: 96507 - DNA, 816 bp, Oryza sativa
atagaaatgcaatctataaaagtgttagtattaatcttgaaaaactttaaggagcagctgataaaagaaatgtactagggcagaggaggtggggccttctctaaaaaggagtatatagatgatacatttagaaaaagtcttccatcatggtgtcgtacaagtcattttgtacggtggtgtagcattgcatcacacaatgatcctatagcagctggtacgttgaatgaccagcagtactaaaaatgcattcaagtacattgcatttgcatacagctagttaacgtaagaagcaaattaaacgatatttccgtacaaacttccaacagtgcatagaatgggcggaggatatgatctacaaaaggaaaaaatcaccaccatcgagatatatcgattttactttgaataatagtggaatttcttttttggctaaccgtgaatgtttttcacaatcacaatacattgatgacagctctcaactctgtgagtaatttcattcgtcttgacttgagtgtaatgctaatttccgagcctagccatttacaagattattcggtttgaccacacctcttatttcaagcccaataaagatcgactcgttagtttcattgactatagttatcttctattccgtctcgtaccttgatatgcactagtcacatgttattttactatggctatgttaggataacacccttcatgcatggttcttgctcctcctatgcattttcgatcaaagtcaaatactcactcagccccttggtcatctcattgttgttcttgtcaccacatctctctcatactatagttgacactcca

SEQ ID NO: 96508 - DNA, 548 bp, Oryza sativa
  unsure (1)..(548): unsure at all n locations
tcgcgcaatttcgtcgaacaggtggggggcaattcgccccgccaaacgggggtcaggtcaggtcagccagcgtcggcgtgagcgcacggaaggcttggacgaagcgcgttacctgggcacatgtcggggcagctgcccacgatcggcggggcgtcgccgccggtaccagccgcggtggcgctggccgccgccgggaaggaacaggtgnagtagaaagcagnaggtggcggtaaggggccggcaccgcggctgagaccaaggccgcggccttctccccgacctcgccagcctcggccccatccgtggccacgagtggaactccggccgcggtggctcgccatgtcccggcgatccatggcggcctttggcctcgagctccgaggggtagtctggtaatttggtggttagttgaaccgtggagtggaacaatggagcttcaaacgaacatgcttttttagtggagagagagagggggggaggccaagatttttttttaaccttttaaaattttaattttaaagtaatgtcctgttttccaattttttttt

SEQ ID NO: 96509 - DNA, 560 bp, Oryza sativa
ctatagggcgaattcgagctcggtaccccttactctatattttactcctacagtactggttaactttgcatgagaggcgaattataatactaatagaccacacttgtggaaaagaagaaaccaaattatcaattattttggcatgacactctgtcccaatgtcattgtcagggcagggatgatgccactatagccaagggaagcatcattgctcaagcttaacccaagtagtactagtactcctcatgattgattgcttccatctttgtgctaattaggcatggagtgcaggacacttgactgtacctgcccctcactttccaagtgtgagtgagattaaagcacaagaaatgaggatttctttttttttttcaaggtacaactctgccagtttggccaagcaaaatgttggtactatcatctttgcatcatcatcatcatccacctgaggaaaaacagtagaaggtcccttttaatgttcaggtgaaaaacatgagatgttttattgggcttttctgctatttttctttcacctcacatgtgttagtggcctgcatcaa

SEQ ID NO: 96510 - DNA, 647 bp, Oryza sativa
cgaattcgagctcggtaccccttagtttgcgccagcacagacccggcaccactggccgagtgcggatttttcgtcgacaatatgctacataaaaaaacattcaataactaataaataaatattaaatttttatatcaaatctaaaactaaatttgtcgcagttaatatggtgcataacaaactcataaatataatagtctcatccaacaaatttctacatccaacaatgtactccattaatttattatgtttctcgcagcaaagggaaaaatggactttttcataataatttagcagtcaactagagaaaagggcgtggaagcgatccaaactaaaattcaggggtatgtaagagaatgagcaaaattcagaagcaaataagagattaggtgaacttttatgggtacataggaaattttctctatgagtaatgtcctcgtcatatcattttttaccaggagtttgtaagagaggccccacagcccttagcatcatcatatatccatggctacataattaatccaataaaagtttttattttggtacaagagtttgtccatgttcctagggaacttctgacgagaaggacactaagttgtgccacatcagcactaggatggccagattagcattccctttttttctct

SEQ ID NO: 96511 - DNA, 504 bp, Oryza sativa
cggtgaagatattcctaggcatgctttgctgtacctatgttgatggggaatttattctgtagtgtcaactcaagcgctagcaactcaagatacatctgagtcagaataaagtcattctagtgaagaacccctaaattctctttctctttttcagagagaagaagccccaaatttgatatgattctgttcttttcctatctattgtcatattcgtgattttgtgtaagattcttatttggtttacacctactgacacatacattaattttttaaacctggacaaggataccattctacccattgattatttattgacagtcctgttcagatagggggaattgtatccacactgaaattggccatgaaaaacgcagagtaggcctagttgataaagagctaagattttgattgtcagttcttttgcgcaaaatagatgcttacttggctatctattaatataactttatctatatggcagaatggtggatgggataacagcgatta

SEQ ID NO: 96512 - DNA, 988 bp, Oryza sativa
  unsure (1)..(988): unsure at all n locations
tggggatgtcagggttggccagcgtgaagcggccacctcgtccatgtcaagagcgtcagcaatacgaggaggaggcagccatgatgagaattggcgtccgtggacggtgaattcgaacaccgttctgcctcaagcatgcggcaagctcgccctccctcgagaatgggtttactgagttgtgggagagttgataccatcagcttgggttttacatatctcgtcgaattaatcatatgtactaatgatgttatgttgctctagtcataaaatgtagggaatggttggtcatgatatcgtattcacggaagtgcggtttcaccgaaaagcgtaataagtatgtcggttttatttattttgactaaacaagtctatgttgagagggagtggtaataaggctcggttctttttctcaactccaaactttaacttcctcgttttccgtgagcatgctttctaaaccgttaaattgtgcgttattgacaaaagtttctatatagaagttgtttaataaattaaataaatctatttttttcaattttataatagttaatacttaattaatcatgtgctagtgagttttctcgttttgcgtgtgctggaaatatctctccagttggagagaacaaacggggcctaagtatcgttgagaaaccggtctattctgccgaaaaacacacgagcagacaaacacagaagctgtagaatatcgaaagtacgagtgagtagaaactttatttcttctgaatttgagtacaagctataggatggaaggcaggaagtgtcgaagagcagtcaatatcaccttggacctttaggatcctatttataggcagaggaggttgatggcttccactgtaagttgtaagttggcttacactgtaagcttgcgtatcccacaagctggcttccggcttccactgtgagttggcttacanccgtagcttgcttctcccacaagctggcttttgcggcaagcttgcttctccta

SEQ ID NO: 96513 - DNA, 728 bp, Oryza sativa
agctaacaattaaaactaaccacccacgactactatatttcttgaatttattactgatattaaatgagttcattaaagttcaagttgcttaggccaataaaataaagacaggctccgacacagttataccacaaccggcatagccatgccccacacgactccaacaagaagacaaacgagaaagaacacacacgcaagcctactaactgctcgtctaccgctgcgacgggccagggcggaaggtgagcaacagcgcatcctccgtgctaccaacgccggaggtttccccctcctggggaaccacgggcgcaggctcggcacgaggggtctcgacgaagcaggtccacgccagggactgactaacaagctcgggcctggaggtgctcttgcgggcggtgatcttctggctgcggcagacgcttgggacggcagtcctctccctgagcgatcttgagctgatgcagctgcgcctccaccgcatctaggtccttcttgagctgcaggttctcctgacgcagctccaggatcttcatgttgttctcgaccatcccgcggcgcaccatctgatggaaatcgatacgagccgcgtcgtacgcctcaccatgcgcgccaggtgcgcgatggtagcgtcatcctccgagctagcatcccggaaggaggcgtagtcgcgggctcctccgcgactaaggtggtaccggtagggcgagtgctgcaactcgtccgggtag

SEQ ID NO: 96514 - DNA, 541 bp, Oryza sativa
aaaaaaaaggtaaaatcataattgaaatacagaatataggtaagaacccgtttgtttcagaattcatgcaacctgctgtaaacttgtgtgtcgggggccttgcaggcttgcagctacggtagatggaatgatgagttcggtcaatatttttttctttcacaaagctaacatgtcagggtaatcagatgttaccgtgtaacacgtctaattaataatctaaaaaacaatatagatgatacacctgatcgtgagtgatgttcacccttgcggccttacctagttaccttcattaatgcctaaaatgattccgaaacaagttattctccatgccatccgtaggctacaggttccctttatagtcgactagattcattgcagaacgaacatataaattccttccattgtatatatgttgtacatctaaaataaactcacggcttttatgtacatatttgagggcacaatttcatgtgctggtagcctggtaacgtggtagcatagtacgtaccatgtgaaattgagtccgagaacgtgaaattga

SEQ ID NO: 96515 - DNA, 648 bp, Oryza sativa
atagggcgaattcgagctcggtacccccacctattaccccataaatcctcctaggccttttaaaccgataagcccattatttccaaccattagttctatctcatcttaaaagacaagtgtgtattcataatacatcatcttccaaaataatatattgcacaaccatatttcttcatccaatattatttgcgctaggttgcatggagtctcacacactctctacatggaacgttcgcatatggattctttctcaaattaaacaataatataaacccatgcatttagtggagcctcatatcccacccaattcatccatcaataaacaatgacaacctatattcaattaaaaaatatcttacttttgattttacacataattttctatacatgttttctaacacaaaatatgtctacctacttagtagatgatgaagaatattataaatatttgcttgtagggattaattaaatatgatatgttataaagataactaatagtttggttagacaattataaaagcaatgctaatgaaaacaatttatggagaaatcatatattgtagatgttcaaacatagcgtacgacacatgcccgcgcgaatacgtggtctatcttcttagtttattaaaataggaaagtaatgcgatg

SEQ ID NO: 96516 - DNA, 1257 bp, Oryza sativa
cagcgcacaatttcgtactaatatagtagaaaacaaaacagtctatagccctggaagacgatagctagaaaaaaaataaccacaccacgcgtctacaaccggatccccgctagtaaagagtaaacatgaacacaacacccctaatggaatgggtcttcaaatgacaccaccagcgaagaaacggtgtcgagaaacaccaccgtcacctattctgagaacatgacatggttttcacctaaagaaaaccatcaaggagagaagagattctacaacaatgccccaagggaaaagtggcgcccatgagtgtcgctattgttggcccaaaggctaggctttcacccgtaatcttcatgccctcccatgccacgtgcacctgtccgtatcagcggccaccaccaactgagcaccttcaatgcatagccaccacaccagcgccttgccgtcgaccatccattaagcaggattgcaggatccagctcactcaacctccatccacacgattgggttgaggaggaagaggatgagagagaagagtggatctcctcttcctcgtactagccgccagcgtggccatcttgtgacggcaaggcgtcaccacgagaggactagcgtatggatcagagtccgttgcatgccctgcaaacacccacctcacggcatcgctgacgcctccacctcgggcagactgcccaccttgctatcgcctcgccccgaagccatcattcgtcatcggatctcccatgtggtagcgcctcaacggtgccatcattcctgcctccatccatcgacatgttgccactggacaccggccacgccgcgatcgcctcccgttgggctccagctgtcgtcaccaatcagcatgggttcttgctacccgcgtgcgccactgccagagcacgacagccctcgctgccgcgcttgcctccaccagccttctcttgcgcctcatcggtctcctgctgtctcgtgcgctgctagtcggctcctccggccagatccattgcaggggcgacagatctagccgtgggtggaccagatcctatcgtggcggcatcggatccgtcgcctagcgctgcgcagcgtcgccgcctcgtcttccccacacatcgcatgtcaagccgccttccccgcgccgaggtggagcgccgccgagggtttgaccccacattcccctacaattttgattttcatgaacactgagttctcgatgtgtttacacggttcgtgtaagccataaactaaatatgtcggagaaaa

SEQ ID NO: 96517 - DNA, 684 bp, Oryza sativa
attcctgcagccccgcgcaaggggaggatcccaccgggaggccgcgcactagaaggaatcatcggccggccgcgtgcaaggggaggatcccgccgggaggccgcgcgctatgaggagtgatcggacggccacatgcgggggaggagctcgccaagaggccacgcacacggggaggatctcatccggaggccacgtgcttgaagaaggagttggtgggcctcacgtggtaaaggaactgactggccaaccacatgctggggagggagctcgacggccgggcacacacagagggaggagcttccggtgggccatgaccaccgaaatgagtcactatccaaatgcacgcggggggaggagctccttgtccatccatgtatgccggaggagtccacggcgccatcgtgggaaatgttgctcacgtactacgcattgcaggtgctctcggtctccggcagcgactgtggtcttcctgacgaagccattccctaacatttcctttgcaccctttacatcgcccatcccacctccggctttgcctctatccttagaggcggcaccgaaaccttctccaactagacctcctgctcctgaccacgttgccaccaaccggttgacacgtgggacccacaagctgactcagccaatcaataaggtcaaatatgccacgtaggacgaaaccgactc

SEQ ID NO: 96518 - DNA, 518 bp, Oryza sativa
caaggctcggcaggcgctgccgattgctacggcctcctgcgtactcaggagcggtggattcaccgcctgttggtgggctctaggcacccgctgacaacttcaacctccagtggacttgggagtggcagatctgctgccgatagggtttgttaaacgatgacgacaattgtggtctcctaaaggctcataagcaaccggtccaccggaggttgcctcaccctgccttatcccctttcttccttcgcatccaccacaccactaccacctctagctagatccagatcaaggtacatggcaggagcgctgagatggaggctgatgatcaaggcagtgggagaaaggggccaatgctgagctcgataacggcaagcttgctgcagccttgacctatgttcacttcgcttttatttcgctatgagataaatgtgaatttgttatggaattgcgttatatatgtgttgagcattgttatggtgatgtcgaagtttactctcgactttggatttgcggtgtgtctg

SEQ ID NO: 96519 - DNA, 753 bp, Oryza sativa
ctgcagcccttgccattgagcaccggcgagtgggatggagtagactacaaacaacaacgtagtacggaggaggaggccaacccaagattgattccacgtatgttgcgaggaggtggcggctcaaattatatagagatatcaggacacttgatcagggcgcctacacgatctccactctgcataaccgaaccgaaccagataagtcacgcgtaacttatccgaactccacaccgtttcacacatcggattattcggagtgtttccaaaaaaaaaaaatctgaattttccgcagcaaaacggactccacaccgtttcactcatcagattattccgagtgtttccaaaaaaaacaaatatgaatttcccgcacatgcctcaagtggctaggagagcatcctctcctagaatgggctaagaccgatctattaattcaaacaataagtccatattaaacccgagttaaactgacatgtcaggagcacgtgttccccctgttctctccgcctcacatgcctcaagtggctagaagagcatcctctcttaaaaggaggtcttcctctcattgaataggcaaggcggtactaaactccccatgcatgatatcccatgaggtgggcttttatgattttccaaagaattaaacttcgaatgggctaagaccgatctattaattcaaacaataagtccatattaaacctaccatatatatattttagttgtaatgttgccctatttttgttttcctctttttcc

SEQ ID NO: 96520 - DNA, 772 bp, Oryza sativa
tgcagccctataattgatattccaccaaattagctaataaactggcttgaataagagcagttggggaaatgcgggaaaaatataggcaaaatgcacatgtagataacggggacctatttgattcatctggtggaggtagctcacattgtaaattttccttgcaaattaaggccttgtttagttccaaatttttcttcaaattttcaatttttttcatcacatcaaaacttttctacacatataaacctccaacttttccgtcacttcgttccaatttcaaccaaacttttaatttttgacctgaaaacacactctaagaattcttgccgacaactatgtttgtcattgaatcgtgagctacacatgtatccagaactttgatattccataatccctaatagactacaataaataagagtggttaaagaaagcgtaaaacttataaccaatccacacactagagaaatgatctttaataccgattctaaactctttttaatctcggttatagtaaccgagacttaagatctaaagatgcatactaaataaaaaatatataggatgtgggattcgaacttaagatctcgcatctcaaccattatctgtgttaccatcttacctactccacacgtttaacttggataaaggtattttcattttgaactaactctagaggcatttttagtactggttggtaacaaccaacttgtattaaaaatatctttagtcccgattgatattatcaaccagtgctaaaaatatctttagtatc

SEQ ID NO: 96521 - DNA, 558 bp, Oryza sativa
tgtgaaaatccatattaatacttactccctccgtcctacaaagaacatatttttggtttccgtccaacgtcctaaaaacatatttttgggtttctgtccaacgtttgaccgtccgttttattttaaaaaattataaaaaaaacttaaaaaaatagttacgtataaagttactaatcataattttttaaataagacgaaaatccaaacgtcgtatcaaaaaactaaaaatacactcctcatgagacggatggatcactatttatttaatttaaggataataataaattattacgaatgaaaaaaataggcctggaagcacggcacggacagctgagctgacactgtacttgcacagagtcacgtagagcgagcgagcgagagagtcaaagcctccacgggcagcccagccaaccaagccagccaggcatccagctcggtcccccacacctcactcctccgctttactccactccccactccccactcgcctccaccccatgcgccgccgccgccgccggtgaccccccgactcccctcccctcccatgggctgccgccc

SEQ ID NO: 96522 - DNA, 632 bp, Oryza sativa
attcctgcagccctattttgggtaactcgcaaacacacacatggtgacaacattccacacaaaacaagcatttatgcatgcatctcgatcgttgaatatctctccacttttttgtggagctagctagtttaagcgcggtcaaatatgtgatactcatctgctctttttaaaggttcatatgctgttttttctttctaatttcacttctcctggttaattaattttggctttatttttactgaaatgttaattagtgtggtcctacgctcaacaaaatgcaagtttgtaagctttgtctacttaactaggtgaaacctcgcgcgttgatgtgagagtttagtataatatatagtgataataagtataaataatactccctccgtcccaaaatatttgactccgttgattttttaaaacatgtttgaccgtttgtcttattaaaaaaagtaagtaattattaattctttttttatcatttgattcattattaaatatactactactactactcaagttttttttaataatattcacaaaaagtttttgaataagacgaacggtcaaatatgttttaaaaaaatcaacagcatcaaatatttagggacgagggagtatataatagatagctacat

SEQ ID NO: 96523 - DNA, 536 bp, Oryza sativa
acacaatgttagaaaattctatcaagttttcaccgtttgattgtaatgccttttattttcacgtaatacataacctatggaagaaacacaaggtaaagaaaattctatcgagatttcatcgtttatgtcgaatacatttcttttttcacgtaaactcacataacctgtggtgaaagtgtccaacaccccccccccccaccaccccccacacacacacaccacacacatttcccccgggatccgccccttgttcaaccgctgggcggctgcagctatagcgtggcgtacacgcccgcatccgcacgcggacggcacacgggaagggcggcccagcgtccgtccgtccgcgggttcccggtcgtccacgcgcgggaccccacccaccacgttcgtcacgctctccgcgcggaggacggcccaacctcccaagcccagcccaccagcagcgagcggcccactagggggcggggggtgtgtgcgcggcgtgaccaccaccaatctctctcgcagcagtcgctcgctgtcaccgtttctct

SEQ ID NO: 96524 - DNA, 1606 bp, Oryza sativa
gtcacaattgagaccaccgacctcaaactcagccaaagtcttcaccttttctctagacagaaggcacatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattggggttcaatcatatgcgttcttatcaattctggagttcaggtagtgacatgtactccacttaggtgttatgacaagaagaatccaatgggcactgcggcattaatataataaaagttaattaagtactcaaggaatgtgtcatgctgttgtgtatatttagttaacacacttactattgattataggcgcacataatgtactccttgtctcggcgggaccacaaggtgtcgtagatgtagttgaccattccttaacggtcattctggagatttgtgacagtgaccacttgtggatcaaggaaggcaacttccggtgcatgcttcagacaccactgccaacttaacctacacacaggataaacgatcttgtaaacaagttaaaccgattgttattaccagattgagttgggcgacaatacttacaaggagtagcacttaaggaggcttgtgtccaccactcggagcctgtagaggttgaaaagatccttgaagtcgaccacaatataatttgttgaccaaggaatggctttctatcgtgctctccaaggatatcggtagctttacttggcttcctggcgttagatttctccatatagtataagtgaaggtccttgcaagcggtgcccattgcggcaagcacgtcatctccaaccaatggcatgcctagttggaactcctgtggagcgacgtatttcttcttgacctctttgcccttagtctcttcttggcccttgcccagatctagcttccttggagctagaagcgaggcctacacctttcctccccttcctctcccctttgcttcgggtttatcgagagtaattctctaaggggaagagtgtgccttcctgctcttcttcatcggtgggggttcatgaatcgccttgctgtcggcctccgttcggtcctccccaaaatccgtgtcgtactgcaactgcaaatcgtaagattgtgcatgacgatcttgagcaggaggggctgaaggagcagaggcgggtctctttgatggacgaccgcctggtgcagtggttggcctcgctataaccctgatctcaatgaggtccttgggccattggatgaaggtaccacgggcattttctagtgagaggacctcgtcgttcggtggatactttagagggaacagctcgtattcgggtttcacgagtcgacttgaactttcgcacagtcggcccatgagttgcgctccatgcactcttgtctctggggtcggcttgtacgcaagtccctcggctgctggaaccgtgaaggtcggcatcaccctaactatgagggtgcagctcgttggttcctgcgatagattaattgatttttttaaaatattatatatcatatggattcgttaagtctttcatgtattgagtaagttc

SEQ ID NO: 96525 - DNA, 1160 bp, Oryza sativa
taattctcaaaaaaaaagttataggtgaggtttttatgcgtctaacgaaccgtccacaggaagttgagcactcgaactgctcgtttgagcatggcaacgatgtctttgtacgggcctcagtagttgtgtacttgtgttgccgcaacttttagttctttgcttctccgtgtgagttggttttcctcaattaattgcgcagttgtaaggtttttgacctggttttcctcctaaactagatcaactctcttcttattattgaaagcagaagcttcctgccctcttttgaggtttgccacaaaagagtaggtgaggttttgaaaagaaactctgagagcttctagacgtttccatagtttttgtccaagttgtgacattgaaaatgaggggtatgactagacacatgtggtggttgcaagcactgagcagagaaccaggaggagatgaatccggctagcatctctttacttggttccgtcttctcaaatctcattcacaagaagaaaaaaaaagattgcctcaacgacctcgtcgtatcgtgctaactatggatcacctaggcgaagggtaggccttcgaattaaaatttcaagtgatttcctgatcaaagttttggatctgtagttggaaagtcaggaatttctgaaatttgtctcccataggatgttctgatcagctttgaactgaatgttttctcactgcatgcataggaaggtggaccgattttctacttgggacttgggagttcttagatacttgacctaaaagtttcagctttttggttggtaattaagataaaatcgagcaagatgttcttttttttttttgaaaggaagcagcaagcttgttgttactgcgtcagttgaaaatttctttaaaaaagccgagttaaataagagtaaaaaaagaattattcttggaacctcattatgttcttttttatgatgaaggagaaggtgaaggattcgacaaattaaggtgccactcacagaagctaagcactggggcagattagcactatccatcagttcaaagctgctgctgcctgctgctgcgcatagcttgttctcaactctcaagcatggagctggttacaggggtgatgggcagtctgctccccaagctgggtgagcttctcaaagacgagtatgacctgcagaggg

SEQ ID NO: 96526 - DNA, 1242 bp, Oryza sativa
attatattctgacaaaagaggatttacatatgtaaaaaagaaagatgttttatactagaggagtactacacaacatgtttaacgctatctaggatatttcgatccatttatgccatgcatatatatacttccatccatgacaatggctctcaaactaattcattgattaaatcatttgcatagccaattgttcatcgcaaatattaatcatgactgatttcacaaactataatgtaacttatatgtaactttcaaaaatctctccgtaacatgttatttcagtaaaatggaggtcgtgggaacaaattctttcacatatgtgtgtgctatgatttgttttcgtcctcaccaaaacaaatcttgtaatatatctaacgattcaaaattatatgaaacttacatataagttacactgtagttacatgcaagttacagtgtaattatagtaattacactacgtttgtactataattacatctgtcaaatttttaggagaaaatttgtcgacaaatgtataggtggtcttttttttttgtccgaccacgccgccacatgcacgtgctaggagtagttttttagataatgtgctaggagtagttaacgcgaggtgaggcaaatcgtttgatttgaaactgttgaagcatgattactgcgtgattaaggctagtaattcattattaatagttctaatttttgtttttttaattaggtgccgcgattaacgtcagcactcatatatgaaatctttcaacccgttttttaaaactttcaactcaaagcttgaaaatttcaactcaaaatttttaaaactttcaacctaaatgtgaaaactttcaacttaaaatttcaaaaactttgagctccaaaattcaaaaattccaattcgttttttaaaactttcaactcaaatttttaaaactttcaatctaaatttaaaaactttcaacttaaattttcaaaaactttcaactccaaaattttaaaacttccaattccaaattttaaaactttcaagtccaaaattcaaaactttcaattccaaaattcaaaagtttcaactcagaatttaaaatttaaaacctcatgttaactatttcctccatattttaatgtatgacgccgttgaccttttatccatcgtttgaccatttgtcttattaaaaaaaaattatgtatttattatttattttattgtgacttaattcatcatcaaatgttctttaagcataacataaatatttt

SEQ ID NO: 96527 - DNA, 542 bp, Oryza sativa
atgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacaggcatttgattagtggctcttttgagtttgctaatacaacgattatcccagtagaaacaggttttattcaactt

SEQ ID NO: 96528 - DNA, 618 bp, Oryza sativa
atttgcagccaactgtagcacgaactgcaagacacattgtgtgtatgacatgtgcgaccagatattaatagtgtagtatgtaactatctatctatctatctatctattatatactaaaagtccattaaacttcctacaaacgctctcaagtcgccacgtggcgctctaataaattagagaaaatcctagaaattctaagaaaaaagcaaaacatctaccccttaattttcacttaaattggtgggtccaatattatacaccgttagatgaaattgatcttaacataaaccaaaccaaatactatgggccccacctctcctcctccctagatatatacgaccatgaacgtacgcttcttctttcctttctctttttttttttcattttttcttcttttttccatttatataatagatatatatatttttttaaataatcataattcatgcgtacgcttcttctttcaattctttttttcctttttttctttttccatttatataatagatatatattttttaaataattatattttacaaacaaagaatctaccatcatgcaacttagaggtaactaaaatatctctacaattttgaaaataaatttacaccattatct

SEQ ID NO: 96529 - DNA, 2503 bp, Oryza sativa
agtaacttcatcgagagaatcaaacatcttttggagcccatgagagacaaaatcattgtaggagtttatctgatggctaactagcctagtttccctgaaaaatgatctgatgcttctttacagagcttctctaggcttgcaatcctcttgtcaactgggacttgtactggtgggtctgcatgccctccatctttcagagatggtatcactctcaaatccacatccatatgagacatgtcacctgggatttgtaccagtgggtctgtgtgccctccatctttcagagatggtattgctctcaaatccacatccatagcaaactgtacctcattgccctcaacaataatgtcatccaaatccatgagatccgtcacaatacttgtggcatttggtgactgctgaccagtaatttcaggatcttccatcgctaaccaccagacagcttctccctgtgttaacaaaaaaaaagaagtgtgttccttttaacaactaagaacaaaaaaaaatgaatatatttagaaaagcatcatgtaatccttgaatcagaagccgcaagcgactcctcgaaaaggcgcacgcacaataacatgattacaggatcataacacgcacattatgacagtaacatgattacaggatcataactcgcatagtatgagaggaggggctctcatattgaaatttattaaagggagggtgagactcgaacccgggtcggctaaccgctaacatacatcttgtggtgctagacagaagacccggcgcctttctgcacaacactcaatatataaccattttacctaaacattcctatcccagcaatggcacaaaaagaaatcaacctttcttaacctattagaccactatctctgctcctctctgaacaaaccccgacaacatcgagcgaacctgttgctcgtcacaaaatgaagatcccacgatgatcccctcccgacccacccctcacatcacccacaacaacatcgcaatcatctccaaaagatggtcttattttggtctaaacaaagtcagcaatccatgatcaaaacgcaccattcccaaaaccaaaatcacagcaacaaaaaatctctccttttctttcctttttttggttgaaaaccaccatcaaaaaccgcccaatcaccccccacttccatcatcatcatcacacacgcaacccagcatcaacaatcgcaatctgataaacaacaaaacggaaataataaaagaaaaacagagcaagcaagctcgtgccaaaaccaaacaaaacccactcgccgcaacagatttgtgcgtcacaaacaaaaaaaaaagagggttttttcctttttggtatttccttttcttttctcctcctcatcctctgaccactcgcccaacggcgaacaaacccggcggcggagcgatcaagaaacaggggaagggagacacgcacccttctcatcccacattgcacccaacccaccacaaaacccgcccacacaaacacaaacatctttggaacatggacgaaagggagtcccacctactcgtcgccggcgacgacggcgacgacggcggcggatggcggcggcgacgaggcgatgatggcaaaatggggggttttggggggagcgcggcgagaccgaggaggcctctcacgtgaggctctctctcctctgctttatggcggaggaaggaagctgcacagtggtagtggaggacagaaggctaggctgtgtaggtgtaggctttgtaggtttccgatttgaggggggttttgacctggcttgccctcttcggtttctactctttactttttgccgtttttgactgtgctgtcacttttttgggagggtcctccgccgtccgatctgcatccgacggtgatggcatgatgggtacacatacatctcttgtgtggaaaatggtttgggtaggtatggtaatagaggttggaaacggaatgggggaaatggttgtgcatagagccacccaagacagttctgtagcttcgtgttaccatttctattatacgcatttggtaatatagtgcgtgagggttgtggtcctgaaggctatgttgaaggatgtcttttgacccgacaaccatgcggaaggatattttataaaatgcgtatgtacaaaagcaataaatgaagtgatctttagagctgacgcgtagaatttgttttgagttataggagagagagagcgtagaaagagataggggagattgacttaagctaagcgtagatgctatactccaagtacgatgcagttaatgtagccttgagggaaaaccacatgccataaaaaacaaaacttttgatagaccatgtaaggtgttggacaacagagtccgcgaaaagcttcgatccaaggaccagttggtccgtgggagtgaccctgaccggtgactagggtctcctctattgtccagtctatatccaatggtgatggtcagacgtttataactcttgtgaaatgatgttttcactacaacaaaaacctcatatagagg

SEQ ID NO: 96530 - DNA, 658 bp, Oryza sativa
tcagacaaattcatcatgaaactaacacgaaacagacaactttccagcacattcatccccaccactacacctaaccattgacccactaccaaactctgcacatttaagcataaattgaacaataccttcagtactttaatcaaaaaaattaaaataaaatagagagaaaaggacattaaaaaagaaaaggaaaaagaaatgacaaccaccagtacctctcatcttagctaaaccgacagattagcctatagttcagatcaaataattcccctcattccaagcaaaacccaaaccaccaatcatgatccccctagtacaaatttctttccaaccaattcacaaagcaactatcgaattaccacatttattttcatattcttactcacctctaaaccttatttaccaaacacattgatgacacagtaaaaaaaaatgcattcatggcaaattggactagtaagcaaatactcttcacatcgcaccagtaaatttttctcaccctaaattacaatatcagcagtaaagaaaaatcgttaaccaatctaatcactaattcttcatagtatcaattcaggtgccatccaacttttcctgtcccaaattgcaaacataacccaaattctacaccatatgattcccaagaaatcaagcaagaacc

SEQ ID NO: 96531 - DNA, 558 bp, Oryza sativa
cgggcattatattattgaaagataagattattgtttgttcgttataaattaagggcaaactaatgtttggataatgttattttataataatttaagggttctatttttcttaaagtatcttaaaaaaccattcacaaacttttaaatagaagatggattaagtacttatgacttttaaatcatgttttttttctcaagtaaataagaaactattggaagttaattattatacaatccatttatagagcaagatacttaaaattcttatgattaaatcatctcatgaagacgcatgatatagtaagaacgggaggaaaacgcatgcatggaaaaaaaagaaagggaaaaatgaaaaaaagggagaggaagcatacgtactcacgtacgtaggtgggtacctatgccaagcggagaggtggaacctcgtagtatttcgtttgttctaagatcaatttaatctaatggttataatattggacacaccgatttaagtgaaaatcaaataatagatattttgctttttttcttagaatttttaatagttgctttaatttatta

SEQ ID NO: 96532 - DNA, 544 bp, Oryza sativa
tttgatccatatgtttggtcatatgtacagtcatatagctgaagggctcaataaattaataattttatgattattattcaagagtagaaataaatgaattttaactattataaagttgaaaaatggatttaaaacattttttaagaaattcatatgtaaaagtttttgcgaaaattcaagagtagaaattcattctttttcattcatttaaaaagtacacgccctgagaaaaattgcacattttaagagcaactgaaattggggagaaaatccaaaagaagctgaagaatgatatggcaaatgttgatcaatccaatgcacctggactagtttcttcgtgaccatcttttggtgaatgattgcgtacattgagatatgatatatttctgtataatttaaaggtactttttagatcagaggccttcaggcctggcttttatagaaagccaaacacataatttaaaggttgaaaggtaaaaagtgagctaactaaagtaaatacgcattgcttgttctgttatgaaacactgtcatatatttccct

SEQ ID NO: 96533 - DNA, 656 bp, Oryza sativa
agctaggagcctaagatgttccagctccagtggggcgatctatattacgaacaattgtatatttgccactacgcaactccaaattccttccactgcacacaatcccctttctaatccaatacgttctaataagatgcaggagacattttatgcgttacctcagaaataattctatgatattcaactatccacaaccagaaaaaaaaatgtggtccttacatactgaccttgaacaactttctagcaaattatcattgacatcatcagagatttcctcacttcatttcaatatacaggtgatatttttgttgtctgttcaatatcacgatgtgttaaacgatctgcaaagtaaacagcatgagcacacacacgtctggaaggttgacatgttcagctcattcatgcttgctgccatttccatcagaaactagtggtatagaatccttgtgttgtaaacttgtatttttggagtgaacgatatccaatacattctgtctagagtttcacaggcatatactccgaagttgccaagtatgtgatgattcattcttacaaccagcaacatgattgtgaaagtcatcaagatagataaccaacctataaaaaataatgaagtacaaaatgtaaggatactgaagtaaatgacgaaaagcatg

SEQ ID NO: 96534 - DNA, 792 bp, Oryza sativa
ttgttggttggactgaatattttctttggctacatgaagatcgttgttgagttattatagttgtcgaaagatggcaccccagacaccaataatgcacattaatatgtagtgataggctatagaagacaaccaaagtaacataatagtaggaggtagagaaacaaggtgcatagctcaatatgtgaaaaaagaattgagaagtacatggccgtcgaatgattgtgtgtgtgcaccattgtgtgccaactggaagattccatcttcttaacatgttggacaattcatcctatgcttctaggcatgggatgcatcaggaattattcaacagccttagattggacccttcgctacagcttggcgttgctctgcttgactaagagcaacttcaacccgagcctcatccctagatccccatcatccgttgcaggacgcagctccagtagatggatgtggcttggaagctccctccctctctccatgactaggaccttccgtggcgtcgtgcatagaggtttgtgaggtggcggatccgaagtctgtggcggggccgacggatggagacgtgcaggccagcggtggcgtagaggcatgcagtatcgtcgttggagccttggaggcttgcaaggcggcgactcatatgcaaatgacgatggagggatttttacatttccttgtttttcctagataagtgctaatgactaacaagaagttgtacttgaagaagggcatttaggtcatttcatgttagtactaaacttgcattgggaatttagggatgggtttttttgtgag

SEQ ID NO: 96535 - DNA, 592 bp, Oryza sativa
tctcttttattttttattttttcttcttttttccatttatataatagatatatatatatatatatatatatatatatatatatatatatatatatatatatatatatatatatatatataaataaacataattcatgcgcgcgctacttctttcaattctttttttcctttttttctttttctatttatataatagatatatattttttaaatagttatattttacaaacaaagaatctaccatcatacaacttagaggtgactaaattatctctacaatttttgaaaataaaatttacaccattatatgttacccattaaattaataatgtaatataatttccatttaaaccggggtactcattactttgtactattatttttaaataatgcactttttaaaataaagttcacacattatattgtatacatacgtatgtgtacgcacgctcctttcgcttatcttttccttttttttcttcttttttctatttataaaagggatatatattttttaaataatcataattttacaaatagagaatctaccatcgtacaacttgcatgtgactaaattagctctacaatttta

SEQ ID NO: 96536 - DNA, 570 bp, Oryza sativa
ctcgtgaaaaggaaatggagttaaaagaaagggacaagaggaaaaggtacctcttttccccaatagttctttttcctaactttcttggacatttctgttcaaaccttttaccccaggatttttgttacctgactttcttttacatttctgttgaaactgtagagaacgtgagggaagtgaagaaactgaagatacatcggaggatgaatcaactgagaaatatagtagaagaaaaaaaggtaaaaatgattgcattattacctggaacagtggatcttttttcgtgtttatgaagtcaaacactaccagtatgtagtaggttactttattttcgtcggaatttaaactgtcaaaacttttgtatattattaacaagaaaaattattctatgcaaaatcctgcagatcgcaaacgatcattaagaaaatcgagcaacaatgatgaaggcttcgaggaagttccttgaaggcatgttcccttgatctggcctttatgttaaaatcatcatcaaaagggggaagcgggaccttgtttaatctttcatgacatgttaatactgcacgtgattaa

SEQ ID NO: 96537 - DNA, 595 bp, Oryza sativa
ttagaggttttcatcatctggcctagattttatatttatctttatgcttaatgttacatcagttgggttcgatctgttgagtaatatccataattgtgatatctggcttgttttatgattatcgagagagatagcatcgggttttcaaccgatcttacctgatttagctactttatgttttatatgtttaattgatatgctagatctgtcatttatattaagatcttgtcgcattaaggtatattaggcttcttgtttaatatattttgcttattttaatatcttagtctaaagtagtatcggagtattagccgatacatgctagatctgtctgatcgtctatataacccctgctttaatgtatatttcgatttaagtgatttatactgtctcggcatgacgaccgatctatcgtaatcacttagtttaaatatacatcgaaggaagggttatatcaatggcggacgcaggattaaaaataagatggggcgaaaatgttcgctttataaagaccgtatttatgccgtaatcgcataaaaatatatttgaggcaaaaaatccattttataacaaagaaataatatttgcatcatat

SEQ ID NO: 96538 - DNA, 568 bp, Oryza sativa
ggttaatatagatagattataaagataggagcagaacttaagtgcttcaaatcaaacatagcaatcctggttctctctcatccttcatgttcccatcttctaaaataggtactacagaacttcaaaacatgctgtttctataggagactgactgacagataatattggcccaactatttaaggcataaatacaagaaactttatgcatatcatgtaaatagtttctcttaggaaataacccgttaagcactatatttgtttggaacgaacttgcaatattctctcaaagacatatactgatgcagcggacaacagtaaatacgagttatgcctatgagaataaccatatacatatgcgttatgtctacctctttgatgagaaaatttcactcatagtatcttacaatttatactgcaactcttatcttttcagacacgctaatgagtttgtgagataatatctacagttcatacccaattagtctattatatcaagctcttcagtcttcaatacatttgcagtattgctcagaataaaatgggatgaacttgccaaatcacctcagct

SEQ ID NO: 96539 - DNA, 547 bp, Oryza sativa
cacattatgagtttttccaaataagttgctcctatttatagattttatgcatttaatacttaaatgaagagataaattaaatgttttattagaactcaagaagtcatctaaatactcattggttgcatgcttttatttacttcttgattttgtagcatccaaggtaatttaatttctccttggtcttggtgtcaaaagtaatatgtgtaatttttgtggatgaagggagtatgttataagtcgctttgactttttctgattaacaaagagattaaactttgttaagtttgactaagtttaatgaaaaataagtaacattttaagaatatattttattattctagcaatcagcattgaatatatttcgatgatatgtttgttttgtgaaaaaaatactactatattttttaaaaactaagttaaatgtaaagaagtttgaataggaaaataattaaaaagacttataatataacacgaagaagtatgtatgtgtatatatatatatatacatatatatatatatatatatatatatatatatatatat

SEQ ID NO: 96540 - DNA, 603 bp, Oryza sativa
gcagtatgtgccatcaaataataatgagggtaactctatctacattaggagggaaaagccttctgaaaattattacagattaatatgtaaatacattcttataagttaaaatttgtccaaacctcgcaagccccaaaaaagatctttttttaacctaatgccgaactttgttccactgttatacttaaaaaaaaaaaattgacccagtttataaggaaaaccgggcccaaaaaccatacagctgcacggttaattacaggaaaaccagctaaaaccttccgctctacacaactaacaacgacggcggagcctaatcgtaggacgtcactgccaaactaaacacaaaagcgacacaacagctcccacattgcagaagaagtgttaccattgctaagctagccgcccaagcgacctagcagcgccgactccacaactgcagcaacactgaagccacgaaagtcaccaaagcgaaaagtagctccgacatccaacaatggacgtcagccaagccaccgaagagcaactttcttcacacggccagcaccagagcttcttggaagagactgcaacatgtcatcattgccgagcgtcgccgcaccccca

SEQ ID NO: 96541 - DNA, 616 bp, Oryza sativa
cttattcgcaaaataagcgaaacggtatatttgcaaacgaaaagtaacttgtaaatacaaatatatatatatatatatatatatatatatatatatatatatattcttagcgatctacaaataaatgctgaaaaataaattcgataaaaaaaacctcaaaatcaacttcaaatttaaagttaaaaatttaaattttgactgataagcataagcataagtgaaaagattaggccctgaaaaaaggaccggaatgaagatgttagaattttttttattttaaaatttttattttttaatatttacagaaatattatatcatccaaaatatttacaggaatggccactgccgtccaagtggagggcggcaaggtgtgcgcattttgtactaaggtcccttgccaccctctgcaagggctgcaagggggcaaatgcaaatttcgccttgccaaaaatgtatttttctaattttttttatcaggcctacttctgtaaatattttcgccggtacaatatttctgtaaatatttaaaaaataaaaatttaaaaatgaaaaaaaatcgaaaatgttatatacccgtaccataatagcgaaccaaaatagcactcctaaacaggg

SEQ ID NO: 96542 - DNA, 606 bp, Oryza sativa
aaataaatctctctatagatacctgacaggtgcaaatgaaatcagagcaccctaagaaggggcagggcactggcaggtaacagaaagagcttgatggtttgatgaatttcatagtgaaaccagaggtgtttgacaatggtaatcaaatggtgtcacagtttctccagcttccattttgaaaaaaaaaatagttgaatccagaggtttttgacaatggtaatctaatggtgtcacagtttctccagcttccatttagttttcaaaagataagatttcagatgacatcaagcactaatcaatcagtatgccttgtcaaacggttgttagctggtacaactacacattcctaagggacatgcaagtgcagtttgctttgcacgtttttcttgaaataagcagtgccggtcatattctggcctagtagcttataaagccaagtcaaatgacatttattaactttcgaagacttatggctatgcataacagctactacaacattagtagaaaaaaacaatattaaccaaaccataaaaaccgagagaagactacaagattgttaatactggctttcctttctataaggtactatgcaaaataatacttgga

SEQ ID NO: 96543 - DNA, 554 bp, Oryza sativa
aaattaagctaagagcaaccaagggtaaacggtaggtactcctgtttctcaatgaattaatctaatactgcatgtgatacatcatcgtagtaatgaattcatgttcataattactatgatatgctatatttagtataaaatttaacttattgtgagacaaagattaatagtattataatgtgtcaatgtgagacggagaaagtagtcatttcgttacaaagaaaatgacaaacacctcaacatactggccgtcaaactaagcttttctttaggactaaacatcctaaataatgcccagatggatcgtcaaagacaaaattatgctgctaagagaaaactcagagtaacacatgacgggattagttgggtggttgggataatcctgacaaaaaaacctgcgacaacgctgccgcacgggcgtccttccatccaggcctctggtcatgtcaccctgcgaaattccagctgccagctcaagaaatggcacatgaaatcagtaaaatgatctttgaatatttaatcctgggagaaagagctaagctaagctaaatcca

SEQ ID NO: 96544 - DNA, 682 bp, Oryza sativa
  unsure (1)..(682): unsure at all n locations
tagagtctatatagaaataccatttacagaanaattcagaattaaaaaaagaaatatgaaaagatgagtctagagtctatacaggaatatatataacttccaaataactaaatttgatatttaaaaataattaataactaccacgtatataaaatacaatatgaatattatacatttgtagtttcgtaaagttattgcaaaatttaaaattatgatgtcattttaatatatttgaataatataataagaaaacatatatgctattatatgagagaaaatataatgatgctagccgcgcaatctgcacgggccaccatgctagttcagtaataaagagagaggagataattcaggtgtatagcaaattactttagaaaatcttaaggtcccaacttttagcttacaacctcgaactattaattgaattattcgtgacatgcttgtaaaactgcaattccttcgtaaactttcttagtcagccttggttagattttttttttcaaataatttgctcgcttaatagtatatattatttattttattcatacaagtagatctataagttttaattcttaaaaagaacatgctagactgacctttagacaatccattttttccctactcatcgctatgataaacatggagtaattcgagtcatttgacatgctgtaatgattgggtt

SEQ ID NO: 96545 - DNA, 1178 bp, Oryza sativa
atttcttttttttccgatttttttaatcgatagcacacatgttttaaaaatagtttactcgaaaaagttttcaaatcttaacttgaaagtttttcaatttgaaggaagttccaaatctcgactctcgagtggaaagtttttcaaatatcatgttgaaaattttcaaatcttgacttttcaaactctagtccaaagttttcaaatctaagttgacagttttcaaatcccgagttgatttttttttctttttgtgtttttttctatttttttaatcgatagcacatgtattttcaaaaatatttgagtcgacagttttcaaaaagtttttcaatttgaaggaagtttcaaatctcgatttgaaaactttcaaatctagatttgaaagttttcaatctcgagttgaaagttttcaaatctgagttgaaagtttttcaaatctgagttgaaagcttttcaaatcctgagtcgaaatttctttttatctttttatgtttttttccgatttttttaatcgatagcacacgtattttcaaaagaaaattgagtcgaaagttctcaaatctttaacttgaaagtttttcaatttgaaggaagtttcaaatctcgagtggaaagttttcaaatctcgagttaaaatttttcaaatctggatttgaaagttttcaatctcgagttgaaagtttttaaaatctcaagttgaaagttttgatatctgagttgaaaaagttttcaaatctggacttgaaagttttcaaaatctcgagttgaaagttttcaaatttgagttgaaggttttcaaatcccgagtagaaagttttcaaatctcgaggtgaaaaatttcaaatctgagttgaaagttttcaaaatttgtcttatacattcaaatttagagttcaaaattttcaaagtttgagttgaaagttttcaaaatttgacttcaaagtttaaatcttaagtagaaagtttttaaaactaatttaaagttttcaatctgttgtcgaaacgacaactacatacgtcgaaagacgtggttacttaatagtggttggaaagaaacgaagtgtattagtttttttttggaatttctctccttccggtccccttattacatggccctagggggctatttatagccccattacagattcttactactagggtttaggttacactgagaa

SEQ ID NO: 96546 - DNA, 570 bp, Oryza sativa
ctgccagtcatgcaatgggtgttattctatatgttctacgatacttaattcttttggaggaatagaagcttttaactggtgcttatggattagggtcagctttagaaaattattgtgtatcgtatttcaccttatttgtttttataagcaagttactcactttgggtagtaagaaggtgattaattgaggtaatgttgtgcacagccagtcaggcatgacaatagtagttccttttttttaaagagaggatgataatagtagtacattaatagtataaactgaaaacatcgattgactgttctgtccatgacactgtttcaacttggaggtacgaattatgatcaagctccattgatgataatcatatgaccaaagcaaataacaaatttctgttatttacctttgtgtttctagtatctagttatctactatgacattgatatctgagcaaatatgatcaatatcctactcataatttgagcattttgttttgcagctgggccgaagatgcaccggttcagcttgtactgaagaacctgttgtgccaaggtttgaactgggatgtctgg

SEQ ID NO: 96547 - DNA, 673 bp, Oryza sativa
tagctcggaggatgatgctaccatcgtgcacctgttcgcatggtggaggcatacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgccgccccaagcgtcgccgcgtctgccgcagcccgaagatcaccgcccgcaagagcacctccaggccctagctcgttcgtcagtccctggcgtggacttgcttcgtcgagacccctcgtgccgagcccgcgcccgtggttccccaggagggggaagcctccagcgttggtagcacggaggatgcgctgttgctcaccttccgtcctggcccgtcgcagcggtagacgagcagttagtaggcttgcgcgtgtgttctttctcgtttgtcttcttgttggagttgtgtggggcatggttataccggtgtgtggcataactgtgtcggagcctgtctttattttatttgcctaagcaacttgaactttaatgaaccaatttaatagcagtaatagattcaagaattatggtagtcgtgggtggttagctttaattgttagctctctctgtttgctggttctg

SEQ ID NO: 96548 - DNA, 599 bp, Oryza sativa
attaatggcgccggcgaggttaggggaggagtttccaatacgaatccgagggagagagagagggaaaaatggggggaaagggggaggggatcccagggaatatttcccccctattgattgcacgtggggaggacgggggcggcgggattcgcggcggcggcggcgctagggcgcgggcaaggcggcgggagcggcgggaggaaggggatgacgggtgggccccacccgtcagcgagggtggcaggcgggcccgcccgtcagcggcacgcgtgcggggaggaggccgaatgggccgcggggggggagaggagagaggggaagagagatgggccgagccggcccaagagggggagggggaaaaaaggactttttagagcttttctttttataaaaccattttaactttgtttacttcttaataattattatttgtgctctgaaaattccactgaaatttatttacgcattttaagcttttaggaaatatacaaaaatcctccaagccttatttgacttttaactttgcacattttaattgttggaggctttcacacggattttaattattctaagcataatttaaagggatatattttagg

SEQ ID NO: 96549 - DNA, 661 bp, Oryza sativa
agcgaagacaaagactgtaaagggcgaaaagatattttatattgtgcatcgaatagatgcacctgaggaggtgtagcccccaactatgtgattagttaacgaactaaacatatagttgagagaccaaataatagcacgatcgtgcatcatatgacaaaagcacacacagcgcctaaataggcatgctagccgaccgctttttagccataatgaaaagagtccgagtagtttacactctaaaaaggttcacgaatgaacacactggacaggcatccgaatttaaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacaggttttgtagcctaataaaactaacaaaaagcagtataacacctttctgtcgggcaccttttaatttgcatttgcaataattccaaagaattatatgaccgcataaaaaggattttatcagcatttggcaacactattgtgcgcataatattgccaaagcaaaatatgcctaagttcctaaggaaacacattggccacgctggtaaaagtattggggccgaag

SEQ ID NO: 96550 - DNA, 592 bp, Oryza sativa
ccctagatcaacttattgtccaaaagtatgaatctgcaccagctggacagcagtgacattgtcctctcactacaggtaagccgatattatcttttatatttctcatccattcattcttgttatcacttgctagccattgtcctctcactccagcttaatctttctctcttttcccctaaacagaaagccaggggtttgtttggaagatttagtatactccgtaagctgaggtgctcaaagataccttctacctggatggttcctcgaggaagtttggcctccccttatatgctaccactatctctctaccttcctatttcatttgttcgtcactaaagaatattataacgttgctttcagaagattcaaggatttgctctatcttccatttctttcagctcaatatcattccttttcatcgtaatgatataataacatcaagtgatttgatcaagcataagaaagactgcaactgataaccatttgcaacagcgcactgttatatatttgatatttggcatggtcagaacttcttttaatcgatttctattttctcagaattttcttaccatcattcactgagcatggttat

SEQ ID NO: 96551 - DNA, 584 bp, Oryza sativa
ggcgaattcgagctcggtaccctattcctgaagtataagtagttttaaaattaaaatgttgaggataaagatgatttatggttttcattactcctttactttattattgtttatttattcatatctattcacctttaattatttataatatgttttgccgagtacataagtactcacccttgcataatttgacatatagcggaaacgtgctaacaaggagatcagaaggaagcgagattctacggcaacgacaagtttgtctaggctagtctacactcgagcttttgcctgtggagttctttgaattctttggactttattagctgtagttttagtagttgaagagtttaggagtttaatagtttagcactttgaattttcttgtatttcaaataaggatgtattagtttgtattttttcaccctttaacagttgtataattagtctatataaacaaatttgtgtaaacaatcgaaagttgttcagtatatcaatctgtgtgtgatcgaaatcctggacgatcacgagtggattttcggggcaccaagcctaaatatggtgtccccacaatagccacccccttt

SEQ ID NO: 96552 - DNA, 667 bp, Oryza sativa
tcacagtctttgattttagtactcggcaaaccagagcagaaggaattgaagcactcggatcattgctttatgttctaagagaaggcattttcgtcgactgtaaaggtctcgggggctactgtggagattatggataccccatatctacacggcatgtatagtctggttaggtacagggtaccaaatatagatagaatatctttaagaggactcgggttagtttctaaacttgtatgtcaaggaaatacctgggatcctagtcggttatgattgtattttatctgtaatcacatattccgttagggatataaactgtattttgtaatatggactccttccccctatatatggaggggtccgggtccctctggggacacgattttctcccagatcatacgatcaataatacactcggcggaatcatccccggacaagaatagggtattacttcttaactaagaaggcctgaacctgtataaaatcccttgtcttcaaacccatccacttttctaacttgatagccacccccttttagtattgccgaaatcttgtttcgacaccctccacatagtatatctcatatgtttgggaattggcttgtgggtgttaataataagatcaaggatcttattcttgttggagcttccgctgttgttgggctctctgg

SEQ ID NO: 96553 - DNA, 550 bp, Oryza sativa
actatagggcgaattcgagctcggtacccctacaagtaattatttataatcttctccatcatttgaaaagtaggtagaattattttctttagaaaacatgtcaaaaaaaagataaagtaaggttttttttaattgcatatatattatcatggtttaatagaggagaattgggtgggacatgaagctccactaaatgtatgggtttatatagcctaatataactgatgtattttgagaggtgatccatctataaacatttcatgtacacaaggtcagacactccacacagcctaacatgaatactataatgacaacataattgtgctgtattaattttgaaatgttatagtattcatattactatagcatgaatacacatttgttttttatataagatcgatccaacgataagaaataatggttccaccgatttaaaaggcataggactattccaaaaatatagcttaaaaattatgtgtgattaaaattcaatattattgtaaagtgagtgtagctcaactggttagtttccttatattagaacttgcca

SEQ ID NO: 96554 - DNA, 526 bp, Oryza sativa
ctacaagtaattatttataatcttctccatcatttgaaaagtaggtagaattattttctttagaaaacatgtcaaaaaaaagataaagtaaggttttttttaattgcatatatattatcatggtttaatagaggagaattgggtgggacatgaagctccactaaatgtatgggtttatatagcctaatataactgatgtattttgagaggtgatccatctataaacatttcatgtacacaaggtcagacactccacacagcctaacatgaatactataatgacaacataattgtgctgtattaattttgaaatgttatagtattcatattactatagcatgaatacacatttgttttttatataagatcgatccaacgataagaaataatggttccaccgatttaaaaggcataggactattccaaaaatatagcttaaaaattatgtgtgattaaaattcaatattattgtaaagtgagtgtagctcaactggttagtttccttatattagaacttgccaccggg

SEQ ID NO: 96555 - DNA, 699 bp, Oryza sativa
cctacaaacactcctagctcaccacgtggcgttttaataaatcgtagaaattctaataaaaaagaaaaatatctgaccatcggttttcatttaatctggtggacccattatttttaaccattagatctttatttaaagtaaataccaaatcaatctatctaaaaaaaataccacgttacccggccgtacgtgtcccatagaacctgtaggtccttgcgtcccaatgtacgtacatatctcctatatgtctttttcctttttccttcttgtatacttagattagatgaaaatctaaaaaaaatccatgttaaccatattttttatgttctaaaagtacatgttatttcaagttttattctaaataatgcatctcatcgaatcttccataataataataataataataataataataaattaaaattgtggattatatgattatatatcactggagagcatagttaaattggacatatatttgaaaaaaaacaatttaaattgtgagtagcactctaaaagtttactcctccatactgtgtaatactgatatatccaaatgatgttattaaatttatcatgaatgtatttttcatatattatatgtttctttgttcatatgtttttttttggaaaattaacaatcatatgtccaaatgatgttattaaatttatcatgaatgtattttcatatattatatg

SEQ ID NO: 96556 - DNA, 675 bp, Oryza sativa
aacaattggatcctataggactacatagattatcaacagcgtcagcttctcggacggctatagcaacttcgacaccgaaagcatcaacaactccgagttcaccaacgactactctccactcttctttgaagttttcatggtcggggcccctgaagacgagcaggcccgtattgcgagggagcaggaggagcaacgtgcaaaagccgagaagaatgctcacgcaaagaagaagaggaacatgcacgaaggcagcgcaatctgatcagaagtgggtgtgtcactaacaataacatcatacagacctacatagatgacaccaatgtcttcgctacgccttagcaggacgtcgtggcagctgtcacattactcgacaatgcccttgaggacatgactccgacgctgaacaaacttaacaccatgatcatcgccatgacagtaggagccgggggctctcgccgagcggaggaatctactactgagatgccaaggacacccactggcagtcatctactgtcaaaccatggatcgccgagaacctgagcgtagcagaggccacacaatgtcaagcctacgtcaccgagaggatagaggccgccgtcaagatccatcattcagcaatcacgaccgcaacactgatcgccatcacgagcattgccaccaccacgaccgaggtca

SEQ ID NO: 96557 - DNA, 615 bp, Oryza sativa
aattcgagctcggtaccctgcgcacggaaaacggaacggttcattagcgcatgattaattaagtattagctttttttggatcaatatgatttttcaagcaactttcgtatagaaactttttttgcaaaaagtgtgtgcgcggaaaacgagggaaatgagttaggaaacttggggtaaggctattcccaatctaagacactagacatagtttccataaactacacatcatcaagaaactagtactggacactactctttaaatgtaaacaacattttttcatacttaaatttaatgctatttatctcatatgatgtcttaaatattgtgtagaaaccatgtcttatggaagacctggtttccttccctttacttatttattcacttgtcacatcattttttattttagatggcagcttatttaatactatgggtaccatactaattattgagggaatggcataagaacacagccctagtcttgcgcgaagctggcgttttcatcgatgcatggacaccaacggaacgacgtggatgtcatctctccgtgtttattgtgactcattctatagctagagtcggtaaagggttcgctggtaatcgatcgatcatacttt

SEQ ID NO: 96558 - DNA, 776 bp, Oryza sativa
ctgacatcaaaaccacctttttggagaagacctcaaaaaaaaaactgaacacgtacatagtacaacacagcaaaaattactaattacttgtgggatcaagcatgatcatacctggagcagtgaagcaactgtgccaaaagaattccacaacagcagagccaggttttgaaacatctctcttttcagaaaaatagtttcaagaagcttcattattcataggtttttccttccatgatgttgtaatgtcaattgtagaatatgcgatttacaattacttattcaattaagaacaattacaaaaataatcaaccaggcaattagaaattaactaatatcttagggtaaggagatctatcaaccctttgagacctcaaggtgtgctttctcacatagattaggattggaaaggttgaggacaagtttctctgctaatgtcatgttttgatccttcgctcactactcgatgacacccaatgtcggagcaagaaagatttttgagcccaggcaaacatcactataactatcatttgctacagaaatttcatcatcaatttattcaataatattaaaatttaatggacttttcaccggtgagcccgagcggctgcctgggctagttgggcgggggctccgcccctgatgacaccaactttagtgcctacctcctcacacggggatgaatgtgagaccatgagagaggagtgtgctatggaggaaaataaagtgttctttttgtttcatatagatgtatgcttgtataaatttctaggtcttag

SEQ ID NO: 96559 - DNA, 608 bp, Oryza sativa
ctgttttcgcgacctttttctccctattttatcctctcgccgttgctttaggtgtgcgaatcacatggccatatatatgaccaagctgatcgggttttcaggcctttttttttccttttttctctcatcgtgcatcgcccttgggtacgaagcttcgtgcgccgtgcgatgtaacatgataagatatcgcaattatcggtggttagatctggggtgttggttcacttgcccggggtggcgagatatataagacgataaggttttgatccgggaattctaaaatagtcgtgtatggcatgtgatgctaatcatgctcttttgcatgcactgtgtgtatatctgtttctccttttttattttctttctacgatacctttttgcaattattattccaattaaaccgtctatatgcatcacgtgtgatctccccgccctaacatgctctgtcaactttgcgttacaacccttacatgttgtcagttttcgatcaattacgatgggaaaccagagagtcgggttacttatattagtactctctccatcccataatacaagagttttttactttttgcttgtactgtttgaccactcctcttattaaaaaattg

SEQ ID NO: 96560 - DNA, 667 bp, Oryza sativa
gttgatattgtaaatctaatttagtggtacatatttttataaccgataaagaatatatagtgatatatagtctatattgtcatcttttttataattttcatgtccgtttggactacagaaaaagaatgaaaatatgacctaaaatataattctactttacagattaaagtatggttaatatagatcataaattaagttaatggtaaataatataatatactaataaactttattttcaaacgtcttagagttagttttagtatttatgattataacgtgatctatgacactataacctttgttttcgttttttttttctgttagacataacgcaaagggtcaaatcgatcatggataaaaataatatttatttttttctaaataaaaatatagtaaatatggattgatttaattgtggtcgaataaaaaaattgtatatataattgaaaagttacaatagtttatttattatttatatactacatgttatctcaaccaatatatggaaaaaatgagttaagaagagggaagagggggtccacattatctgcaattagtgagtgtggctggttagttacgtatggtggaacttaattgcccacgcctaggttcaagacctagacttcacatgggtctcatatttacggctaattatttttgaagtagg

SEQ ID NO: 96561 - DNA, 637 bp, Oryza sativa
ccccttcatcccttaggctatccttgtaggcgtcacatttcttgtaggggtcatgtttgaacccttcttcactgagcttggacgatacacctcgaaccctaccctctgggctcaagagtacccagtgtcatatttagcacatatttctacctctttggcttaaaaaatcatgtcttctatgcactggataaagactctattttattggcaaccccttgcagctcgaggtcttcaaacgaaaattcgccttcttgcgtgatcttaggagttctagcttttacccattttttcgatatttcgctccattcctccattggtacctgaagccccgccttcctcatttcttcctcctcttttgcccactgcgccacctttggtgcataccccccggaacctaagcgatgaggaaatctgttcttcttggacaactcagcaaacttcttgctcttggcaatttctttcggggaggtcttcaacttaacataatcgttccactgtgtcggtgttatattggcatatgtctcaaatggtgtccggcccgtcttcacgaattttgtgttcaatgtgtttttccaaccacgccacgacttgtccattgtttgcagtgcacaaatcctcaccgctgcttctgatccat

SEQ ID NO: 96562 - DNA, 547 bp, Oryza sativa
tttcctaattagatatcctcctatctttatttgacttattcctaatttatcatgcctaaactaacgcatgagcctggtccagacccataatacttgacccacccagttaggccataatgttattgttatgttaatgctttcaaggaaaagagggtgggttagagggaatgatgataaattgatagtagtatttcatacaatagcctgaagcaatgaaatgattccacatagaaagaggtcttcagaatattgtggaaaggtcggtgtgtgctcttgaacaaaatcacaaatattcattctaaaactaaaggtcttcacagttaaccatgatcatagaaaaaaaaacctacaacagctcaggagttggtccttttttttcacgaaacatgaaaaggtatagaatagaaaaaacagtacaggctacagcaagtttagaagttcaggcagataatgtgtacaccgcgcagattgcagagcattcaattgtagaatgattaaaaaaggtcttgaataacggacagggtaccgagctcgaattcgccctata

SEQ ID NO: 96563 - DNA, 551 bp, Oryza sativa
cactgtaactataatgtaacaaatcttgtagttacatgcaagttacagtgtaattacactatgattgtactataattacatttgtcaaattttcaagagaaaatttatcgacaaatgtataggtggtcccacaaacaattactcaagggtgagaataaccgtctcacccttgtaagaaaataattgtgtcttatcttttgaggatagtgctaatagtgaagtggggacaacaatgcctataatagtgggagtacaagatgctatatgtgaggcacaaattatattatacttgtaaagtgatgttgttccctaactcagcgaccttgttgtgttgtaaaatgtaactcttttcttaattttaatgaaatttggccaataaatttctgcatacccaatgatgaatgtattacaactacggaggggttgaatttcgtaaatattcggctaaaccaggctcctctaaaatatggagaaaagaagtcttatatatatatttttctaaaaaaacccaaattttgttatagaaatttttccctttcaatctaatttca

SEQ ID NO: 96564 - DNA, 981 bp, Oryza sativa
ggcgaattcgagctcggtacccttccaatagatggaagtaatgaattcttaaattgtttatggtggattcgcctgttcgaataaaatactgcctttttatttgacaatggatgcattaagtcgttgtaaggtgatacttaaatagctgggcatcatgatacccttcttcatgagactttttgtagttgtttccttatctgaattaggctcgaaattcactcgacgttgagtcgagtccagcatgagccagttctctagctcggaatccagcttggctcaaagtgagctcatttgaagtataatgtgagcttagtcaatgcaagactcatccatgcatcccatggcccagccatatcacattggaggatataagctgataaggcagtcacatgccacagccacaaatctcacggcaaatctctcccatctgtcgattctttagtagacaagagtggtgcgagctgcgagcaggagaagatgggtggtgcaggcgtgcgggcaacgggcaacatgagtaacacgaacacctgtcgccttaatgtgagattcttcggtaaaaaccattccccgtaactaccgaaccgattttatttggttttttcggcttggtttatatttgtaaaaaaaaaattctcagcggctattatcgagaaaccgaattttatgaaaaccgaagaattgacccgactaaaccgatgaaacagaacatcgacacctaccttttaccacaatattttcgttaaattctgtgtggtaaatatggtattactccctccttcccaaattgatcatcatataagtttatacactaagaccaaggataatttaaatcacatcaatctcccacaatgcatgcatcgattaaaacaccatgccaattacaccttagcatacacacattctcccctgctgcattaattgtattctgatgaaatccgtatccatacggttatatgatgatcaatttgagaaattttgaat

SEQ ID NO: 96565 - DNA, 669 bp, Oryza sativa
actgcactatttcctgagctaaatttgctcagaagtacagatagtgagataaaacaacctctaatataatgagaagtggacttgaacaactctgcagcagagaaattacaagctgcctcagattgcaaggcaacttttttggtgaaatattatttccgctaaaataaaattaattgaactctacaaagttttcaagagtagcagtgtgcataaaatccagcagttttctataacaggtctactaggcaattattatgggcatgggccaaagaaagcttgaccagtaacacatgccttccaaagccaactcctagatcctttggtccacactcgggcatatacgaggaatgaacactccatgcctattgctgcataattgcctgttatgaaatataatcattacctatgtaacaccaacgcaggataccagtaaagcgattttgtgatcattctcagctactcaataaaataacaggtaaactactgagggtcccaaaattgtatacataaaaggcctacatacatgcacataaggcccactgcttcctgcatgctgttggccagccagcaaacctatattgaaataaagaaaaatgaaaggagagtacactcaataaagtaacctatattaacttgacacttggagacatgaagccgtgctccgtacca

SEQ ID NO: 96566 - DNA, 553 bp, Oryza sativa
actataggcgaattcgagctcggtaccccaatcgagttgttgagtagggcatgcatatatgcaaaaatgcactttatttcctagctagctagcttagctagtatgctctcatgacagtgcatgggtaaggaataaggaggacataagttctttcggtgcagttaaatactcttttcatcaccaagaggcgatatcgatcaagcccccatctaatccggctacgctaaccttaattaatctcgtctgttgcctgcaactacgggtaattaggccattcgatctcagtcagtcacagtcaagtctttggagaggattgaacgcctatgaaaatatataaaaacgacaattttatgtactacttcgatctgtgaatgacctgataagttagtatcactattttatttgcactcaacaaatgttaggtgttggcaacatagcattgcataattgcgctaactttattccaggctagctacatgcgcacgcctagagttggttacttggttagttgctggcttgctgctcccatcatgatcgtctttaatcatacgaa

SEQ ID NO: 96567 - DNA, 727 bp, Oryza sativa
agagagagagagaaaggcaatctatcgagctatgaactttgttgtttgcatcctggaggaccaagtgtcggtaagcctgtatctcggttgctagcatgcatgtactgatgcacgcctcccttgtgattgcttcgactttaagctcactcatgtactagtattttttttttgacactcaaagtgaggaggaggaggaagaagaaacaacaagcaaaggcaaaagaaatcgagcgtgtgagtgagtgagcccccacggaccgatacaaaaaaaacccgtgtgccacgacgtgcgatgcattcatatgcatgcatccatcctcgtttttttttattattccctgtgtaataataatcgagcccgtcgaccagtgcatctggatatatatatatatccggtgctccagagaaatttttcacgtgccattacaccgtacacgcatatggagtgtacacgacgcgcaaaacaaaatttcgccggggagcagcgaaaacggcgtgcaggaccagcacagtgagagggcgacgggtcgaccatgtgaggaaggacgggaaagagagagagagagagcgagcgcgtagtacagtacagtacgtgcctcgaccggaaaaaagggggccggccaaaatagcatggaactgctaaaccgaggcgcgcgggcgcatgcatatgtgaccgtgatcccgtgctgctacgatgacgcacggcgagcgcggggtgtatcggcat

SEQ ID NO: 96568 - DNA, 722 bp, Oryza sativa
tcccccgttcattttatgagaatactataacatgctccgctctcttttttaagtgaaacggaaagcatttattttatgagagcactctaaacaagcccctggtctgcacatacaattttttttcttgactgtagattgagttttaactggaaagttatggattaaatacacatggtaccaatgtcatttttaaagaatatatttcataattatctgtaaagcttttggcggataggaactgcgggcacatgcattggccatatttggccttctccatgttttaggggttgttcaaattatgcccaaaataatccttatcaaattttggcattggcaatttgacaatattgctaagttttggtatgatttcttatatatttaccaaagtttgataaaaaaaaactaaatggatgcacatatatatttgataagtttaccaaaatatgctatggtctaaaatggcatcaatctaaacaaccccttaaaattctgtataaacaattgcagaacaatgaatcattgattaaccactcatctcttcagaaaaaaaacttccttgccttaaaaaagaaaaaggaaggaaaaatactcacaaaatattatcttcttgttaaagcccgttctaactttcattggcatcaaacatcgataaagcttgcacggagtgctctgctctgcggtaaaaacttgcagcattggctgcccaaaacaagctatctcca

SEQ ID NO: 96569 - DNA, 731 bp, Oryza sativa
aaaaaaaaaaaaaaaccaaaaacgcatcgtcactttcatcaccaccggccccgtggccccacgcgtcaggtccgctcaggataactccgaggccacgccagtcgcagggttcgctgacacgtggggcccaccgaataattgcccccacatgctagcctcggggcggaagtcttccgtctctgtccgcgcgagccctcgcctccccgagcagacaatcccgtgcgcgcctatagttacaccggaagatcctacccacgagcgaaccacatactgcaggtgggcccagatggtggtgtccccaccatgtcagcgagagaggtttctgtgcgcgtttgagatcccacaccgccgcgacaagtgtacacggggatggatagagaggagagaagaagaagcttaaggctgagttcggatgggggagacggggaacctaactctaactcctgtgcacggaaaacggagtggtccattaacacgtgattaattaagtattagctaatttttttttcaaaaatggattaatttgattttttaagcaactttcatatagaaactttttgtaaaaaacacaccgtttaatagtttgaaaagcgtgcgcgcggaaaacgaaggagaggggatgggaaaaggtgcatgcgaacacagcctaagcgcggacaaaaaaaattgggaaattgattttttaataataatataataatactaataataatcgcatcgcagccgcatcg

SEQ ID NO: 96570 - DNA, 554 bp, Oryza sativa
cagaaattcgttaatgtccagggttttttttaaacagttgttcttttctttttgtcgtaacattcttttccttctttcctttgtatagacaggaatattttccatttcgaatttgccgtttgcaccctgctgttttgtgggcttaattaaatatttacatttatgtttctcccgctaacaatcaatacatgcaatccaaacatgtacagtgcttgctttctttttttgcggccggggacataaaatgtagtgcatcttttttcttttcagaaagtggtccctccttttaaagaaaatacatgacgccattggattataggttgaccattcatcttatttaaaaaatatataattattatttatttttatataatttgttttattgtcttggcttatattttgcaaacctacacaacatttttgaatgaatacgaatgctcaaatgcgtacctaaaagttaccagcatcatatatcacaactgaagaagtactcgtttttacatgtactaattaaaatgtatttgctttaacatgtaaatagccaaagcgatagt

SEQ ID NO: 96571 - DNA, 703 bp, Oryza sativa
aactgaaactacattaaacttgtcaaactggaagtaaaaactagtcctgacctcctttttcttgtcgcgcttgctctttacctcttgaaacgtatctagagaaagattgacaaaatgtcagatatcattatcagggcactactggaaccatgcagaacatcaagcttacgtgctattcacaagaaaaaaatgcactaaaatgaacaattggacatgtttttttttgaaatgaagaccagcatcccaagattataccatccaaagcatgctgaataaattgtagaaatatatcgatgtaattcaaatgttttacagatgatacccaagtcaatctcaattcatttccaacttcctttagaatatttctattatcaagcaatgaaggttatttactcaaattacagaaagaagttatagaatatgttagtttcctacaacaaagactacgagagatgcacaacttgattgcctatgatcagttgactcttactttgaatgaactgtaggaaaggtgtgcagaagataaatgttcagacacaggttaatgtaaagaaagaggcagcccaacagggaaaaatcagatgccctatccaaactgaataaatcgaaacactgtccgagcagatcgaaaagacctaattccaagagaagaaaatcaatgttcacaaagctaatctatattatgcccccaaatgttagcatc

SEQ ID NO: 96572 - DNA, 611 bp, Oryza sativa
ggccaattcgagctcggtacccgcgtatgatgcacttttgcatggttgcccacccgagctctaaatttttttgctgagagcgaggaatagtagcagaccaaacggtcttaggtctcctgtcattgtgatcccttttcatgattagatttcctgtactttctcctcctgttgcagggaaaaggaaaacgatgaagagactggagaggggaagaagaagaagagaacaccacctcccgtttcccgatgccccccctgacgcgcagaatgatgcaccgtctccgaatggaaacgccacggggccccacctgccagcttgacccctgctgctgctgctgcactgcacatgttattccccctccgcctccggtgtcacacacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccaacgatggaggcaggcgccgtggggtggtcaaagggggcgcggggacggacacgtgtcggtcgccgcaacgtgtgaatgttcgacc

SEQ ID NO: 96573 - DNA, 607 bp, Oryza sativa
agttagggggtgtaaaatggacttttccctaaagtttatcttcatctaactctgtatgaaaaaagttatgtatatatacgtgttttttctaaaatttgatccatgtctgcggatatccaaacaaaatttctggatagtttccaatcatttcccttattgtatttgtttttgtttccgactaaaaaaatccgaattcatttccgaatcccataatttccaaataattccgacctatctgaattttaaaaatgggcccgacggacaaaaactatccagtttcaaccctacaagtagatgggacttgcagttgactcgctgagaacatgtccacgcttgatgcaaatgcctataaactaccggcaaattgggaaaaaaaaagaagaaaagaagaaaaattgaacttgcacactcacttgatgaagatacacgaattgttttctgaagcactgcatatcttttgacttaggagtagtaattaattatacttcaccacatatgcatactgaaatcaattgggccatccaccatctatgcatcaacattatctctgcagatgcatcacactgcaatcaggcatactcctatgtactgctacctgcgtacccca

SEQ ID NO: 96574 - DNA, 648 bp, Oryza sativa
cttttgcatatgtatacaaagtttatatacgacgtatacaaactttatacatatatatatatattaaaaaatcaaaaatatagaaaatacatcacatatataaagtttgtacacatgtacaaatttctatacgtacgggatacaacgtttgtatacacgtacacaaactttgtatatgcatatagaaactttgtatcccatacatataaaaaacaaaaaaccaaaagacctgcaagcaaaaaaaccgaaaaaaacaaaaagaaaaaactagaaaaaaaggcggaaacaaaaatcggccacatatataaagtttgtatacgcgtacacaaactttgtatacgcatacagaaactttacgtcccgtacgtataaaaaaggaaaaaaaaactacaaggaaaaaaccaaaagaaaaaacagaaagaaaaaaccagaaaagaataggaaaaattggtggggaaaaaatcgtgcgacacgtggtgccgtcccgcaagcgtgcgctgctgcggctccctctgcgtgcgccacgtgcctttccgcgccggggggggggttgtaaccgctaaatataaaaattgggcccggtgcctaagaacccctggcccattgggctccacccctctcccgggttcaaataaacttgtatacatg

SEQ ID NO: 96575 - DNA, 887 bp, Oryza sativa
atcggctgtagatataaacgatatatactcctcatatcgatatatacttaaataaagtgattgggatagatcggtcatcatgccgagatagtataaatcacttagatcgaaacatatatcaataacaggactatatatgtttatagcatagccgatcagatagatctcgcatgtatcggctaatactccgatactactccatatcaggatattaaagcaagaataatatatcaaacaaaggcctaacatgtttagatacggcaatatcttgatataaagggcagatttaacatatcagtatagcatatagaacaaatatagttaaatcagatacgatcggctgaaactccgatgctattctaatcggcaactagaaggcaggctagatatcgatattctaagcacgacttaatagatcaaactcaactgatatagtattaagtatgaaaagaagagtgatatctagacaatcaagctgctagaagtttcatagaatggtagatatcttatataatctagaccaacatcaagatctaacctaatcggctgccttctgcattcagatattggccgatagtagattagatgacgatgttgctagagattatgtaagatatatgataactcgacgaattatataaacaagattagagtgtcataaagatggaaacactaatcctaagaacgcaattcgtcataacgaattttacctcttgttgaagatcgaaatcgatgcagctcaacccgaaaacatgaactcgtcgaaacaaaactaaagcaaaaagggtggcgatgtgccaagattgtattgaatgtgtgtgttcaaaaattacataaggctcggggtctatttatacccgagaattacaagatatgcccataccgga

SEQ ID NO: 96576 - DNA, 527 bp, Oryza sativa
ttgtacacctgagctgcagaagagcgctcgcaagccttgagcttttcttgcatcccatgacttgatcatcccggaacttatgtcaccaaataggaaaccaacagcatcctttctctgcactagtaatatgcccgtgcgcagcaatggacattgattcatgggcttatgggcccatataattggggatgggctcggagtgtagggagggtgctacgctcacgggagggaggcgtacagggcgtgctccgcgcggtggggtgcggaggagagcggacggatgactccattttttagtagagaaaaaatcaaggttaaaaattttgtgatgggtacgcagcagttcacccacctagtagctatccaagaatcactgcttcagcaccaactgctgttccgtacatgatatgcatgtcatacaacatatcggaactgcatcaaatcgatttagaattacaagaaaacagatgcaatacggcagcggcatgggactggaacaatacacacagatacagcaggcccaaataccc

SEQ ID NO: 96577 - DNA, 721 bp, Oryza sativa
tagcgctaggatgtactaggatgtgtcacatcacgtagtaggtttgtttttatgagatggagggagtacttgctttccctcttctcaactctgcttatctacctatgggtacatggctctgatatgcttccatcattcatctccttccaccgtctatttcctagtgagtgcacttgtatgattatagatcttattattgtgtgttttggtttaaggtgcacgactggtaggacaagcaagtttaaatagcgagtgcctatgggtctctaggatcagtagctaggattaggccattcccaacccaaaacactagatataattttcatacactccacatcatcaataaattagtactagacactactctttcaatgcaaacactattattccatacttaaatttaatgctacttatctcacatgatgtcttggatgttgtgcagaaaccatgtctcatgcaagacatggttttcttctttttcctcatttattcacttgtcatatcatttttcatcataggtgacagtttatttaatgttatagacaccatcctagtcattgagttgggaatggccttaggggatcattcttttgcttggacatagatcatactccttcgtcctaatgtatagcaaagactggacgagacatatcatagtacgaatttggagtcctctgtccagatttattgtactaggatatattctcacaaatcctagatt

SEQ ID NO: 96578 - DNA, 1362 bp, Oryza sativa
cgtgaatggctagctgtgtccgagctctagggtcggccgtggtgcaacttggggcttgatagaggagcgaatcgagcatggcgcggatgagctcgggggccggctgtggtgtgaattgaatcaacagcggatgagcttgtgacggctagtggtggcgcaaattgaagcagtgacgaacaagcttgcgacggcagagatatttcacccatgtgcgcaaattgcttgtgattggcagattgggaagcggtgctcttcactacacgtggagaacgagaatagcggaaaagggattttcaattctttgggatgttgattggagatctattggatctattttttttatacataactacaaaattttgagattgggaatagaattggacatctcttgggcatgctctaactattactcattagtctctcggtgcttagctaacgatggtgtaatgattgtttcatgcatgctatttatgcggagatagaaagtatgtgtttcaatgacagtaggtgacggagtgctcggttgtgcgactcagccaaacaaaaggattggcccagggcattgtttgttggtcgaaccaaacacacggctgattattgaatgaaatggattcatcatcacacttcattagtcaaaagcacatctagaaagagaccgaggaatgtagttatcatccataggccaacacatccggcaacaagttgtatttctttaaagtacaaattttattttggatagtcttttattaccgatgtttcgctttaaaccattttttaaccaatgtttttattctaaattgagtatttgtatctctatggttctttggatcttaactcttttatccatttacatccaacttgttatatcctaaagaaacaatctttcatatagttgtgaaacaatctttcatatagttgtgagagttctttgatgggtaggagccgacgtactcaagatctttcatatgcttgagagagtcaggtggttcaaaataaaacaaagccaagattaaccggtccaaagaaaaaatattagttaaagagtgattcaaaataaaacattggtaataaaatatgatcaaaagtgaaatttactccttttttttcatctcattggttttttaccagccaccgaaactatttatttaacacagttatgatccatattgatcacatttaattgtgtggatccactgaacttatgacattaacatattcttacatgaaaatttgttactccctccatttcatattataagtctattttacttctttttcctaagtcaaacttatttaggtttgattgagtttgtaaacaaattaacatctataatatcaaattagcttcattaaatataacat

SEQ ID NO: 96579 - DNA, 1600 bp, Oryza sativa
taggatcattgaaaatggccttgaactgaaacctgtgacgagaaaaaatatttttaaaattgttacaacttaaatgggagaaaaaagttgggcaagcaacatgataagttgtgcggagaaaatagagatgaaaaaatattcaattttatactactgacagttttgtggaaacaaagctttaaattaaactagagccgttcctgcacataaatatatgacagttgtgatgtacataaatttgctaaaattgggtcacatgaaatccatgatgaacaaaacataacaaaaaaatcccataaaaaaaaggaatatgcaactaaagaaatgacaatgtgcgactcagtgattggaaactacactacatagagaagttcaaacaagggaagaacagtttatgtacacataaagtttgtagacgtaaagtttataagtcaaaagtttatatacccgactcaaattacaattcggattcaaaaaaaattttgtatagaaactttatacttgtaaactttacactaataaaaaattaaacatccgaaagtttatagtcgcagaaactttatacttacgagtattctgctttaaacactttatacttcaaaaacattataaccacaagaaattagcgggggatgtaaacaaaacatgtgtattctaaaaaaaactctatcgggcgataataagtttaaacacctaaagtttgtatacctcgagtttacacatgtgaagtttataaacctaaagtttgtagacctaaagtttataagtcaaaagtttatatacccgattcaaattacaattcggattcaaaatatttttttatatagaaactttatacttgtaaactttacactaataaaaaattaaacatccgaaagtttatagttgcagaaacttcatacttatgagcattccgctttaaacactttatacttcgaaaacattataaacacaagaaattagcgggggatgaaaaaaaacatgtgtattctaaaaaaaccctatccggcgattagtaagtttatacacctaaagtttgtatacctcgagtttacacatctgaagtttatacacctaaagtttgtagacctaaagtttataagtcaaaagtttgtatacccgattcaaattacaattcggattcaaaaaaatttttatatagaaactttatacatgtaaactttacactaataaaaaattaaacatccaaaagtttatagtggcagaaactttatacttacgagcattctgctttaaacactttatactttgaaaatattataaacacaagaaattagcgggggatggaaacaaagacatgtgtattaaaataaaaccctctcgggcgaatagtaagtttatacacctaaagtttatacacctcgagtttacacatctgaagtttatacacctaatgtttgtagacctaaagtttataagtcaaaagtttatatacccgattcaaattacaattcggattcaaatattttttatatagaaactttatacttgtaaactttacactaataaaagtttcaacatccaaaagtttatagttgcagaaactttatacttacaaatattttgctttaaacacttt

SEQ ID NO: 96580 - DNA, 1841 bp, Oryza sativa
  unsure (1)..(1841): unsure at all n locations
gttattctgccggaatgtgtactagtacgatatagacgggagattgagttgcccatggtttgcccctttatgaatgaagctgatcgacttcgaatcactgtcgctattgcatttcggcatatcatcctggggccaactataggaagaagtagaataaattaagacatgtcatttggagtcaagtagagcttagggtgtgtttagatctataggtgtaaagttttgacgtgtcacattagatattatatagggtatcgcatggggtgttggggcactaataaaaaaactaattatagaatccgatagtaaaccgtgagacgaatttattaagcctaattaaaccgtcattagcgtatgtttactgtacaattagttatttttttagcctatatttaatacttcatacaggtgctcaaacgttcgatgtgacagggtataaaattttagggtagaatctaaacacccccttactatttaatattattgccaatgtctatttcgagcaaagttggagatagggactcataaggaacacacgcgcctactgccttctctataattgacttgattttgctggacaatgacatgcatggctactcatttgaatagcaaattctcaacggggccatctatatcattgtagggcttagttgcatcatattttggtatcatctttgctcggcaattagatctataactatatgggctctagagtctagactagtagggcatggctcgtcagtaccgtataattgtaacggtcaaacaaacactaaactagtaaattctcaacggggccatctatgtcactcatatttttaaatgtgtatataatatggaataaactgcactagtattatctggatgtcctactttcaactcaccttgctgntatatttccttgtatcatatccctggggcggaagaatggaacaaggcagcttcagtgggacttttttttccgcatgtatcagtgggttatgcccctctggcgacgtaatttggagtaaagctaaagaaaatgtccctcctacaatatatacaacttgaattctttaacttctgaggaagtggcacactaatacataattatctttgcagacctaccctgtttatttttacaaacagactataagaaaacctgcatgcaaaaacatttcagggttgtctagtaagacccgcatgtgaaaatcaatttttataaacaggtctctaaacatagccgctagtgtaaatacgtttatttttacaagcgactatattaagatgccgcatgcaggtatacgcctcgattttcacccgcgttagaaaatcacatctcaattttctctcaccctcagcttaaaagtcaatgtccatcatcctctcatctactcccatctcttctcctccacacatccactccctctctgtcccctatctcttttcctaccggtcggtgacgaccagcgttagcaagggagcagcgccagtgacaagagtgcatgcgcattcctcggctcctccttctcctctctctcctctctccctccctctcactcctatccgaccaactcgggcttaggctggacagagggttgaggcgtatgtaatactgttgtttgataacaataagtcaagttggagataccttggtctcagaatatggtttctttgtttgattcatgtgtaggtgacttgatgcctcgggagagtattccggtgatggatcgggagtcgacttggggataaggcgacgtccgtgacggtcagatatcatgcgggatacttaagctagagttcaatgcacgtggttggtaaagattacatatggcatacgatggaggtattgtgtgcatatg

SEQ ID NO: 96581 - DNA, 1485 bp, Oryza sativa
tgggtaaattttgaagttgtactagattacttaaagaattagctatagaactcccggtaaaaaaattataacaatttgtttgaacaatcaagtactaatttgaaaagagcttagcctcaacatgcgacgagaaaaagcgacacgacagaaatgtttggatttggattaaattattcttagtggcttttggtggcacagtgggcagattttgaagttactatattaggaattagctatagatctttcgataaagaaattataactatatatatactataattctagtgtaactaaattgaaattgcatgtaattattagaaagatgtgcttagattagattgttgaatgtgctacacagctactggctcacaaggtctcgggttaattagatccttcctcctatcctcttgtcaaaatcagtatagttaagtggtggtatcaatctatctatttattatatatagggattattatattatttaaaatatcttaaaaagaagccaccatattttctacggagactagaaattcccacatctatgtctatacctaattaaaaaatacgtaaggctttgcttccgtaacctttttcgtctgtcattgtctctcagccggtccagttctgtttttctctccctccctggccacaatctctctccctcttgatctttttccctttttctctccctcttgaatcttcttccgtattttttacaaggattccgtatatttttatgagtccgatccactgactgcgtgcttcacgcgccttcagccgccactcaggccgaacctagtgccaccgccacgttgatctacctccccgtgcgtttcctcttcaaattaattgcaaataacgattccacactcatccctcatcattttcccatgattttccctttcaattcagcttttatgggccagatttaatcttcatttataatggtcgtcaatgatggttagccagtgagcttccgtgggcccttttttctcgagttctatggattcgcatcaatttttggggaaatagaaagaggagattgaatggatcaaaagccctcaaacaatttttggagatcaaaagagatttagccggatttgatgtgcaggatcggttcaagcatcataggggcatgggactcttattcagaggttaaagacgctactgaaacgcgagggtgtggcttggcagcgagaggaggccaatgtttcaatttattgctcaattcctaatagctattgtatcacttagaaaacgtctgtacccattgcaatgcatgggcattttttatagttaattaaagaagaagaaaatatttaatccattaaaccgtgatgatcaaaattataacagtgtagattgatcgatataattgtacatatagtaacatgagctaggagttgtatatgatattcaaatttattttaaaaatatatatagtagaaaatacaattgtatcttaaaacacaatttaagtatatcga

SEQ ID NO: 96582 - DNA, 1512 bp, Oryza sativa
ttcttagattatctctataaatattgttatcatgtggattccaatctatccagactatacggggataatctaaaatgccaattctatttaccaaatcatgtgtaaattctacattttgtagactacaccctaaataagaagtaaaataacagatggagtacacgtcatgttcttccccccttgatttctattaaatacgtatggtgtgtgggtattttgtacatactaagtttggttaattagggaacataaaccatactaaagttatatatgagaattcatgcattaaaaatacaatctcatacaaattattgataaaaacatgttcataataaagtaaaaaatattttaagaaatactcatccatacataaatattcataattaaaatacaagcaacattaaataaggtgctcgcgcatgtgtgcaggttaccttcctaattattatatactaaaagtccattaaattttctataaacgctctcaagccaccacatgtgactcctacaaacactcctaagtcaccacgtggcattctaataaattagaggaattcctaataattctcaaaaaatctaaccattgattttactttaaatacagtggacccactattttccaccattggatttaccttaataagaaaaagctaacaaaacgaaaaggcccacaagttacatgcaccagtgcacgtatgtatgccatacctctcccctactactcttcatgaaaatatattttgtgataataaattccaaacaattatacgatctaaatcatatagccaatgttttaccacgttcatcattagattatttacaacaaaatttataattcaacacccaaacgctatatttaataagtaaaagaactaaaacacatttatatgaaaaatcatatagatactttaatgatctatttaacaacacatagcttttaatagaacaatatgcaacacataaagtcaatttataatgttataataataagcaatttaattagaaaatagatatttaacaagtatgttactttgggtcattattattttataaatatagaaaactcaaattggtaaaaccattggatctatctcaaaggaaacaaaacttctcccctcctcatgttgtatgtacatatgcatgtcttctggaaacaagatcagaatacatacatctattatatctttattgatccatatgtagatacatataacaaattgcgttaatgtgaaccaattaaaaggagtgctagcttgatggtacattattaagaataatagtttttcgagatttgtaaaaaagaagccccaaaacattcaatttaaaacaaaaaaaacaccttacttttaatttgaacttaatttgttagacattttttttgtaaacaaaataagtctaccttatttttaaattatgaagcagaaagtaataattaattaattatatggatgaattaaatattgcgtagtataaagataacaaataccaaagaaaacttatttaagaaatgcc

SEQ ID NO: 96583 - DNA, 2089 bp, Oryza sativa
tgtattttggtttactttacataattgtctatattgcagttaagcctattccacgtagatcttctgagttgtgcacactttttctcaacctagcatcttttaaacgtgcaaatgccaaaacccaagaaaaacaacttttggtcggttttccaaaagccattccacctctacctgtatgtagaagcaactagagtaattccctacacctacccctctccctatttaatttcaagcgaccagtggaaacatgaatcatgtgaacttcaaacactcacccttctcctccctcccctctcccccctctcctacacacccctcctgttcccttagacaatttatcgcctcaaccacaattcttgtagttagaatgcctgatactgtgtagtagtctaataatctttatgaaaaatatccaaacctaccaaaggggccttactattgtattggttaggttaataggcatttgcggtaatattgtcacatcaatgcatgccatgccacatattgtccaaatatttacttaaatattgcatattatcgacaaatttaatttaattttatacatatttatttaaaaattgaggggaaaactaatagtatatatgtttagaatatatctcatatagcatcattagataattcctttcgtgcacaaatctgcaataagaaataatgaaatgcaaaaaggtgcatcatctgttttcaactgtcatttattcatgtatgtgtgttacacatatcacttttatttggtggaaaacaacacattagtatattagtaaatcaagttaattttacgcaacttacagcccagtccacttcttcaaataaaaggaatgatgtaatagacaattcccacaaaagatataaattactttgcgcagctcggaaagagcatgtccagatgtcttggatctagcagatcaagaataagacgctcaacaagttcagggtccctagggctaggaacctcactagtcaacatagcaaatatgtgaagactagctatatccaatgaaagaagtgatataaaactctaagtcaaactatctccaatgcttctacatgaataaaatagaaatctgtgatacataggggcactacagcctttaagtagtgtagatacagatgatgtgcatttacttggttcataagaaattagtagaagttgttccagataaatgcacattatcttgttggtttctttgtaaccttgggtgcatgtttcttttgctctaaaaagaatccaaagttaaaaactgcagctccacatctgcgatgagtcatgtaaaagataagtttagcggttcatacctttttatgtcattcctatcgtgtgaagcacatgacaaagtgtaagtttggttcctttatttttgttaatatatgaccagatcactaatctttcttgagggtgagacaaaactcacaggaaaataatgattcacctcataaatttttcccatcagaatgaaatcctcgaggtggtggttttttgtgggggggaagaagaggctaacgcttgtttagattataggataggaaaagtatagaaatttaagaaaggaatctaagtataaaacagagaaattaaaaataaagaaataaagaagttaataacaagtttcaatcaatccagtgcatcggcccatattcaaagatcatataattgtttaattaatatcttataattatcaatcttatacttataatatctgtttgatccgatctattaagattagttttaatagagttagaagattcaaaattatatcacatccaaatcttggctaatgtattctttgctttatttttcataacttatatcccatcggttatagccgatcgatccaaaattccatccgcatcggctagacacatgattatatatagaccttttggccaatctgccccacgatctaatctttatatattgtcgacgtttgatatcgcgattatgatatttgcatagtatgtggatcgttggtaccagtgtatgtgcgagattgaggtaaaagagatggagacaacgatttttatacaggttcgggccccttatctgacaggtaatagccctactcctgttggc

SEQ ID NO: 96584 - DNA, 1544 bp, Oryza sativa
tatttcacaattcattattacatacctaactaattatatgtttgaatgttatatacctagaaccaaaatctaaccaaaaaaatgtccaaactcagttcaatcttatttgaacttgttagtaaagaagttaatgttcatatctaaacatttttttaaaaaatcatactcattaaaattgggtatatactcaattttaatcttcgagcccgagcaccatggagccccagttaattttaatacacatatgtatatatacatacacacacatgacggtgacactggctctatatcgagaaatagttatatgttaaaaaaaactaggaaggtagccagcgcatacgcgtgggtatgttgtttaatcttatttgaacttttattacgaatttttatgtgtggatgatatttttgaaatattttttgacactattttaaacgtatgtttgttaataactggtttgggcatattacttgaaattgtatatctattaggaaaaacgtgtcataataatagagttagttcatatctattttaattatgtgtgattcctttctaaaaatttttggactttccaaactttatataacatttttattttgtatgctatacatgaatttaagtaacattttaaaaataataaatttaatctaatggtgtaaaatgaaacaactaaattgcattgtttttattttttttataaatgtagatttaaattagtgttgtatatttgtcaagtgatatttgaaaccctaaaacaagatgtgaaataaaaaattatcatagcaataattattatatatatcatcctcgtatgctaagataggatgaataaagattattcatgggatatttcatatttataatataaatttagtttaactacgtatatttacataaatttgtagggtaatatatttatatttaaatagtagataatactattttaaaagaccatcgatctttttcgaatgatacacatttttttgttttattgtttttatagtaagggattttgaaaatactatttcaaaagaccattgtgcatagatttttcttttccaatggatagtaggtaagctccaatttttttccaagtcatatgtatgtacggacaacttatgtttttttttgtttttctatcctaatagttatatagttctccagtatacgtacacagagtaatatggtattagtttataaaataaaatactctaatggtctaaatattgggttcatcaatttaagtgaaaatcgagggtgatatttacttaaatttatagagtaatagattttatctttaaatagtagaaaactctattttaaagataattgatttttttaatggtactacgtatggttttttttcctttcgataaacagtagataagatacattgtattttagtcgtatgtacgtacctattgaatacttgtgttttttttccggtgaacagcaaggtattagtttctattttctttttcggtgaacaataggtattagtttctttttaaataaaatacatctaatctcatttaatggtgtaaat

SEQ ID NO: 96585 - DNA, 631 bp, Oryza sativa
ccattagccacacccgaggatggaggagccatgctcggctgcattttttcacattttagtactttttaaaaacttatcctgcaaatagacctataaaagaacttattctagaaatgatccttgtcgcggcgccaatgtcgttggcgccatgtttcaacatgacggcgccaatgacattggcgccatcctctccgccctcgggtgaaagtttagtcacaaatgtgaagtgggacggcgccaacgacattggcaccgaggaccaatttgtaaaaaaattgaaaaggacctatttgtaaataaaaaatatttacaaataggtccacaaataggtccttggtatcagcgtcattggaactaaggacctatttttaaataatttttatttgcatataggtcctttttcagaaaaaaataatttggtcctcggcgccaatgacattggcgtcgtcccgttcacatttgtaacttacctttttcacctggggctaggaggatggcgccgacgtcattgacaccgtcatgttggaccacggttccaacgacattggtgccgtggaaaggatcatttattaaataagtttttttagagatttatttatagaataagttttctaaaaagatcaaaatgcga

SEQ ID NO: 96586 - DNA, 1031 bp, Oryza sativa
gactttttcacaggtattatagttgcagttaagttcttataaattagtactgttctcattgcattcataagagactattccttcctattgtcatcatagcagatgctattggaatcattactgagataacgtcagtagctcctatccagacatgcatcagagacggtgaaagcctcaagaggagcatctacatcagtgatgccgagttagtcctccatctcagtttttcatatctgccaaaagatatttactctgcttccctaacaactttgttgccactgttccagtaacgccagctaaccgctgcctaatattctccttcctttcaatatgtgctttttgtatattgttctgttttactaataacataacaaacacttaccatccatatactttttctgccattatactataccttttaatagtaatgtgacaataaatgttgcgctgtggggagaccgagctacaagcttccctgcaaatgacattcttgaggctggccaaaagagtcacaagtagtaatctttgttgggacacttgtcaggggatttggcagtaagtacattagaaacgtttgctatcgttattagtagctttccacaaattctctgagattcttataatatgtgtacagggaatgtttctttatctggtaactctgcttgcaagtggtacataaaccttgacaaaccagaggtggctgccttaaaaaacaggttccttatttgtcctttctttgccatttatatcttgttagtttctattcctaccaccagtttaaactcacacttattggttctgtgcagcatcaaaggaaattatgaaccgataaaatatatcgacctcccagcctcatctgatgctccaaacaatgcagaacaaaagaaaattattgagatcaaggacctgcacccttttaagttcaaggtaaatctttactaatatcagtactcattattgtgtttgccattttgcaaaatagtgtgctaatcaccaccctacttctggcaaacagaaacatcagttcttgg

SEQ ID NO: 96587 - DNA, 518 bp, Oryza sativa
ggcgggctggcctagcacgactctaggaagaagatggaaaaggaaggaagaagacggaaaggaagatgatggatggaaaaggtgacagcaacgacatggttctaatttcgtaaaattggagtggcacagttatgaatatacaaattgtaatgacattttttaatatccacatttgcaatggcatggatcaaattaacccttgatctattgaaaatctatttttttaatttttacaatccattgttttacaccttcattattatcatatttattttttgttaatacatttagtccttaaggccttgttaacagtgaaatttggtaatcggcaaagacgtcatcggcttagaatcattatcggctgtagcatctcggaatcagccgatgggagttatcaagtcgccaatagtcggattccttctatattcggttaaggaaatcaatatactaaaggaagcttatccctaagtgacccgagtttaaagaggatgcggcatggcagtttatctattaattag

SEQ ID NO: 96588 - DNA, 706 bp, Oryza sativa
ccagttttccctctcaatccatcttatatccgctactatttatgaatgaactactctttgtctcataaaaaataaatctagtacgaaatgtgacatttcctgttactacgaatctgaagaagaggtagctcttatctagattcatagtgttacgatgtactaggatgtgatacatcccgtaataggtacttttttttacgggacggatggagtacctgctttctctcttctcaactatgcttatctatctttgggtacatggctctgatatgcttccatcaatcatttgtttccaccgtcgatttcctagtgagtgcatttaatgatcatacatcttattgtgtgttttggtttaggacaagcaagtttaaagagtgggtgtctatgggtctctaggacaagtagctaggctcacgggatgactcttttgcttggtcatagatcatactccctccgtcccactgtatagcaacgtagaactggatttgacatatcctagtataacgaatttgggcatatccctgttcagattcgttgtactaaaatatatcccctcaaattctagatttgctatattttgagatgggggagtaagagcatcatcaagagatacccaaataaatctgctccctagatgagttttcaagaattcctaaccagaatttatggtcctaaaatatcttccctccaacagattagataaaca

SEQ ID NO: 96589 - DNA, 650 bp, Oryza sativa
tatgggtattacgcgtgcgaattcctcatggttaatgggaggtacatggctaacgcagaggatgcaagtttctacactatggactagacaacttcacatatagatgatactaatatattgcgtttcttcaatgcatgcagttgccaagaatagaacatcgaacaagctttgatgatacatgcatcataaatatctagcgcgatctttgccacttcatccactgtgagtgttgtcatgtgaaaggagagttcttcgacccagagggtgccctagctacaagtaacgaatacaagcatcttctggagtggagcaatgctatgccaaaatataattagatagcgtatttcaagtgagaatgtaaaaaaaaaatattgtaatattttgtcaacacttttcacttatgcaatatatgtagatttctaagtatcaaaagcttgttatttactaatattattcctgcatcaatttcaattaaataattgaaaactaatttataggcaaattattattgtatcaaattttaaaatttttaacctaccttcgcaggcggtaatttgttattttttgcaggcggccgttatctatttttgcagacgggtctagctacactccgtttgggaaaattatcttcccaggcggaccgccaaccc

SEQ ID NO: 96590 - DNA, 682 bp, Oryza sativa
ctgcaattgtggaacccaaaagtaagaggtctcttgcataacatattaggcctagttgatggcactggaaggacagaaagaaagcgcaaatttaggacaaagatgtggactgtaaatctgaagcgtttgaccatagggcccaaaaaatattttggagcttgctatacctgccaccagcgccatcgtcaccatcgtctttgaacaacttcttagcagcgcctatgccaggagatggtctagtcctgttatttgtgatttgttattagcctgatgcagaattttctatctagcaatatttagaaggagcaaaatagagcttaccttttttttagcttttggaagcgctttgtttagtgccagatggaggagatttcttggcaggctggcatgatcagcgccctagtccatagaaaaagaagttcagtactcagttttgaaagatgtttgattaaaagaaaactgagaagcaaaataacctcatcctctacgtcctcttcatcctgaacatctgcatgggtctttgaaacacattctatgtccaactccttctttttcgatacagcagttgatgggctggttggtccagtctgtgcatcactaaggccaactgatggagttggtgctagagccatggaagctgggagagaagatgcttgagatgcagatggcgactgaagcaagg

SEQ ID NO: 96591 - DNA, 634 bp, Oryza sativa
ctctctctatatatgacaagatctagatctagatctagaactaggtggtggatgtgatagcaaaaataaaaaaaatcgagaatttatgttaccacattaaaccactacaacaagaggcatcaagtattacacatacatctaacatcaacatatcaaaagaaataaaattaaaaaacatggagctcttccttcacaattttggatgcataaatccatcacaaattaagatctaaaagcttaaaaaattgcatacctagtgtggaaatgagtagatctaagtactgtagaaaaatcccccgaagatttgaagttcaaaacctccccctatatttaagtcactttaggagagagaaacgtcggggagaatgaacagggctcggggagaaagaagactatataggggcatctttgcaggcggggcttatatggtccgcttccaaagatcgatcttcgcaggcggaccgcccactccaccccgggtactttttttgccggcggggttttggctccgaattacatgcccgcctgcgaaaatcgatcccctacgacgccgaaaaataaaatcagacggtcctacccaatgtgtatgaaacagccatcagtctcacatatgaagggatgcacatgcgagcat

SEQ ID NO: 96592 - DNA, 715 bp, Oryza sativa
actttaaacatgagctccaacccatattttaagagaattccaaagcaacatctccatttctgtcttcttttaatcttaatctaagtaatacataatctcaaaaatcatatattttcctttgagccatgtaaacacatgttttgagaaatcatatgattatagatccaatgggattcaacatactcaacattctgtattttttttatccatgtgttttttgaaatcatgcatttcaaagaagccttaaagcaatatcactccatttaagttagttacactcataaactggcattttctatatatatccatccctatcaagatagacacccataatgttgtttctcatatcctgcatctagcgaggtagcttgggattatatttgggtagtactagtgccatatgatatgcattgatcttttgaccttcttatggacttcccgtgcacgatatcttctgttttactcgcttctaatactttttgttacatcctattttggttgaggtggacaaaccaaagtgtatatatatatgtcatgtatatatttagaatacatatactttatcaagaagataaattacattcggcctctacacctatattaatatattaccataactaataaagaaaagaacagcaaagaaaaaaaaactaagacaacttgaacatatcatatatcattttgatagcttactcccttactggcctacaaccca

SEQ ID NO: 96593 - DNA, 518 bp, Oryza sativa
cccaaaacaagttcatgtttagtgatcattgcatcggagttcgtgaaagtagggataaaaacattggaagtagataaagtgggggacatttacattgagatttggtaaagtggagggtattctagtcctttagcttttgtattggtatgtgtggggtaggtgaaaaatgaacttattttgggacagaggtagtaactaatatgacaaaaaaaaactcggaatataatacaaaatgtaattagacccctcaggggcaatttttaataaactatggtaagataagcatgagtcggccacatttcacactgatgaacatacattatataagagtcaaaatccatgataatttttttagcagtatcaagataagtttgaattgagcatgtgaagctataatttgtagactcaacagctatttattattagttcagaaagaaggactacaggtgttcaagtcaaaagagtagttatttagtaaaactttagatgcacagaagaagcccaaaacattttaatac

SEQ ID NO: 96594 - DNA, 650 bp, Oryza sativa
gctttgcttgtgtgcttcgcgtagcttctgtcgttccgaaggttctcgaagcatggtttgcggtcgtcgccaaaggttcgaaaggccgttctctctgagcaaggcaagtcacatcatccttgagcataatgaatcccagtttataaaattattttgatttaaattaatgcattaccgctttatttaaattcccgcgttatcactgttttacttagccatgcctatttacctttgttatgaccttattattattgctattgttattattaccttgttcaccctaggataaacaaaaccccaactagtgggtactctatttatggttccactagtatgaatttaggtagatgcttcgctgattaattaggtaacaataggtggttttataactttagactttaggaattctcatatcacttggatactatggaatggttggcttatggtggaattggacatacccctctcttcctatttcaaaacccctaaaacctgttttctggtggggtttgggtgcatgccagttgtgggaagtagcaccccggacaatataaggattaagctcgggcctctgttgcaaagcactaccgtactaaccacatgtctaatgggtaaggcttaactcggtgctcagtctagtcctgaacaaa

SEQ ID NO: 96595 - DNA, 521 bp, Oryza sativa
aattgggttatccgtttatgcaaggtccagtggagcaaccacgccgagaagaagctacttgggagcgcgaagacgagctgaaggccgatgatggcgacgggagagagggagaaagaggggcggcggtgaatgccggcgacgggagaggcggccctcctcgtcgtcctcgcggtcgccggtgacgggagaggcgagcggcaccggcggcgaaagggagaggtgagtgcggcggtgagatggaaggccccctttcttgtgaaaaaaataaggggcaaaaaaagaattttggttcgggttggaaaaataatttggggcttttgggactgggaatcccatttggggggttagaatgccttttaaatgggttcaaatttttaagggacccatttaggatgtccttccattacgagctgagtttccctactagtgcctttagttagtatggacactttaagagtatctggcattgtagatacccttagtgcgcaatattggaggaacgagaagctgacataataatt

SEQ ID NO: 96596 - DNA, 550 bp, Oryza sativa
gctcgaggataaaggcctgattagttaccaaaaactttttctcaaaaacatcgcatggaatctttggacacatgcatagagtattaaatataggtaaattaaaaaactagtaagtgctacagtaacccacatgtgctaatgacggattaattaggctcaaaattcatctcgcgggttccatgcgagttataaaattagtttttttatttgtgtccgaaaatctcttacgacatccggtcaaacgtctgacgtgacactcaaaaaaaattcttttcacgaactaaacaggcccaaagtaaacattctggcaacttttttatgtagatgctgtcttattttggtttttaaaaaaatgaactcatgtgcctatgtcgtcatctccacggcgaactggttcaagaagccgtccttgttccacgcactactagaaaaagcattcttctcgacgtgagggtcttattttcgcatgccgacatgacccttagagggaaatgaccacctacaaagatataaatcggagtgaaatttgctggccgcctgcgaaaataga

SEQ ID NO: 96597 - DNA, 618 bp, Oryza sativa
acagatggaacatttgttacaaacttgagtaaggataagagaagaatgaattgagacggtgagatgggtgcagacccaaaataaatcatcatataagcaacaaactaaattaaatgattacaaggccttaaagaccacaggtacatattttagaggaaatggtttgacccacgtagtcacgtagagatacagtggagtccactggttataaagtatcatcacgcaaatggttgatgttctagattcaccgctctctaatgcaccattcggtcgccacataaccctactgtagtacacgtacggttcattctttgtacatctctctacagtgatggagtgaccaatgtttttttttttttttttgaaaactgagtgaccaatgtaaaattggctcaaacccttgcgttgtatagttttaattaacaattgaggtgaaatagacttccaattttataatattaaggtggtgtgtttttttgacagtacttcaccgttatcgaataattgacgctgttgactacgtccacctcctcactttgacaaaaatatttagataattatattatgatgatgatagttgtataataggaatatttatggcgttgcacattttaccaa

SEQ ID NO: 96598 - DNA, 740 bp, Oryza sativa
catctcgaggcggcccaactagggtttgcttcgttactaaggtttatcatgtaatttttttataggaaaaaaatatcaaaccctcttgtttattttatccatggaagaattattatatatccattcagataggataatgttttaaaaaaaggatatatgtatttaatattaaattccatggatgaaacgtggaaaagatatcttagtatttaaaagaaacaaaggatatatattccgcgtgctgaaattaatgttaggtacgttctctcatattaaggttgttttgaattgaagccaacacgtgtcctactgaatttttggtaacttcaatagttaggaaaaagctagatgtgtcaacattttcttgctaaattcttaattattaatattgatgggtcatgctatgggtgtatttagatttttataacttacatcttgatgaaattattgtcaaagggggagaaatatacaaaatgcatacttcttgaaaaggggagaattgaagttctagactcagtgaggagttgaggtccagacggtcaaggataccgggtgacgaagttggatacgagatggcatacggtggatggataccgtgtgggtgaaatctttgcaacgggcttcacgaggtgtgcgtgcaagcgtcggtgttcgcgaaggaaattggaaagtaagagtatatggtgctacagtacacgtggtactgtagcatgcatatatgtgtgcctactatgaattgc

SEQ ID NO: 96599 - DNA, 597 bp, Oryza sativa
agatgaaagatatatagcctcgatcacaccgattttcatgtagtaacaatactaacaaacaatgatcctaataggaacctagaacagtgactacagtctacagatgccgaatttctatccattatctacaaaattctcgagccacgacaatccagaattgaacagacagcttacgtccaacatggaggattgggtctacttaattcatagaaggccaaagcttagctgaattttgttcacgggtatcgcatcaaatcaaagttaaaaaacagtttagatacgctgtttggttttctacggatactcgactgacaatatgccgtttgttctgattataaactaaacaatttatattaatcaagcagtatatcatgcttctagataggtagtatatatacgactaagttgtaacttgcaaaggttttgcagccaatggaggccagtgtccaggtaggcagccatgaggctctgcccctgcttatgtaaagccactacaagcaagaagatttaaaggataattggtctgaatcaattttctttcgatttggtggaggaccaaatactatttcagacaagactaacaacaattgtgaaaga

SEQ ID NO: 96600 - DNA, 723 bp, Oryza sativa
tcagccacacgtgcattgattgtacaagtcatcacagccgaccatgatgtcatcggatgttcggtagtattccctctctctatagtagtataaccatgttaacacggttatcatgggatataaaaacttgtcaactttttggattatgataaagacaagagatggtaagtgtagtatatgtatagttaatttagtgggaagtcaccttttataattactatattgttatatttgtcataaattttgaatttgaagtagttgttacctccgttagaataattgtatttctaatatttaaattttgtaaaaagaatatttctaatgagacaagacctaacaaattaattttatgaagatatatatgctgtcgcctagcctcccatctctctatccaaatctcctagccctcattttaatcaagttttacatataaaaagtatgcatgcggtgtggatattaaatagggttattatagtcatttgtgtgttgctaatctgtctctaatttttttaaatataattattttgagacgtatgtagtatatatattttaggacgagggaatgcattatttttgactcaagatgatcctttctgagtagggctgtgtttagattcaaactttttttcttcaaactttaaacttttctgtcacattaaatgtttggacacatgcatggagcattaaatgtggacgaaaaaaaacaattgcatagtttgcatg

SEQ ID NO: 96601 - DNA, 2139 bp, Oryza sativa
  unsure (1)..(2139): unsure at all n locations
gaaataccaaatgcacaacacgagagtctagtgctaattattacaccataagaccttagacattgtcttaaatcatcggaccgagcggtccggaatacatccaaaagcagaaatagataaggcagcagaatttaggcagcggcatgccattgccacaggcaacgaccgtactaagacctactgagcgccatcgtcttcatctccctcctggtagtaggcatagggatcctccgaagcttcatttcccgcttctgattaattttataattgcaagggtgagtaccaaccgtactcagcaagccaccacagcaacaatgcatatgaaaggggtatttcaaaggatggctatggctcttttgcgtaaagccagttttgtaattcttttcacaagcctcagacctagcattgactgatcaaattttagtaccagtgtttgtattcaaacaatgacggttctgtccaccatccattgtgatcccaaggatagcttcccgccattgaatcgttatggttttctgaggacgcccactttcccccttctcaggaagtggctccaacagcatataaattcatcatgcaactacccatcccacacaagttaataacttagagactagccaagtgtaatacatgtcccggtgctcaataaccgcgagcacggctattcgaatagatttggtttactcacattgcagtggatgtacactttacccgcactccgtgactgcccaacacatgagcctcgtcccaacacatgagacgcatcacgacaaagctttttgataacctcgcattggcagtacccgctccatgnaactttacanntcctcttagcactctagggcgtacacgagtttctagcagtgagaggagttctggcgcacccgggaaagaaagactcacacatacattaagttataattatgtttaaattctctcatggcagtcctaccgatggcgacaccactgtagacacccgcctcgcggttctaccaatggctgccccaccgtagagcccctgcctcacacatcaagaaaccactatgcatggataatgcctccgctcagctatctattccgctaggtctatacccatacgagaagtgcggttgtacgagggtcgtttcatgcttaacttcatggctcggtccttaattgaccagggatggcactagcctttttccggataccacccaaatcctccatccgccccagtcgaaatcatttgtttagtttcattttcctttcacaaatcatgtcatcaatatcatggcaatgtggcgctcatgtctccacatgccgcatctcaattaccttcccaaagataattgcccaagcatatagcatttgataaatatgagtatgcataaatctagagtagcatttctaagcatttatcatagttgactagggacttttacgtaaatcatggttacaaggatttaagggtaaacaataatcaaggcatggcataatcacaagtaggatgttcatcattgcatgcaattttatttgtaaacaaaacaattttgcaattgggatcaacatgttcaaggaatagtgatgacttgccttgctctaggtcttgtgggtcttggtcttcatccggatccgcggctccctcggtctctatagttacgtgcgtaagaacaatttgaattcgattagaattcaaacaaaatccaaataatgaccgaattgagaaacgagcgcgggaggtgaattctatataggctactttattcgcgaagtggaattattcttctacctaaaatatttgtgtttcttaagaaattttgtgatttaaagtcatgtcctaagactttatctaattatctagtccttaattacatctagatcactaccgcgaattaatctcttatagagtttactaaaaataatctataataatctataagaattcatctaattgtttagttcttaaataattgatcctataattaaatgctagtattttaggtatttaaatagcaagaatttatctagctatattttcattaagcctatgattaaattctaatatttttaaatattttaaatttccccctaaatttttcctttcctttctctccctctttcttttcttttcttttctcttttcccttttcctttcttttt

SEQ ID NO: 96602 - DNA, 722 bp, Oryza sativa
agatatgttcacttcatactctacaaggtcctttgtttgtgcacattgcagggagatatctctactgtcttaaaagcacaatcatcatcttccctcccatcctaatctcatgtatatagaaaaccgctcactagatgtttggctattccccaacgcccgcgtcgctcgccccagggcgacacgggcggcgacaccgcgcgcgccgccacaaacttctcctcctcccctccgcctcgccgccgcccgagcagccgccggcaaagctgcgcggcggcaaggacggcggcggcgggaccttctccctctctcgagaagcgcggctagggcaccggcgggacctgagcaaagcggacgacggcgacagtgtccggcgccatctgggccggatgtggcggatccggctccgccggaggtggatctggccctatcgcggccagatcaggaggggcgtgccgctcttggcaggaggcggcgtgggaggcggcgaccgcgaccgttggtgggagggacgacggatccggccactctggcggcggatccagtccccctggatggctgcggccggcgggcggaggtggccgacgccgaggaggtttgtggcggaaggcagtggtgacggcgaccgacggagtcgagagggcggtgacagcagtcgacggagacgcgtaggcggcggcagcagctggtcggcgggaccggcgacggcgtgcatggcgcggcgc

SEQ ID NO: 96603 - DNA, 651 bp, Oryza sativa
atcatctcgagtgtgctgatgtgtgcctttttgcccgatttctctgcatcttgtcattcaattaacaggctgttgcatcatctcgcaagttgcaactacatttcggttatagccattatatctaaggcatactctctcatttcggttatagccattatatctaaggcatactctctccgtccccccccccctaaaaaaaagagaatatgtaaccctaggtcgagttttttttggacggatggagtatgatttaatatgctgtgtctactaaattacggaatttttcaccaacaaattcaaaaactagaaatttgttctcatgggcaagtcctttaaacttaagggagtcgtccatggaaattgatttccaagagcggtcgttatttcgcttgcccaaatcatgtgatttttacaaggccttggttgtaggcgggtctaaaacaccattgtaaacaggttcttgaccgccccgcacaaactttttttaagcagtggtgatctatgaacggtgggagtgattgtatttgcgcaggtggcagtgaagcctaagcccttctctccactaggtgcagttactcattgtgacacatcttcatcactagttactgacttttatatcatcatgtaggtcgaagctatcttgtttcaaat

SEQ ID NO: 96604 - DNA, 721 bp, Oryza sativa
ttagattccgtcgtttccggagagttcgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggatttaacctattctttgttatggcccttttgttcttgtttaccttattccttgataccttgggttattataatttgactagcatggaccttacatattggattggttcagctagatattagatgtaattgcttagccctgcttagaaacactagttcacttttgggttaactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgt

SEQ ID NO: 96605 - DNA, 1875 bp, Oryza sativa
tcagttctctctcaacacaacttggactttggttctactccacacagcccccctgattgcacaccgtacacacattacacccagcaagctgtgaattgttgcactcactccgattgcaatcaaaccaaactacccaacacgaagtgagtgtaagggcaagtacaatacttgaaattaccggttaatagtaagcttacgttggattttatcctacgtggcggagagagagtaccaagagagagaaacatcgtcgattaatctgtcgacgatcatgcacgggcgccaatgcacctagcgctggcttggagccttcctatcgacagcaccatcgacggaacaagaaattagcatgaataatcttccctgattggcttggaggaaagagaaaagctgggaaggagtgagagagaagtaattaaataattattgatatgtgtgctgcagtaaatgtgaagagacaactattatatttattatctattaagttacctccaaatgacgtgtataaatattagagtaagcagtcgtcttttttattgcccttgccctaactcaactggttaggtttcttgtggtgaaactagttcatccacattcatacgggtgcttgtatttatggctaattattctttcagtaatatgcgatagatccatcgaaaacaagacgttcgtggtaacttcgtcaatctcaagatatgttagttcagtcttgcagaaatactcatatataacagtagcgtgtgtgtgtatgttcatgacttcgttaatcaaaatttaagtttttcagaacctataaatattattcttgacttttttttcaggaatttaacgaggatatagatttgtctctggcatccatatgtctcttttagggtatgtttgtttgagcatttttgcccgacagctttctcgtttttaacatgttttccagagtactaaacggtgtattattttttaaaaaatatatatattcaagttttctaaagcataaaataaactcattttcaagaattgtaataattaatacgtaattaatcatatagtaaaaacttttctcgtttcatgtgtacttgttaatcatatagtaataacctatatgctacgattctggacgactttcctaatactaaaaatgtcccaaccaattctacattcgtcctagaaaaattgtagtttgtattatgtccaacgtttaaccgtccatcttatttaaaaaaaattatgatcaatatttttattgttattagatgacaaaacataaataatattttatgtgtgactatttttttaattttttcataaatttttaggtcaaacgttagacacggatacccataactacatttaaaatgaaacgaaggtatgcgtactaatagtatattttaggacggatatacgtagtactccctccgtgtagccataagtttccgtgtccaacatttgaccatctgttttatttaaaaaaaatttaaaaattaagacacgtataaagtaatattcatgttttatcatgtaataacaataaaattattatttataattttgtttcaaaaccgacggtccaacgttgataactgaaacccactgctacgtttaacacgggacagtggaaatggtacaaaagaagtgatgtcgggctcggcccgcgcggccccaccgcgtcggccgtcgcgtagcggccggcccatatggtccgtccgtcgctccgcgactcctctccccgtccccgtccccgtccccctccccctcccgggcccaccaaacaaccaccccgtgggccccacccccatcacgcccactccccgccctccaccgtggccgccgtcacgtgcgcgcccaaacgtccaatcacccacggccgcgcgggccctataa

SEQ ID NO: 96606 - DNA, 707 bp, Oryza sativa
ccaatgaatcgaatatacaatttcacatattctagcaaacaatgtaacattaatgaatcgaataagtagccgacacaaacaatggcaacattcagttcaagggccacatttcctcggggagcaaagcatatagcacacaactccacggtaagatagtaatagcatacgcagccacaaacttattggacgatcttgaaaggcatggttattgcaaaaaggatcttcttggttctctcactggttgagatcaaaatcaataacacgcacaaactctatgcaagtcattcacttggaaaatcaggtatgtcacaggcaccgggcatgctcgcccaggggtcctcaaggtcatgttcatcgccttgacctgcagcagctagattggtctcatcagaaagacccccatgaccgaaagcgtcatctgcatctttggcaaactgctcatttgagggcggcaattcttcgttaaactggcaataaactggcaaattcggttctagtgatacatcgtgcctccagaaagtagggtccaccaagggtggaggttggctgtcaaggaataggctgcttgcattattgttgatgccaacaaaagcatgacaacctgaaaagactaacagtaagttttatgtgatattgttcatgttaaaataagagtgagtacacttactgttctcgaggagatcatcaccaatgattggaaaggaaga

SEQ ID NO: 96607 - DNA, 718 bp, Oryza sativa
ctcgggttcatggcggggccagggatcgaggaggttctcatcgagtgcatcaacaggggcaacgccgccgtcgccgccgccgccgccgccggcgacggccagccgaggctgctcgccgcgttcgggatcaagccggagagcctgccggcgaacccgacggagaggcgcttcgtggccggcatcctgtacgctgcgctggagatgaggaactgcgtgcggaggcgggtccggtggctgaggagggtggagaggttcaaccagcggcggcgggaggaagaggcggaggcggccatgaggagggaggaggaggaggcgaggaggaagctggaggtgcaaaaggttcttgaggggtatgaggaatttataaattttaaataaatatttggcttgtttagattcaaggaattaattttggaggtttttcacagtaattaattgttttgatccctatgaaattactactttccaaagtagcacttagccttacaaagtactgaaggatccaagcttcacagtgcacttcatactattgaagggagtagttgcattttcaattgttttcagtggcttcccgtgatagaaaccattatatatctttgggctgtattgggacttatatgttctacactcatccaatttgttttttggagccctttttgaaggaaattttatttatcttagacaactaataagacggtataattagtgcaagaccact

SEQ ID NO: 96608 - DNA, 741 bp, Oryza sativa
tggcaaatggcaatggcatagattttgtggccggcttcgcttggaaggaggtcgtcagacgcccccaagtccgagcatgccgtcgtcatcgtcgtcgacgaagtggtcggggcgccatttgcggtggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacc

SEQ ID NO: 96609 - DNA, 721 bp, Oryza sativa
cgccggcaaaagatgacgtgtttagagtagtcggtgcagaaggagctccaacagctgcaagatggcttttcggcttggatgtggtccttttcaaaggaggaggcctgcgaagggcatttgcattggacttgcgagaggagccagcacccaacccgacgaccgcaggggctgcacccaatgcgacgaccgcaggggcagcacccagcacggcggcggatacggcagtatgcccaacattgggtgtggctgcggcagcgactactgctttacttgtatcacgtggtagcaggtccaaatccatggcagcatcccttcgcgtggaccgccggtcgtgggttagtgagtcaacaatgcagctatggaagacgaataactcgatggagaagaactagaggtaggcgtctatcgagcacagagaagggatgagggattgtagtatgctcaccttgcatcgtcgctgtcatagcttacggggggaggctgaagccatggtcaacggatggcggcggcgatggcggctcccggcggcgcggcgacggcggctcccggcagcacggcgacgacgactcccggtgaagacggctgcaggctggcggcgtgtcgacagaggcagccggtggctctcggtgaagacggctgcaagcgccgcgccggccggtgacgacggcttcaatctcccgacgagagaaggcagcgagtggcagcgaacagtggcgtgcac

SEQ ID NO: 96610 - DNA, 782 bp, Oryza sativa
tattatactccttgaggatgaatgaatgaatgagtgcctcacctttaaatcttgtgtctttcactttcttatagacatctgtcatgtattatgcaaaataaacccacaaataaaacgatttagatggtacccaaggaaagacatgcataaaaaaattattttccgaagtgaatatcttaagagatcctcttgagaaaacgaattatttccacgggcctaaaagaccagccactatacccaacctctccttactctcagccttcttaaaaagtaaagaattatgctctccctcatctcctcatccttatctcctcgagcccctctctcttctctcactcacaaactcaactcctctctcactcacaaactcacctcatctctcactcacggcagcggtggtgcacgcacagaggcaggtccgacggtgtggtgtgcgttgatgacgaccgccctccctcgtggatccaacgaccaagtggtggggaggggcgccagatctggtccaatgggaaagggcaatgacgttgacagtggctaggggcgatggcgtagatccgatgctgctaacctttggagggatgccccacagccggaggcctctttccatcccttgtgcctggattcaccgtcgtgagttagggtttttaggatttttctttttggaatttttatttatttattcaaaaattctttatttttcagtcgggtaaacgtgtcgtgtgtaaaaatcctattttcacgtgtggctgtgttacctgtctgggaaatccctatttctatat

SEQ ID NO: 96611 - DNA, 507 bp, Oryza sativa
gcgctcggaaacggacgacggctcgcaggtagtccagatccgctgtcgctgggcggcgggaaggccggatcccccgcttccgtgccgcggggaggccagatccgccaccgtcgaccttgctccgtcgtcggctagatttgattttttttctttttgcatgttgttccagatgatgcacatgttttgatctgtgtaaatcatgtttgattgtgtaaatgatgtttgatatgtgctgatgataattttgtatttcatgtttgaatttggaaatgagcagcgaatctagatgttgatttgaaatttgaaattaatgaatcactgggcggctgcatgagtattttcgctggcggctgtcttaagccaacgccagcgaaaatgtatttttgctggcggctggcttaagatgaccaccagcgaaaatgatttttgttggcggtcaataaccgctagcgaagatcttgatcttcactggcctttgctacattttcgctggcggctggcttaaga

SEQ ID NO: 96612 - DNA, 663 bp, Oryza sativa
tcatttcagaaataaaatggtgaacaatactctttttcttcttgtaatatgcagtagccacgaccagcactacctagaaaagccattgttttagagtttatatttttcctcaaaatacgaattaacattaagaggtttggtaccagatcacatacatttttaaatcaacgtttgaaaggaggccccgtactcttttacactcactgtgctaacatagttaaaacctctgttacgaggtataagtactgtcatggactaatctccagcagccccttgacagctctccctcgccgtgcttgtaccctgcagcttgtagtttactccaacccaagaactagtactaccactgcactgctacagccaagtggcccaaacgcccaggacacattgctcctccctcctcagaacaagtactatggacctcatacctcttgtttgatatagtacttcctccgttttatattagaagactttctaacattatccgttcatatatatatatatatatatatatatatatatacacacacacacactaatgaatcacatatatgaatctagacaacatatatataaatatgggcaatgctagaaagttttataatatgaaacgaagggagtaccatgtaagagcctcatgggttgccaatattacttaataaa

SEQ ID NO: 96613 - DNA, 1922 bp, Oryza sativa
ataatcaccaaaataaattcactagaaattttggcatgacctcccctcttttttaaagaaattttgaagcttgctcgggctggaggaggaagaagacatatatatatataggggtgggactttaggcccggttggtgttatgaaccggggctaaagatcgccgagatctttagtcccggttggtattaccacccgggactaaagttacgatcgggactaaagatcccgggggggcctgacaggccctgacagcatttgaaccgggactaaagatcaaatatgcccgttaccctttttaatcaggactaaagatcatctttagtcccggtttttgttgcaaccgggactattgtggaattagcccgaccgacgaaatatggtttctccaccagtgatcaagtgtcaactgaaacactgttgtctttgactggagagagcacctacagtgcagctaaaaattgttccattccgtatcataaaaattgttttaggtatgtcctaaattaaacttcttcacgtttagaatgagttttataaaaggcgtagtaacgtctataagatcaaattaataagttttattaaatacgtctttatagtatatttattttatattaaaaatattccttttttttaaaaaaacttggttataccttagagaaaaagtttgacttgggataaacttaaaaaaggcttatggagtagtaatatggaatgcaggcagtaccatgcaggcagtaccacagtgaatagattaaaatcgaagttagatcgatcccatcatatgtctagttcaataagaattaacttaaatgtatatttaccaaaaacacttaaaaacaattttaggtatatatatataatgtaagttttatttattcagttacgtgtacgtctattctgcggatggatatctaatatgcgtaaatcatgatatgaaaaaaaattccaacattttagcatatgcctacaggaccactgaattttttcgctctaactaaattgaatgtgcttaatttaataattgtagatgcgcacatatagataatcttttctaaagccatggcttatataaaaacgtacgtgctggcgaattgctgggaagctggaagcagatatcactcacgcaatacacctcgtccaactaatttagccgtataaaatacaattaaacagtagtgcctgtgccaacttgctctaactgttttattaattgtcagtgctagctagctaggttaatcgcgtgcgtttgcgtgagtatacctagtatattacttcctccgtttcacaatgtaagactttttagcattgcacacatttatttaaatgataatgaatctagacatatgtatgtgtttaaattcattatatgtatttaggtaatgctaaaaagttttatattataaaacagaggaagtatgtattaatataattaaaatgaattctagctatatctctcgtgctgtcgtgcacgctttctcctgatttagcgtgtgaagtcagtggctaacgtttttattgatccaaacacttgcctgacaaatcgagagttgttctgtcagctgctaaattgatcgatctgttcggggcgcgtggatacaagaagctggagcccctctcctgacctaagatatctattaaaattgtactataaaattttacaaattagaagataaaaataaaattatgtaaattatatttattgagccttaagcttagaaggattctggttccatatttgttaattaaccgagttcatctcagggtttgtttttacaatctactccctccgtctaaaaaagacaaaccctggtttccgtgtaccacgtttgaccgttcgtcttatttgaaaaaaatataaaaaaaaataaaaaggtaagtcacgcataaagtattaatcatgttttatcatctaacaacaataa

SEQ ID NO: 96614 - DNA, 696 bp, Oryza sativa
ttattcgaaaaaaaaaggtagtagtgtcttattccggaaaaaaaaagttgtagtgttatctcgtattgtatgcttctacgacagcaacatgttctgcaccaataattgttttgtttattgtgaaacattactgttacagcatcatcttctgattagtactatatacattgactggtcctttctactatgtactccaccctgatcaagtctgatttctcctgaacccagtgtgacaagtctatattgattgaccggtcctttctagactgctccactgagtggatgcaagcgagccaacccgccggacctaccacttccttacacccgccggacccaccacttccttacccatgcttttctcattctaagtcttgatggtattgtgttcttttttaaagttcatatagaagcgagattttttttttctaatatttcaacgagaactgtacttcttttttttaaaaaaatctatatttaaaaagattaggctagttatggactaattaggctcaaaagattcgtctcgcgatttccatgcaaactgtgtaattagtttttttatctatatttaaagctccatgcatatgtcaaagattagatgtgatgtttttttttaaaaaaattgaaactaaacaggcatttagctcaaaccctcattgacgcctagagatggcaatgggggcccgtttaccgttt

SEQ ID NO: 96615 - DNA, 723 bp, Oryza sativa
aaaataaatcctttatttttaaatgttatagtgtaaatcttaaatacaaccctcgagatcttctgcccacccatataagctcatacatgcttatatgaagaaatatcacaactggctacatattttcaaggaaaacaataattaaattttataaaatcctacctactccatctgcaccatattataagggattctaggtggatatgacttatcctagtactacgaatctgaacactaccagaatgagtcacatccacttaaaatcccttataatatgggacggagggagtattatggtctgttgtggttcaagttatacaaaaccatatggatttagacacgtggttcataaccctgggtattatgatcctaaagtttaacaaaaatcacaccactaaccattttggcttactcctatatcaaaatttaacactcctatatcaaaatttaacaaagtggttgtaatataagtttaaaatgtgattgtaaaacttaagaatgtggtagatcaaagtcaaaatgatcatgattatgatttcatcaaaccataatacctaagactatgtgtcacatgttaaaagttctattctgtgtaacttgaaccatataataatagattaatatatagggttttatgaaatttactttaaaaaacctacagcaacaacgctcaaaatggatgctgggtcatttaaggattctagttgcattcgagttttcttc

SEQ ID NO: 96616 - DNA, 672 bp, Oryza sativa
atgcacgatagaatcactaaaatatttgatcaaatatcagtttttaagaactcttttaggatatttaaccagcacaaattatgaccatctaaacttacggggagacacatattaacatgctcagaattttagatagaacattgagaggcattttgtcaagcagttcatgagcagcaacggcattttgtagcattaatacaaaccacacaatgctagcagtgaacatgtacaccatggtgattttcatcatcacaaaattcagaaaagccaccttacaatccgattggatgagtgtcaagcatgcaaggaatgtcaaaagccagaaacattgcaggcatcaagatgcttgactccgtcagaagcactcagttggcagaggtgatcctatcaggattcaagacatacaacaaactgaacgaactatattttcaaacactcaatcaaactctgcagtaccttccagaaatatttggtttgcacttcttcatcatttaagcagcaattgctacactacaaccaaaccaagtgataccaaattaaacagaatttgctcacctggcgctgaggggaagtagcacctgtatgctggattggggagaccgtgcactggacggatggccggtggtgccctgaacggaggacccgcgacgccctaaatcatcgatgggacgc

SEQ ID NO: 96617 - DNA, 1179 bp, Oryza sativa
cgccgccaactacagtgatggggaacttttttgttatccccgcctccacacggaaaattaatcaccgcagatcgcccatccccatttttaaaatcatttacatatcaatagcatattcttttaacatgaaaagtgtccgtccactgatcatgttacgattaaacctttggacatacataatttgcattggatttagacccttatacccgctaatcaggtcttcacagggaacggggacgacgagggacaaaggatcatccccaccgtacccctcgccacacccaacagggacaacccctagacccgacggggacatatttccaccattccgtgttctctaataagagaattccctacagaaaaaagggaagagagccccatttcgatacctatataccgacggtagtgtgatgaagttatatgggtataactatattcaccggggctcaaattctgatacctaccgatattacatacatacacatatacacacacgtaggtatactttcaatgggatcttagtgagctcggcgatttgccggccatttacatctatctatttgagctcgtgttagggagacacgttcgtaaatatgtaagtatggtatgtatgttatcttttacgtaataaaaaaagtccaatgaaggataaaagaaaagtaaatatattactagtcgtaaaaagtaattatcattcaaagatctgtaaaattatatacatatgtgcgcatgtgacaagctgcctttttttttgaatgtttcattactcaaccacttcttataagagtgaggatatgacaattttggaatcaaaattagcttggttaataatttaaaatactgccaaagcagtgtaaaacctggcctcttaaccaattcatgtgaagtgaattagaggtctataagtgttacgtacttgctttgcaggagaaatatacaagtaaaacacaagaacttgctatagccaactgtcctttcagtctttcaccatgaaaatgagtgttcacccaatcacccatatattctctagtacatgtcattagttttttatatcttcagagggatcttcacggacacttaatgatgcggtgaggccactaatcttcaattagaagatccagtcatacaatgcatgcatgcttaatgcattccaagctaagtaagttctagcattcatac

SEQ ID NO: 96618 - DNA, 534 bp, Oryza sativa
ttttattagataccacttaacattattcataatattatgtagtatttaatcgagtactaagttactatattttaagacaaatgtattatgttatcgtaaaaagaaatcagagaaaatagtgtatacgcttgctggaaaagacgtacttcttgtatggtcaatgacttgtatacgtgtttctaaaatacagtagactgtggactttgctattttaattagctggaaacgagaaaaatgcatgcatgcgaatatgcgatgcaattttgtggcgtcgcgtgcagtggaactggaacgagccaacgacgacgcgttcgcgagactagctagccaaagcacacttctctttgagctccttgaatgaatattttaagaaaccatatagttcagtgacttttctcatgcaaacgttgccacttgatagcacattcgttgaatcatgctgttctaatcctaggcaagtacggagcaaggacaagtgactcactcaataggggtcatttacttaatcagggtaccgagctcgaattcgcccta

SEQ ID NO: 96619 - DNA, 869 bp, Oryza sativa
attaagtgttatgttttgtatggtcagcaattgctattgaatagcatatataatattgttaagagtaaatttcacaaaactattaatattttgatcaaactatcataaaaatacttatttaatttatgtgtcataaaactacatatttaacgttaaaattatcacaaaaccgaatatcacgaaactactatttatattgaagttatcataaaactattgagtttaaatccatagcattgccatcatattggagctatgataattgtagttttgtgattaaattggcactaaacttagagttatgtgataaatttgctacttgatttttatttttgtgacactctatattaaatctatagttatgtgagaaattacacgttaaatctataattttgtgataatttgatcggaatatctattgttaaatgatatgtgacatacaagcatatgagtttgcaagtatatatataatctaggattatgataattgactatgataaaaattttgacatgtaaataaatttctgctggaagaataatcatcttataagtgatctttattcaataagctgacctagtttctgcaatgtcgatttctggggaaataattaaagctaatcatgcctatcactaaacagtgtaaactttttattgaaagcagtagtatcaataaggtatagtccattatacgaaatagtaataacgttggtatcttctttttctaaaaataaatcatatgtctttttcaaatacaccctattttggtgttgggagaagattgaaaggtagaataggagcaactataggcgtgccgtctgccgatgaatacatctcattttgatatgtaccttacctccctcctctataga

SEQ ID NO: 96620 - DNA, 3354 bp, Oryza sativa
ataaacaggtatctcactgttggttttctggtcatcgcactattgcgtaatataagaagtaatataatacttcctatgtttaataatacaaaaagttataaattcaaatttaatattataatataaggatttctacttattcgcatgattcacacatcattttaataaatcttgagctaatcagatgatttaaaaattaaaaaatgataactaaagttgactaaagagaaatatttttctctaacattagtacttgctaaataatctagaaagttggattatttagcagttggattcagctccccaagcactagctaggcaacatggtcgtggtccaggtcgggaaaattagcagagttgcatgcaagctgtgcaggcattgcaatgcttgggatggtgatggtttatcgtatcgaaatacaacaattgatcaggttaagaattttctttccccgattacataccccatccgtctcacgtacacactcgcaagcgcactctcttaagacatgctctgctgatgagagcacaatctcacatatgcgtgtaattatagacatcaagatttaaaattaaatttgatggatgaactctacttcaaataatggttacctcatatcagcagttttatgtgtttgaaatagattatttatcagatcatctaattaattaatcgtagtgataaattaaatactttttgaaaataaacataaattaaataacttaaagaaagtggtttaagcaatgccatatgaagaaaaatttgttttagaggcatggggcaaataattcacagtaatgatatggtgaagtggctaaaaaaacagggagcgatcactaaggagatgagttctatatagcggcccgaactccactcacacatctaatttatttttttaggttactctagtcaactcggctatttcttttttatagagctaaaattgtttgattagactagcttcagttccaaaagtgatgcagctagagccgaagctttcacaaacaaacccctaagctaggtcttgaagctagggagctgatccagtcgtttctaggaaattgaacacaccaagtagatcttcagttgagatttattctacgactctcgattgcaagtgaagccggacctgtttggcacgagagcttcaactttatttctacctcttctgaagacggaactcaaacaaacagtttgatctccacgtaaaataaaacggagcggactgaagtgctatcacaaaacaactagccagatgaagccgggtttatattgctctacaactttactctaaacgtaactctaaaaattaaatttaggagttggaaccctatcaaacgtggccatagtaaattaaccgggcaatcgatcgaactcacgtttgcgggtgctcgctttgtcccgtccggccgtgcctggcaccgaaaacgactccccccgccccgcggcgcaaacggaggaaaaagcgctcgcgcccgcgggaaaaacccatcataagctagcaaacgcgcgcctcgatcgatcgcgcacggcacggcaacgtacgtacgcagaggctgcaggttcactgaacgcgcgcgcgcctacgcacgtacgccgcatgcgtcgcgtcgcgcgtgctgcgctcgcggagacgcgggcagagaccggcgtcgcgcgaggtggtggtagtggtcgtcgtcgacgcgcacgcgcgctctcgcgcgcccgccgggagagacgccccgcgcgcgcagcttcggatcaacttgccgccggtgtccgagctagaattctactagtacacgtcaaggcgtcaagatgggattagattcagaaaaccggctgctaaacaagctaggagaacttgttaaaaaaaaagaaacagggattgtggtttaagctataaacttttgaaagacgactattaccacgtctgtgtggagaactattaatctaatttttttaggaaaaagaagtgtttttgtttgtctaatatatatgaactttaaatcttgatctcctacttaatagcagtaatttcttcatatatacatgcatggctagctttcttatgtgcatagctagctactgcaaattaaaaagaagccaaccagagagcaatcaaacaacgattatatgataaacttaacacaagtcgcagctaggatgaatatatagatagctcaagatgcagatgtgagtgaagtactgtgaactaattttcctatctagatcaccgtggcatctgctgatccacagattaccaacacacgacaccataaggcaaactatataaaacaggccaagtgatgtaggtgggggactaattaatcaattaaccattaattgcgtttgattgaaaagttaatcaagcattaataatttgcatgaattagcaaccgacatatttcctctttcatcgttctggtcttcaggactttaggtcatctcaccctccgtccctcgtactacgccttagctaaacaatcggcaaattgcacaagcatgcattcaaggttcagctcacctggccacatgaactacccaaatggaggccgagaaagtgcagtccaagacgatgatgaagaagactctggattgctactcctagccagcaattcattcatttcctaggaattcttgtactgcattttgcgtgatctaagcaacaatccagtgttattttattgctgcaacttgcaaaagttgcaagaacgactgatcaggtcgagaaacagctcacacatttcatttgtttaagactagtagacagtatagatcgagatggatggatggatggacccttggtcggtcatgcatcatggtactactcctacctttctctcacgaatctatcgatggattcagctccccaatgcaagaaaaagaataaaggtcttggtccagtgcaagaagggtgaagagaaagaattaaaagttaaacccaacttgatgaatgatagagcatggaaagagctgcaacttgtgtatatattcagctctctagctgcaactgcaatggttgatgacgatgacgacgacgacgacgacgatgcatgtacttggataggatgattgattggtgtgtccagtctgctaattcaattaattttgcctgtcctagatcgaagctcagagagtttcaacagtgttgtgtgctgctgaagtacagactatttaggccacaatttcacaagttgagttcagatctagagttgcatatggaatagtatgtactagtatatgtcatgtcgatctctcttcattgcatgtttctccaattcagtgatgaacatgcatgtaaaattgatagtactatatagtttggtgagacatgcactatcaggttcaaattgtcaaattgttgtgag

SEQ ID NO: 96621 - DNA, 572 bp, Oryza sativa
tacaaagaaaaaaaatactactactcctttttttttcccggaataatacgaggagaaatttacccaagggggggggggtaaaaaggtggagaaagttaaccatcaggcccatatatattttttaatgctggaacataaacagatctggatcaatttaaatatgaaagaaggacccttgagtcgatccatctttgaattcagcggatataaaaatacgtagctctccgaccaaccatacgcaaacaaactatttgaccacaacgtgaagctactatctctaattaatttattctatgtatttcggtaagactagtagtactatacgtagagacaaggtgaatgctactactacagtatcagagtcagactccgaagtctccaaggagcttacaatataattacttaagtattttattagtcgaaaattgaaaatgtgcgttctcattaaatattgttgccgaggttattttaggcggcaaaagccagcatgggaccaattaggcttctaatttagaagttacttagtagtttgctagtgctttggctttttagttacaaataagtatatggag

SEQ ID NO: 96622 - DNA, 654 bp, Oryza sativa
ttacgaggtacatacgcacagcttaaggtacttgatactgctactactttttggtcttttggatggacaatggagaataaattagagagtagtatggatctactatggagtatatgtcatacgttaccgtcatagacgtcgaccaacacaagaaggggacttattaattattatagcttgtatacttgctaaactcatatgaactgattaagcaacttaaaatctgctggcacttgtcaggcccatatatattttttaatgctggaacataaacagatctggatcaatttaaatatgaaagaaggacccttgagtcgatccatctttgaattcagcggatataaaaatacgtagctctccgaccaaccatacgcaaacaaactatttgaccacaacgtgaagctactatctctaattaatttattctatgtatttcggtaagactagtagtactatacgtagagacaaggtgaatgctactactacagtatcagagtcagactccgaagtctccaaggagcttacaatataattacttaagtattttattagtcgaaaattgaaaatgtgcgttctcataaatatttgtgcgaggttattttaggccgaaaaaccagcatgggacccattaagcttctaattaaaaagtactta

SEQ ID NO: 96623 - DNA, 714 bp, Oryza sativa
ttaatgggacaagtagtactgtgcatagtgctagaaatccttagatttttttaacaagattcaaatgctagaagttcttatattttggaatggagggagtacattatttcgtgtagaagaacgtgatagcattttgccccctcctgggctcaatttctaggtgagccactgctacagtagcatgtaggaggatcagccattcttgtttgcatgggaaatattgtgacgagcagccattcttgtttgcatgggaaatattgtgacgagtataaaactactgaccaataaatattgttctgacttttgtatgtggtcctgctgtatataacttgtcaatttgacatggttgaccttttttttttgtggaccatttgctactaaagaaatcttcagtggtctggaattatggtgctttctttgcatttcacaaattagcttttgcacttctgccctaagcccatcgtgtcgagagagggtatcattgactaattacacatagccaactttactcaagctgaggcatttgaagttctgaacttgttttggactgtagaacgttgcttcggactggtaactcccaatgtgttattccgtccgtttcatattataagtcgatatgacttttttcttagtcaaacttctttaagtttaaccaagtttatagaaatatatagcaacattttcaacataaaacaaaccatcaaaatatattaa

SEQ ID NO: 96624 - DNA, 549 bp, Oryza sativa
atgtgcgtgctcatctttaatatactaatattagagtataatgtgtgtgtgggcgtttatcggagtcacacgttgtgaatgtttacgtttatactatgtttttgagaaaaaacaaaattaagatacgtatattaataccactataccgatttatcttttttatgggactattcttgaccaacttatacgaagctctctctctcagtagggagaatcaatatacagttttattattttcttactaaccgtacaatttgtaaatttgtttgaacccattagatcagtgcaatattcatctcagttagagagagcaccttaattaaggccgcattctttccataggttcgtatggagattttaacgcatgcaggatgagaaggcttattagtatatgaataattaaaatttaactattataagcttctatgctataacatttaataatttgaaaaacatgctaatgaaaaataagaagttgaagtttcgagttgaagaaaataactaggctttactgtatacgtgcaatgaatcttaacttgttaagttcat

SEQ ID NO: 96625 - DNA, 544 bp, Oryza sativa
ttccatgctatctcgtgaacaatgcctcttttaagttccaagctatctcgtgatctctaaactagcgagttgctttggtgcgagtttttctgtgtagatttgggctgaaagcctgcctgagtgtctggcccgtgagagaagcccaaggctggaaatctgcagcataaccatgggccataaatcacatgtagcccatatgacactgcatgttaacaatagcacatgttaacatgcaaaaacgcccgttcaaaaaaaaaaaaacatgcaaaaacgtggtacatatgtacacgcagcataggtagcactacttgctaaacttggatatggacggcacaaacccaacgtcccaacctgccacatttccctagtggcgacgggtctatttttttcgagacaacatgcacaaaatataaaatagtacgacgtttttattgatatacataaaaaatataagttagaaaacagaaaaggacagtcacactaagcgtttacgtctgatcctgatgctgaaaaataaaaacaagcactcaacatccggaatggg

SEQ ID NO: 96626 - DNA, 572 bp, Oryza sativa
tattctagttccatttaaattattttccttttacagatcaaggaagtgcaaaaaagttatgtagctgaagccattgggccttttgcttgctcaaaagatggggtgtatctggttggtggtgctagttctggacatacttatatttgggaggtaaataaaaaaagcttcctctttctacaaaagaattaaactattcatacgtcgttctattctagctagattatgatcaacaagagactcttgatgcattgttcgatgtttgaattgggtatctttatattaaaggaaggtatggcttgtgtttatgttcgctttttaaatcattctacgaattatcctgtcatcactaatgcataattatatccaacaataccaagttcttttattttgatttatgaaagacatggggatttcctatttaaacatgtatggatctaccgaacttcaactggtttgtccagcaatacgaaatggagtttgcactaataaaagatcacatccccctttatgccccgccattctttcattaataacctagtattcgttatgctccatctttatcgaaagaatgc

SEQ ID NO: 96627 - DNA, 625 bp, Oryza sativa
tttcttaaccggcggatgataatcgtcgcgcgagatgaaggaaccgaagcaagctagggcccgggaacttcagggacaggaaacgacggcagttcacgtgcgcaccgcgtcgcccggtagcccctcctcgcattcagtgcacccacctcacgggaccgtctcacagcactctgcaccctgcagcataccgggcaccacgcgaaaacacccgaataccgcaccttccaaacctacgataatcgagcagtcacttcccaccgttgatacctatgtctcgaattagtccaatcatgtgctcaatgagagactgttctgacatcgtcgtcatcaactggtcttgggcatggacgagtaaaagcgacatcggcagcgagccgttgagatcacgcgtgatgagctcggtctgcatatcatgggctttcttcaactgtgtgtccgccctaatcatgcactgttcactctcagtcatctcgccagcccgtgctttgtcaagagcctgatacagcgacgcacgcgcctcaccagcgctcgtgatgatggtaaaaatggcggtttcgatctctggcatcaccgccccaccatccgggctgtcactcccacaatatgaagtcatgctccaccttct

SEQ ID NO: 96628 - DNA, 522 bp, Oryza sativa
ccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgctatgcttaatatcttaacttagttcctgatttcttaaaagtttttgtcgaaccttgttgagcctaaaacccgcaaaagttgttaaaaaactttcagtcctcattgataagccaagaaatcaaacagggcaatgatacatcaagtaagcaaattgaattgataaaaatcacactccattattattatagtagccccctgactgaaaacttcaagaaaaaacttgaagttagcagtcaaagaggaaagata

SEQ ID NO: 96629 - DNA, 675 bp, Oryza sativa
acaccaattcccctcccggtttccccctatttccactgcgccgttgattatagctcgccgccgataccccgtcaccgaaggagccgtcgatactagcatccatctactccctccatcccaaaatgtttgatatcattgacttttttaaaaatgtttgaccgttagtcttattcaaaaaaaaattaagtaatttcctatcatttgatttattgttaaatatacttttatgtatacatatagttttacacatttcataaaagtttttgaataagacgaacggtcaaacatgtttaaaaaaatcaatagcgtcaaacatttacggcttgtttggtaactcgagggaagaggattgagagtttacacgagggaattgatgacgagattaagctgggaatttgatttttaatcccaatatcttgtttggtagaggtgatgaaaattgatagggagtttagttggagattagatcattaatagaaacggatggctgagatttgcttagacaaagtaaaggaggaattccctcccaattacctgcccctacccaggtattgaaaaggaggaagtttcttcctcaattcctcatccccatccccccaaaattcccatgtctcccaaccaaataaatcacttaatatcctcatccatctgaactcccaatcgggctgcaggaat

SEQ ID NO: 96630 - DNA, 775 bp, Oryza sativa
tgcagcaactggtttctggtgtctgctcattatggctgcgtaagttgacctcttctcattggagatggacgatggagctggagcccctctatatatgtttttctttgatgaagagtcaggtgttggtaacattgatctcagtaatgtttttgttgcccctgtctttcctgagagctgccagggataataccaagatcaagagaagctctttgatgaacaaatacattctagaaatgtgtattgcaattgaggaagaaaattggcatctaggatctttagcattcagtatagaagactacagagcagatagtatataccctggaagctgaaggtttgactggccgagagattggtaactccttctggaaagccatttgacaggagttattttcggccaacccagcaaaaaaaaaaaaagagaggtgttggtttccatctctatggaaggaaacagtggtgaagctggaggtgtcttcagcctgaaacaatctgttcttctaagaaacagttccaacaacaaaaggatacgatctagagtgaattatatcctaccacaatcattattctcacactttgacaataatggaagaagaagcatggaaacaattctggacctttgcatggtgacaagagtgagataatggaagagcaaagcgtatgcacctcatttgagagtcagcaggaggggatgagcctttttacaagcttcttcaggttagattccagaccttgattcctcctccatttctgttttcgctgctgctggaatgcatat

SEQ ID NO: 96631 - DNA, 585 bp, Oryza sativa
ctaataagccgttttgacttattaggaaataagccaaacgatggggacctaaataaatacatgtttacttttattatagagctttgaaagatagatccatatatgttattctagttcttttaaactaaatacgtttaaagttattgatagtcaaagttataaaagattgactgcaatctttgtccaaaacgttatttcctccgtttcataatataagacattctagcattgtctacattcatatagatgttaacgaatctagacatatatacgaatctagacatgtatatatgtctagattcattaacatctatatgaatatgtgagatgctagaatgacttacaatgtgaaacagagagagtaactattatggaaccagagggagtatgcttactaaacttgaaacattagtgcctgttattttcttgagttgcttaaagtcttgtcagtggcactattcctcttggacccatttgtgtctatagattacatgatgtgtacatgcatatagtttataagtagtatgtaaactagatgaatgggcgcaccctgacgcgccgcctgtggatagttggattgcgggg

SEQ ID NO: 96632 - DNA, 539 bp, Oryza sativa
aaaaatagtttttcttcattgattttaaagaaatatacgtgtttacaatgaataggcagaatgatatcgttgtcgcataggagtgatgcgaattcgcggcaagttcacgtggtgagtgcacgacttggcaaacttacgacgagtttggagcgaattactcacgctattgattgattaattaattaattgaccattatttttaatttagcgtcattagctgtcgattaaaagtgattaaattaatttatgccgcgaagattaatttatgctcgtgtcgtcaatgaggctgagttttttccccaactttcccaactcactttcctcgttttccgcgtgtacgcttttcaaactactaaacagtatatttttttgcaaaaattatctatacgaaagttgctttaaaaattcatattaatccattttttaaaaattagtaaatacttaaataatcataagaaaatatgccgctccattttgcgtgcacgggacctcacctcccgaaccagccttcttctgctaaaaagtaatgtaactcacat

SEQ ID NO: 96633 - DNA, 621 bp, Oryza sativa
gaagttaagctaactcataattgcatgccagaagattgtagaacagaatagcagatatcaaagagcaaggcttagacaaaccagacacactagtttgagaatataatattactccaatattatgaagtaacaacttccactggaatgtaactccaatgcatagtaaaactataagctctcaaggtggcatgtaaaacggataaaaaataaaagaaattaggggaacgcattcaaaaggtcactaaggacatatcagaataagagctagaatatactgagttaacagaaacaaccaaaacaagcaatgaatgcaacaaaaagatcacaacactaaactcaaaacataaaacaaatcgctaaatactgtactagtagaatggtaatggaaccaaaagtttgtgaaacattaagggcctgcttgggagtttagtttttttttgtaaagtaaaacacctgtaaatttggattacccaaacataacagtgaaaccccctctaggacctgcttcatctgtttgtaagaactgaatcctacatggccatagcaatgtgtatgaacatttgtgtctaacagaaatttcagttcataggatcaatctggaactacaaaatttgataaaca

SEQ ID NO: 96634 - DNA, 675 bp, Oryza sativa
ccgattcaccaacccttctcctccatcggcatgtcgcgggggggaggccggctgcccccgcgcttctctctacccagctgtacctgtacctgtagtagaatcgcatttggttaatttggtgcgtcgtctcatctactgaggggatttagagggtcagcctaacgggattgtggaggatttgatttttctttttgttgttggcatacgatgaatcgaggtgctagttttatgttcgtggatttgtttgagtgtgtcctcttaagagagcctaacaatgcctattaactgaagatagacttttggttttatgcagaatttatctagctaagtcaatattggtagtgaagcttattttcccttttttccctcctggaaaatgcaagtgtagttttgaagatgtggattggggaatatgctggttgctagaacagttttttgccacattttggttgtcaataaaagaagtttgtccctttttgatgagaacaaacatatagcccttagagaatgaaatttgtagcttttaaaaaaaaagaacgaaatttgtcagtcttgatcaccttggaaatttccatactagactgaataaaatccctactggtcttcgtgatactttgagtctacagatatatggcacagtgcagttttctggaagatgtcacatgaaggaaaaac

SEQ ID NO: 96635 - DNA, 670 bp, Oryza sativa
ctttacttgttctggaatcctatatctttgatttgtgaaatccttgtgttcaagcattactttagatggttaaatgcatcaactttacatgatgtaccatgggactaaacataatttctctaaactagattatcaacatggctaaatgttatatcaaacaatataattctcaccagaaaacaatataaaattcaactgataattaaagagaggaggttgcatttattggatattagaatgtccattcgatatctttgtaacttaatgggtttatgcttcctaagagcacgttgatccatcttacgagtcaaactgtatatggtatcacatatatatataatgaatcatctaggatttgtgtcatcaagccattctatgtattccaatgtgtccttaattaaatagaaatagttccaatgcatataattattagtgtggctttgcagttcatgaaacatctaattgataaagtacaaataagatattttgaatgttaagcttcaattaacatgctaatgtagtatggggacaagactatttgttagtttcttatttaaggcagtactatttgggcttttcgcatgctctctgaatttaatggattaaatgctattattattttattatattggggtagggtaacattttcaatgcaaaataggtgttgttt

SEQ ID NO: 96636 - DNA, 2576 bp, Oryza sativa
ttcctgcagcccagccgagcggagcacggtaagccgagcggagggcggcgcgctcgatggcgagggaggccggggatccggcaccgcggtggctagatccggtgctcccgcggccggatctagctgcacggcgcagggcgacggctccatcatgggcacggaaagctacggctgaaggccgccagcggcggcggcagcggcacgagggccgcgtgccggcgagggaggactgtcgcccgcttggcagcatgctcgtgcctctctccggccggcctggtggtgtgcgcggggaggagctgtggggtggtggactgggctagctggtggctgagaagatgatgtggtggttcagcgacggttgttgtgtgaggtggtggtggcaatggatggaaatcgctggcgaaagccttgcttagcacttggctggcatgacgacggcgatgccctttggcaccgtttcctttcttggaggcgtagttatggcatttttcttcatcgctatcaatctccaggtgaaaactatgttccggtttccggacggacggtggcggcgtttcatgtcgtatccttcattggggcatcgtcttggagaaccttacccttgcttcgattactgttagcgaactcctgtgtcagctcgaagcactagatgcctaggttttggcgaggccttctccttcctggctccattcttgtattggtggcatccagcttcttcatttgtctctgtcaggtggagtcgaagctgcaacgtcattggggtgcgacgttgcttggcaacgataacatttgcagtttctctctagggatgttggtgttgccagtgcaggttttggtgcctcaggggctttggctgatgtctaaagtatgagcttggtgttgttttgctcgttttggcggtgcctccaatgatgttatgatcgccgtggagtcggagctctgggtcgctgggcggcaaaggttggcaacgatgacacgtgccttgtgatgtcaaagttgtatgccgcttcttcagcttttcgacatcgatgttcgcctttggattctgccgtcgtagtttggttagagttgtgtggtgctcagtgtgttgtgttgtttgtaccggtcgtggttgaggggcttggcgagtctacttgccgagaggttattttttctttttctgtaacccgtctagttttttacttctgcttaattgaaatataatttgcagttccctgccggtttagtttaaaaaaaaattatatgtaacttgatcatttcctttttcaaaaaacacagcatcccaagtggctagtgccgttgacttgcaagcagcaagtcttgagttcgattaccaacttgcgcgtggaaaatttgtaagttttgaggaaataaatcttaaaacaaattgtacatatatttagtatatgcttaaatgttgagctttgtgtgctttagccaaagctcaaacgatgagaaccttagccacgtactcctttcgttttttaatatatgatgccgttgacttttagatattcatcttatccaaaaactttgtgccaacattaaaaatataagtcatgcttgaataaccttaatcataaatcatcataaaaaataaataatgattataaagacgaatagtcaaacatattaaaaaagttatttgtattatatattaaaaaatgaaggtaatactacttaaaaacttatcagtgttggacaaaaatagcaacacacatagaagagagaacagcaggacgtgctgcgtcaggtggcatcgcgtccaggtgagccccgtcatacatgaatcgataaatcatcttgtgcataaatcatattgaaaacaatatttttgccaataaatacctctcggagcataatgaattgccctcaagaccagcaaatcagggcaagtggaacccagatctcaccaatcagcatcacaccctacaaaaagacatgcattcagtgttggtttcttcgaaaaatttagatcggttctccaaacagaaaaaaagattgaaattttactagttagagagaagggacagaagaatcacttctcatttggagctgggagagaaagggagagagaccaattaagaaatgatagtgaaattgaagcaataagcaaagtgcgtgtctgaggatatcaggcagaagatagatggagcttagcaccagtgatcgatgcaactggtatgaatatattgtccctagtttgagtttcgctccttttaacaaagcttccaatgcgtatcacttttgaacaaagcaaaaggcaaagctctagcatcacttgtctgggtagtttataccttacttcctccgtttcacaatataagtcattctagcatttcccacatttatattgatgttaataaatctagacatatatctatctaggttcattaatatcaatataaatatggaaaatgctagaatgacttacattgtgaaacggagggagtacttatgagcaacaggaacaaattgtgtattgccatatacggaacactaacacacctttaagaaagcgaattacgtgatgtactccctccgtttcaaaatgtttgacactgttgactttttag

SEQ ID NO: 96637 - DNA, 1324 bp, Oryza sativa
gggtcatacctacctccactccgctgaagacagatgcgacatgggggcacagccgtccgtccagtcagacatgaccggggacaggccggtcacagaccggtcatttcctaactgacgcgcgccagtcgggcacgccgcacgtctgcctctaccgcattgaacgcggcaaggggcaattggggcgctgcgcgcattaaaggtggttcagcctggccccctccccgcttgctcctcccaccagatgacagctaggcgagggcctcggagcaaagcggcacgagggcccgaggggcatggcgtggcaccccgaggccccccggccgctcttgctattcgtggggtgcgagggtagggccaggctgtagggtcacgcgacaggatgggaaggtaaattcccctcacttcgcatacccctgggcccatgtctccgacattatccaacattttatttgtgtgtaggacccaacaactaataatcggtggataggagctggactgaaaagatatcacagccatgcaagacaaagcaacaggttcattttcaggtggacttgttttttttataaactaaaccggcgagagaaactgccaattatattttcaataagtaggagtgaaaacctagacgggttactagaaaagaaaaaataaccaccagctggctgaacagctacacagcacacgccacaactcactaacaactgaaacactgacggagcccaacgtagggtgtcgttaccaagcttgaccgaaaacaacatagggggtttggactttgcaaacgtgtcatcgttgccaggcttgctgccaagcgacacagcagctccgacttcaaaccggatgcatcatccaaacctagcttgttgccaaaatgatcaagtggcttcgacttcccacgatgaacttcagccaaagccacctaagcgccatatcctattcacggccaacaacaacacccctagaaatgtagcatgtcattgttgcctagcttcgtcacccggacgaagcagctccgactccacctagtaaaatcaaacaaagagcgaaggtcgcccactgcaaaacaaaaggtggaaccagaaagtgaaggcctcatcaaacctaggactgaaaagctttgaaaccaatgcatagaccatcaacaatatccttacacgaagaagtttctccaaagcagtgcccccaaggaggacacgacgtggatcgccgccaccgctcgtctggaagccggagtaaggttttcacccggagaacggtaaggaaaggatcggggtcaacaccataacgacgccttcaagaaggggaacaatgcctataggcgtcg

SEQ ID NO: 96638 - DNA, 510 bp, Oryza sativa
gactatgtgatggacttttggcattgtgatttgtgcaattggaacctgttttagtctgtacgaatctgtgaattgtgatttgaattgcgaactgtgaattggtacatttgtgcaatatggatctacaatttgcagggaggcagagggcggcgccaaccaccctagcgccgaggttgagaagggcggcgccagccagtgccgcgaggcagaagggtttcgggctgggggagggcggcgccagctaccctggcgccgtggtccatgagggcggcgccagccgaggcccggaggcagaagggcttcgatgggtggaggaggggggcgccagccaccctggcgccgcggtcggggggggggggcgccagccgttgcctggaggcagaacagacttggcgaaaattttggggggggagaaagttggtggggcccgcaaaggaggggcgcgccagccatgctggcgccgggctatgaggggcggcgccactttggctggcgcccccttctgcctaa

SEQ ID NO: 96639 - DNA, 790 bp, Oryza sativa
gaacctgtataatcttgttgtgcacacgttgcctagcagccttcagggcggatacgaatttttagaggcgagccctttcccccggcgaactcacaaaagggggatctcacgatctcccgctagagaggatcactcctcgacagataacatagcaatagaaaagttggatgaaacactcaataatacaatatatagtcaaggcatttctggataatatagcataaatatttattcagaaagagagtttgggcactagattttaccctttaaacctagttaaatgaaatgtattattattgaatctttcaatgttgcatgtgaaaaatggtctgtagtacaaattactgtttcatattaaatgacagaaataattggctgttagtaactaaatgagtatgcaataggcataattaactattcaacatgttcagttcacaagccatacgttgtgaaagagaagatctaatgtatactatggtccatagtaaacagaaactagtagtatccctcctccaaggccaacggaactaacttgcacaaaaccagggcaaagatgatcataacatgccctgtaaatctgcgttgcaactgcctgtcacaaaaaatacatgccaagtgttcaggttgatgagtttcagatgcaacaatttgtaaaagtgtttactcgcgtaaaattgtattggacatattgtgtgactttagcattactcaagtaatatggaaccttacaaagttgtcactactaaggtcccgttcttttcttcaataagagttggatgaagattaagat

SEQ ID NO: 96640 - DNA, 606 bp, Oryza sativa
acggaaaaccgacacctattgccagttttcaaccggcactaatagagttttctggactagtggcccgaagcattcgataaagttttacctttaacttaagttagctaggggcatccaaacaaaacgatgttcctatgcaaagagagctaccttgtgtgcctcacaaacatttacatgccatgccatttcggatgatgcggtaaaaaaagctttatttttctataccatcttaaaagcggagtggttttacttccatgtcctcctcccaccatatgcagtgcatccgtacatataatatacgtaaccaccagatccaacattttattttcaatcatcatcctagctcatccatgcttatatgggacttttccgttttatccgttataacgtaacgacatacgactttattttaaattttaaattgaagaggttaaaaaatagtactccatctttcccaaaatatgggacggaggttataagaaactaaccacacatcggttgtcttcttcatgcgcctgcggtttggctattttctggtttttcctcgtatccatctgggagtctgggaccctacccaccacgcacgggcggggggcgccagtggcc

SEQ ID NO: 96641 - DNA, 660 bp, Oryza sativa
  unsure (1)..(660): unsure at all n locations
tatggccccntttgattgactgtctgacttactatagggcgaattctagctcggtacccattatactaaatatataaatatatagccaaaatccattgtatagtcataacaagatctattataggtagatatatgtaagtactacgtaaaaaaggcaattatacgtatacatgtaaaaaaatgaatattaaaatggttgtttcggttctgattatcaatttaacctagaattacaaaaccaaaaaacaacatcttcatttaagtcttggatatatgaagactacaaatatatcattctcttttaaaaagctagaaaataacatatgcttaagaattttttatggagagacttaggtcatgttcttttctcaaaaaaaaatgaagattttaccttggtttcaaactaataaacaacgtgttttatgcgaaaactttctataaaattgaananaagnttgnttntnttgaanaaaaanaanttaaattttttccccaaaaaaaaaaaaaaattttttaatattttttttaagtttgaataattaaaacttaattaatcatgcgcttatagctatcttgttttgttcaaacgcatttttaatataanagatcgggntgngttcagatatacttagngcttgataagtagtgtttagtcatata

SEQ ID NO: 96642 - DNA, 640 bp, Oryza sativa
  unsure (1)..(640): unsure at all n locations
ctaatcagcagaatcacttatttctctttcaaagaaaatcagcaaatagaatctcaggggcaaagcgcgctagaccgngcatacctcactcgggcgggtcatgctttgtcccgcctcgagatggatcttctgtccggatgcgtgtatatcatctgctgctgctatccttttggcagcttctgctctgctctgctgccttgctacaacctgtaaccatgtggatgttctctttcaacctctactctatgtactccaacagtccaccctccgctttcatattatgtggtgactcgggtatttatcagcccccctatagcagacagatgaacctcctgcttaggtggtaccattcgcggcgaagaccatgcgtcgaggtcctttgcattactgcgcccagagcatgaatgcgcagactctttggctgcgagaaactaacgatcgacctacatattaagctttatctttccacgtctctgcttgcgcgagtcgcattcattgctatgaaccctgcacggttccctagggaaggattaatgaccggctcatgcactaactaataccctattgttgcaattcattatggattcccctgaggaatgtgtgatttcctttctggtggcagaaaataaacatctcctgg

SEQ ID NO: 96643 - DNA, 640 bp, Oryza sativa
  unsure (1)..(640): unsure at all n locations
tgtttatctagtctaacatcattgagaaaaaaaatagaataatgatgaaattttctccagtattaataattcttaacctctccacttatcaaccacaaaagggatcatgtttctttattttatcaaccgtgaaatcttcattctttgccacttcggtatgcaaaaacatgagttggttgttgagctccggttgagaagaatcagcatgacatcatgattcgtccctttgcaaatatcccatcctctccctccgtccctctttctctctctcattttaagggtatgtttggataatgaaaaatgagaggtaggattaggattggaaaataaatgaagcgttcattggtggagaaaccatctttggtcggttgaccaaaatccacaatagtcccggttgcaataaaaacagggactaaaaatcaaccgggactaaaaacacaacaaccgggactaaaaatcatctttactcccgggtcatcacgtgtcagttggtgacaccaacccggactaaagatcatctttatagtcccggtgataatactaacccggactaaaaattatattgatctttagtcccggntaatattaccaaccgagactaaaatttaatacgtagtatataatctctatnccttatcct

SEQ ID NO: 96644 - DNA, 592 bp, Oryza sativa
tgtcccaaattcaagaagtgaatatgagcaggctcccaatatacatttatatgactccatgggttctaataaaatagttaatttctctttatatataagtatagaatgtataacgatctcaaacagtaaccactgatttggcaaactcagaatgtgtaaatcgtgtactatctgtgcatgtaggcagtaaaattcactgattgatagattcagcatgctgtagcaaaaccaattcaaccagtttaacacattgttttaactataagcccgaactcaggatagcacttctatatttccaggtcagtgtccagcatctgtatactattatgacatttttttttacactgagtgcaatgatcgttccttgcagagaacagtagtcctcggaattacagacttatagtagttccaagttgttccttgtttagtgccacaaatagcaggttgctccgtgtccatactgaaccaaggcgtgcaagtgtatcggcaatcctttagtcacttgtttcaggatcatctagtacttctggtagtagagtcacccatctatgtgcatatgcattgttcacagcaatcgttcacagtaagccaa

SEQ ID NO: 96645 - DNA, 544 bp, Oryza sativa
gagttgtgaggtccatatgattgcgtgtagagactatactgaatggagtaaaataacagtctgaaacacgtaaagtgctcattaccatttagttcagcctaaacaaatctctgaaaattgttaccaccatggagttgtgaggtccatatgattgcctgtagagactatactgaatggagtaaaataacaatctgaaacacgtaaagtgctcattaccatttagttcagcctaaacaaatctctgaaaattgttaccaccatggagttgtgaggtccatatgattgcctgtagagactatactgaatggagtaaaataatcccttcattcctagactggttggtggcatctgatgatgtgctgctacagacaaatttggcacaaacaaggaggcacattgtgatatcgaatgattgtactcgaaacacatgccatgcttcgaagttttactaagaatttaaccaaattgtgttgtcaccaaacataaggtactatctgtttgatgtatttaatagaatgagaccgtaagttacaggcaaggacca

SEQ ID NO: 96646 - DNA, 641 bp, Oryza sativa
  unsure (1)..(641): unsure at all n locations
caaaagttgngggtacatttgttctcgggaccgcggtcctcattcattttatggtgtctcaatatgtctgtaaccacgacaaactcttctcaatcctgacatttgactcggggacgaggataccactacgatggcctggctactaccaaaaatgatgtatatgcttgcggagtgatccttctgattaaattctggaaaggaggcgattacaaggattgttggataaatatcggattgagatcacaaaggcgttcttggagttaaaatgcaattttccttgttctcaaatgccattttgatctttatgcccccttttgctttcggcttacaatttgttggtatgctagtcggagctttctcctcggtttgtcgacgttatttgtacatgagtctgcttccaagtctagagttcagtatgaccggcattctaacatgaaatgttgtattgataataacttgcagatctgtcgagaggtcgacgttgcaaagggcaggtcgtgatgctgtgacgtggttcccttgactgcgtatattatgatgcctactatcgtgatgtggatctcgatgatcatcattattgcaattgtaaattatcttggttataacttatatttctgtactcttttatttcaactcccccg

SEQ ID NO: 96647 - DNA, 692 bp, Oryza sativa
aatcataaatatttgatttttagtactatatctgaacaaacttttgaaactttaacaatcagtaattttttaaatatatagtttaaaacaaaaaagctatatgagtaaatcgcattggcggtacacgaacttatcaggtatgtgtaatctagtgcactaacttataaaacaattatttgagtaaagtgcattagcggtccttagacttgtagggttgtgtcatataggtccctaaactcttaaaatacatatcagggcctaaaacttgtcaaagtgtatcatttaggtcccaaatcgatacatcccctctagaatcctacgtggtgctgatgtggcataccacatggacgtgacgtgtcctttttatttttgtaacgttttttattgtaatttggggagtcttcttatgccaccgttttttgtcaagaatttaggtggggccacagagaaaggagacgaaaggggaaaagaacaagctacgaatttcactggcgcccccctgcagttaaaatcgaggcccctggatgcccaagtggcttgcctcattaaccctcctcaaaatgctcgcgggactgtgagccgcaagagcgcctcttataatatttctgtcgcaccttagtcgtcggaagcatcgcacttgcgtggtcgttgtgactttgtatgtctcccgtgcttcgggggaagagggatcg

SEQ ID NO: 96648 - DNA, 684 bp, Oryza sativa
tccaactctatctcgaagggccaatgtccgactagaagctcctttgggctttatatgtctcggccctgtaaaaagggaccacgtgggtctaacatttcaaggcttgggccagtccatatataggactgtgggcttaaacgtagcctgtccgacacacatcctgggctaggaaaaagtacaccaaaggtccctcaacttgtcatcgagttacaaaatcgtcctctaaccgcaaaaccatagcatcgcttaaccagtcaaaaccggtcacaacatgtcgttcggtggttttgaccctggttttgtcctacgtggcggctgagtcagcatgggaccatataggccccacattgtcaggctgaatcatctctctccctatcttctcttcctcggatcctcctctctctctctctctaggccagtcggcgactccgcgaggcaaggcgggagaggaggagggcggcgccccgacggctgacggcagccgttgcagcccaacggagttccgcgacggtcaaagatgggcttggggaagtggcaggcggtagcgaggcgagaacggcgcgggcgtctacggggaggcaccgacttgcgcggacggcgccgccttttactgggcgaggcatgaaaggaagatggctgctcccttacggctggcggttggcgaacccgcgtactgtggaatca

SEQ ID NO: 96649 - DNA, 579 bp, Oryza sativa
attcctgcagcccagatcagagaaatacagattaaatgtaaccatgttctgatgttctgtttcctgcgtctaaagaaacaacaattcccagagcaatgaactatgttcaaaaccaattcgcgcccgcatttggttgatattgtgttcagctgtgtatcaatgttatcgcctcatctcacctagtagtaaaaaggcaattaatccagagagggaaaaggtttagttacgatgtgcgtctcgcagtcgcaggcgtataagagatagctgagcggcgaagcacggcggccgtcatcgtcatacggcgtcttctctggagacttgattcgtgaactcgaagaactacaggagcaattttctggatttttccctccgtaatcatgtgtaacatccaaatctggatagggtgaattggtgaaatccattagatgaaaaattggtggccaagcagacattttttttggataccgttagatctaaactgcacggtccacgtcgctcactaggactggatggtgtattttcttcaaaaaccccctttagtttccgagtattatatcgctcttacatcgatcgtctctg

SEQ ID NO: 96650 - DNA, 696 bp, Oryza sativa
ctatagggcgaattcgagctcggtacccatcttagttattaggttgggaatagccttatactactaagttgtaccatcccggccgggagattggtcatgacatacaaagatcggagacggtaaggtgtagttagtggctgaaaagtttttagtatggttggtaacccatatgcatgtggatgcatgcaatagttagcgcccgcctcatcacctaattaattaaactacaaaaatctacacgccggccggcacacaaatttctcgcgatgaggttagttgagtcgggtcaatattcctggtacctatggcctttccattggtttctagcgcgatttcattacgtcgattaaagaatcggcatgtgagtcttaaaaaagacatgtgcttgggaggttaattagctttagggaccagaagtgtgttggcgacagtttggagcatacgggatcatcgctagcgcgtctcttctcttttcttggttttttggtggtggtggtgttgtgcttggggtaagggtggagctggaaagcttggacgattttgaatggcgtggacgaatcttaccggggctttcaagggcgtgacgagcttcttaaacacccgaaaggtgcaaatcgatgcgtatgcgtgaatatcacactgttcatttggcccaaatcttgctggatcactttttaccacttaacaaaacaagct

SEQ ID NO: 96651 - DNA, 572 bp, Oryza sativa
caaatgactaaggttcaggaaggttgcttacacataaggacaagttttatcctatccatactatcagaatattttgttgcatattttcaagataactaccctcttatggaccataccgctgaattcagaaccattaaaatatctgaccatctgcttgtctttgtttggaaattacactggcacagactagcagcaaattcagttatagtagcctggattctgtgagtgacaacatgtgaaggatcatggcggcatgggtgtgcatcaattaagatgtaagaagacggggagcaggactcaagatatgttcccactcgtttgctagtgatccggcttccaatctgtcaagcaaaaaaaaaaagaaaggtgtcattataaatatatcacataatgaaaaggaattcaaatgattaggtaatgcaaaagtatggaataaaaagaagaatcagtgaggagatgaacctggacaataacatctggagttttccagcttttaacagattcagacagtagaatttgatctatgtggtctataaaacaaatgctcttatctagtcctggaattgatttct

SEQ ID NO: 96652 - DNA, 551 bp, Oryza sativa
aaaaaaccatttcatactttgaatctaaacaccctctatattcaaattaatagtcagaactgattttaattttttttaagtatggaagggtgtgctcaagtacatatctttatgtcccgctagctgaaaagcagcctgaactgaaaacattctccatatcatgcataacatcagagtcagacacatcgccatgctctagcttactcgatttacttcaacctaaacatgagatatacctccgggtcgtactttgattcaagatctgcagtcaagtacacttctacaatactcactccgttaaaagatacaaggcagggtttcacttatcgcatgataatcacacgattatcgcgggggtacggtaggagaaatcgccgatatggtttggatgaattttgaccaaattcaaaattccggaaaaaataaaaaaaaattgaaaaaaaatcatggatatggttcttgatttgtaattgtcaatggtgaagaatttttttgaaatagagtaagctatattcaaatttgaggaaaaaaccgagaatagtttacaaatt

SEQ ID NO: 96653 - DNA, 671 bp, Oryza sativa
attagtttgaccgttagttattgtagaaattactttgttgtccttggtatattgttaaaagctagaaatgttttatgtgtaaattatttgagttgtgaaaaccaataaggaaaattactaaatatttgttatgaatttttaaaaataaaaaattatttcattaaaataaaaaagatttattgtaaaaaaagttctgcataaaatttcaaaattacttttcaacaaatatttagtgaaaaaagatttgttgcgaaaaaacaaaggggatgtaattagtttatcacaaattagaaaacaaatttaaaatttaaacctaaataacatttagtttttgctcttaattttctggtgaaactaatgtatggatttaatcataagttttaaaaaataaaaaataataagttttattttttaagttgggcattaaatgattatattgcttgtattttgtataagttaattttttcatatgaaaatttattaggtaggtaccattgtataggatgggtaatatagttattttaaaatatttaacggtcaactaatgatcaactaacggagatgggtatagaggagatcaaaatgaaaactcaggggtatataagggatgatgtcaaattcaggggtattgaagggattgagtaaattttcaggggtatattgggaatttt

SEQ ID NO: 96654 - DNA, 518 bp, Oryza sativa
atccctagtcatagactagcgcatgggttctttagttgggagtattactgcccgccgataatattataagcaacttttagttataaaattaaatatatagttgattagataactaaaagtttatattttaagatgaaggaagtaacaattttgacgatgtcgataggctatatcgtgactacaggatttgtagggtatggtgttcgtcggtatcagggtgtacgcgatattagggtaaaagagacaataggcaagaatttatatatagtgtcggcccccttaactgacaagctatagccctactcatattagccaaatccagagttacctttatatatcaatatcttattagttcaacaattgggtgacttaatccaatccttgttagcatagaggccttgcacccttacatgcagccaacagctagtgtagtctttttcttcgaatgtgaactcggtgagattggaggcagctctagatccctcatgtttgcctatcaagcttcagataggatttgc

SEQ ID NO: 96655 - DNA, 550 bp, Oryza sativa
gctccagtcataaatatttagcaaattgtaatacatgacatacaaatttttgtgtcatatgttgttggataccgcaaaaacatgtcacggttagagaacccagaaaactaataactcttagagaaaagtttcggtccaatggaagagagacattcttttagaaaaagtatctttataggcacaagttactaacctgactctggaataaaaataaaatatgatatatattagcaatatgtagttggggtgaatgcaaattgagagctgcatctcagttaggtccgaaacttatggccccaggggcattctctctttttctaaaagaatttctctctccaatttgacaaaaatattaattctttagcaaattaccagtttttgggtgttctccaaccgtgacgcgtttttcgatatccatcacctaatgacccaaactttgaaccgcatagcaaaatttgcctaaatattttacatttaaacaagaataggttagattcttttttccagaccaataaattatgaatatcctcaaattttcttacgtttaaaa

SEQ ID NO: 96656 - DNA, 558 bp, Oryza sativa
ttacactgtcagtgcctaccactgatttagcggaagaagatatgcactgtggccatgcaaaagaacggatatcgatgggtaatttctttcaacataaacatgcttatcgatggttaatttcttcatgtaatcaggtttagatgagaccttgaggttgaatatgtggaacagcttgtgatgcgaacatcccagactcaaaaacatcaagcaaaagagctttatgttcagtcaagaagtccaaaagggaaggatcatcagactcgctatatttccctgattgttcaggaaccacaactcggagatcaaggttcctagctctgatcaatgagaaccagatgcaacatacaagggacggtctgaagcaaaagctagctatcttcatgctggagaagtgactcaactgaaagcttccagagttcatggatgggatgccacatgtttacatcggctgccgataaaatacatggagagccacgattgtactactcaccttaacattctacggcttttgacgtcagagacatataatacacagcaatttttaccttgaatgaatcg

SEQ ID NO: 96657 - DNA, 609 bp, Oryza sativa
caaaaaggttgccataagacatccatgttaacacctaatgttcacaacaaacttttaccacctacaaagtttgtaaacctagctaaattctgtgagttgaagaaaaaacagttgctgtcaaattttccactgataacatgccggctgatattggatgacaaaatatcaataatcagtgggaacatttacaacctacaaatatagtaataatactgtttgtctgtttgatactggtttgggacataagctgattattgcagagtaatctatagaatagttgttttgttgaagtgacactgtccattaatgtaattttgcctaaagatctggttttactcacaaaagcaattattttcccatatatacaacgttatttgaaaacaggttatcaaactaaatttgcacattgcattgtatgatgtctctggcaaataccaaaaaaggaagcttgaactgtatttaaaaaaaaatgcttgaccagtgggtttaagacagcccgtgacattcaactaagttgagaaaaatcccccagaccgcagttgagcacactcaacttctcgtggggagcacgcttctaccagtgcctgcgaggggggatgttttttgggc

SEQ ID NO: 96658 - DNA, 635 bp, Oryza sativa
tcaaacataattgcaaacactgagagtaaaacaaatcaaacagctaaataggagaaaacgaaggaatgtggaagtatcaacaattcaacatgtacacaactgcagatgggcatcactatttcttctcttttttaaaagtaaattattagaaaagaaaagagaaaattaacagaaaaagaaaaagaaaatagatttaagatgtgagcatacatctagtcacttaaaaatttgcagagaaagaaatctactttcaggtgatataatctgtagaactttcttgaagataaacgatagaaaaaaaactaaaatattgcactattttttattagatgttccactccgtagcatgggtccacaatcacttagacaaactatatgcttaggttaagaatattaaaactaacctctgaatagagaatagaggaagcaaccaacaccctttgtctcttagattcattaattggcatattgagaatgggaccaagcacactgaaatcacaagagtaccaacaaaataagaattgataaaaccagagtaaacgccatagtcacctagatatattatcatgtatataggaagccaactgtgtttccatcaaagttgcggctaccaactgattgtgacatatcatgcc

SEQ ID NO: 96659 - DNA, 622 bp, Oryza sativa
ccatgttctagatctatgttgttcacctattatttatatcggatatttgcacttgagcttgcatacgagtatatgacacttgtgatgttaatgaatactcaacaaacatatccatatctttcatatgcaaccggttggtcatcaagtgaaggatgacaaccgatttgttgagactaatgtctcctttgaggtgtgaaaaggaataggtcccactacgatgaggctaatgaatgacaccatgggttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcacaaggcaaaggtataatgtagctaacaatgttttcttagtcttttcccggtcttggaggttggtgtagaccggatttgctagataggcgccgtactatcaataagggtctatgaagcgagcttgttgatgatcttgtgccatattagttcatatgcatgtaggtgcattttgtgggtttgtctaaacaagtgtgatgagttttctcaagt

SEQ ID NO: 96660 - DNA, 515 bp, Oryza sativa
cattattgaccacttgaaacctgttatttgatcaacacatagacatgatgttgtggaagatcaggtagcgatcagtttgtgtaaagatatatagtatagtatcaattagttgtacccggtgaacatgcatggttggttggttttaaactttgtaaatttggttgcaaatgatcagggcaagcatgcaaaaatgattgcggttgagtaaccacttcgttattaggactgatggtgtgcattatgctttcttgatatgactataacagatggccacatttctgtaggcacaatgatatgcataataacgtgtcgacgttgttgttgcaggtatgccggtgctgggacacggttttccgccgtacgggctgccgacgtcgtcggctggtgctctctctcttctgtcatcggctagagccaccggcccatggctgatgccgacgcccgacatctccggccgctcaagcgcggcgctcgacgagctcatcgccgagaaccgcgcgggccttctctcgtgg

SEQ ID NO: 96661 - DNA, 631 bp, Oryza sativa
ttgtaagtgcgtatgtacctactggttctagtggtcgtgtgactcagtgttagattccaaaatttcttatttctaaccccaacacggaggcctcgacatcttcttgttcgtagatattttggcggcatactccccatgagtgttcaattttaagatgacgattgcttttcaaggtaacatctatttacttttgaattgacatatttttttttgttatactctcttgtttattagcttttttcatatgctagtatttgaggttgtagttttggttaatactattggatatatgtcaattcttgagaattttggtgatatcgttggcaattggatgtctttttcaaaagctttgatttttttcttgattttcggggagaattggaggttattttgagggggagttagtgcttattcgtgaattcttttggcatgatttgagggggagtttgtacctcatggtttatcaagcaatatatgacaatgagaaaaaattaataaatgagagctttgttatacatatggtattttcttgtgcatgctaacaatactttgaaggtttatttgctatagcatagcttggatgtattctagtcttttcatgagattagatttgctttaagggagatgatgc

SEQ ID NO: 96662 - DNA, 2405 bp, Oryza sativa
taaagtgcaaaaggggcaaacatattttccctgcaagagcgtgttggctacttgtcttgagtcgacttttgcaggggcacatcaagcagtggtgaactgcagagacgccagtattaggccagctttcttttctatagccggtctggtccggtggtgcctcccccgggcaggacctttgagcctgccactcacaagttattcaggccgaatcaattcgttcacattgatcaaattcaatggacgcaaggtgcttgcaccaaccaggcaggggtcagtgagtgagtcagtgatctcgatgaaagctacgtgtgcatgctgacttgaagatgcaggagggcgtaaccgagtgaggacggataatagacaacgattccagaggaaaagggagaataataacgctcacgctgagaaaaaaatggctggaacttgtaacctgaccattcagcactaaagtaaagcacacggacatggtttattttcccggatttaccaaaagcaagatatactctccatgttttttctctgttatgatttttaagccttttttttaatcttgttatggtttttagccttgcaaggtgtggttcttcgtagaaatgacagctaactttcgatccgcacaacgaggattacttctagttccgttctagtcttcaataacttcgaaaaagaaattctacagtagaagtcaacagtaagtactaacaccagtccggtcaaaaaacagtaagtaacatcagaaaaaacctgtaatctctcgatgataaaaaaatatgtggactcgcgcttcaactccagtgttctcactgctgacggcttattcggtttgaaggaattttagcccataaaaatagaaaaaaaaatgatggaatagaaaggtatgcacacatcaattcataagattttttttttgatatttgagtgtatggaaattatcctatgatttctcaaaaacaacttgaagaaaaagaaaatttcctttgatttttctataccttatacctacaaaccgaatgacactcgtagaaattaatccttaagaatccaaatcatttatttttcttcaagccgaataagtcctgacattgttgcaaggtcacaagggtaaggggatctaaaccttttatgaacaaaatttcaaatatttgtatctacctatttcctttatcttaaaatatggagtatcaacttatgcaaagattagatatatcttaggataatgaatatgtatagatagaggatctatccaacttcattgtcttaagatatgtctaatctatgtctaagttactgtttttgaaacagatggagtaataagatagtttagggttgtctttcatatcgttattaatgatgttaggatggctaggagtcaattctatttttttactacctccgttcctgaattgatgtcatctgaaaacatgtacagtcaaaccttaaaacattaaatgattaatttatgaaacaaatatcagaatttgtgagaaaataatattattaaatttgtcatgaaaataaattttacgttgttatattgtaatagctttaataaatatatttactaaaagtaacgatgaaatatgtgcattgcagactgtgttggtgttctatgtaacaagtaataatagtatgtaacaacatttatcgattaatataatgtcttattgcattaaaaaaagggaaaacctatatttgttgtaacttgaatcaatcaatcatttgatgatatagtgcaattgtatcgtaacttgttatatttacaatgtaagttgcatgcaactttcaaaaaaacatatggtaacacaatattttcgcaaaatggaggttgcgggaccgaatcccctcaccgccactggtgcgcacactatgaattttttacttttttcgtttgcacgaatctttaagtaaatatgacagttcaaaattatgtaaagttgcatacaaattatattgtagttatatgtaagttacaatatatttaaatttgtcaaatttcaaggaaaaaattatcgataaatatatatcaaaactaaaaaaatagatatgacctacacccgctgtccaaaaaaataagcatatgaatctcgataaatgcatatcagtatatctaaattcatccttagaagctgttttttttttccttgaatggaaggtgcacaacgcaacgtgccaatagagcaactcgaacaccggcaccctgcgctgaacatgttaaaaaaactttgaacaagctagccgcctagccgcttgtatccggaagaggaagagaggaaaaacgctcgaaacaaaagccggaggctcgccggcgttgcgtagcagaggcgtaccggggggaggtgaaatgcgtaactgctttgctgacttgctcgctggtctgcgtcgagcttagcgtaaatgaatat

SEQ ID NO: 96663 - DNA, 516 bp, Oryza sativa
tccttggcacaacttagactctcacacaaagaacgaaaattttcgcaattaggattttgccgagttagtttttttttaacgactcacgaaaagcggagcgttacaacctgccccgggcgtttgaaaacagagaggctcaccgcgcttgcctaggcacgtgccacaagtccgcatctcacagcctcacgccgtcacgcgcagccacgccacgcaaaagcggagatagatagatagatatgcgcgcgtggagaggatagcgggggacgacgtgacgacgagccagacgccgggcggttggtgtgtataactgcccagattacgtgcatgacgtcgagcgcgcaagggccacggttcatgtgtttgcgagatcgcgaagccttcgattcgcccgacgcgcgcggccataaaaccccgccagcgcgagtaggcgtacgcaacaatcgacgtacgcaaccgctccccgccgcgcgtgtggcgcaaccttgtcacgggtaccgagctcgaattcgcctatag

SEQ ID NO: 96664 - DNA, 992 bp, Oryza sativa
tccacttgtgttcttcaaccgcatgacgcattgttgtttcccttagtttgtgggggaggaggggggggggattgacttctcgcatgtctgcttgatatggtgaagtgaatctgattctgcatgcggatcgctgggggtgcagtccgaaggtttgatccataggaggcgtgtgttttgcttaattgcttgtgataattttgggattgtttggtgtacatcgtaacttttgttcatttcatattttataatatgtgcttcgctgcgaatttggtgcctgttcaagtggggtgcctcatttgatgaattctatttagagcttttagcataactacgtactatgatctctgtataacttgagttatctgctggaggcagaaatttccatgtggttcctacatacacgaacataaatgcattccgtaatgccattatgaaacagagttctcattacgtgcggcataacagaaccaaaactgtagggcgtatgctagtagtctgccatatttactctgtctgtaactctgtaactttgtttatgtttgtttgttatctattgaacatacccacctccaactaacggattaatagcttataggctgatatttagggtggatgtggaagccaactcaacagatttgaagccactgcatgaggggctaataaataagtctacatgcttcactttcttgtggtaaacccttattcctattgttgaattttgagtttcacgggaactcacttcgttctggattcctgtcacctcatatactttactagtagtatttaaggaagagactgggccaatcaaatggttaaatcacatgtatattttcactttagctctgaatggagagaatcattctgcattcagcgattaattattgaagtttgatttttttaagactattgatgtttgagtcgataatatcattgcgccacataatatttttgtaagaaatatgatgtaaatttatcacaggtaaccttgtatg

SEQ ID NO: 96665 - DNA, 712 bp, Oryza sativa
tcatgtatacacacaggaagaaggtagaataatcaataataaaacgagtcaaacgcttacacttgcattacggagggatgtagtacacgcatcaagctccacgtttcctcctgttcctcatgtgacctcctatacaacagggatgcatagtcaccactactactacttccaagcattatcaagagtcattaattgacggaagaaaaataaaagcttacaagaaaattcaccatacttttcacaattccatttcgcttctgagtgcaaaatgcactactactaaaatgatcaggaaaattaatatttccccgatttcatggcatctgatccactacgcttaactgggttcacggaaccaacttggttacatgcaccctaacgtgaatggattaaccattaattaattactccctcagcttcccggcagtatccccttcattcaccaaaatctcgagaaatctcatggttgaggagttagcggtgagtagtaaattgggggagcgataatgaaaaggacagatacacatcagaaaagtaggaaaaaaatgactaggctaagtagttaatgtctgtcattaatcgactggtgaagtagactcgcttgagttgaattatgcacagcaaattcgttgcttttagactagtatagtgcaagtgtttgaagacttgtactagtactacttttttatttgagatggaatacttattcaca

SEQ ID NO: 96666 - DNA, 701 bp, Oryza sativa
cgtcttctttttgtttgggggaggtttgaaaaaaacggtggcggtggtcagaccgtgaaaaaaaggctaagcatttctccctctttctttcatcctttggggcggtggaaaatgatggtgcgcggcgacgacaaaaatcggcgaaagcgggagagcgagttgtctctgcagtctgcactgacctgtggcgtcggttcatggggaggggaaaggggctcgggtcggactcgtccacaggggagcaagtgaaaggacatggaaaattgtatgcaaagctttactgctgatgcaagagagtgacttttatatattgggtttgtttgccatttttcgggttacaagcttacaaggcttgtactacgaaagcttacaagctttcgtgtttgccattttatcttatcaagattcaataaggtgggggtaacaaactaaacggcctccgtattcaaccaaaatttagcatggttaaatttgatatcaaaccaaactgctctacatatggaatttgtaccaaagcattacgctcaactctacaaaatctaccaaagatacacgcgccctttttgtttgaagaaaaagctaatagagctaaccaagtttttgtggcatgagaaccacgtgaggcaactgctacactcaagtacttggatttctaagaggtagatatttcttttttggctactgaagaaactgactgcata

SEQ ID NO: 96667 - DNA, 751 bp, Oryza sativa
ctcaaaaataaagataaaagcttttttctaccctttatcagctgctgcaatagtgccatcccactatttcagctgacaaagtggaaaagagcaaaaggaccaccaaactaaacttaccaacctgctacaagaccaaaaggaaagttcccagaccaccagaataatcagttatccataagcagttttccagcctcagtagtttgtaaaacaggaagcagcagctaaacatgataaaaagaaccatcagtagcatcttctatcttcttcttataggcatcatctcctccagctgttgtgctctgctcctgccgtgtcgtcttcattgcaaacatctggagctagaacaccacccatgtcttgcattatacacttcctcggctactttttttttttttgaaacctaagtcagccttagctgattttatattaagcagaggaagaactgtacataatcacccgcggtgattagagaggaaaaaaaaaagaggaaatacaagaaaaaacaacttgccacaacgaaaagttctagtgtgctattctcacaatgtctttaaccccacaacttcctcagctacttgctttagtagctacaccccccagagtaatcttctttcactacgcaatcatgtatcctcggagattccaatgtgtaagtaagaaaggccaaccgcctgatcaatactacatttttctaatagcataaaaagactcgaatttcttgtgcaaaagggtcatgtcattttgtacacac

SEQ ID NO: 96668 - DNA, 906 bp, Oryza sativa
atgataggtggggtccacgtgggccccaccattttttctattattgtgtgtgtgaactgatatgtgggccccatatgttttaatatttttcggatcgaatttccacgtcaatgccacgtcagatgaagaccgagtcaaattagccacgtaagcgccacctcagccaaaaacggggtcaaatactgccgatggaccttatttaaacggtttcgtaagttgggggacctgttgtacccggttttgctatcaagggacgaaaatcaaactgggcgacaaatagagagacccaaagtgaacttattcccctgaatattacacggttgctcctttgcttgctcggggcatagggctatgtgggccttccaataggccgttatatgccttaacatctcgaattgcattcgacccaggtaagatctggcctggcctggcctggtcaacaaagaactggagtaacaagggtcttgttcgtgtgcaacggcagtagttccaatcaaaaaacaacaacggcagaaacggtttcttgcgaattctgattcttggaggcttttatctgcacttctcattccgcataataaatttgacaggatatactttcctattagctcgttgggtcactccaacgtctatgttctgatcaagcagggtggtatatcatctttactataaaaacccaactcctgacattgaagtataaaaacccaacttctgacattgaagtactgaagtactccctccgttccataataaatgcaattgtgggttttagtgtctaactttaaccatccgttttatttgaaatatttttatgattggtatttttattgttattagatgataaaatatgaataatactttatacgtgacttaacttttcaaatattttcataaattttttaaataaga

SEQ ID NO: 96669 - DNA, 1557 bp, Oryza sativa
atattatgagtgggttcatatgagaaacattttttttattctttctaaaagataagatagagtttgtgtttagtatgaatatgcgatcaattacaaattagaacttggaattgtataaggataggatagaagttgagtcggaccctgtcataagtcttctcgcaaatagaaaagcatacatgttatatccacgtagtgacagtaacataggtgtggaaacgactagccgacgactgagccgatcgatggttgtgatacctggatatattgtaatatgctagtttgaaaatcatcgtccataattagtgctatgaagatgtaggtttcgactgaactcgatctaaatatcgggcatagatatcatcatcaagttttgatcttgtatgatgttcttccgtgtttagttaccgatatcgaattcagggccgattttataaacaagagggacggtcgaatggcatgaacgtaaagcaaacgttttcatattagaatcacatgaacaaaaacaattaaaacgaaaatgatagagagagagagagagagagagagagagagagagagagaggtcctcgtgggtattctaaaaatgatggaaggactccaaaatggctacaacagggagacttttacgagagaaaaatgagtggaaatgagagcaatagactcagaacaaagggtggatgtaatatcatcaaaggacaggaccaccacccatctcacactagctaattaatgggcaccttaaacatatgcaatagtagccccaacgagcctatgagacaagatgtcacaaagtaccaattttgttgacctttggtccattctcatcatccacaccactaaggccccctttgattcaaagaaaattggccataggaatttatttaggggaaaaaccttgcgggttagctcatcttccgttaacacgatgctaccgcatagtgccatgccttcggaaattggaatgatcaaagttttcattttttttccccgattacattgaaaacgtgcgcgcgcatcaccacacacaccatactcacacttatgcgagtgtgctcaataacacacgctcaaaaacaaaaacaaaaaccaattacatattgttggcccccactatatctttttttttgttgaccggaacccactatatcttttaaaagcacaattttacgtgaacaatattcgtaggcggcatgatttaaatcttagtggatggtcatgcatctacgagaccacgaccccaccatcacaacagtacacgtgctttctccgaagttttaaagtttgctaggtgaaatgccacattactgatctggatgttgatatttgagttgaattttatgaaattcttaactgaaaagtggaaaattcttaaggaccaagtcaagttggcaactgaagtatcaatattttctatatacacttgtcctcacaaaagattaaaaactatgcgcacttcttttctagaaggttctcctagtagttcctagcttggtgtgacgtaatttctccttcaaccaatctaaccaattgaaagaaaaaacactttctccaaca

SEQ ID NO: 96670 - DNA, 1577 bp, Oryza sativa
  unsure (1)..(1577): unsure at all n locations
tagttaatatagaataatttagcagcttcttcagattcaaattccataccctcgactggctcatcaatagggtccacctcaatagaatgtggattttccattagatcacaatcatgatgttctccagcatgaggttttcttggtggaaccggtccatgattatggatttttatgaatttggtaacaacccatttgtcaggcccaaactttttaatcattaacatggccttgcaaccaactctagttcctacccttgcttgctgtttctggtccacatggaggttttcacaatcacgagtttcatgaaacccctcttttgagcagacaatacgacgagaaattattgaattatcacgtctagaacgagtgtacctgctgattcgaattctaaaacctgcatgtcttgcatatttgctgtagaaatccctcgcagcatcttcagactcaaattccattccttcataagggttaattcagtatcagctccatgtccaaattagcttttgagcttcaggatcatgcatggctgaagtctccatgtcagtaatgactctgggaagttctattgaagaatcccttggctcatttcttgatttggttcccactgactggttaccacacctccaccattnnnatccacgttcagccaaatcacaacacccaagagaatcaattcccatcaagtcactaagctcaaagtagcaaagcttcagaaccatcatattgattgcagacttgttcctgtgaagaacttaggagaactggtccaaaatccgaaggtaatgattagatattgccatattgggggaaaaatcatcatatcttgtaaaggaaaactgtaatgactcgacagttataagcccaaaaccttagcttagcaaaaacatatgaaattaccgagaaaaagtactcagttactcaggcagtaagtaaatatggacatatggataccgaaaaggtatctggaacaactatttggataatgcaaaaacaaaaaacagatcgtatttacctgaattatttattgattttccataaagtacataatttaaggatcttaacaaagttagattgggaagttaaaggtatatggtgactaaaaactttaatatcaaactggaactgctaatttatgagcatcaagagaagtactctgtggtgtgaatattcttaaacatcttgaagatgaagttcataaaagatatttaaatgataatcaagtgcaatatgcggacgattagtcggatgattaaacaaaaagtggctgattaatccctaaaaatggagatgaacggtgcactggtcggaggttaaagcacctagttgtgagctctaggagataaaacaagaaattgtctaaaaaatcccttaagtttaatggctttagtataaggtaagataagtgtgaagggcgtttttttagcgtgtccaggaaactataggggctaaagtgcagagcaaacatcctagtcatattgaaagtgcacctttgttgttccttttctaaaacttactattgttgaatgtgcactagtcccatcaatgaaattaacaagatcttagaaagaaagtttcca

SEQ ID NO: 96671 - DNA, 660 bp, Oryza sativa
aactaaaaaaatagatatgacctacacccgctgtccaaaaaaataagcatatgaatctcgataaatgcatatcagtatatctaaattcatccttagaagctgttttttttttccttgaatgaaaggtgcacaacgcaacgtgccaatagagcaactcgaacaccggcaccctgcgctgaacatgttaaaaaaactttgaacaagctagccgcctagccgcttgtatccggaagagaaagagaggaaaaacgctcgaaacaaaagccggaggctcgccggcgttgcgtagcagaggcgtaccgggggaaggtgaaatgcgtaactgctttgctgacttgctcgctggtctgcgtcgagcttagcgtaaatgaatattcttcggttcccatcaaatccagatgatgctgcctaattgccaaacgccgagatactaaagcgaggtttgctctgtatttatcgtctttttttgacggcttgtggtgctgctacagaataacaaaaactagggccctgcctggataatgtatgagaaccgtgggggcagtgggcatctatccttgtggatatttgagttgagtactagcgtgtcaccgcctcaccggcctcacgcgagctcattgtcgtgtttggtttcgtgtgattaattcatcgctgtttggg

SEQ ID NO: 96672 - DNA, 1527 bp, Oryza sativa
  unsure (1)..(1527): unsure at all n locations
tacgtgcaaaattactttaaactaatttttctcttaaattacttattcaaatcatgatccgattgcaccattaaattcgttgcaattaaatctttaaaacaagaccacacatggatatattccgacggaagttttttttagcttattactgaattatttttaaatattgcacgatgtttcaccaggtatatcggaattgtttcactaagtagataaaaaatgtttcactcatttaaatcgggtgttgcttcaccttatataaaaacaattttcaacaaatagcgaaagaatgtttcagttcactgcaacatttgatccatacatagaaaaacattataagtacactaggtgaaacatttttcagtggaacaaaaaaataaaacgaattcccttaatagggggtttccaaaatatgcggatttttggttgcaatggaatatttcagttcactgcaatattagatctatacatagtgaaacattgtgagtacactaggtgaaacatttttggtggaacaaaaaaataaaccaaatacccttaataaaggtttccaaaatatgtggttaatttgttgcaattgcaggtggggcaggcactatggtggggcccagcagcatgcatgcaggcgcctcggggggagggctgcgtgtggggagcgcccgatccggctcccccggcgccggtcgcccggatagtatcattttccactttgtttctatgaaaaaaggattttgtatttattaattaatagtaggagcgatgaaaaccattggaatgacatccattggatgaggaaaatgactaaaattttagtcatacgaaatttagacgcctctaaagaatatttagcaatcacatgcatggtgaaaaaaatagtgattgcagtaaaaaaaaaacatgggcgtcacatttttagaaaaatgttttttcaactagtcatcccttattacaagttgtagagaacgaatgaagcatcgggatattgagtcaaacttttccggtacatgaaaacatacgaaaataaacaatggacaataatagaactcatagctatgctaattagaaatatttgttgacatgaaaaaaaaaaagaagagaaatatcattactttggntaacacaatgacttaataacgactcttagcctatgaaaaaatgaaagagtagcaattaaaattatcttttggactaatggttagaatcccttataaatgaatatgtatcgtctaatagtttataccgagctctacctttaaatgttacttaaaataggacatgggaatccccaaagataatactccataaaagacttgtgcccactccatatgttaatatgtacgtacatcagaacatcggcggaacatagtccaataaagaacataatgttccttcgacaaataaactattgtgaccgttgtacatatacaaatgagacggctacgcttgttcgtgtttacctatcgtgtcatctctttctatctctatactagggcattatcaatcgaaaaaaattacgggtgagcgttc

SEQ ID NO: 96673 - DNA, 574 bp, Oryza sativa
ttttccgctgcatttctgtagactttataatgttgaagacgtggatctgtatgtcaacattgtcgtttgtgtaccccggctggtcctggacggggattttaatgcacattctgcttgggattccatccgggaatttctgggcgtgacattagcccacctccctctttcagccgtttcttctccctcagcctcgcacgtgcgttgcacgcgccgagccgaaccgagagagagctctctcgctctctcgttctttctctctcccatcttcgctctctctctctgctcactcccctcccggcgccgattcccgccgccgcctctgaattccgccgcgccctcgcgtcgcgcacgctctcgcccgcgcgtggcagaccgcccggtcgtcgccgcgtcagccctggccgcctgcgccgcgcagccgcccatgccgccctgccgctcgcccccaccctgtgcgcgcgtgcgtccaagacgtggaggcagcgcgtctttttgcctaaggggttctcttctccttctcccattccccgtttcggcaagaacagagctcccttttccccctcctttttccatt

SEQ ID NO: 96674 - DNA, 564 bp, Oryza sativa
acggcgtggtcagggtgttccacagggaggacccgcagacgtccagccggaccccggtgatcggcagggcgcgggtggcgttggtcgacgcgcagctgcgcgacggcgacgaggacgaggacaaggaccccgggaggaagaggagggagaaggacggcctccggccaggtcaaggggacccgggagttcggtgaatgggtgaagctgcagggctggaggttcccggcgcgggggccgccggccaacgtcgtgcgcggccggttggccgtgcacatgtcattggaggcgcggacaggaagaggtgcgttcgtggtttgaagatgaagaggaagaacgtaggagtattttgattggtgacagcgtagcaagaataaaggatttgtcattgttctctctgaaaacgaattacttcgacttattttcttttactgctttgcaattcaaatcaattactatgacacaatataatatattaattagagatcatatatatattcgggatgatggtgaacaaatagtcactgctacagaaaactacataggatcatgtgactgcaagtagtt

SEQ ID NO: 96675 - DNA, 538 bp, Oryza sativa
gtcattttaacttattaaaaataaaaattaacttataagtaaattttacaaaactacgaatattttgatcgaactatcgcaaaactatatatttaaaaatttatatcacaaactacagattcagcgctaaacttatcacaaagcaacagatatagaacatcatatcacaaaactacagatttagtgataaaattataaaaaaactacaaactttagagtttatatccgtagcactattgaattgcaaaagttattgttttgtgataaatatgataaatttattttttttatattataccttaaatatgtagttttaggaaaaaaatacgatgataaatttgtagttttatgatacacttttttaaatctgtagttttgtgatagattgatcaaagtatatgtagtttcgtgaaattttctcttaatgtataggtaaaatttttatatatgtgttcctagcgacttaaaaggtgacaataaaaatagaactacattaaaaatatattaaaatcaacttcaaattgaaatttcaaaattt

SEQ ID NO: 96676 - DNA, 510 bp, Oryza sativa
cgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcttcggctcaccccgggacaacgacgacgacgagaacggcggccggagcggaggaaaacggcggcgcgggtcgggatgacgatgatgacggtgctccggcggtcggcggacggagcggagcggcggacggggtcggcggcaacacggcgaagcgcacggaggtggcgccgagtcgggaggaggaccggagcgacgacggcggcggaacgg

SEQ ID NO: 96677 - DNA, 1182 bp, Oryza sativa
aaacacaccatacctctcttttcctcctattctcatgatacattacttagaaatcataatttattattaaaaaaatagagaacagtatcatccaaagcatatagtgaatttttgatcgacttatttttgttatattatttataactaaagttaaagacacatattcacaatattcaaacttttgaaataaatatgtttgattttggtttatattcttacacttttgcgtacattcaaacaattataaaaaaaattatgaaaaacatttaaatgttcatattttaattattttatgaaatatatctaacttataatctattgtattcctttatttaaataaaatattaatcacatataaaagttatattgtagtgctaaatacatggtgccgacatatgacacttaatgccatcatataataattgatgacatgaaatttttttaaataatttcacatgataaaaaggatcaacttggtgtcaaatatcgcttgacaaatatattacactaattcaaatctacatgcagggagaatcatatgatcatcggtttaacttaaattattcaggaaaaagcaggaaaataaagtctccaattcctcaccgtccccataacatgcacacaacaccaaacgcccccttcccttttagcttaggctcttcgcactccactcctccctattcctactttttagctatcaaatttaaagacaaactatgaataatattgaaaaacccatattttaagctatacatctaatttctaatctaattgttgctctattaaataattaaacaacaattcatgatccattatgcattttgaacataaaataagagttgtataaagtaaattagaaaaatagaaaaattccaatagggattgaattaaatcaattgggcagaatataataaatttgtaaaaaatagttattacttttcacaaattggaacaaccatatatgttccatcgccataaccatgtttaagtgcttagatgttaatgaccatccatctatcttatatcatgtcattatgagtttttcaacgaattattacatatataaaacatatagttggttaaaaagttatctatatgctactattaactttaagtttaggactcatgttgactaggtatgtttttagaaaaaacactaaagatcacatatataatagggaa

SEQ ID NO: 96678 - DNA, 609 bp, Oryza sativa
gcctaaaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacaaccgtgattagtcttacccctagttagctatcgaactggtgtagttcaagtggttggttgggcctgttgcaacgtggtgtagcgttagacaatgattggttaatattgattaatactacaactgttttactgctttcaactactgcttttaaatgctagctttatgcaaaaggacctttagcctcccttggatatatcctgcatcata

SEQ ID NO: 96679 - DNA, 1837 bp, Oryza sativa
atgctttctttaaggagtctctctcctatgaaatttggtgaactctctatgcaaagcagattatggacatctttacaaagattaacagaatcttcaaattatacattgaccgctaaatacacacacaatgtttagtgaatcttatgacaatccaatccaaggatggaacatcgtttgtatgtgggaatttctatgctcttgtcaaatttgggttttataccgttgtatggttcaggtatataccagttagcggtatagaagcgttacccgttgatctgtttccagaagattatcatgtctttctcaatgagagggcaaatgtgactgattatagtaaggtagttttcgtggaaacgaaggatcttactccagtagtgctgtctgcctttcaaaatgattatccatttaatgaaatgtttggtcctataccggaaacagagagtcctcataaaagaaaatggttactatccatgggtttaggtataatgatcactttccgcttatcggtaggtgtgctacctgacataaacgaaattctactaaattgaaaaaatgaagatgaaaccaaatactatgataggattgattggattaaatagataggaatgattggattgaatagaacaactatgaaacataatagttgattgaatagaatgttggtctcacaagtcggtacggtgtgcatatccatccttggaagaagtagctccgtcccagtctttgtcggaacttgaatcgaggtaggcaaaagaatccttactcggaacgagcccaagataaaaggtctagtccaattttagtcttggttgtacatcggtactacgcacggtaggcatttcttcccgttatcgggacttgcacttgcccggccttagtggtattttaatgattttcttccccagcaaatcaagtaaatagaagtaataattcaagtcccaccgtggatttgaacatacttcgcttcgtggagccgaggattagatcgatctgaactttcatttcttccattcgcagtaatcgttggttttgtccaattccttcaatcatcactgttttgttctgtaattccatttcattttatctattttcttcaagaaattccattgatgtgcttttctattgctctcattcattcctattcaatctattcaaaactacgggtactggtctcaatgggaaagagccctaattcaatatgtcgtttctagagtatcagcaagtggtaagcggattacaagcaagcggaaggtttgaattgactagcttgatccctactattaacaaggaagaagtaagcaagcaagaaagaaagtaagttcagtctcttatttcgaagttcgctgtgctcttgtcaatagacattctgctggaactcacctttatctttagagatgatgataaatattctttagagactcctctaaataaaagaaatactttacaagaaaataaaaattatgtttatacggacggaattcggtctatcctttattgaatatcattgggcctgcctcctatctatcaactcattactctcctttgttctctggtaagctctcgcattgccttaaaacaagcattctttcgtattcaaagaaggtttgcttgcatgttctagcactggaagagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaaccttttggagttacctagtagcattggaaaccttatgttcctttgataccttggcttctt

SEQ ID NO: 96680 - DNA, 760 bp, Oryza sativa
cgattcatggcactctgcattcgctcatcatccaataataccacgtgcaacattcgtaaataagctagtgtaacatcaaaaaaaatatttattgggacatcaaaatattgccatgtgcaacatttttaaaagattcatggcgaccttaaatttaaaatgtgcaacatagtcaaattctgactgaaacattgtgcatcagacgctcgatcacgggcattgcgaaactttccatcggacgcccgatgcccaaaaaaattcactctgtcaaatgtttcagttgatcaacgcgtgaaacatcaagttatacatgcggaaaaaaaaatcactagctaaaacatttaaaaattttatgaaacatgatacagatacacgttggaaatatcgctatcacatgtgaaacaactagtgttaatggattgaaccatatgtttttcttttatccaaatataatcatgcgatatcttgtgaagattaactaccacgaatacaacagtgttatcggatcgtagattggttattaggttacaagaaaaatcgttttgaaactcgctaaatgcatacatgcatgcatttgcatgtatgaggtggagagggagaataatgatcgggtgctttgcgaatttgtgaaacacgcttaagacacatattggaacatattcctatcacgtatgaaacaaaaagtgataatgtgatggaaccatataattatttttctcagaattgatcatgcgacatcttgttgcaaaaattaatatttacg

SEQ ID NO: 96681 - DNA, 757 bp, Oryza sativa
  unsure (1)..(757): unsure at all n locations
cgatgattgcatctctgctgtagttcatcattctctttgttttttggcccaataaattttatattcagtccaatactccagttgtacgctaaactctttggattgcactgtgttcagtaatatcatgaattggttcacttttgaagtgaaaagaacacacctgactgggttgacagagggaactatatatatgactgaaaactttaaaaaacacggacgaatatgctatgagagtcctatatttaacatggaaaatgatgttattgcttcagactatttgcagcatttagcttgccgtagctaaatatagcattcctctaagcctcaatcagtcatttttgtcatttgacttagcatagaatgtagttctttggtcactgatatctatataatcatatcacaaaaactgcactaaattatatgtgtaggatgaatctcattgtaccaatctcatgtcagccatcctttattttgatatattgatggtaaaagctgggaaaaattgagcatgaagtgctagctacttataatattggaagggagtgtctctangtcaaatgtgcagattatacttgcatagaatcacatgagggaggtctagcccattatttcttgttaagatctttgtaacatcttgcattgggggcggcttaccatgtttattttggcatttctaataaactgagtcaaaccagtgatatgtgtggagtaacataaccatattttgaccttattcttttctctttaggtaaaatgc

SEQ ID NO: 96682 - DNA, 669 bp, Oryza sativa
  unsure (1)..(669): unsure at all n locations
agtttgttaaggggtcaagtctatataggatatgtaatcgtactgttatggcaactaataaactaatcaatctccaagctcatataattatcgttccccttttctcttcttcctcctacgttccctcttccctatgcatattctttctttcttgtatacagagccatcaccaccgttgtatatttctttacttggtctcagaatgcactgaacgtttctactttttatgtttactaaaatagaaagcacaaattgtttatttgacaatggtattagttgtatggagtattgtgtttttaaatttgagaaatgaggaggtaacggttaagatgcttgcatgacattactttgacattaaaccttgactcaaagtgcttattgccagggactcaactttaggatgtgtttattgccctgggagaaaaaaaaaaataccaaaatatattgaaagcccttcctgacttaattaaaagtcgttgtattgtgtttaagttgatggcaaatgcaagagctggcacctataaggaaaatgaggggtgttgaagcaagtgtagagcaccaaactttttctgcaacaaccctatcttccatgggaaccactgnggtatttggtttgctatagaatgagaaccattgtgtagaatttcgcaaagaactttaaccattgtg

SEQ ID NO: 96683 - DNA, 683 bp, Oryza sativa
tcgggaatttctgggcgtgacaaggggtcacatatagttggtgtgctttgtgaactgcgatcttgacggtgagactgataggaaaatgtctgaaaaatggggagaagccgagtaggataggactcgaaagccgagctattaattgaatcatgcttttgattgaacgacaaaacatcgatctgttaaagtcgataattctgattcgtcttcggggtatgccgtaaagatagccgagaccgaggataggtgccgatctgttttacgggcagtaagtaccgttgttcgaaaggaaaggttggcattgcctaaaccaaggataggtttgaccctaggattgggattttagaaaaaaagggatagcgctcgtcttttctctactctagcgtatggactcgtcccaggattgccggagctagcattaggtgagattcctttgattgaatttagcttgccatcatggtacgctgcagttagattaggaaccgtataggcggcctcatatacccggaagctttggattcacggatccgaaacaagacatattcactgctactgatatccctccctttgctttgagccgaagataacgataggatttccggaaccgaaactattattaattataattagattgcgaactcaggagggcttagtaccagctacaactatcaaatccgttaagg

SEQ ID NO: 96684 - DNA, 3027 bp, Oryza sativa
agaaactttgccacacctctagaaggtcctcgaatcgactatctgccctcctcttttcattggtttgtttgcaacggtttcccattctcctatgcccctctaggttaaaaatagttgttgttttggacaaggacatgggcacggtctccaaaaaataactttgaccactacttttatatatatatatatatatatatatatatatatatatatatatataggacactcatatggggcaccatggtatcaaatgcacaaaatcacttaaatttttcaaaattttcaaattgtgagtatatacctagttataagaattcgattcatacctatacctatcaacaaataactcaaatttaactttatttcacaatccatgattacataactaactaattatatatttggatgctatatacctagaatcaaaatctaacaaaaacaagttcaaattcagttcaaacttgctttgaactagttagtaaagtagttaatgttaatacctaaatatttgaaaaagtttcatactcatttgaattgggtatatactcaatttcaaccatggtgcccgggcaccatggagcaccaaacaaatttaattaccgtcctgcactccattcttcaggccacctagaatagagatagctaagctagacgacaggcatacaaaccaaggtttcaatgtgtgactatatttaatcactccaattttcttttgactcgactatttgatttatgaacaaattaaactgatatgcttgttgatcaaacaagcataccatgcatttggctctaactactgccatcattggataaatgagaaaactgctctcttgcccaatctttaggtgggattccctcaggtatcctagtgtttgttagattttctcaattcccccatagtttaatggaaatctgtgtgttttcctcaaagtcttctgaattttccttgttttcatctcaccttcccgtagattatttgtaattgcaagtactaggctattattttcactaacaaaaagctgatcatacctcaactaaattaaaagacctagaaatagcgtaggggctacggtcacacgaaggtgtgactaatgaactagtgactgtgattgttctttgtcagatatacactgttaaaagaccataatttattaatcaacacagaatctactgttttgttggaattgttccataagtgagttgtcagttatgaacacatgctgtttattgttcattttgacatgcatgaagcattgaacacatgttgctcctgtactaactgccttattattctttttcttttagctcgtagtttggtggtgcagcatttggggataatgcggatcctgctgtaaaatgccttctgcggatacaaccatcttaagagtgcgtgtcagttacaggatacgagggcacagcaggcccgcttgaattccttctccatgtggtggaaaatgcacctgcactggagattttaacagtagatgcagcctgtgcctgataaaaggggaactttttaatgctttttgtcaggcttctcgacatcacctcgttcggaggctgccgcctagcaaagttggtcctgctgtgagataaaaggatttatttgtactcaggaagtcaggatatgcgaggtttaagtagcaggtcattagtcaattactactactacctcccatctgttgctaggtttctatatattgtgacagaagtagtaaaattgcttttgccaatttcatttaacttcactatgtaatgctgaatgaagtatatgtatgttcatgaagcaatcccccgagaaatgctaatcttgaaattagatataactacatcttccgttgtatgctgccagtgaactatttgccatcccttgtgcaatttttgtccaatgtgtcaacacatactgtcaaagcgtttttccagcttggaaaaagtccactttgactcccttaaaaggtacgttgaatctaattcgtaccccttaactagaaaatcagattagacgactctctcgaactattgaaaccagtgcaatttgactccctcagctgttttggagggtggttttgttgatgtggcggtattgacccggtctttgttccacgtggcgcttatgtgacgttagaattaaaaatatatgtgggacccacttgtcattcaaacaaaaaaaatgtggggcacacttgtcatcctttctccctccgacccttcttcctcactctctctcccttagtgcaatttgactccctcagcggttttggagggtggttttgttgacgtggcggtattgacccggtcttcgttccacgtggcgcttatgtggcgttagaatcaaaaaatatatgtgggacccacgtgtcctccctctttctctcccttatctctctctctctcattcagcatggcggcggtgggcgatgggtgcggctacaggaggaggccaaggatttggggggaggggaagggggcaggcaggatcgctggggatgacggttggtctgcaccgtcggtcaccaccatcgtccattccggtccaccaccgccggtccacacctgcacgcggcgtcgcccgaggcggccgatgcaacaacgacggcaatcccatctcttcccctcctctcctgttgtcgccgctcgttgatgttgctgacgagggatagtagcgactccgtctccatctcttccctctctcttgcttggcggtgccagggtcaagcccgtcctagtcggcgtcgaagttgggggcacgctccgcctcagtcttgtctcgggcggcgacgtccacttttcctggtggctgcggaatgggtaggttaggagctctctcgcccccgcagtcggttgcccggtcgactccctgttggcggcagtggcagcggcagtctcattgggggactaagagacagatggtggcggttgaggaggccggaagccctggagcggctgctttcgcttttaattgacgggcggtcgttctcaccttctcggcagctacttgaacggagggagagagagttcacggctagc

SEQ ID NO: 96685 - DNA, 1540 bp, Oryza sativa
agagatagatccggtcaccggttgccgacgcatgccggtccccttaccctccgccggatctgcaagggaggataggagagccgtgtggcaccggcgtctcgtgccacctcccccgaatctgcaaggggaaggaggggagggggcgggcgccgccggatccgcggcccccaagcctcccctccgccgaatctgcacggggagggaggggagggtgcgcgctccgcccccgctgttgcctgtgaccgccgccaccgccgcgtgctctcctcccgccgcgcgccgccccctcccccggatatgcaaggggaaggaggggagggggcaggcgccgccagatccgccacccccaagcccccccccttcgccggatctgcacgggaacggaggggagggggcgcgcgccgccgccgctgtcacccgtggccgccgcgtgctctcctcccgccatgtgccgcccgatccaccgccccctcccccggatctgcaaggggaaggaggggagggggcgagcgccgccggatccactgcccccaacccccctccgctggatctgcacgtatgggcgacagcctggagcctgtcccctatttttccttgcggtttcacttacgatccgtatgggaaaaggggggggggcgtccaggaaaatctattctgtagtagtgacaacccaatggttgggtcgggcctgcacaggactgacccagttaagccgtgttgtactagggctgggccgtccggccccaggccttttggcattctatggatgtgtacattgtccgattggggcagtatcggatgtacgggagcaatgagccgggaggggagtacaatctgagcatacaggatccggactcccgaacggacgcgcccgcgaggagcgacacgctgtagcagtcgacggataaattttggcaatttgaccttttaaaaaacttatttgaagaatagaccatgtcaaaaatttattacaaaaatatatcaaaacctcagcgctaatgggtttagcgctgagttataatatctcagcgccacatattttggcgctaaaaacctatccgagtagccactatacatcatatcattggatctgagcgccaataccacaggcgctaaggttttggtctatttttgcaatatgtttttgacatggcctattcttgaaataaattttctaaaaggatcaaatcactactggagaactaatttttgttgggtcaaccaaaaatcacaatagtcccggttacaaaaagaaccaggactaaaaatcatctttaccctggttgaaaagcccataaccattttatgatctttagtcccggttgataacatcaactgggactacatatcattttcagtcccggttgaaaaagtgtccgccctcctacccgttttattcccgtttggaaacaccaaccgggacttaaaattgcgataatatataatcccgagcacttatcctccaaccacctctacccttatcctcgtccactcttttcttatcttctccctttcctctcgctcttttcctctaacttat

SEQ ID NO: 96686 - DNA, 590 bp, Oryza sativa
tctggaaccacggtcccacaacatatttacttttaatgcgataacaagttactttccttttcttttaagttacttatatagtatatgtaaattactttcaggcttcagtgaatttacttttatgactaagaagcaatttaataaaatctaaaagtaatttagataaattataaaagtaatttgtattttttcataaaaaatataatcatgaaatcggatcgtaaatcggatgagtaatttaagagaaaattctataagaacaaaaaaaaaatgcatgcacttttgggtgtactagactaatagtaacaatccagcgtacggtttcgtcgtagactaatagtaacaatccagcgtacggtctcgtcgtagtcacgtgaaaaaaaaataatagtgttcacagcttgaaattttccctctgtgcaagtcgaatttaacttttctttctaataaatatagtaattttgtattgtctaatttttatcctattttttgatataactattaggacgacattttgatacagtgcaccgtttggcatatatgccttgtgcagaaccttgtcgccggtggcgcggacaccagtgcagtga

SEQ ID NO: 96687 - DNA, 680 bp, Oryza sativa
gaattgaatggaaacggccgtatgacatggactgtctagcagcctctccgtgcgacactgcacggtctcacgctgtgatagtgcgagaccgtccatgtggtcattttcacgtcacggttacgcgggatcaatagtatatttctattgaacaaattacattccgcatattcttgagaaaagatgaacaatatattttcaaatttaattcccgagtaaatcacattggatggacataaactcgttaggtgggtgcaatttaatatataaacttgtaaaacgcttgttttgttgcatggtcttatctaattcgtgcaaactaggaccaaaatgtcttagcaagattaattttaccaagttgatgttgattagtatgtgacgttcaaatatgcagtgagtgcataacacatgctatatttataaacttggtctctactttccttcatcattgaaataatgaatttcatatcttcctatccttgtatcatagctcgattttcatatgttcatcgacaatcactgcctcattctatcttttaattgaactaaatgtatgtttaaattgcaacctttctcagatttatatttacgtctagtatcctaatcagcacctaaattatcaagattaacaatgtaatgtcattttagccctagttcgcacacacttgataagttcgtgcacc

SEQ ID NO: 96688 - DNA, 735 bp, Oryza sativa
  unsure (1)..(735): unsure at all n locations
attccaaattacagttatttttaaattgtattcgtacttgaactcttctttattttttttctaatttcgtattttatattattttatttttattctgaatttntaaataatctcgtattgggttattatgtggactcttgttttaaattccgaatctaagttatttttaaattttatttctactttaacttttttcttttttctaattttgttttattttatttttattttgaattttaattaatctcgtattgggttcttatatgaactcttctttcaatattgcttacttttaattccaaatttcaattatttttgaattgtattcctacttggatttttcttttatttttcttcgattaatgtggaaatttctagccccacagagaacatgatacctccattcaaagctgttttaataatatataatcgataaatatcattactattcacgatattggctggatgccattgaaatttttcaaaattgaaaccgtgtcatcgccgtcatactttacattatcacaaatcatatgtatgtcacagctcagttgatttaaaaagggatcctaggggaatcatcgggcatgcccttgaagtcttgcttttgtacctgtacgtcaaataatggagtagcatttatcccgtgcataagtattgtttcacggcttaatgactactagtgtactgtgtccatgaggaaaatgcaaatgaaatatataaggccaagcatgt

SEQ ID NO: 96689 - DNA, 828 bp, Oryza sativa
gatttaacatatcaatcaagcatgtaagatataaggtagttaaatcaggtaagaacggctgaaaccccgataaaaccctaatcggcaaccaaaaagcaggctagagattgagattctaatcatgacttataaggtcaaattcaactgatgcagctataagtatgaaaagaaggaaaatatctagacaatcaagccgttggatgtttcataggatggtggatatcctatataatctaagtcaatattggtatttaacctaatcggctaccttcaacgatagatgttagccgattgaaggttaaataacaatattgtcagagattatatacgatatatgataactcgacgaattacataaacaagattagagtgtcgtaaagatggaagcactaatcccgagaacgcatgccgccataacaagctttacctctagttgaagatcgaaaccgatgcagctcaacccgaaagcaagaactcgtcgaaaataaacaaaagtaaagggtggcgatacgctgagattgtattgaatgtctgtttttttattacatgggttcgggctctatttatacccgtgatacaagatatgtccgtgccggacacgacatctatctctaacaaactctaaaataccgtaagtctttgcggcagacttttgtccaaacatatctccaaggaaattacatgaaatatcctaattaatagatacaattaccttccgagaactttatctccatcgcggcaatcctcgtgaagcaccttgatcgattctagaagcatcttcgaaatcatcatcatcggaatcggctgcaccacctctaccggctgtat

SEQ ID NO: 96690 - DNA, 817 bp, Oryza sativa
gcggccggcttatgtcgaccgcatggaaagatatttttccatgcggtccctaaagccgcccgcatgcgatgatctgtgcctatatatagggagcgcggggagccaaaattttctaagtcccggctcccgcgaaaccctagccgccaggctgccaaaatttcccaagtcgccatcgccgtcgtccccgccaccgccggctcctcccaaaagtcgccccgccccacgccgccgccgccgccgccgtcaggacctctcccccctcgccgttgccgtcgccgccgccaggacctctcccccctcgccgttgccgtcgctgccgccaggacctctcccccctcgccgtcgccgtcgccgccggcaggtcgccgtcgccaccgcacgaaactctcccccctcgctgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtataattttgagaatgtttaattgtggattgttaaatggagatttatgtttaaattgggacttatgtttaaattggg

SEQ ID NO: 96691 - DNA, 586 bp, Oryza sativa
cgaattcagcccaaccgcccagccagagtatgttcccattagaagcatgtgggagagacagaagaaaaagaaaataattctactttcgtttataatattttttctctatattttcagatcactacttgtagatatattttttatacgtattagtgtaatgcatttagatacacgtagttatataaattatcatgcacctatattttttaatggaatgaactgtgagttttttatttcattgtgacacatttcatttctcaacggttttgatataaaatatttattcatctcatgcacgtcctttttttgtgagtggcatgcgcatggttatatctatgggcgacattataatgcctgcacgttgttgatattttatacggtctatacatcctatatttatattataccgtgaataaaataaatatatattcatttaagttgtatggatgaaccatacagaagatatagaacaaaaaattaataagcatgcatctattaatgtatacaaaaaatttgtctatattttttcttcatatctactcggcttcaaatattttcccagtatattgagatcgtgttcctttgc

SEQ ID NO: 96692 - DNA, 703 bp, Oryza sativa
  unsure (1)..(703): unsure at all n locations
atcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcnagggaataacctggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtct

SEQ ID NO: 96693 - DNA, 577 bp, Oryza sativa
attcctcatggagtgtacatcacgtgagaatcctactggacgtgttgtactaaaattaaacatgccaaagttcaaaaaaaattaaacgtgccagttgccaatttacaattttaggtacagcacgccctatacagctatatgtacctaggacaattctgtgctgttttgtgtgaaaagggacaaaacaaaatgtaacacatggtgtttatcatttgttacacactattagttctcgtatttctcttttgatttaatatatgttggataagaatgaatttattaactcgtcaaatgaactactccctccgtttcaagttataacatgtattgctttaagtttgactaagtgtatagtcaaatatagtaatatttacattaccaaattagttttattaaattaataattaaatatatttttataataaatttagcttaggttgaaaatattttttatatatataaacttggccaaacttaaaacagtttaatttgatcaaagtttaaacatcttataacctgaaatagattgagtatgtaacatagttcaccaaccaacagtgaatgcttaccacaaata

SEQ ID NO: 96694 - DNA, 583 bp, Oryza sativa
ccgtggttcttttgcattttagcttgatttaagggctcgtgctcaagtccgatcctcaaatggctcgggtcggggctagtgcctggggagatccacatgtcgagactggccaggccgggaacatggtgaccgaaggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaagaaaaacggcacagacacaacctttaggaaaatgaaaccgttttattggaatgctgaaataagaaaaagtaagactgtgcatgtgtggtagcccccggctaaccctgcacacccgaggggggtgcggggttagcccgagcccgaaacctgacacccgaccccccctttcccttcagggtagaagcgaccaaagtgctcgatgttccacgggttcggcagttcaatgccgtcgcccgtgccagccgtaccgagcccgggcgggggacccccatcactc

SEQ ID NO: 96695 - DNA, 1268 bp, Oryza sativa
atcgtgggttctagatggtctcttctttcaatagtctttatttttctattagcaatttatttatttataaattgtattcctagttaaaatgttatttttctttttctaatttcaatttgttttttatttcgaattttacttgatctcgtactgtgttttatacggactattatttttatatttcttattttcttttccactttatgttgtttcaaaatggtattcctacttgaactctacttttaatttttctaatttcagattttattttattttttattctgaattctaattaatctcgtattggtttcttctatggactcttctttcaatgttggttatttataattctgaattaccgttatttttaaattatattcgtacatgaactcttcgttatttttttctaatttcgtattttagttatttttttattccgaattttaattaatttcatattgggttaattattatctggactcttattttaaattccaaatctaagttatttttaaattttatttctactttaacttttttcatttttctaatttcttattttattttatttttattctgaattttaattaatcttgtattgggttcttatatggactcttctttcaatattgcttatttttaattccaaatttcaattatttttaaattgtattcctacttggattcttctttcatttttctctgattaatgtggaaatttctagcccccaagtgaacgtgatacctcctttcaaagctattataataatataatagataaatatcattactattcgcgatatcggttagatgccactgaaatttttcaaaattgaaaccgtgccatcaccgtcacattttaaatccttccgacttcttccttcttccttctcttctcctctcctgccttctcttcgtctcttctcctccctatagttcggtcatgcctgctggtcctcgatgaacggctgccacgcctactgctcctccccccactgccctggtgcgctcaccggccgatgccgtcaccatcttcaactcctcctcatgcgagctccggggaggccgaatccaggcgtgcgtgctccctggccggcatcattgccagtgccatctgcaccacctgctccttgcacgagctctagggaagccatatccaagcgtcaccgtcatattctcttcacctcctcctcctcgtgtgagctcccaggaggccagattcaggcgcgcgtgctccccggccgacatcaccgccatcttcaccacct

SEQ ID NO: 96696 - DNA, 606 bp, Oryza sativa
agatgtcgaacgaaaaggttccatcgaacgcaccaatagcgcctcaagaaggtaacgctcctcaaaattccggtagcaataagcatccaggcgcttctagtgaagaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacat

SEQ ID NO: 96697 - DNA, 517 bp, Oryza sativa
tcatacttttggagaacttccagctatcaaaaagacaaaaagctaggcgcacctctcctaactattgcccataaaaaataatatatttaatattattatatattatatatatttgcccttataaaataatatatttaatatatattaattcaattttctattgtgtgaagtaaaagaagaaaaggtctaggctccgtcatgacggaatctaagataagaacctaacagaacgtaaaaaatgaaaaaagattctagactgttaatgtcttggctctggaaggagatcgcgtgcaagtaaactaacgtcgttcgttcggcgaccccgcctcacttcacttaacagaaagggggccctattgagaattacgagcatcgcataacagaaaatctatttacaagctattgattctccgactaccaattctcaggtctgtgcttcggttggagtcttggtccgcgggtggaggttcgcgagggggatattctgaaccagccgctatggcatattgccagccga

SEQ ID NO: 96698 - DNA, 576 bp, Oryza sativa
agatcttgttgctaggggctcaaccctggcctgcctgtcccgggataccggtcgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttataaatggctttgggcaactaagtgactttaaatgctgtttactgcaaaacttaatccctattattattcccttgtacctcccttgcattaattatgcatccgccggtgtggcttgctgagtactgtggttg

SEQ ID NO: 96699 - DNA, 788 bp, Oryza sativa
cgacacatatagatcgacacgtgattcagtataaacatgggtgtacacatatatgtctatagttctctttccggtcgagaagaaaacaacgttttggaaattgagacagtctatagaccattatattgcaaaatatttaaaacttaaaagaaacctgatggaattcagacatcatgagagcgccctttgagataaattaatatacagatatgagttttattcatcttacataaaatatttgaaacatattgttctccgaagattattattttttatttattgaagcgtttgcaaaacacaattaatcatataaacctggttggggtcgtaccagctagtgcaaatcaaggtgcacttcttcttgtttttttatttttttgaaacatatcaaggtacgcttcaacttatttaccgtttactaataacctgtgaaatgtggtggtcaaggttcgaagcaaaaattcttcatgttgggtcaaattacctgggtttctgtgtgggctgaacactttggccccatgggctagaatgctggacaatctaatgggctagtcgacctatctggctcgatcggtaagtttaatttgtagccatggatcagccagatgtgatctagcccatggttgagttttttttttcttatgcattttattgattatagataaccagacacatatcgcatgagttatccttagtgagaagtcaactgcaagtacaagcagttttgcataaaggcctcttgaagatggccaaattgacatgagctcatgaaaattgctatggacgac

SEQ ID NO: 96700 - DNA, 500 bp, Oryza sativa
agttcaactagagctaaagagaattgttctactaaagctttgccatatgaccacataactgcaaaggtgtgttacagaaatcttactctattactgaaacatgtgattgttacaacatttcacaaagttgactttcaattgtagcaatcaagcattaaaagctctgtcaaaaggactagaactaactgtgtggattcaattttaccacctgataaagccaaacaggttagattcaaactattatgctcttttagttctagtattaatgctgatcaagcctgctcatccacttttgattctttaaaatttttaacacaggggcctcagagaaagggagtattagagaatacttcatctaaatcagtatgtggtttccattgtttatgataaaataaatattcatatgctcatgaatgacaatgctcctagttttgcgaatgacaatattgggtttctcaaaatgataggatcaaagggtggtgttctggttttcattgaat

SEQ ID NO: 96701 - DNA, 987 bp, Oryza sativa
tctcattggctcgttttttctcattggcgtgcggttccagtggacatcagactatccgatgaacacaatcgcgctcagccttggtgagtactagacattctagtgaagtcaccaacacacataccgattgatctcatcaacccatgcggctatcggttcatctcacgttccgatcacctaagaactcatgtacaatataattgatcttatctactacacctgcatatcaactatatgcaatgatctagatcataaactatacaaggcggctctgatacgactgttgggatatgcgtagactacgatagcataaatcaaaattttctatcgtgtaaaccaggaaccatgcaagtattagatcatagatcgttaccactcgacgcgctgcgcagcagaagaagacgctgagaaatcgaaggaactctcgcgaattagcgcgcatcgatgtataggaagtagtcgatcgcaccggctcgaccttctcctcctcgtgcgttctcctcgtcgtactcccacgtcaatcaggactgcaaaccagcggcgactctaccagtatccacacgtacagggacggaacgccatgcgcagatgtgctagcacccgggcgcggctagggttttgcttggggagggaactgacggctagggtttctcacgtgatgcaatgcctccgccggtcacacccctcacgaatatataggatccatcactcgggcctccaaggcctgtaggactcctattcggatccctatccgaattaagctcatattggatctccatccaatccccttattccggcccattaagcgtgcgaccctgtaggttcatgtatactcggctataacccgaaaactcctttttggtccacgtgtcaacagcggcccctagcagaacaaattgacccaccgggtatatataaagatcatatcggctgaacctctagtgtatacttgtatgaacccctttgcctcacgatatcaattaagct

SEQ ID NO: 96702 - DNA, 695 bp, Oryza sativa
gtacgcttactccctcgatgctcgagaagttttggttgcaaactgtacatataaaaaatggttccatggtagattgggccaatgcagtcccttcataactacatcagtacatgtacatggatagaacatcactatgtgattctagctgctatatacatgattctccttaattagtatcacttatcagttccattttttatccattaatttgcattaaacaagcttcaagaaaacacctgcttcggtccagatatttgaaaatttgactagatttgaataaactttgaccaaatccaaaaaaaattggaaaaaaaccaaaatttttgaccggcatttgcttgccaaaaaggggcgaaattaccaaaccgaaaatataaatcatcctcagtatataatgcttacatccctgtcccactctcatgcatgaactcgactgaccttggacgctgcaccattatctgtttataaagtatcgcagtggacatgactacattgcgtatgtttacgaccaccttgctgcgcgtatgctaatccatggagatggctcaattttaagagcgccggagacagcatcggcgccgtctgccggtgcagagatagtatgatacttgctcacctttctcgagaacgctggttcgattagtaagtacagatgaattgaggaaaagtctgtagaaaatgggtaaagttacaag

SEQ ID NO: 96703 - DNA, 508 bp, Oryza sativa
  unsure (1)..(508): unsure at all n locations
cgtgtgaggtannnnnnnnnnnnnnnnnnnnnnnnnnnnnngccgctcgtgggagccgccgctgcgaggaattgcctcatggtttgtcgccttcgtcgatttcctggctccctcaacacccggacacccaagcgccttgccggtgagggccgccgccaagcttccgccgcttgccgaggccgtgcactgccacttggagcttgacaccgcaagtcaaagccatcccccgaaatcaggttggatctcatctcatctcaccaattgctccgtagcaatcttgtggaatcctagttgtatttatggggttgatttcatccgttcttgagtccaaatcgaatccgctatgtctttcgtgttgaacttggtatccgcccttctgtttttgtttttgtttttgatttggattgtgatggtttgagattttggagagaatgtgggattctatttgtgtgatatggaattccgactaggatttggggggcggggtgtgacgggacgaaaaatcacc

SEQ ID NO: 96704 - DNA, 644 bp, Oryza sativa
ctatatgtttgaacaaacgttactacgctacgagctttatatcaaggcttgtatgatcaaagaagttgattgggactaaaccaagatcttttctaagtctactcatatctcatcatgtcacttttggtctatagaagacaagagataaattagatctacatattttggatttagattcgggtctcccgatagtataaacttcaaataaaccgtacctatccgttcatctaaaaggaatcttaattgggaccaggagtacttgtcacaaagcttaggacaacaacaatgcacgtatcttgcctaattaggcaataagtagcgggattaaggtagtaggtctttgtaaagtgagtctcatgaggaaaaagtatcggtttttcacagttattctttgtccaactcagaatgcagtagaagcacgtccttgtgttgaaaagagatagatattatttttttattcttacaactgggtcataaacttactactaccacttctacaatgcttattgccagtcataggaataatttattgcctaataccttctttttcttaacatcgtggacgcccttatggattctaaattaaatggttttggtctaacgccaaaattccaactagtctgacttagaccttggatcttgta

SEQ ID NO: 96705 - DNA, 801 bp, Oryza sativa
gatgttgatgaattaatgctgatgttgatgaattaatgctgatgttgaatttctatgatggtgagatattgatattgatgaattgatattgaggaatttctgtgacgatgaatcatgatttcttgtatgtgcgctggggagctgctcgatgagccgatgcatcgagccggtttttttttttttttttttgctcctgtgcgcctcaaaggtgctggttatggaaccggcacctataaccggcaccatttaggatttttgtagtagtgctgatcaatcatcgcatgcgctaattaaattaataattcatcttaggaatcacagcgtcaacagaaaaatcatactgaattcatgaaatgatcctgacagatcatacacgattgtacatgcataacgttatcatatattgtcatcaagaaaactcaaaaggtactattcactaatatttgagactatctattatttttcaagcagttgagatttttctcttgttcatcagacactcttttagtactagatcaatatgtatcaacaactcacacatttatgtgtttctttaattatctcgaggtgaaggagcgaggaagggtctgtcctaaaacttaaaaaagtgtattggcataaattcttatcagtatatatgaaacacaaagttatgaactgtattagcataataatgcataaataattattcagaaaagaaaaaacaaagcaaactgaaaattacacttcgatcatttgtactaataattaattgaacttgcaaccttaatttacattgtataagtgtgcgtaggctatgac

SEQ ID NO: 96706 - DNA, 709 bp, Oryza sativa
atgcatgcgcgatccccgttatttcctagccaatagcaaattaagatattacatgtgggttataaaaacttgtgtgcatgcatcaatgtccatttactccaatgcacaaataacgaatagacttaatgaataaacacaaatatgtatatcatttaggaatagcttcaaaaagactatatgtagatcaatttggaatggatggagtattaacaaatggtcgaagtgtaattttcagtttgcatttttttttattttctgaataattattgatgcattgttatgctaatacggttcataactttgtgtttcatatatatactgataagaatttatgccaatacacttttcaaaattttaggacagaaccttcgctccttcaccacgagataattaaagaaatacataaatgtgagttgttgatacatattgatctagtactaaaatagtgtctgataaacaacagagaaatctcaactgcttgacaaatactccctccaaccctaacattttacgccgttgacttttctaaatatgtctgactgtcttattaaaaaaattaagtaattattaattcttttcctatcatttgattcattgttaaatatatttttatgtatacatatagttttacatatttcactaaagtttttgaataagatgaattaatcaaaatgtttaaaaaagtcaacaacgtcaaatatttagggac

SEQ ID NO: 96707 - DNA, 743 bp, Oryza sativa
gcttggtggatcttcagaataacgatagctgtgcattgatgaaatccaatttacacaataccaggatactcgcagatcgggcacactacaagcagcaacaattgcgaccacaaagacgatgacccaaggaggacttgccggccaccattgagagtttcaaccaagaaattagaaaaatggaaatggaaggtagtggaaccctacccctttaggtcttgttctgctaatccctctctcacaagtggaccgagaggatttggaagggatttattccacacctattatggtgtggaatcgttccccctcaatcctctccaaacccccctttctcttagggattaaacgaacccttatggcagtgatgaactgctgttgatggaggggaatagggggccaaactacagagaagctaggggggattttgaatttgcctaacttgttgattgactgaaattaaggagagaaggcgatgtactaacctagatcgattcaatgcgcaacaaagaaacagcaagaagaatcagcagaggttaattgacccacctgtgtgcaaggaagaacggaggaacagcactgccgggcgccggcggcgggcagccgtcgtgtgcaaggaagaacggaggaacagcaccgccgggtgccgcggcgggcagcagtcgccagattgggttttccaattctgttacaggagagtactatggagagggagaggtttagggatgtggcgtggaaaagtaggtccg

SEQ ID NO: 96708 - DNA, 666 bp, Oryza sativa
tttagcacaaaaattcgtcaaacaaaaacgaacaatttaacatcagccaaaaggtcaataatatcaacacttaaacacgctgggagtagaagttagcaaaaatctagaaaacgggggctcctaatgcggggatctctaattagcgcagacacgctggttagagatctagcgtgcgttttggcccacgtcctcgcgcatgatttcgttacggcccacttccctttttctcgacacaagaaaatagtggagagacttgcgaacgtggtgtgccgcagcgctggattagtagcttttacgtaattacttttctgattattgtgttaattaatctttcctctttttcacgaggttgtttcttttttactaaagatttacgtgaaatttgaaactttctgcaattaaaagtcacacccataatttaaaacaactcaaaatttaaactttcaattcaaattttgaaaactttcacctcgaattttgaaaactttcaactcgaatttgaaaactttcagcccgaaatttgaaaactttcaactcaaattttaaaaacatttaagtcaaaacttgaaactttcaactcaaatttgaaaactttcaagtcaaaacttgaaaactttcaactcaaatttgaaaacttttaagtcaaaacttgaaaacttttaactc

SEQ ID NO: 96709 - DNA, 688 bp, Oryza sativa
agggtttgcccgtatactagagttgatgtgtttaagaccattgattgtactgaaaaataatcgtttgcggtggtccaaatcgcaacaatggcaaatttgtccggttcaaagtgaaaagatatatttaagggtggttcaaagtgaaacttaggtaaaatgtttttttacgagttttagagatagctaaaagtaattaattaatcaagcaagtggatccgatcatatattgcatcttaattagggcacacctagccaaaatgatgccacaatagaaaggtaactttacacgttggtttatatgattctagagtattggttagatcgatagctaggaacacatcgatgatgcatgtccaacacgaaacacatccatgatggattgatggacatgtttctccaaccaaaagaaacaaagatttcaatcaatctgtactccaagtctccaacacatgtaggcaggacagtcttcttgatcaatcgagccgaccgagcgtgctaactttaaataacccatccgtgcaaattatataaatattatttttctaattataatctcatgtgctgtactgtacactccaattatatatgtatactgtacactctaattaatttgactaattgctaataaatccatgcagaataagaaggctgcatgaatgtacagtgcacttatagaagaatcgtcctg

SEQ ID NO: 96710 - DNA, 1015 bp, Oryza sativa
tatattcctgctaaaaatggttgccacaaaccatctgtaccacatgaacacatgattgccaaggtaacttatgcaaatctcactatgctcaccatatgcatttttacattatatatataattaaattggccttcaattgtagcaatcaagcattggaagctttgctagaaggtctgaagctagtcagagatacatggaatcaactatggcacatgaccatggaactgataaggtatacaaactaagcatgcacaaagattgaaaagattgatacaagtagaaggtctgagttattttttggttacaggttgatatgtttgatcaagttgacattgactgtacaaatgaatttgataataactttgataattcatttgccaataccaatgctaagtcaaatcatgtgcaggtgcggtgtttacttgaaaagttttaattgaggctttcacaatttctaaatattgacatttatcataagttgcagcaagtacattctattagttctgctaatggcaatggtcgtcgtttcaatccatctataccatatgaacgcacaaatgctaaggtgacttaggaaaatctcactacataatgagttctgcttgatttaaacaacaatacctaattttaatgaatttcaattacagcaactaagtggggaaagcttaggcaaaaggtccataacaagtcaaatgaatgtggaatcaatggtgccacgtgagaatgtgaccaatgaggtatatacaactaagcacgcaaatatcaattagtaaacttatttggcaatactgtgatttgtttgattttttattcaggcttatgtttctgaacaagatggtactgatattatgaatgggtttgttcacaaccgtgaggaaccacatgccaatgagaatgctataccaaataatgtgcaggttctggaatgtctactttaaaaatgttgaatcaaagtttgccaatgtcttaattctatcatttattattacagcaattatgttctgttagttcaact

SEQ ID NO: 96711 - DNA, 983 bp, Oryza sativa
gagtggaagccctgatattcaactttccttttgaagaaatattatagatttccttatagcagtttagaaaaacacgcacaacaagctgtaggatgttatatatgtgtgtgtctattgcactttagttttccagttagtcgtatatgtctatttaaaattacatggatgttttatttagttgtaaactccttgctctcatacaagcatgtacagcctttccccttttaatatattatatgttcttgtatatggtcgggaatatggtactgcctgcccatgtaattttttacatgcacatgtatatagactccattaatatatgattaatttaatgtgcatccatatatataattatatgcaatacgtactcgttacaatatactaaatgtataaaatacatactacgctatatctaaaatactgccaccgagacgcaacagaacgtcttaattaatgtgctaaaatactactactgagacgcaacagaacgtcttaatggatgcgtctatggacgttgtacattgttttttaaaagcgtctctatgcctatagaggtgatattccacgtctctaacaacgtcttaaaataaattaggtacgctttaggaaatgtctctatttttttgagacggtccaaacgaagacgttcctatgacactttataaaagcgcctcgcgagtcggcggagacgaaacaaaacgtctctatattacaaataaaatgtcttctttgggggggttttgttgtagtgagcggaggcctgtcgctaggaggcttgggccggagcgtagcggagaagcaaatgttccaccatatatatacctcttgtaagccgccgtgtggcaaagtaacctcaccccagatatagtgaagatattttgctggctggcgcccgtggtttttgctctcctgttttgggagggttttccacgttaaaatctctgtcttctatgattgatctattgttttttatcgtttgtttg

SEQ ID NO: 96712 - DNA, 1365 bp, Oryza sativa
ccattaatttctgacgttagagaggctagcgataaccaatgttcgggtagatataaggccgtgtttagttttcccctattcccaacttttcatcatatcatatcacattaaaaacttttctatacacataaattttcaattttttttctaaacttctaactttcttcaaacttccgatttttttcaggaactaaacacaccctaagagtagtttttgtcacatcaccaggatagtgcaagagggtagaggagaggaggagagaacagttgggtgctacttgtgcaagtttgctcttccagttatccacggcaacaattaacttaaattttttcataacaattacatatatactttgcaggaactgtagctagcaaaattatcttcatttgtaattattatcatagcataaaacaatttaccctacattaccacgaccaattacatacttaaataagttttcaaagaatttatcagctggaagtctacttataatagattagtccataataaataaatattatcatgataataaatatgaattccgttttacttatgtcataaattatgtgtgcgtgttttcattgcaaaataaaaaactaactatgcatatctcatacttcttttgtaccaaattacaagggtttctatgcgtatcataaaatgtcatccctccgtcctaaaatataagcatttttagctataaatctagataactgtgtgactagattcatagttacaagttgttatattttgatatggaggtaatatctggaacgagggatgtgcatataaattttagaaaacacttcgaattctttatactacggaacggatggagttccataattttacctttaagattactaactcgttctctcatacacattttgctccttctagaacttcagtcttttagcaagtaacaaaactaattcccgttaagaaaatattaataaaagatgtgtactccctccgttttatattgtaagactttctagtattatccattcatatagatgtttatgaatctatatgaatgtgagcaatgctagaaaatcttacattgtaaaacggatgaagtatttatgttggaaatgtacaaactaaatctctttgaagtagatatacaatgtgtagggacttgaatgttaatttacaatactttaaaataatgagtgtggccatataaaacagggacttaaacggaaaatgtacaatttgctactaatgtttatttggattattctacaaacgtgtgtgactccaactgtcacatgtatttgttttgttttgttaactcaaattttaaatcgttcgtagtaacaattgaaaattaggtgttacgtatcaacagctccaatcca

SEQ ID NO: 96713 - DNA, 513 bp, Oryza sativa
ttggctcaatagaaaaaaagatcttagctcacacaaaagcagtaaaatcaatgaagacaaaagatgccaagcgggagaaaattaaatgccatgcaactgcgactacaagattttaggactaatttgcaaccatcagagagaatttaatataaaaacgtccgcaacctaagttttatcataaagaaaggtatatatcttttctatccattgctagaaattggaatcccaacccatctcactaggccatctgccaaccacactctatttctctcaattttcttgtcttttcttcccgttgcaacgcacgggtacttttctagttaacttatatttgtgcaagggtttgggcgccctaacaattggaactcttacttattccagttcctaatggcttaaggcccaaactaaccctttccaatttaaccatacttctaatttaaataactaagggctgggatgctgctgccctggtccctataaccataacacattcagagttcaatcaacctagta

SEQ ID NO: 96714 - DNA, 650 bp, Oryza sativa
cccagaactcgaactacacacaagctccaagtcacttccatatcttcattgcttgcatggtgtgtcactcgcattgtgttcactctaatatccttcctgggtgccaaccataacttgtttacaagatttcatttgtgacttggtttagcagcacatccacccattgcagcttgatgacttgcctcctatgatttatgtagaactaaatgacaccccgcgcgttgttgcgggcataacttgatttacatagtagatttttttaaaaaaatctactgatcctcatcatcaagcatcgaagttgagtactcctaccttgctcagaaagcgtaaaaacatttgacatcaatgatgcaagaaatcactatgagagcgaagaaaattaaatataaagaccttttgatcattacgattttcaaatgaatgaaatcacagcacatgttagtttgactccatatgcatttgcatgagcttgaggtagcacattggggaatgcacatggccacaacccacaactatgtatcaattgtatacaacaaaatgagaaaaaaaaacagcttgtaaaaatagataaaatagaagaaatgagtaaagatcttgcccacctcgcattaaatcttggataataacatatccaatattattagttttta

SEQ ID NO: 96715 - DNA, 1680 bp, Oryza sativa
ggctttttataattcccataattttagggttttgtatctaatggattcctcatcatattaatttatcatttttaattgtaataacacaacaaattgacaattaagaggcaaatgagaacagcacctagctcagctggcaaagagctgctaggagcagcgagctggccttagttcaaatccctttgaacgcatgttttctcaccatttctttcttctatatcaatactggtgctaagttcatccttagtatttcaaaagtttttgatgcaattttattaagaggcaaaagtttttgaaagtacacaattttgggtttcgtttctacttgtcgaattttcatttcttcgatgattaagaggcaaataacatcggcatgatgcaattttattcaaaagtttttgaaagtacacaattttgggtttcttttctacttatcgaattttcagtgttacaggattttaccctgagaggcgattctagaagaacttgccgatgcaatttattcaaaagtttttgaaagtacacaattttgggttttgtttttacttgtcgaattttcaaagagttacaggattttaccctgagaggcgattctggaagaactactgtgttcgagtaattccagacactagaacaattggttcgggaggggttcgactaaaaaggagaatcgaactacggaatttgaatcctgcgaaaaatatagcaagagttgggattcacaaggatggattaaccgagatcttggcacaaacacttaaatgcacacaagtaacacaaatcccattatgcgggttgggccaggcctttcaaggaagaaaactagacttttccatgaattctttcgaaataaactctatcaatattttagttcgtaaatagagttttgctagtaaatttactattgtctttatttgtaaaactactccaaaatgtttaacttctagctaggatttttcagagattagttaacattagccctcgtttgtaaaagtagttttcctcagggaatgtttttctaaatatttagtgtttgtttttatttatcaaacaaatacatcaaataggttctaattcatagaaaagggttttcagaaagataaatggtatttacaaatattttattaattagtatattttataatcatggttcttttaacaaataatatttgaatctaaaatagattttgtccctagatttccgtcctcgtggttcaagcgcaacagaaaacatgagataaaatctaataaaatccaacatgacagactttggaaaagatttttttattatccagaattttgttttcgtaatgcagattcaaaatttttagggtgttacacaaggctggtgtgatttgaggggtggggcaaaagttagagatggtgggctattggttccaggggatttgagtgggaaggtgtgggtaggagtgcgtgtggtggacgcgcgacgtgggagtgacatgggcacaatggagcggtggttgcttggccgtaggtaggaaacgtggctgacaggtgggtctcggtgctatctgtcagcgaacggatgcgggggcgagccgggctgggcccgcatggttgggcccaggctggctggaggagggtaaaagagggaaagggggaccagaccctcgggaaagacagaaaagtatgggaaaaggactttggccgaattct

SEQ ID NO: 96716 - DNA, 1489 bp, Oryza sativa
ccaataccggccacaacagccataaggatgtcggtagcaaccgtcagaaggcagttgtggttggaccgggataggttcaggtcggccaaacccaaggtccgccgaccttggccagctcccctggccgtgggttgtctcctggactttagcaattgagtccttggcctagtggtgtgttggtttcgcccaatttctggtatttcgatgagtttgtgggcccaatactcgatgggtgagagcctcctcttttacatgtaattcgtctcaactttgatagtttgtcacttgtatccaaatatacaccaacacttgtgaaaattgttagaattatatcataccactatgttgaatattttatatttttcaaacttatgtaggtatatttaccaatgccacatcatgtcaagagcacacttagaaatgttgctctagatataggcaccttgtgtgcctcactatttaattagaaaaatattagttgcactctacttgtcacgttgttccttcagaaagatgtggtatcgtatatctttggacaattacttatttgactctattatgaacttagctataaacactcctgtattaatttttttctaacttcgctaaaaaacattaaaccagtgctccgtaaaccagtccaacgccagctggtagctgcattactactgttgcttgcgttagctagctgcttcgcttcggaaaagtattttctacacctggtatcatgtcacctagatgtatacatatatattatatagtctaaagaactataaaatcgtgcagtttaaaagaaaaaaccaaattttatgaccgttgtataggtaatatgcactgcctaatttaattattttggtttctcgagttgtagatcaaatttaatcttacatgtttgtcaatagacttatagcatcccaaatgtttagcacccaagaacattaacctttgccacatcacgtcaagagcacacttagaaatgttactgtacatatagacaccttgtgggccttactatttaattataaaaaaaatcagttgcactgtacttgtcacgtcgttccataagatagatgtgatatagtatatcttcggacaattacttgacaattacttgttggactctattatgaacttagctataaacactcatgtatttttttttctaacttcgctaaaaaaacatcaaaccagtgtgctttgtaaaccagtacatccaatgccagtgggcagctgcattactactgctatatgcgttagctagctgcttcgctttggaaaagtattttctacccatgatatcatgtcacctatatgtatgcttgtagattatgtagtataaaccactatacaatcgtgcaagttaaaagaaaaaccaaaatttatcttcgttgtacaggtgatatccaccgcttgatttaattatttttggttgtcgagttgtaaattcaaattaatcttacatgtttgtctatagacatatagcatccca

SEQ ID NO: 96717 - DNA, 834 bp, Oryza sativa
agaaaccccacacagcacaacagggaccacggattacacccacaccaaagcgacggtgggaccaggacaaaccctattttcacttcacttattcttctcttcaggcggaaggaactatatattttatatagagcaagggtgagtactttcgtactcagcaatcaccggaatttaggtgtttgatgcaagcttgaaagagagcaaaggttgttttggtaaatcttttgtttgaaatcattttgaaatcactaagtgatttatttctttttaagttcgggtcaaaaagagacttgcgtatcaaatttcaacaactcaattgataatgtaccaacctcccgggtcagatcattacttctcggctcccagagccatttcacttgattaaatcggctcccagagcctttttcattttcttggactcccagagtccagctgcccagcagcacaacaatccgcttccactcgggaaagcctagtctatgatgcccgcagacatcccgaatcacatagattcgtttctgaccactcaggtcatccatctgccacataggctgattctggttacgattcccacaccacaacaacttttcaccaagcacaagcaaacaaatctacgcaacgggaaccaccttacatccgcccattaccgtgggcacgctgttcgaacagtaagttaacctctgcagaggggtacactttacccataagatacgaacttattccaaacacccatcggtatcggaggttcgcaaaaagcctttcccaagccgacccagggttacctcatgccacatagaagaatcaaatcctcacataaatataggccattttagt

SEQ ID NO: 96718 - DNA, 1383 bp, Oryza sativa
ccattcgtcttatttaaaaaatttaagtaattattaattcttttactatcatttgattcattgttaaatataattttatgtatacatatagttttacatatttcacaaaagtttttgaataagacgaatggtcaaatatgtttaataaagttaacggcgtcaaagggaaggagggagtatattttttctttcttttctctttcttttttttttgtctggtagtcacaatgttgcagtcgatagtggaagacagtgtgaactacgtgcaggtggccagctgatccagctcaatggcagatcaactggcccaatggcctccttcagccgtggtgttcctccaatctacagaaattcggcttattttcttccaggtgactctcattctcagtgtgcgaataaagctgagtcacaaattaaagccggccgttctttagctggctagtaggtagctagttgactctcatggatgtatatgtttgcttctttttgcaaccaatttatacatgcaattttatgatcttcagtaagtaacagatgtaaaaggtaaaaaggaaggaagaggcagatgtacaaatgaacaaccctagcaaatttagattttttttaaataagaccaattaaaatatggtacctcctcctccttaaggaccatgtaaagatatctcaatttttgattctagaaaatctttacttacgtacgcaatgcttgatgaggtgtagcatacggatctagtctaggctcgacacatcatccaatcagttgccggcaaaactgacagatttaaatatagtagatttatatacacaaaaatcaatgttttcaattgttcattcaaagatgccaaacaaacgcatatatgtaagcatgcttagtagtaacttgaacatcttaattaatcaggtactccctcaatatctttatttctttaagagattaagaagagcgataaaattgatagaaagaaagttcggattggttgagataatgtagtaggtggtgaaattaaatagaaaattgttgtgtggtaggttaagatgatgggtacgtggcgacgtaaatatatatactttgagataaattttgaatgctaaattttgagtatatctttttgacaatgggaggagcaattaacatttttgtctatcttctacataattagtgatgaaggatcacaaatatattagagatgaaggatgaagaatcacattagggaaggatcagtgcgggtggttatgaaatttatctccagagagcgcgaaacgttcagaaaaatattactcctacacaatgaatgtgcaattggtcagtggtaaactgcaatgtgacaattaggtgaatcaaatacttaacaatgcaccaataatttcagatattcgttgggt

SEQ ID NO: 96719 - DNA, 683 bp, Oryza sativa
ccccgataaaaaacttttaaaaactaattaaaaagtctgtatcgagcaaacatgcatctactaaatggagtacccaggggaaactagaacatgtaaatatataaacctttattaaatttggagttagttacacctcaatttgcaggagcaagatcgaatgaagtgtggcagttgttagcaaatttatctttacagcgagcgaaatggtgtatatatgtatgtggttaggcaaccaagtccaccattaattcctgagttcctggcattcttttaaattaaaaaaatattattgtctgagtatttacaggccaggtcatctacaacgcatattatttgtcgaaactctaaaaaggaaggccgtgcaccattgtcgccatgctcaaatgctttgaaactctagactgacttcacttctgcatatcaatatattagacgagagaactctaacacatgagttaaatttgtcgacatgttcaatatatatcttgtacatatggatgaaagcatactagagatgacagattaatagtcaagtactcttttttatttgcttctggagaacaaaaaaagtcgtagagtacatgccaaaataaataaataaaaagctatatactttaagtcagctcctctcgatcgtcgtcacatttctatactgaggccgagtttagttccaaactatttct

SEQ ID NO: 96720 - DNA, 634 bp, Oryza sativa
ttaactcaatacggagtggttttagctctatatgtggtagttggttttagctctatatgtggtaatctagtcagcactttttttttataaaaatggtgggacccttcatgtcatattcttttccttttaacccctttttttttaacctttccttctaagtctgtccatcggcaggggacaacactacacaacagcagggcggatgagctagagcggcgaaggcagctgggggcgactagcgggggaggcgggtcctcctcagcctccgccggcatgcgcctcctctacgaccgcataacttctcctcggcctccgccggcgcactccggcacatggtgggagacggaggcacactccgacgacagttgtgacgcgtgaaaaggatgttgcgggcagtagctctcttagccatcacatgcgcactccggcggaggtcgtcgtctccatactttccgtcgcatctcggtcatcgtcggccacttgcaaaccaagagtcggagggagaaagcaacttgacaaggtggtgacaatggcgatagaggcggaaagctaggagtaggcatccgacttcgccaccttggccgttccatgccactcaacgtcgtcgtcgccgctatagagaactgtcgcaccc

SEQ ID NO: 96721 - DNA, 712 bp, Oryza sativa
gctaatattttggctgtggccaaatcaacaaatgttcgacctgccaattcaattgctttccaaaatatggctcgacaaaatgaacaactactccgggagaatcaatacatgcgcaaaaaacaggaacgaactgacaagttgttattggtatgaagttacaataatacttttactctcagttttactctcagttttagtttttagtttctaaacccagttggctactttttaaatgtaggcactttatgaaaagttgggtgaacaagtaccacaagaattggactgtccagtagaagaggaagatccatttgcacaggtaagcggagttcaattattttagttatttacctaagtattttctcctatactgctgcggttactcatagatgaactagctgaatatttatattgtgccagtacaatttggttgccctattgaaatagcaaactaatttgcattggtatgtcagagtgagaacagacaatgcagcacttacagtgagggattgggctcatgttgattgttgtaacagttggccttgtagtcacattctcaaataattgagatggtaagacaaaatatattattttaatttgagatgacttgcatcttgcacaaaacagaaaattggtttagaaggttatagttactccaacatttgttcaatatagtacaaaaggattgcataggaactttgatagaccactgtgt

SEQ ID NO: 96722 - DNA, 614 bp, Oryza sativa
actataggccgaattcgagctcggtacccgcagtgcaatgcaatgcaaggcgcatgcaatagtgatagagtttggtgtgagatatatacatgcatggagtagtatgagtaccttttttgttttgttccctttggtgatggtgatgcccttggctagctagctgacaactgcctaacctttgtctgcccagtgtccaatcaggccatgtaagtgggagtcttgggagctttggaggtatctcctcttctttccctgtcacttgcatgcatttatgctctctggaggaattgaagatggtgatgttcttgccaagtgtgcaaaccccacgatgacacgtgtcgttcgagttgtttattaattcaagccctcaataatcttgctcaaacaactgtatgtttgatggcttatcaattaagtactccctctgtttacatagttctgacgttttagataagtttgaaatcaaagaattagactttaattatttataattattagaatattcagtttgaagacacttgaacacgatacatagattagtaaaagtatttgaatgaacataaatacatttacttatttttcaatatattataatatataggaaatcatagtta

SEQ ID NO: 96723 - DNA, 1893 bp, Oryza sativa
ctcgttcaacttatacagaattattctttatctcgtttgttatcatcttacatcatggtgatggtgccgtgtttgtgcatattgaaatatcgaatggcattgatttctgaaagtacacttctggaaaatacttcacactgctaaagtacaaccaatccctaatgtagagagattgagtggcttgtttaattctgatcatcagattttttttaattttttttttgtaaaagctgtgcatctgtgcatattcaaatgtccaatagcattgatttctgaaagtacacttctggaaaataatttacacttctaaattacaatgagaccctaatttaaagagaaattgagtggtttgtttgcttctgatgatcaggattgcaacctttttatagcttttacatatttctgtatgattaatgtgtggttatctgtattactattagcaagcagagaatcatgcattccttcttaaacaacaaaatcatatctcctacctacattcaaaagtgacttaaccacttctgaaattttcaaacctggcgaagttcaataaccaaaaataagcaaaactatttaaagtgcaactagattcaaagcaactatatcttaacaaacttttatgtctcatcatggacatgttgccatcagatgctaattggtctcaagtaatcaaaagctagtcttggataattggataagaaggtctgttgctgctgagctgacccaaaaaagaagaaaaaaaaaagagaaacaaacattataggccatgaggccatgacaagtgctagtagcactacacaaaaagttgcatcaattcatttgctacattatgggttaccaaagttgcatcaatcatttgttgtaaatcagctattacattgtgtttggtaactaattgtagtgcgtattaattgtactaccacaagattaggactttgcttagtgccctgcactttatctaatctgggatgagttgtccagatgcatagcgttgtctaccattcttgagttctcagttgattatcactaggcaggcacccgagaggcttttggccgttgtgcaagctgagtgtgttagctcacaaaaggagagaagaaatttgctaacctcacaagctatgatcccttcttacaccaaacatttttgtggccatgatatataatggctaacctacacatgtttcagttggctcttgtgtgatgtgctagtgctacatgtacttattatcatgtaaaaactactacaattattaaaatgactatttccttgtgggccagaggtagtagtatatatcatttgtaaccttgaccaatataataattttatatgtaaataattagactatgacaaaagaaagaaagcttaatgcttaattatatttaggatgttacacactttaataatacatcatattcttttggaaacagagggagtacaaatgtcacattgacaggaaaaaaattaaaaggtgcaagccgtagactgtaaatcatgtcatttctcttttcaccttctacttgaaatgtacacatatagaatgatcttccgatcaaactaaatgtccatattggtttgcgacatcaaaaaccatttttacaaacggtccaaaacgatttttttagtttgctatccactccgcctgcactttaagacctacgaaaatacacgacttttgtaggcggatattagttccatctgcgaaaatgatttttgcagacagtatctccatcttcacaaacgctatagccacctgcttgcgaaattgttttaggcgaaaaaaacgccaccctccccccatctggccgcgctgccgccgttgcccctccgccagatctaggagagagagggagagggagggcaggggagccgcaccaccgcctacgtatatcaaatat

SEQ ID NO: 96724 - DNA, 558 bp, Oryza sativa
cgagcagccatggcgtctgcaagctcgtcgtcgttaagcagtcgacgaaataggttagttctaccgttgattgtgtgcccctcatgcaacgtgaagaccattgtgagatgcacagcgaagacggatgctaatcgaggccgtgttttctacacttgtcctgaccatgaggtgattattagttgagttcatttggttggattttgttaactgggaattacctgagatgtgttgatttgagtttgcttgttcttggtgtagaaagatggatctgggtgtaacttttggtattgggagcaaggttacatcaattttctcaagaggaatggcttcattgaagatggcactaaggggaagagtgcattaagggtggatctggagcaagatgattttggcagacaagatgaactagagaagaatttgatagctgtagtgcccattgctagagaactactgttggcagtgaagggcatgctagttttagggtatttggagttgttattttagtactccctccgttttttaatagatgacgccgttgactttttctcatatgtttga

SEQ ID NO: 96725 - DNA, 715 bp, Oryza sativa
cacttgatccataagttaacgaaatattgaacttgaactggaggtgtgtatgtgatcatgatgaatactggaaatgagtacttttgctattgtactgtgtatatttgattcatgcttacgttctggtaggttttctcctgatgatttgcggctagttgtctaactgtcagggaaatatattttcctgactgtcataaccatcagaaaaaaccactgcaaaactgtgacaggggagaccatcagcgatagatgaatatcgatgactgctcacatcaacgtcaggaaaagtatccctgacgtgagtacacgtcaggaaaattaatcctgatgcgcctccgtcacctaaatttatttttctctgacaagctagtcctgacggaattttcctgacgttgacacatcacaaacaatttttctgacgtgcatttgttttatcctgacggtttttagccgtcataagtaatctagtttctggtagtgtatgagacgtcgtatatataactagtgtgtcacgagtatatatatgtatgacactaaagtgaatatatagtgccattatatatattcttagtaatcactctaaattgtaattacacatgcatgtgcaatccatcacacatgatatattccaatggacgcttaattaaatcaattagctattctttcggtacaaatctaaaccccttttgagctcttattttagtttgtctccgat

SEQ ID NO: 96726 - DNA, 1673 bp, Oryza sativa
tgcaggtcgactctagaggatccccatttatcttgggttaaaaatgtttaagtttatcttgggttaaaaaatttgttcaaacttaaagcagtttaagtttgatgaaagttaaaacgttttataacctgaaacggagggagcatttttttaatagtggaaataaataaatccgaacctttagagctcaagagcttcagttcaatgtttattacagtaggtaattcggcttttcaagctgagacatttcgtttagctaatttgggcgcagagattaataattttcttggcatacaaattaattagaaatgtacagcgtaaaatatatataattcaaaagtacatgtttagttttaaaacaatggaatgacatcaacctgttcttttattatgtacagaccacatgattatcaaggtgcacgaattgcatttaattttattaaagctctagtatcatactttttttttcggttcgttgatattccggtggattatgagataaaaaaatattgcttaattagttcaaatacgtttcgatgcttgggtgcttagctaaatgcatttattttattctatagccgctgtcctatatatatagatatgactgaactatcgtgttgataaaagatagagtgattgtttgaagcacagtagttggatgataatatatcgtacaatagttttatatttttgtttctacaataaccacaaaccgggcctaatagttatcattactgcttataaaaaagagtttttgtggcaatgatgtgctctacattactatattatatcgggaaaatatatactgtcatggtaaaaaaaattagtgcatacttttgaacggataaggtggcaatatatgtactggcatggtaaaaatagtacatatatatcagatatgggtaaaaccacatgcatataagttcattttaaaattcgccgttttattgctagttagaaattatatacgggtcccccaaaaaaaaaagaaaggataaggtggtgatatatgggattccaatccaaaagtcaagcaagtaattacttgtaattgtactacttgagtaaaactacccaaaaacatacctatcatccattttgctactacctaccgcaacacatattttgccatattcgtacggacaattcatttattctctctacaggatttccctttttgtgcatgactgaaaatgacttttgctgaagtacctgagaagaaaatgaaatcctaataaatgctgtacctattttgtgatcccatcagataattaatgttatgttgtattttctggcacgtgccacgcatggcccatataatataatccatctgtcccaaaacaacttcatctttcaccatcttatttatctcaaaataaattcatcttttaagcaagcattatattgaaatttatgaaagtaggagacaaatagattggggtttgttaaaataggggacaatagtattagatttgttaaagtagagataaattgcatttagggttgtcaacgtggagggcattcttttttttttttttgcctttgtattggaatgtatgggtaagttcgaaaaataaagtcagaggtacttacttgttactctatcctttctcaaataaaaataatataatcatttgtagtattgatgtgtctcatcacttaactcccgtacaaaa

SEQ ID NO: 96727 - DNA, 696 bp, Oryza sativa
cttcggaggttgtgccattaagttggcccgttctgtataccagtaggatacttggtgacttaacatgcatggactgaagagttgggctccatcaagtgtagtcatacgtttttgttcaaaacctagatagttcaattgtcccaaatttagtccagctggttaattaaacaattaagtccctttaactccctgcaatataggtacaatcttattcgaatccctttagccataatatcaaatgttttgagccctcaactattagaaccaatgcaatttaacttcctttgtggttttgatagtggatttcgcttgtgtgacactttgacaagtccaaccggctaagttagcaagtggggcccacatgtcaccgttcctaactcttcttcttcctcctcgtcttcccttcatccctttcctttctgctgaggcggtggcatggagaggcactgggaggaaagatggaggagggaggctacgcctggtcggtccgccattcacgcgtgtgtcgcgcgtcaggagatctctctggcacggaccgatgaatggtgataaaactctgccaatacgtgtaccacctagtactattacttctgcatgtggcagctccatttttttttatttaggcactaggctgctacgaggacatcacatcatcaaataccacgctcaatgctgccataggagtcactttgtacc

SEQ ID NO: 96728 - DNA, 1913 bp, Oryza sativa
aatgcctaccactatcacacttgaatcaatcagctttgatgctacaccccctcgtgctaaaataaattcatttatgggttttttttgtccaacgatcgatcgtttgtcttatttgaaaaattataaaaaaattaaaaaataaatcatgcataaagtactatttctgttttatcatctaataacaacaaaaatactaattacaaaaataatcgaataagacagacagttaaacattggaaaaaaacacataaataaacttattattggaatggaggatgttgataaataagtgaaggaatagttgataaatcagggatatgcaatcatagaaactatactgtgctttgctagttagttcaacttatacagtaattggtagtatgatttatttgaattaatctggtacttttatttgtagctttctaattaatggcttcgaccgctactgttaatttttttaaaaaaaattatgagtccatttttttttccattcgtagctttcaaatttacgtgttcgaccgctacttcaagattgcaccgatcgggcattaagattgcgagtccaattttcaagtatgcgtctatcgggcattaagattgacattgataccatcatcaataggttcgcatctaaaaatcggaatttctaattaaggtaatatgcatcaagtttcttacattacatgaatattgcttttggatgctctttaattatttattcatgaagttttgtatgcgtactagtatattaatattaagtcgcacaacacccgtgcgttgcaaggggattttaattaaaaagctaatataaacactttcaaataatcattttgtaaataatcattttgtgcatatgtttattactgacacgtgtgctatctagcctaatactgtcaattttttcctttccagagaagattggtgcagattgctacatggtggtagatttgtcaccgaccaacactatactccctttttaattaaggtatatctaatatgtactttctccattctaaaatataataactactactgttttaaaaagcaatattatatatattatcgcttttattcgaatattggttccatcaataggctttccactcatcccatccctttcccatatatacccaatctcctcctaatataataaatcagcctaacctatttcagtgtaagaaaattatctcagtaacccactttatacatggtcacgttgtaaaaaaaattactagtggaaaaatattatcatcataataagatttttaatgttggttcatattttttttctaccgagagactaacgagagacccagtgataaataatttaccacgatatattttctacctgaaggggtcagagtaataatttttgcatcaggaggggaaggagaggatagcaagagaatattcgataaaattaataccaagataagtcaaagttatgctggaaaaggtgagagtagtaattcgttttttacattagggggagagggattgaaggaggcgggtgaaaacggtatgaaaattttccaaccgtatcgataccatttccgaaaaactaatataaaaataataattttatcggtggttactgttttcaaaattttgttttcatgaccgttttaaaagaaataataaaatatgatactggtcctgaccattaatttctgacgttagagaggctagcgataaccaatgttcgggtagatataaggccgtgtttagttttcccctattcccaacttttcatcatatcatatcacattaaaaacttttctatacacataaattttcaattttttttctaaacttctactttcttcaaacttccgatttttttcaggaactaaacacaccctaagagtagtttttgtcacatcaccaggatagtgcaagagggtagaggagag

SEQ ID NO: 96729 - DNA, 549 bp, Oryza sativa
tgagttgtgatccaatttcatttgcacttaataaaggccagcttctgccgtagtggagcgcactacaacaaaaccactgttataagacatttgacttaagacactctgtaagttgtctcaactttgagaattacgattaaaatagaggcgacttttgagacgctttacaagttggagacatagtttaagacactttacgattagcataagactacatcgtttagatatgaatattgagacgttttcagacgtctcatttctaagatgtgtttagatatgaatactgagacgttttcagacgtctcatttctgagatgagtttagatatgaattttgagacatcttcattatatgcatgtcattgacatcaaacaatacaattattatttacacagaaaaaaagaatatttgaatcatttagattccatcggaaaactacataattccttatcatcttcatcacataatattataattatttaatcatttaaatcatgagggtttccgagactaaaataatattataataatttttgaatcattcagact

SEQ ID NO: 96730 - DNA, 565 bp, Oryza sativa
actatagggcgaattcgagctcggtacccatgagagatcgctttaacctactggttcaaaaaccaggagtaggagtctgtcaaccgtttgaaattgaggtgcgaggaccgctacactgctaattgaggaccagttgtaatcgtaactcgacctttggaagacatggtacgaggaccactacgctactggtggaagaccagtcatagtcgcacctcgaccattagaagtcatggtacgaggatcgctacgttgctagtagagaaccagttgtagtagtacctcgaccacttgaagggaatccagagtaatagatggatgacattctcgtgacctgcgagaactgcctcctgatgacgacgaaggcaatgaggaattaccgtagtcggaggttccgttcctggacctactacctcatcctcgagccctctagaagtatggggatctcaagttttgtcgtcgtcgtgtgatgtcgtgatgtcgttaaccttgtccgttgtcgttccgatgtcattagtcctggacgttgtcgtcctggtgacaacggcgatctagtcggtcttggttg

SEQ ID NO: 96731 - DNA, 1043 bp, Oryza sativa
cagatctcctatatgttatagaaaataatacaaccaaattaggcttgtttaaccagaggttatataaaatttcccctctaattaacctgtgtttatctcttgtagatgctcctaccactactaaactgaaggaatccagaatctgatatgtgatcatccatggtcactttgggtggtcaactaaagtcagattcctctgttaatttgtgttaggccacacgatcgctaagtgtacgtacctctgcatttcaccttaatttgaacatggtaaattttagacaacttggaaaatgacacatgccaagaaaagtcttcagctgtgagctagaggccacacttaatttgtcctccttcacacttgaagccatgaaaaagatcttccttagctttcactttacgtttagagctttcactttacgtttagctacctttccaaccaatttgagatgattgtatataaatgtttccagccaaactaggttgcataaatgagtagctcacctatcatttgcatggtcttaattttgccatgcatactacttatttttagatatataattcaaaccatatgctactctacacatgtgcctgaaaattgtaataatattgattcacatccaaaatatatctgactatacccctattttccaagagaaacattactgggtgcattattgatattgcaagttgtgcacttattgcttaacatgttgtcatatatattccggtgtatacatatgcatatagtgtttggtatggttgtgtgaatctcacactacaatatatatgtggtgagaattattcttgtctcatctgaaaaacacacagatagagtttctgtacttctgcctttcttggtgccatgacaagtggctggttttggaatgctctttagtttttggtagctaggttttcctagttgctaacttttgcagccatagcagggaagaagagagagagatctcaagaacaagttgagcaccttgaaagggacaaactacgaggagaaattctttgaatctgcacactactctgaatctctg

SEQ ID NO: 96732 - DNA, 2126 bp, Oryza sativa
tgtttggtatggttgtgtgaatctcacactacaatatatatgtggtgagaattattcttgttcatctgaaaaacacacagatagagtttctgtacttctgcctttcttggtgccatgacaagtggctggttttggaatgctctttagtttttggtagctaggttttcctagttgctaacttttgcagccatagcagggaagaagagagagagatctcaagaacaagttgagcaccttgaaagggacaaactaggaggagaaattctttgaatctgcacactactctgaatctctgcagaatgttagttagcacgaccaaatcagtcagtcaatcaatcaatcaatcaatccaactggtgtgctccagagaggataaatactgacatggaacttgtccccctggcccccttttgcatagtgaggtgatgtagatgtctcaagtgcactgcaatgcaatgcaaggctcatgcaatagtgatagagtttggtgtgagatatatacatgcatggagtagtatgagtaccttttttgttttgttccctttggtgatggtgatgcccttggctagctagctgacaactgcctaacctttgtctgcccagtgtccaatcaggccatgtaagtgggagtcttgggagctttggaggtatctcctcttctttccctgtcacttgcatgcatttatgctctctggaggaattgaagatggtgatgttcttgccaagtgtgcaaaccccacgatgacacgtgtcgttcgagttgtttattaattcaagccctcaataatcttgctcaaacaactgtatgtttgatggcttatcaattaagtactccctctgtttacatagttctgacgttttagataagtttgaaatcaaagaattagactttaattatttataattattagaatattcagtttgaagacacttgaacacgatacatagattagtaaaagtatttgaatgaacataaatacatttacttatttttcaatatattataatatataggaaatcatagttaaatatatattttggaaactgtgtcctatatagaacctcaagaattatgaagaaatattgctcacataattgtggtacgtacggtgctactagctagtatcgacagtagaagatctgtacagatcagttacacaaaattatagccgcaaattgaaggatatatggctccaataaattttttttataataaatatagatggcacttgtctgaagtctgaagtctgaagaccgagaaaagctagcttagggtgtgtttagtttacgctaaaattaaaagtttgattgaaattgaaataatgtgacgaaaaagttaaaagtttacgtgggtaggaaagttttgatgtgatagaaaagttgaaagtttggaagtaatctcggcattggaatgattattatgcagcagtcatatatgcaggacaagggcagggcgttcgtccgtcgatggatccgtcgcttttattctgtggacgatcgatgtcgtgtcaggaagggttcatgtcacgtcaaatcgatcggtttcatgccggtgcgtcgatccaaagtacttggagaccctcacataggctgcgtttagttggatccacggtttagattttggttgaaattaaagatgatatgactgaaaagttgtgtgtgtatgacaggtcgatgtgatggaaaaggactgaagtttgaatccaaattttagatctaaacacagccatatttccacaagtgcgcgtctcatcgctctcatctgcctccaaatcagaagttttcaggttcaggcggccaaggaattgcatgagaaagtttctctagcttaattggacatgaagttctcaggttcaggccaaggaatttcatgagaagtttctctagcttaattgcacaaattttgacaatttgaccctttgcaaaaactatttgtagcaatgtactccggtccagacttcatggagatcaggcctttaagttcagcgacacatgatttggcgttgagtaaaagggtcagatttgaaataagttttggcagcggttcatttgtaaaaatagtttttgtaaagggtcaaattgtcaaaatttgtggtttaattggacatgaagttttcaagttcagg

SEQ ID NO: 96733 - DNA, 1005 bp, Oryza sativa
atattttttaaataatcataattttacaaacagagaatctaccatcatacaactcatagataactaaattagctctacaattttggaaaataaaatttacaccattatatgttacccattaaattaataatgtaatataatttccatttaaaccagtgtactcattactttgtactattatttttaaataatgcactattttaaaataaagttctcacattatattgtatacatacgtatgtgtacgtacgcttctttcgcttattttttccctttttttcttcttttttctatttatataatggatatatttttttaaataatcataattttacaaatagagaatataccatcgtacaacttgcatgtaactaaattagctctacaattttaaaaaatataatttagaccattatatgttacccataaaattaataatgtaagataatttccacttaaaccagtgtactcattactttgtgctattattttccaataatgcactatttaaaaataaagtttacacaattatattgtgtagctatcaaataaacaatttaagatctatattaactaatttatacgtgcatttaagctgatggacccattatttaaatcactggatttattttttattacattggactattattctccaataatgcattgtttcaaaataaagtctacactattatattatgtacccattaaattaaaaatttaaaatctatattaactaatttacacttacactagaaccggtggacccattatttaaatcatcggatctattgttttcttataaataaagcgttcgaagttctcttttttggcccgctacacaatgcacgtttgcactttttgccttttgcacgcgtgacaaagcgtcatgtctaaggcatctaaggtgattacgaccgccgctacgctaccactttgccacatatcaagtcatatatggagttgattaattttattaataacatgtaaagaaaattaaaggtg

SEQ ID NO: 96734 - DNA, 644 bp, Oryza sativa
acacaactttaacttcttggttctataaaatctatctattattatatactaaaagtccattaaacttcctacaaacgctctcaagtcgccacgtgacgctctaataaattagaaaaaatcctagaaattctaagaaaaaagcaaaacatctacctcttaatttttacttaaattggtgggtccaatattatacaccgttagatgaaattgatcttaacataaaccaaactaaatactatgggccccacctctcctcctccctagatatatacgtacgtacagtacgtacgcttcttctttcctttctctttttttttttcattttttcttcttttttccatttatataagtacgtacgcttcttctttcctttctcttcttttttcattttttcttcttttttccatttatataatagaaatatatatatatttttaaataatcataattcatgcgtacgcttcttctttcaattctttttttcctttttttctttttccatttatataatagatatatattttttaaataattatattttacaaacaaagaatctaccatcatacaacttagaggtaactaaattatctctacaatttttgaaaataaaatttacaccattatctgttacccattaaattaat

SEQ ID NO: 96735 - DNA, 662 bp, Oryza sativa
aactcaagatgacatatttatcacgctgcactagaggtatgtgataacaatttacttctctccaggtgtggtctcatgaaatctgagtgaaaccttgagaaataagtggaaaaatatgtggtctcagatataacgaaaaactcacttttatgttttttattggaaataaattcacttttattttgggtattttatcccgaaaactgtctttgctggctgacctctgcaatggtatctcatgcatccaactagctagttgtccgaccatgagttgtgaaagtgccatcactgcggtttgccctctcgctatctcgcagcatcgtctagttaacactccgttattataaatagtggatcaagaaaattttttgagcctggacaaatctagacatctagtgatagcctaataggtaagtataggcggccaatgtatattatctttcaaaaaagacgctttggctttcaagctacaaagtgcagacaataaaactacatgaccagcagatatcaatatcatcggacaatctatccactaaaagctgtagagttgtatactctacatatattatattttttaaacaagccgcgcgagatagtgcgaggtaaattaaaactatgtactacgtagcagatcaagcagtaacgacagtcaatgaatagaa

SEQ ID NO: 96736 - DNA, 2383 bp, Oryza sativa
cgaggaaccatgccatagctggtactgtggcaaattctgcaagctgatcaaattctgaacgccggtgatcgacacactccacttgctcttgctgccatgctgctcctctgaacttcacagcaacagcctacatttttccagctgcctctcattcccagtgccatatatatccttctttttgaaaagttaatactagaccggatccagtcatctgtgacgggctctaaccctcacctttaacggatttggttctggtcaaagacaagtggtcactgatgactacacctcatctttgacgggtgaaagcccgtcactggtaattaaaacctttgacgggctaaaaaatatagccgtcacaggtgactcacacctgtgacgggtgactctttgcaacctgtcaaaggtgacgaaacagctgtgactggttttagttctcacccgtcacagatatcaaaaatcacccaaaaaaaaagaaatgcctcagcccaaatgtacgaaatgaagaaaaatcaaatacatctcaagatgcacatgatacaacaactttgtattttaaatcaaatacatctcaacaaacaactacacatgaagcaatttgacaatatacatcacacaagtatccatgtccattttaacaaactacacatccacacaagcaacaaacatgagcaaatcaagcacaaacaacatcaagcacaaacaaattcggcagccggcggtcggtggcggaggcggccggccggtcgtggcggaggggaaaggccgcggacgctagatccgcctcccccgaccttgtggaggccggatatggcggtcatcgcactacaacaaaaacctcatatagaggcacttttgtagagacgttttgcaaattgcttctaaaatcagaagttttatagtgtagagacactttatagaggcactttaaaaattgcctagaaaacttttactctagagacatttttagatcagtttgttagattttatctcgtagaggcattctttcggtactataaaatgcgtctaatatgtaaaggcatttcgttgagacattttaaactatgtagagacactttttagaatgataatatgtactaaaggactaaatataagtaactagaggaacaagcatacaagtaatgacatggagttgagttggttagtgtattgaagattaaaatgatttaatcaagagatcataagttcaagacttgtcaaaaccaaggaaactattttattatcttttttgattggttttatatgtttgcggtacaatttaatgtctctagaaaatgcctctaccatcttatagacattttataaaatgtctcttcgtttgtagagacaattcaccataagacacttattagacattttttaaaatgcctctacattgttgtaaagtcatttgataagtgcctctacagtactagaaaaatgtctctacaaagcatttttgttgtagtgatcctagctagcaggcctttaattaattgtttatttcgcatggatttacactggtagtttattatgaattttacatgttttatactacatggatttaatatgctataaaattttctctatttaagctgttgctcatttctagtaggagaaatgggagctgcaaagccgtagttaaaaaaaaattctgtggaattatcagagctagttttgtcaaattattgtgcacaggattaaagagtagaaatcatcggtctaacaaaatttggtctgtctcatttggtgctaatatgtttcccacgaattttaaaagtttgcacattttttagttcagcagaatggacctgcaggtcagtgaacgtacggcaattacgcaggaaatccccttggctccatggaaagttacaggaagcacgtgttaaaaggaaaccaaccaatgtatatacaattacaattaagtccttggatccacatgcaattctaagcactcttacaatataaaaccctgaaaattttaaacactcgctaagaccggtcctggcacactaagcacagtatggcccacttgtcaacgacacaacaccgaggtagaaaaaacctctagcagatttggggatgaagacttggggctcctcggcttcgagtggcaggtctcctagaccgatttgaggtggcgatcgacgaagactgctaagctatcatgtggtggctgcatccaccaagctaggccgaaagcatgaaacacagaagcgaggcggcgagctcgactagagactgagtggcggtggcactcttggttctccgcggaacgagatgcaatgagagaaagaggaggttggtacagcagcttgctaaacaccgaggtcgggaggtagtcaacggtgaggtggccggctgacggcatgcactactacagaag

SEQ ID NO: 96737 - DNA, 1190 bp, Oryza sativa
caatgttttgtcagtgtatatgtactactgaagtacaagttacagagggactgaattggctcaatctgtacccgtgtggaatcattatttctacaagtacattatcagcttcttttttgaatctgacatcatgcacgttgcaataggttatgtgaaagctaattcataaattttgatcttgttccacaattttttcatttaaattgaatataacagtgtcgatccaaaacaaaaaattacatagtaggctctggtgcaaaaatgagtgtctagtatttcatttagattgaacgtaactaggtaattggattggtaagaccaacctagctaagttcttgttcctcttcggccagcccggatcgagctcatcctagtcaggaacaaaatattatgcatggatctaggtgctctagtagagaccgacaagttttgcacacacttgcatttgcatgccccaactgagctgcatcgatcgatagatcctgaactcaacgctcatcaagagtctatgaggttgttgcattgctaccaaacgtacgtactgagtctcacggatgagggaagacgactgagctgctttcttaggtagcacctaaccttgttacaattttcttacattatgtcttcaaatttcaggacatatcaccttctctgccacttcatttttcctagatgcctctcatttccatttgcccttatttactatttatcgtacttccctattaattagtaattccagcataaactttggaagctcctagctagccatctaaccactattacttcaggacataggaatttgttagcaagtaactagccaatcctctagtactaccctttgacgcctctcacacaaattgatgttgaattagttgatacgaattgaattagtcgccctctggacatcgaagacctgaatttttcattctcatgatctaagaagaagatcgcgccgagacaaattcaaacattaattgaattggctctgtttcagttgaaagaagttcaaactgcgctagctactgctatcgagtgcggttatgacgtcaacagtggggaacgatcttcctaattcctctcagcctcatcgctcatcatctccatgcctgccagtagcatccacactttgggatgttgttcacctcaaatatcgtcttatttctcgtgtgtgtgtatataggattgaaatt

SEQ ID NO: 96738 - DNA, 3729 bp, Oryza sativa
caaaaacttgcttaaaatttcttatttcgccatgtattttttttagaaaactaacactccattagttgagttatatctatagtaagtcctagtcttgtataatttctggctctaccactgaatacaatattcatgttagtgtacgtttgacccactacctcgtccattcagtccgccctcgtgatcccagctcatgcatggcctccttcaatcttgccttcctagcatacttggtggcggcgagttcgaccccctatcaccaatggaggcctcctcatcggctatcgagcctcctcatctccctactctgacagctttgccctagggtctagtgacgtctggcttgtgtcggtcaaatgtagcctccttggtgccggcatagagagaggggggcttctctcgttgttgcagccgccttaccaccgtctttgtcgttgtcgcaaccgtggcgaagaggggtgtagctctaggcggagtgcgtgcgtgcgaaagagaggcgaggaaaaagatgaagtagtggataacatgtgggcccaattatactttttaaaagcattatctccttagcttgatgactagattaacacatggctaaaacatcatcacgcgtgcgtcacatatgatcgatattgtctttgaaattttcggaggataattcattcggttttacaattccgaaatgtcaaatgactaatatcatatttttttcgcgaacgcaaaatgacaaatatcatgaaatggtatatataacagtggcggacgcaggattaaaagcatgatggggcggagatattcgtttcataaggacactaaacgcaactaataccatatcctatatacctatatacctatatactataattaaggcaaacaaaacaattttaaaacaaagcaataatattcatcatacaccaaaagactcataaagcattgttgatagatatatttaaaaaagataaatatatgagaagacataccggcaataaaacactaagcccttctatctagaaggcttaggcaactctattcgccggtcacccatggcttttgctactctgtgctccccctaccggctgagacagtgagagtgagacattgatttagtgatttgtttgttgattcactgagaggagtgagagcctgagacattgcttgcctgattcgctagcgccagcggctggcgtcgagctgcccgagcaggaggcgaggtcagcagacggcaggtcgtgactcgcggggaggtcaggaggactagaggaggccttggcgctggtggaccttggcgctggcgggcggtggcctggccggctgcgagcggcatcgggccgggcggccggccgtcggccatcggccatcgctgctcgctagggcgccggacggcgggcggcggcagctaggcgtcgtcgtctcgtcctctgcggtgcgcaccgtgtgcggcggccggcggtggcggcctgcaggtgtcgctgcgcgtggcgcctggcgcggagacggagtaagtcgacgtctcggcttctgtctctctcggcgagcgggcgatgcgtggagaaactaaacgtcgcgcgtggggtagcgagacagaaggtgaattggacactgatgggctttctacttatgggccaatttggcaatttgtgaatagatatggcccaagggggtgtggggggttggggcgacgcgggccgtagctggccgaccgcccccatgctgcccaatgggcagttccgcccttgatatataatgttgataccgagagatccaaaacaatttacgtctttctttccgacccgagggagcatacgcgtggcaaacacatgatgggttggccaaacgctacacgaaaccgggccccaatcatgggcgatcaaacacaaccatgctctcaacatcccttgcgtgatcgatcgaacatggctccgtccggaaaacgccgtctacgcgcggcgtcaccatcacctagccggccaatacatgtgcagttcccgcttcctcatagaccttttcatgtcgatcgaggcccaactcgccaagtcactcgcggtctagtccttgcggaagtacgaaacatacagagagagcagtacgtgtacccatgaaccgtacgtcctccctccacgacatttctccatcgtgttcgttctccacgagaccacgagagagaccggccgagggccgcggccgcggccgcgacgagacgacgaccaaccggcgacgttcttttgttgcccctctcgtccgttcgatcggtggagcgtcgcaactcgcacgcaccacacgcggtcgtgggtgtggcggtgaaacgacctgtggcgtgtgtaggagtagattagatggttggttaggcccgcgggatacacgtgcctccgtgagacgtggacgtagcgaaactggcacgtgattttgccgcccggtttcctacccaatcccggggcgaagagccgatcgatgatatactctctgctgatcaaagcaccgatgatcgactcgtttatttgtttggagtaaatctgctactccattaatgctcactataaattcgtgtacaccacattaatgctcactaaattctaaccctgcatatcatgcacctgaagaagccaaggttagttagggcctgtttagatccatttggaatggcaaatgacaaatggcaaaagttttagtggcaaaagttttagcattgcaaaagtactagttggtgtttagatgcatgttaaagttttgccattctagcactaaagtgagagagagaaagagagagggagtggtcccaaagcactttttggcacaatttgctactatggactagcaaatgccaaatgccaaattgccaacttttgctacaagtgtttagatctaaaatgacaaaaagtgctacaaaattttggaggatctaaacatggccttactagagtaatcacgcgagatcggatagggtgaggaactgagaatcttctattataatatcattatgggtgtgtttagttcacgtcaaaaatgtaagtttgattgaaattagaacgatgtgacggataagttggaagtttgtgtgtagaaaagttttgatgcgatggaaaaattaaaagtttgaagaaaaaattaagatataaaccaggcctaactcatataccagtgtgtaatagtaccatattatgatagatgatgtaaacctgatcagatttgctcgagttggtttgataataaactgaagtactgacaatgcaaacaaaatctcccctcccccaataaacttgatttggcaagagcgtaaatacttacttcctccgtcaaaaaactaaccttagtataaataggacattttctaaaacaaataatctgaacataactaaggttggcgttttttcgtttttttacggagggagtacctgctactacgtgcgactatgccgagatgcgaccatcgtcaccgaatttgctgccgaacagctagcacaagcagctccatcctacgcaagccgtaacagattggaggaggagcaggagtactcacgtattaccagcagtctagcactgtccacgcgggccccacgccgctctcgggaaaagagcgcttgaccgtttccttcgcgccaatcccaccgcgcgcgcccacaaataccgcgcccctcccataaccccaccccccccccccccccgatccggcgatccccctcctcgccgtccgtgccaccgccgccttctcctccctcccatcccccgcgcgcggtt

SEQ ID NO: 96739 - DNA, 3100 bp, Oryza sativa
tttttcgaggggtttttcgatttttttctctttttttttggaatttttttgcagaggaggcgacgaggcaaagccgcaaaggagaagagggagaagagaagacgaggcgaggcgaggccacgaggtagagggggactcggagacgggcgcggcggagtcaatggcaggtgggctccaggtgaggtggggcccacctgtcattggttaaagcggcgtgggtaatgggaatgggtagagtctagagtggcgacggttgggggatacactattttggactgggtctacccaattagactggcgggtggggtcgaggagatcgtggcgtgggggtcgtcgaggggatcgtggcccacctgccaagtccgcgaaagaatcggaggttgtggatatcgattcctggcttcctgtcctgggggccactagaaacacggggaaggtatttttcactctcaggaaatgaaaaggtgatcctcgatcgtttctaagcctcgtttgatccaaagaaaatctatagaaattttagaggattttatttctataggaattttttctataaagctctttaaattaaaggaatgaactctatagaatcctatgaaattcctatggaatgcctctttccatataagttttggaggaattttaacaagaggtagaaactcatggaagaaatccttggagtttttatctctccttaaattcctgtgtttttcctgtggttcaatcaaacggtcatacatatgtttttcctgtattttgcaatcctctgttttacacttacattcctgtcagaatcatatgtttttcatatttctccgtttttgtcattcttgtgattcaaaggatccctaaacaagtttggtattttcgtgctcctatatgcttatgcagtatactccctccgtttcagattataggttgttttgactttggtcaaatttaaaccaatttgaattatagatttaataaagagtaatttgcacccactatatatcaacttggcatgtgggtgcaatttgatgcaagaacttgagaaatgagtatgctaatgcaacaacttgacaactactcctaagtgtaatttggtacaggaactttataagtgattgcataaatgcaacaacttgcaagatatgtacgattttgatacaataagttaagaagttatgcaacaacttaattagttggagcacttttttatacatattcaacttttaagtacttattttgacagtatactagcatggatttttatataagcatatttatatttttatcctaataactaataattgaaagtcaattaaattggatatataaattattatatttcggttgagatttaggaaggtgaagaaaacaaaaattcttaaaggtaattggatgtgcagtataattcttaaagattaaattcaatattataaggtaatatccgtaggattgctatgtaatggcatattgacatcgtaaaaaaaactcatctagcatatgcttagctaagtttatgcaccaaaatactaaattgtcaagttattgtactagaacacacccatatgttatgttgttgcactcgaacgttcaattctcaatatcttgcactatatcgcatccacccgccaagttgtttgtaccgtggatgcaatttactttttaataaaactaatttggtgttgtaaatattgctatatttgtcaacttagttaaatttgaagtagtttgactttgaccaaagttaaaacaacttataatataaaacggagggggtaagtacatagtccatccattttcaattaatcatcctatagtttctttaagtttattttcaaataattatcatattagtatacattctctaaatccatatattatctgtatatggaaatggaaagtaaaaggacattgggacatgcatccatacatacaaccagtaataaaccaacatgtaatatctttgcttgttattggttagaaaatagtgataattgtgcatgtattgagattgttaccatagcacatgttgtacaggttggttttgcttgttttttatgtactcatgtaatgtgatgatcgattgggatctgagagagtatagcaggtataagtaatgtttgtgacttttttttaagaaaaaacatataaaccgaacgctctcaaacatttcgctctctcactcctatcatcctatggacacacaaatatacaccttggccatcgaatcagcatatattgatattaacaaagtcattatggatatctcgttgtcaatggagaagtcgtctgccagtgaataaataattaaccgtaaatacgagcacatgtaccaaatgtaagatttaaaatcaggtagacaggttccacctgcccctattattttcttattaagaatcatattttaccttggtttccgttagtgcgtttttcaaattattaaatagtatgtttcgtgcgaaaattttctatataaatattgctttaaaatatcaaacatattcattagtcaagtttgtaataattaaatcttaattaatcatatgctaatggttttctcattttacgtgacccaacttatggtgtgtatggttgttggccacactttaccaccacaactaaggttaggctacttgtggtagtcacaaaatgtgtcaaagttgacaagaaatttgagtatacgacgtgtgggacatgctattgaaaaactgtggcaagccacaagtgttatagtgaatcaaacacatgcctaaaaactatgatagccaaaaatttggcgtggcaaaatgtgggcatgaaccaaacacccacttaatcttcatcttaattaatttcaaacaccaagactaattaagatcaagattactgtaaaatttaattatttggtctttgagatctatatatggctttataatgggcttggcacttgtttacagtaaaatttaaattataagggctcatttggaactaggatatttggatgaattttaaatgtgcgagacttttcctatacgctccattgatattgaaccaccaaatttctttgaaatttatatggattttttcaatttataggaaattcaaagaatttctaacatgaaatccaacctta

SEQ ID NO: 96740 - DNA, 607 bp, Oryza sativa
caaccctagaaggaggggacagaaagaagaaaaaacggagctagatattgagatggctgaaaggcttttggccatggatcgcacaagcaagaagaaattgggcaagcaaagaaaagagatcgaagaatttcagaagtttgtttgtgggatcactagttgtaatagtgtccattttattcaagatagttgacaatttgttcaatgaccgctgatgttaattttgtttaagatgaaacagtaagtttaaggtctacaacgaaagaacagtttacacatcagagcaagaaactacaaactttcagaacatctacttcttttttactattattacattcatactttcagcaaaatcaagtaggttcattacatatatcaaaagacaaggaactaggtccagaacttggcacacaacataaatcaaactcagcctctcccatcaacatagcagattcttccaatgaatatagcagcaaagcaatgtccagcaggaaagaaatacttcatctctctcatacatcttccataaagaaactcagggtatcgtgatcctgtgccggagactgcgtaggtgccagcagccgagatgcataggggacggaggggaggg

SEQ ID NO: 96741 - DNA, 692 bp, Oryza sativa
tgatggcatctcataggatccgtcaaaggtgaccctcatcactaaccaacacttatgcccgtcacatatgtgccgtcacaagtgtgaggatctggcgtagtgctctctctttaattgacctatgctttcccacagacaaataaacagtacttgctagcatgaggggaatactgaaaatcggttctaattaatagattgatagctaagtgcatggcaaacacttgtatatatagtttctcccggagtttggagtctcgactcgccttctcttccctttatattgatgcacctcttttctcaatccgcgtttttctttcttcactacttcatcaccaaactctaaatacgaaggaaatacatttttcctgcaggttgctagagttacaatttaggactgggagatgtcaggaatagacactgcaggattttgtgtcatgtaacaatatgtcgaaggcattgaaagttgtgatgctttcatgactgctcacctaattcgttggttccattacaagtaagtggcatgttcggctgctttgtaccgtcgttgcgctgccacagccagaagaaacaacacactgttcttgttgctacagcacagcaaaaataagagcagccgaccagagccaagaatgaagatccatgtagaaaaagaagtacaatggcatgctggaacagaaaacgactgtaaccaa

SEQ ID NO: 96742 - DNA, 640 bp, Oryza sativa
ctaggcgttcagtagcatcaaggatattgaaggctaaggtctgccacaggccacagcctatgggacctgaggcctgaggttattgtgaaggtctcagtaaattcccttggtacttaacaaagtacaattgcttgctagtcttagcttgtgtaaggaccaatgtttccctagtgaaactgtttcccaaaagaaaaaaaaatcttgaagcatcatttattcaaaaatacacattttgcagatttattgtgtttggttaattcttacagattttcgtgaacaacaatataatatacatgtgttaataacatatgcatggattttagctcagaaaaaaatggagtgttctagctagctaggtgcagtatagtttggcagaacatatttgattaagtagatattcgaccggatcgaggagggcggatgcgcggctggtatatggtttatcatttgtggggatgaggtcctgccttttgcatctgttttcaacagttttccttttccacttgataattatagttctttcaatctcaatatatagtttcagtcatgaaatgttcaccttttcattcccttgctgtgtaaaatgtttatatacatggtcaagttgtgttataccgtacaagcgccgggaacgggagga

SEQ ID NO: 96743 - DNA, 657 bp, Oryza sativa
ttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttttcaaattttgattaatctcgtattgggttcttacatggaaacttctttaaatattgcttatttttaattccgaatttcagctatttttaaattgtattttttacttagactctccttttttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcgg

SEQ ID NO: 96744 - DNA, 718 bp, Oryza sativa
caacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtttattttctatgctcaaagactggaccaattattattctccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacggggtgcag

SEQ ID NO: 96745 - DNA, 918 bp, Oryza sativa
gaatggggcctgcacccagctcgaaggcatcggcaagcgtattgatgaggctcttaagcaggagtgccgtcgatcgagccgatatgccggatggcatgtattggcttgcatacgagatcatcgcccgcagctacacctcgagtttctccacgaagggttttctcgttcttggagaactcggacggagatagatcacctggcaaagtcaatggcgccgctggcagagaaggtgttccagtctatggactggcgttggccttcctggtagtctctgttccctgtgacaaatatcttagggaaaagtgtaataggatttttacggaattgtaggaagtacttgtgaaatagaaaagaaaactatcttaactaagctttcttactctggacgtagtgtgtaagagtgtcttctcacttcgcgactccaatcagtcgtttgagttatacactctccctagcccccagccttgtcatcggagaattcttctcggaagataaggctcttggacctttgacctgcctcggttgaacaagcactgatcctagcccccagctgtgaagttggaaaattaatttccgattacacggcttggttaatacacacggtgagaactcttacacgaccagatcttacatggtctttcgtctctacaggatccgacaaggccttatcggctctgggcgtccccagctgaagatcccttaggttcctcggaggccttgtcaagacggcgtaacgggacatgaggataggtttcaacgctaggtgtcatctgggttagggaacattgggaaggaacactttgattgtaatctgtacatgaaaataggctttattgaaactgtaagatgtcttgcaagtatggatactattgacttaaacaaagaatttacgtaattaatcaatgttccaggaatttg

SEQ ID NO: 96746 - DNA, 709 bp, Oryza sativa
agcatacaaccaaccaatcatgtctgttaggtaatgtctagtgtagatgaaactaagattatcacatcataccatgccacatatggtttataatatcttctctctctccttaggctacattaggcgtgatctcataataaaatctagggccactagagaaaataccttgcactcagcgaataaagcctgtgcgggtcgccgcacagtggcagtgctaactggccacttcgatctcagcttgactgaaactccccccaaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctccttaggctacattaggcagtgctccctccgtcctataatataagagattttaggtggatgtgatctaattgggagaaatactcgctccttcttcacgcacacgcttcccaaactgctaaaccgcgtatttcttataaacacattttatagaaaagtttgctttaaaaattatattaactctcaattaatcatgtcataatggatcatctcattttgagt

SEQ ID NO: 96747 - DNA, 699 bp, Oryza sativa
tgtgcagtttcagacacttgattgaggaggcagcagagcaagtggtggtgcagtggtggttaagacatgaatggccatgacggcaatgggcgcactgttactggttgaatcgggctttggatgtacatggacatgggcatattccagatctagggtaagacggcgctgtttacgattggcacgttctcttcgctgaatttagctgatatttatgcaaagctgctagctgctgcgtaacattgttttatcggagataattgcatatggttatagctgggtaagtattgcctttggtttatggctgccatgtgagcctttggatgctttgttgacctgtggtcaatttgtgtttttagccatatccgcatcccacgcggttggctgacttgtgttggtgccatgcgagccagtactagctaggtacccaggctaggatctactacatgcgtatgacagcctgtgtgatagtaggagcaatatatgcgagatgttaacgtgtttggtaggccgcttaattgtggtcaggctcaggcgaaaaaaaaaactacttactccttttcacaacctaagcattaccataaacatatatatatatttagttatatatctagatttattgatatctatatatgaatatagataatattaaaaagtcttatatcgtaaaacggatagagtactactgttggtactactgag

SEQ ID NO: 96748 - DNA, 567 bp, Oryza sativa
aatgttatactctcgaatgattgtgcttcacctcattgcatgtgtgaaatgctcaccatatataagcaaacaaataatatatattttttatatgtccatgaaatttcagccaatgctttttacaggctcgctccgtcacatatcgtaaattttggttttgatctttctatacccacactaattaatacgcgtagtgtctcaagccatcgttacttaattagttagttaaacagataaggatactttacacatcaataatgcggcaccatgcatgtacgtacatcaccacttgctatttattttgtaggttttaataagaaccaactgcttagttcgaaagaaaattaaattagctaactaatgcatcaaatgatgttagactagtttagattatattagagcgtgggggtcacggttcagattgtagtgtgtcattatgtgcatgagtgtaagtcccacgttctgtcagcgttcaattttgagtcctatcttcttcgtagtattatattacgacaaaagagaattcaaatgacttgaactaactcaatcattcaagcgcggaaatca

SEQ ID NO: 96749 - DNA, 837 bp, Oryza sativa
aaatgtgacattgtaagagagctatgggttatgcatggtgatgcagggtacatgatgcatgggatcacagacgatgtgctactgccacgaggcatgtaatgatttctgttgccaccaaaacaaattttgacatgccaaaccattgaacagtggcctcaccgcgtcacgaaggactgtgcaccttatcccaaggcaagctacactaggctgcaacacagagaactgggcacagatgtcgctgttaatggtctgctacactgtttcagaatgcaatgagcaacatcacactaaggcatacattagtgaaccacaccaagatgccaagagttctgccaggtcatttcatggtaaaacattgttgttggcagtgtttcaacagcaaaatgatctcttcatcagcaaggcttcctggaagcacctccacaaaattgtttttcatgtgaactgactggcaattcctatttagaatcaataacaaaacaacaacatcgacttttggtcccaagaaggttttgggttagtcgagagatgaaacctaccacacgaacaaaaaggaaaaatagtgctaaaaataataaaagatatcactattagaaatcaaattatccaacaattaccaacctccatgtcattgtggcataaccagaactacagtctactgcacatatatatataaatatcacattctacaatcttagttaacagatatcatttggatttgggtggtaactattgattcttaagaaaggtacactggcactgcaccattcagatcaagtattttgcttctcctatgacatcctacaacccaatgtcaattatctacaatctacattt

SEQ ID NO: 96750 - DNA, 668 bp, Oryza sativa
cactaaagccatgctagaaaaactgatacaacaaggggataagcctcacctagggtttctttagagaacttgtgaggagacaataggggagactccggtctaacccctccttctactcctctcctcatcgttccgtttttctacttcgcttcttgatccaagctatgaaggtggagatctagggagagcaatttgctgtagatgggagagatgcgaacacaggaggagaggaggaaggaggcaccggccagggagaggggtggcggcactatgaggggaggtgggattcggttcccctctctctaggttttaggggagaactaatgggctgggtttatgggccttctcatgttggcccacttctaaaaatatttttcttttatttttttctgttaacatctttattttaacaagtcaactgtcacgcccagaaattcacggaccagaatttctaagctgaatgtgcattaaacccctgtccaggaccagccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgaga

SEQ ID NO: 96751 - DNA, 619 bp, Oryza sativa
tgctttccttgttttacccctttccttgtgttaagcgatcgaccttactatatactcttgcattttgtcattattacatggaaatatcaccataatgtagtatgatttagtgcatggcttcctattttactacatgatcttcatttgccgacagttgaggtacatagaactgccctcacatgctattttttcaagcatcacggcatcccccttttttctttgatgtgagcatcacgacattcttatccaccagactaccactagcatttatttactattagaacaggctgaacagaagccaccatattctctatcaagggctagaaattacaacgttatcaaataaaaggagaaatatcgtcactgttcatcaggatgagctcagattataatggtgaagatttattggatatattttagagctttctttactatacctgtatgaaagttacaattgtgtttctagaaataaacctaagagttatatagcaaatgcatttctactttcaatagactataatctagccctgcaaattgcatgaagaatccggctatctctttattacaagagatactgcacacttttgtgtggttagttcttatatccagctattagatt

SEQ ID NO: 96752 - DNA, 515 bp, Oryza sativa
cacgtgtttttctctttaaaatccacaatataatagtatgtactcgatgtactaaatagttaatacatatagaagtttctgatacatgagaactaggagcgagaactagttcttatatgagaaatcatccaagaaagtaattttaagagggcttaaaaaagaaaataatgaaacaacccatgatcaattataaattaagttctacaactcaaattcgaaaagactggtaaggcaacgagcaaacaatgaaaaagttcgacggttcatatttttttttactatagatttgtatcattagatttatcatcgaactgctttaataacatacggtcataaatattcgacactttagtcaaacttttgaaatttcaaaataagtttttacaaaatctaataaatttatgaataatattttaggtaaatttaagtgcacttttttactttctaaaattaagtgtttcaaatggttgagatttaaaaatttgcccaataatcaaatataatgactagagatc

SEQ ID NO: 96753 - DNA, 626 bp, Oryza sativa
tcctacatatgttcacagctcataaccgctattaattcaatatctgcttgtttcattctttctgcgacatagaagttccgagagtatctacaagaaggatcacatgaagcagccacatctactagcaaatgcacgtaatagtaaatgcataataagataaatagatgcaaggacctcatcagttagtacaactgcgagcttaccttaccaacataaatagtgtctattattttcataagtaaaattgcatatacaccattacatgagaaatagatagatgctttccaaacattttcgtagcttgtttagtgacaactataacatcgataagaggctgcgatattcgaagaacgtaccatgaacaagaagtattactttcctttcgtcctcatcatcaaattctgtctgcacctctgttcctctgacagctccagatctcaacaactgtctatcctcccattgagcattatcagcagtcatctgtgataacttcttgctctgagcaagggtcatcagactgccatctttacgagtctgcacccaataaaaataggtagaaatcagaatacaagacattctctacaagttaaagatatgaaaaattattaccaaataactatatttac

SEQ ID NO: 96754 - DNA, 507 bp, Oryza sativa
gattattgagcatgcaatgcatgcattgtttgttctcatccgcacctcctcctgcgtgcaggcagcatgcaataattctgatgcatcctctagtggaattagtactctgtaaaacagtaataatgcagagtacagagatgaatataatgttgattcaaccatgcaaatcattgtgatggctgatcacttgttgtttactgaaggtaaaaggcgcctgctaaataaaggggcacgtctcacatatattgacttgataaaacagtagcgtacgtagtataccatgatgttatacatacagatctgtatgtataacatctaagctagatattcagatgttaaaaataattgcgaatttggctatacttttatgatgaaacaaaacatgttaaaagttgaaactgagcagcatgtgtacgcgactactctcatatgttttttcttcgataatttcttatttaaatatctcaaagctctggttcgtttcaattgcttctagcggcggggaca

SEQ ID NO: 96755 - DNA, 672 bp, Oryza sativa
ctccttcaccactttcgctgccgtttccaccgccgcctctctcatctaccgccgattccattttcgccgccaccatctccccctgttacaccaccgccggtgcctccatttctgccgcccccaccgccacagcagccgaagtccccgtcgtccgccggcgagactaagccgacggccccctctcctcatcggagtaagagaccagtcgggttcggacgctgttcccccccccccccactccgttcgggagcgtgcagctcgaggagccacatgaacggcgcggaaagtagcggggaggctgagcggcgaacgggaaacggtgccggcggcgactctatctccagtgggagggagcactgctcgccggggggcgtcaccgctgtccatccatggagcctggacctggacgcaacggggcaccggtgcactcgtggcgggcgcttgtggtggtggagtcggaggtgtggcagcgacggcaaatgcggcgccggggatggtggcggtggccaccaaccctagaatggcgcccagcatggcgatggtggtgactccatcgaatcgacggaggaggtggcgaaggcgatgaatgcggtctcggcgatggaggccgagaacggcatcgaggatgaaatcaaggtagacgtacttacgcgatttcgggctgcaggaatt

SEQ ID NO: 96756 - DNA, 579 bp, Oryza sativa
taccctacagttgctctggctacaattgcggtaactctgtcctgatgttatttggttgcaggccatagtagatagtcagagaaaggaagcatacaatgcattagagagcattccatttgactacataatgaatgaaaatggcgcccctactaaaatttcccctaatagaaatgtttctgaagacctatctttgtcaatgcaagacgcagcaccaccgccaaatccttctaatcacaatgcagcatatcaaggtcacaaagtgttttatcatagcttttttcttctatttacatcttaaaatagttttgacatttacaatttttttgtaacagtcaataattttatccccgggcttactcacgtctctcaaacatgtccttcacttgaaaactgcaacactgctgcacgtattccagttccaggaggtggcggatcaaatcctttgcttgctgactctgagaatgacctatctgtcagtgatggtaagctctcccataaactgctctttatacctgatttcttgacgggataaacccaaaaagtttatagaagtcactctcttaatttatcgcttaactc

SEQ ID NO: 96757 - DNA, 671 bp, Oryza sativa
tgatcaggcaagacaacgactgatggagcacgtacatggcaaattcttatgcattaaactgaacaaaagctgtcgctgtctgaatttcagaagcatatgcatgtgtaattaacaagcccatcatcagatcaacatcaactaatgactaatgtaatccaaactaagtatgcatgacactatgacagtgatagtcgtggtattccacgcggcagcacaatgtgcgcatggactacaggactgcattacccaccacgaaattatgttctttccttctacaggtaacatataacaactactaactactctgctgaaaaatgttttatttcttcggttgatcaatgacgccattgctgacactccattggagtatatactacttcctccgtttcaaaacataaggatttctacgttatttagctaacactaaggttcttagtcaaaagattctctgatatatcctttcacttgtcaattttagaagtttgaattgtttagattcttttcgaagcatccaatatgcaactagctaggtttgaaattattggagtacttaaaatcatgataatcaggtgcaaaaacgtcttatattgtaatacaaaatttaaatgctatttatagaaaggtggagtaattactatttgtgataattatacaagcagtaaacctcactc

SEQ ID NO: 96758 - DNA, 628 bp, Oryza sativa
tttcaatcaaaataggggattttgcacgcaatttacgctggctagctagttaaagtggatttgttgtacaactttgaaatccttttttttgggtgaaactgaaatcctaaattatacttcgtgtacaatatatattaaaggacttgaatcaatatgcaagtcaattcttctgtttctatatagagagaagatttcctgtgtacccctaaactttgtctaatccttccctgcgctcattcacttttgcataccccaaattttagtttggatcccttccgcaccctttccagtagttgaccattaaattcttatggaaaagtccattgtaccctttggtgtgaagaaactatatatttatgtagtatattattggagtatagaaattttttgtatgagacttttatttatttatgagtttgttatgtgagatattatttacgataaaatgtaactaatgaaaagagtatagaagagattcaaactaaaatttaagggtatgcaaggaaatgaggaaaactcagggttgagggaattttctcttctatatatatactatcattgcactttggatatatataaccattgttatcaatctacaatgttataatttggtcccatcataattaat

SEQ ID NO: 96759 - DNA, 545 bp, Oryza sativa
ttaattagatatatgctgccggtggagcttggcgttttgcctctcaccagcatcgggggctagtctcgtcggcgtcgccaaggcgcggcagacaacgggcaggtaggaggaggcgatggtggcgttgcagtagacggcggcagtggtcgtccaccaccacgtcgccacggccatggccccgccagtggcgcgaggacgaatggaagacggcaggacgctggcgacacgaggatgagcagacgaagccggcgatacgaggtggacgagcggacgccagctcaagattcggcggagctcggagcggacgaggctccggccagctctcggtggattcggcgccccctctctcgctttatctggatctgggcgaagccacttgcggcggagctcgggccaggatgcaccactgctccggctagacggcgtcggtggatctgtgacagggaggctcgggcgtagctgcgcacgaccggtggcggagctccatcgtggccggcctcgtcaacttcaaaagttcttccccggcgccgtctcccggcggcggg

SEQ ID NO: 96760 - DNA, 580 bp, Oryza sativa
aaattttttataatagttaatacttaataatcacatgttaatgagttttctcgtttcacgtgtgctacaaatctctctaaagtcatggaaagaacgctgcacaaactacatgtaatatagaacacattgctctatgtgtctctctgtcccagaaactcttgcctgcattcataactaaaaattgttacattttaggatggaaagaacggtatttattaaatactcaaaaaatatataatatttactttctactttataggatagtgaattgatgtttgtttgacataattgttccttgatttactaatcaaacaactttagatgggtggggataacacaaatgagaagattatgggtgttcaacataattggctaacatcaaggccaagtacacaaggtttatgggtcctaaaataccttatattgcatatcttaatccattcttattctagcacggtactagtaaaacatttcatgactaactacatcctcataggtttgtatagaagaatgatattttttagggtaaattggatacatgccaatataaatttgatgtggttttgagaaatgccattat

SEQ ID NO: 96761 - DNA, 654 bp, Oryza sativa
atcgaaaatgtttcactcgtttaaatctggtgttgtttcaccttatataaaaacaatgtttcagcaaatagcggaaaaatgttttagttcactgcaatattagatctatacacagtgaaacattataagtacactaagtggaacattttttggtgaaacaaaaaatgaaatgaattcccttaatttccaaaatatgtgggttttttattgcaatgaaatatttcagttcactgcaacattagatctataaatagtggaacattgttagtgcactaggtgaaacattttttgtggaacaaaaaataaaccacattcccttaatatagggtttccaaaatatgtgggtgatttattgcaacggcgcgttccactgcaacatttgatccatacacagtgaaacatcatgagtacattagctgaaacattataaaactattagttgaaacatcaaaagagaccacatgcaacattaaaaaaatcaataaaaaaattaaaatatttttttgtcgaaatataatcatgtgtggtcttgttataaagaattaattgtaacgaatttagtggtgcaattagatcgtagattaaaataatagtttacgataaaaaaatcttttgaagaaataagaaaagaaaagattttttggatactggcat

SEQ ID NO: 96762 - DNA, 621 bp, Oryza sativa
ggacgaaaaaagatgagtagtaagaccgccctcgcagtgatcgcaattaatttttggtttctttaaatttgattaaatttattactgtaaaatttagtcaaaatttgttaatttaaataatttcatgacaaaaaaaaaatctgacccccaaatttcgatggaaacgaaagtatagaccctgcactctcgtgtcgctcccgtgggacgtcatgggaggtgaccaaagcgtttctccatcgctatccaacctcccacctttcgttccctcgttgccaccgaagtataccgatggagctctatgcggttgtgatgacgacaacaacagagccttcatgcatcttcctcggtggccctcgttctccaagaaaggccgacggtgacacagtcatgcttaaaaaggatggcaacaagcggatgggaacaaacagatccaacgcttcctcaactggatctggcgtcctcctagctagatatgacgcccttcaatccgatatgtgcatggtgaccagagatgcccccaaggcgcggttggtggtctaatgcgttgagaggccggttgttttatctagggataggcaaataaggcgcactcagtgggcaagttgctagacccgtgtagtt

SEQ ID NO: 96763 - DNA, 681 bp, Oryza sativa
agttcattttcccatgattgtcatttgtctttgctaatgctccaatttcttatggactgaaccaggggctgattttatctttaggctgtgtttagttccacatcaaaattgaaagtttgaagaaattaaaacgatgtgacagaaaagttgaaaatttatgttgcaggaaaattcaatgtaacgaaaaaattaaaagtttgaagaaaaaaattataatctaaacagggccttactatttttttggtgtacagaagtacagaacgaaaagatagaaaaattagacgatcgagcaagtgtagtgcagtgcagtactagtaggtactggtagggccctgtttgaaaaaaaaattagctcagggctaattttgagagctaatgtttagtcatgaattggtaggctaaacattagtctagggtggtatgtttgtatccatgggctaatttaaggttaaaaggtagagagagagtagaaagagaggagagagctgtttttttatggtccccacacaaaattagccctattaacattccatggagaggctaatgttttgagggggctaattcactttagcctcaattttagcccacccgtttggatcttgaggactaattcagcactaaaaggtgagagctaataattagtctaaggaccaaacagggctgtctagttgatttcatggt

SEQ ID NO: 96764 - DNA, 569 bp, Oryza sativa
acataaatatgcaagtgcacggataccgttgtaccactttagttatgcgtattttcaagggcatcgtatttatattttttaggaagacggtgctacgaagacatacttatatcttttcaatccatttataactaattcaccatagtctagacatgagttataataagaggcaattacgtttttggccctgctttttcgagttgctcatttgaccttctttttttacaaacgaggatgagacttggccctattccgtgaaggcaacatgcggtgttaactcacgacaaaagttccatttatacccttgtgaatttaacgcggtttctcaaagttttttattcaatacagttttgtgcacttattagtatatatcaaattgcgtcaaacacaaatacatggtacaaatttatgtctaccaaaaacaaacaaaaataccatgtcaagcaacaggacaccgcgccacagacggctaactcctgagcccatccatgcggagcagccgccgccactactcctccctccgcccaccggctccgctgctccgacccggccaccgactgtgcagctcc

SEQ ID NO: 96765 - DNA, 529 bp, Oryza sativa
tatccctctttaaccttgtgttgtcaaagaaaatctatagtagctagaatggtgttttatctaattaagaatgtggcaagatttttagaacgcggataaagcataacacctatctagttcaagaagtcagaggagatagttggggtcgagcacaacttcagatcgagtaaaactgagcataggtaaacccatacagatgtatttactttgggcacattaataggtaaccacatatggtaaatactaccctgttcgccaacaccgacatgctagagctaacgtggtgaaaggatgctgttctccaatttactatatctgtgcgtttctctaatttaactttcttgaaaatagagtaaaatacatggagggtcatccaacttatttagttgtgtcatatagaatacacatattgataactaatgtgaattaagtgaaacattttagctatctaactatccatgtgaacacatcatgtacacaaagcgtgccagtggcggatccaggatatttcatgagcttgggcaagcta

SEQ ID NO: 96766 - DNA, 524 bp, Oryza sativa
aattgtaggacaatgcacagaaaggaggcaattaaaactgtgtatcgtgaagttggtggtgaatgtaaagatggatcaactattggtattgacatgaattcccataacacatcagttaaggaggtacaataacttatcacattcataacattcctcttctgttttcttttcctaattcctacatatctcttgataaactgattctctttctctctctctctctctctctctctctcacacacacacacacacacacattcataaaaaaacagtgcttgagcaaaacagaggttgtgactaccgactcctgcccagaccgtgtaatcatcccagaccctacacctaaggttgtctttagtttataaaattaagtgtcaaatcttcagttatattaatgttttgttttgaagtacttcagtattttgagtatttaacctgtctatagcaaaattggttttgctgttgtaagatgcactgcagaaagttgtcattttcttctttttcgtgtttcttaattgcataat

SEQ ID NO: 96767 - DNA, 719 bp, Oryza sativa
tcattattacccatcagttttcgcagtgagctaaactttccccaaaagcttgcgtgttgtgttttgccattcatcggtcctttcagagcaccgcaccaccattgttgcatgtccaagctcaagctcacctattgcccaaaatatactgctgtgccctccccattgttcttcgcacagaggacatctcgaggtcgcctgcaggagtatgaagaccggcggtcgtcgaatctcgaatcgtggcagcaagcatagagggcagtcgtcgtctgcatcatcttcatcgtcgccagtccgggcaagcctggcagaccacgcgcatggcataggctgcttggcctaaaaaggaagcatccacaagcccactttggtgtggtgcatcggaggaggagaaaggtgccgttcgcaggggcatcggcgcttcgtgcagagggaaggcatcagctgcccgattccggaatcgctgtggccattgcagagaccggtcatctccgatctcgtgctgcacagttgaaggggatttggcgcccttgcatcgccattgcggaaaggggatccagctctatataagggcatggctgcggtaggcgtgaagcgcaaactcatcgtcgacaaatcccctacccatcacctcctccatttgcctccgtcgcccatcgctttgcttagaaggagggggctaccttcagatctggaatcctctgagggtttcttcacatctc

SEQ ID NO: 96768 - DNA, 627 bp, Oryza sativa
ataaccagactgatccacaaactaaggcttaaccactagacatgtggaagtacggcagtgctacgcaacagaggcccggagaccggtccttatatggccgaggtgctactatcaaaaccatgcaccccgagcccagcctaaaaccattttgagggttttgaatagagggggaggtgtgaatccaattccacaataatccaaccattccataatgtccaggtgatatgaatattcccaaagtctagagctgtaaaaccacctaatggtgcctaattaagcggcgaagcatctacctaaattcatactagtggtaccatgagtagagtgtccactagttggggttttgtttattctagggtgaacaaggtaataataacaatcgcaataataataaggtcataacaaaggtaaataggcatggctaaataaaacagtgataacgcgggaatttaaataaagcaataatgcaataatttaaatcaaaataattttataaattgggattcaatatgttcaaggatgatgtgacttgccttgctcgctttcccaaacgtcggcttcaacctccacgaagagcggatctacacgaccaacggaaaagaaaaggcttttactctaataaactcc

SEQ ID NO: 96769 - DNA, 599 bp, Oryza sativa
tttctacaaattaacagtcccctcaggtgccccacaaggaggtccttgaacacgtgtcatcgattctcaagttttataatttttgtcctactggagaaggcatcagcattgaaagcctaaacctgtacattcttgcattcctttatattttttctgattatagtttgtatgccataatgccttacatgattgacatgatgtttaattatttcttctgcttgtttttgaagctcccgctacgactgccccttgcccagtggactcatacttgacgaatttggtgtgtgtgtatttgttttagcccaaaaccatcctatcgtgatttctgcaaatagtcccatctaattttttttttgtggtaaacagggactactgtagctactcatctgcatgctggaaaggaaaaggtaaagatgtttcttacttcactgcatgatgtttctttgttgtgaaggtatttttggtgtcccatttttgttttacttgctgctgtttttactttgggttagggcactgaatccactgactttgtgccaagtggccttgattcttgagtgtttctgctttttaaagacgttccttgcatgtttgtttcccca

SEQ ID NO: 96770 - DNA, 554 bp, Oryza sativa
tcatagatagtataacatgtgtacaaggtatgctcatgtggatagttagaaaggcaaattgattgacttaactcacactagtgatctagatgtccattttgaaagtagattgacctacacaattccgtaaacaagttaagtggtcctccatgtattttactcttgaaaatataaagcctaggcaccacacctaagacttatactaaaactcttcctctgatgaaaaggaagaactcctaatttacctaggtgaagtaaactcgaacaacaaacccataaagaactttataagacttgcaattcataaacgatcggctgaaaggtcaatccgacaagtaaacgagtaatgtgcacaaaagaaaatatggaagataaatgcggaaagtattcggcacaaaataggaaatgtacgaaatcggaaagatacaacatcattactgaacttccaaaatagatccttcagagtcagttcaatcaaccgactcgacttgactccaacagaacccctcctattccttgaactagagtcggttgatccatctcagactcctcct

SEQ ID NO: 96771 - DNA, 566 bp, Oryza sativa
tttgagtttatctctcttatcgaatttatgtgtttttctgcgttgaatcaaatggttatttaagcgtttttaatgtgttttacattctttattagaatactacgttgtttctatcaaagagggcctaatagagacgctaacaaagcatattttgaatttgtcgttgtttgtaactccggaatgtgtgtgtcaacataaatataccagagtacgatgaagcacaaaacgtttctgtttacacctaaaattggcatgaatgttcaaattaaggaaaattgctaagatttgggaaaaatcgctggtttcctccatagggccagtctgaccggcgtgtattggccagtcagaccgttgattgagggtcggtctgaccggtggcatgtggtcgatcagaccggtagagtccgagaccgagtctgtttttgtcaggtctcggaattccttgctcgagagactatgcttttggtttcctttggtttctataccgagttgaacgtggaggagaatctgtaggagacaagaccaacccctatataagggacaaagccggttcaattggaggagaa

SEQ ID NO: 96772 - DNA, 580 bp, Oryza sativa
cataacttcaaggggacaaggaggtataattttgtgtgtgtgcatgaaaagtaaaggggaacaggatgttggtgaacagtgataatgttcccacgttgaaacaggataatgtcccgcactgaaagaatgagatatttatattgatgacttcacagatggagcacttgtgagagatgaagcagaggccaaaatcttcaatgcataagggtactccaaggaggtcacaaaaatcaaggactgagaagaagaagactccaggattgctaacaacgttgacatccatcttttccttggttggctctagctaagggaatgacctcagcctaatagagtgtgtttttctcttcttatgtaattcaggtcttcctgaactagaaattctcctctggtatcctaaactatgtgtcctcactgttgtctctgttctgtaaaccagaatatccctttagggtgttaggaccctcaacattctttgtagaacagtttcttcatctcagtctgccatttctcaaagtccagattttagataatggtgtaatgctaagaatatctgttttttccagttctcccaaaaaaatgc

SEQ ID NO: 96773 - DNA, 559 bp, Oryza sativa
aaaactatgaggtgggccccccaccaccaaaaaaaaaaaaaaaaaaaaaaaaactgaagaaagaagagaggagaggaaagagagggaaaaggaaagaagaagagaacctcgcggggtggcatcagcccacgcaggccctcagcattcagtgtcattgagcatgtaggctgtgcaccacctgtgctacccatgagacgatcccaggtgcctgtggaacgcagagcaagaacaccactccctccctctccacctgcatttccatcttgatcatatggaggagaaagtcttagtttaaagctagcctgtctttgacactttcctactccctgtcaatctccattttaaacaatgaaaggcccggtctcaggccataactttggcaggtaacagtgtaaggttagaatttaatgatgccatgtaagtttcatatatatgtatgtttagggttgccatctatgtaagacaactgaagattgttttttacttacactggtcataacaacttttaagaatccagttcaagtgagttgataaaaaggtcaagtccataatagtgcag

SEQ ID NO: 96774 - DNA, 630 bp, Oryza sativa
cttgcgaagccaagggaggcgacggcgtgggtcggcgtggaccaaagcggcattgtgaccgcggctgatggtggcaatggcgacaaaaagaggtggtgcgcgtggcggcggcgttccggagacggaatgggaaaatgtagtaggggccggggtggagatcggcacgccgatgccgatggtggtgtcatcgcggctcggtggtggctagtgcggcgggaggcggcggctggagcacgccggtgagtggtggggagtgggagcaccgtggggaggtggttccggcgacaaaatggggaagtggaggggatgctgggttacggcacgacgtggcgaagacgttggtggcggtcgtgcggagcggcggcggcaggagcagcggtggcggccggttggagggtcgccggcgagcggcggcgcttgggctcgcgtggggaaagtgggagagagcgcggggagctcggggaggaggaggaaacggaagaggagagcccggggatcccttttataggctcgggaaggcgggatcgatcccgggagaggcggcaaccgacgatggggtgggctccggcgacgtggtgaagtggggcagttcagcggcggttttggaggggagaagagggggaaggggtg

SEQ ID NO: 96775 - DNA, 634 bp, Oryza sativa
cagggagtgatcaggagcatcaatgccaaaccccagcctgaacgactgagatgttggttcggccaaaccatggctgggcccttctggcctggcctttggcccatctcccgctctgatcctactctatctaattttcagagttttgggctgattctcaaatgttttaataaagttgaaagcccatccttatatggatatggttccttctccactttagtgtgattttcctcccaacttcggggtttatcatctgcatacaaatatacaccaacacttgtagaaaatgtgagatttaacacctattactatgttggatgttttattatctgtactttaagcagatgttggcggtatagaatcgatatttaacagctgccaacaaaaccacccacacttagctctttagtcgtccctgagtaaaggcagtgtagaatgaaattttccaagatataactcaagcatatagattattcaaaaccatacctgtacctgtgaactttatcagtggttatcttatcatcttgggtaattgataaatggaacggtcatgattccagtccttcctacttcctctgtcagactcatggggttttatgaatttttcacaaaatagctcttttcctcttactgactt

SEQ ID NO: 96776 - DNA, 2572 bp, Oryza sativa
ttaacggcgtaatcaaattatgccgaaaccgagtcaatctcattggctcgtttttctcattggcgtgcggttctagtggacatcggactatccgataaacacaattgcactcggccttggtgagtactagacattctagtgaagtcaccaacacacataccgattgatctcatcaacccatgcggctatcggttcatctcatgttccgatcacctaagaactcatatacaacataatagatctcatctactacacccgcatatcaattatatgcaatgatctagatcataaactatacaaggtggctctgataccactgttgggttacgcgtaggctacgatagcataaatcaaaattttctatcgcgtaaaccaggaaccatgcaagtagtagatcatagatcgttactactcgatgcgctgcgcagtggaagaagacgctgagaagtcgaaggaactctcgcgaagtagcacgcgtcgatgtagaggaagtagtcgatcgcaccggctcgaccttctcctcctcgtgcgttctcctcaccgtactcccacaccgatcagcatcgcaaactagcggtgcctctactggtatccacacgtacagggacagaacgccacgcacagatgtgctagcacccgcgtgcggctagggttttgctcggggagggaagtgatggctagggtttctcacgtgatgcaatgcctccgccggtcatacccctcacgaatatataggatccgtcattcgggcctctaaggcccgtaggactcctattcagatccctatccgaattaagctcatattggatctccatccaatcctcttattccggcccattaagcgtgcgaccctataggttcatgtatactcagctgtaacccgaaaactccttttcggtccacgtgtcaacagcggcctctaacagaacgtattgacccaccgggcatacataaagatcatatcggctgaacctctagtgtatacttgtatgaacccctttgcctcacgatatcgattaagctcaaggctggatatgtgccatcctctaatagctcaatcattcactcgaacctgttgatagattatataacttgtgattgactcctcaatcacctttggcatggccatgcacttccataatctacaacatcgaggggcccagagatatctctccataggaggggcaaatcctatcttgattattcatatcccactacatgtttcatagcatactcgaaaactacttttataactacccaattatggagtagtgtttagcagtccctaagtaagctactacacatgttgagaaccatgataatctcaggtctaaggattcaacaccaacactaaataagatcactgatgacacaacacatagagctcttgcagtgtctcatgttgggtctatccaacaacatgttcactaacatgtgtccacattattaatttggtatctctataccatgatccatgagacatgatcatcaattaatacatatgctgatcatataaacatatttgttccacatatgatatttgattagggatcctttagaaatagtaacaaacaacatatagagtctcatgaaagaataatatattcattaaccaataatgagttatctatttcaaggaacaatgtcggataaatatgtaaacatagtatgtgatacaatcatctctatgattgcctctagggcatatcactaacaaaagccgtcactcgcccttcaccaccggatgtggttctttggtgccaagccccttgctttaccttcaccgctgcatggtccatcgtgaccgagcatcgcttgcccttcaccgtcatgccatagtagccacttcgtatcccacatcttcaatatcttcaccttgtcattcatggtattttaggtgtaatgatatcacttgagcatcaacacctttgcaatctttgggacctatttctttcatttaactcaataaaattattagtcacaatgatccggttgtcaacttccacatgttgaccaactgatcgcatgtataaaaggatatgaataaatgatgagtattaatcaacaccacaagtgtcatatactcaattatatgctcacatgtaaagttcccaattaaataaaagtgaataacttggatcaattacattcataactaaagtataggatttgctccccctaaatgtatgcatataaaatatttgtgtgaagcaagagtatgcataaaaagatattaaacattgagagcttatcctatacaagaatagaaggcacttatcaaatatagacaataaaataaaaacataccttcatcatctccatgttctcaatgtaaagagactaaacaagatatggctcaaacaaaacattagtctcacatgcttatgtaatcacatgaaaatattatatatgaatatatcaatatgtgcccggatagaaagagtgatacatatagcttgatctccatgtatttcatccttgtgatttaggtacaccatcaatgaacgtttttctctcaactcatatgaagtccagaaatcacctctcacatattccactttcatatccatat

SEQ ID NO: 96777 - DNA, 1710 bp, Oryza sativa
ctaagagtgcccgtcgtggtgatcttctacttgtgtcatcagtagagccactgcctgctgcttcggtggcggcggcgcaacccttccggacacgagcgtcgtcggagaccaccatgctcgtcacgggtgccacgggctacattgggtgttttgtcgtccgcgagctgctccgctggggccaccctgtagtcactgactcgctgtcacgcgctcccggagcggcttgggcggccgcaatggccccgacgagttggtcgcggacctcggccccacctgcgtcgtcttcttcgacgtcaccgaggcgggcacgctcctcattgacctgttctcgcgtggccccatccacgccgcggtctgctactctgctgcctcgccaaccgcggcggtggcgtccaggactcgtggcgcgtggaaggtgggagaaggacggaagaagacgaaaaatgaagaggatggatggaaaaagtgacggcagtggtacggttttaattttgtaaaattttagtggcatagttataaatttgcagtggcatgaatcaaattaacccatgtttctaaccttcctttatctatcccgggggcccagctcgacatgctcccacctatcactgacttaggctctccaccaagccccatccaacctctaggtcgtgcacccacctgttgacggtcgttatcgatcagtttcggccgtcaatattaccaaaacagaggagacctagtgatgcttgcaatgcatatatctactagaatataatatcccactactataaggtatactaaccttttgcagagaatgacaataaagtggaggagaatcgacatcaactcaatcgataaatcaatcggacgatgtcgagaaccagacttatgtatgaatgggccaagaactcagaattaacacgacacactgagccaaaattcacaagtctacggagaggaacaccagaggaggacaccagccaacttgtgggctggttgggccagcccagggttcggccgaaccaatgctcgcgccgatggatgcagggttttgagggaacggtggagattcacgccctatggcggttggagggtattaccgacctttccaaccaccataaccgttactacctgcctatttaaggagttcactctcttcacttcaacacacaccttaagcatgagctcgctcatttctctcaagtttagtttagtagtatctagctggtggaataggaatagagtagaaatcaggagtccggaagcctttggaagagtttggatatggctctagtagctttccttttctcttttgtaagctttgtacttttattagaatactcttctatatacatttatggtattgaaatattttccgagtatatgagtacctactttacattatgttcatgctatactgaatatacggttagcatatctgggagatgctttggtgagggtataatgtttgcttatgcaattactctatgtcatgacgatgatattagagtagtatctgatagtttaggcgtggtgtctagattacgggatatcattatttggggttataaactgtggatgagaggtgagctactgatggtgacagttcagtacgagtattcctccgcactggtatataatcctaagttaattccctgcggagggtattcctctgtatttagccccggttgtatggtcatgacgggctgtcgtaaggaactcggcagt

SEQ ID NO: 96778 - DNA, 692 bp, Oryza sativa
gtttgggtttatcaagcaattgattggatacaatatcattgctttttgccacataagtgtgcatttttattgaccaatattatggcttaggctgattatatattttggtcattttccagacgattgataaatccttatgagtttatttactcggattttataccacatatgccatatatttccaggtatggtgaaaccatgtgtcttttagggactcaagcacatctgttaaagcagtgtgcgcatggtgtatgcccaatactttggaaatttatttattcacaacatacaagcttctttatagctgttatgctatgtgtattcaatgatgtaatcagctttaggttgcacgcatcatattttacaaagcagtcggtatatcactcggatcctgttattcagggattcacaccgcatatgctatatattaatattaagtcacttggttgactataattatcaaaaccactcagttggtgcatctattaggtacatctattcgatgcacctgagtttatttttcagccctccacagtcttcatatttggtaaaagtactcgggagatcatggcgaagatgattgaagcactcggctttgaagtaatctagttcgagagaagattatctttccgactgtgaaggtctcaggggctactgtggagattatgggtaccgcatacccacacggcatg

SEQ ID NO: 96779 - DNA, 543 bp, Oryza sativa
tcgttatgagatacgcaccaaactgctccacacttgggttttgccttaggggacaccaaatgtgaagtgtgtggcgttcgagtctccttcagaatttggtccatcagcaaagcactgaggttctagagatgatgtatctgccatgtttttgggcatcacgtgaccatcattcttttttaatcttaacctgaaatggatagagaccaaaagtacccgatagcaagacttatcctaaaaacatatacctgcttttttgatgaagggaaatgataatctgggctacctcccggtagcgcgttttttatggtcgaaagctcaaccatggaaaatctttacgttgcaaccaccattggcgatgtagttcacacttcaccaccagatggtgattcatcattgaagtagtatctgcactgttagtgccacaggtgcaaccacgaaatatgccatgtttatgataaacatatgcatctacatgcagccttgtgaacactatgtcggctaggatcttaaggcggcatgaatgtgcttgtggcacaaaatgtg

SEQ ID NO: 96780 - DNA, 1397 bp, Oryza sativa
tttccatagaaccagcaaataggtatcttcaacatagtaaaataaaatttggcatcttttgtagagaacatagatcaaaaccttaacttagtgaaataagaatttaaacacatagtgttgtttaagtaatacataaacatgtataagtatatatacactttaggtctaattaaacctaaataaaaacttgattgaccagtgaagccatagttccatcctcatccactaaaacttagaagaacttagctcatatgacaatttctaggttaatataatatattgctagtttagattagagcatctctagtttataaaatatgaaccatagtagtaaagaccataaacatgtgaaataaaaatgttttagttaaccaaattattccttttattcaacttaaacaggaagtagcatgttctgaacctataactcaaaagtcatgaacatataaaacactatatgcctaaaacacgttgtaacttgtaaaatctataagaaaatcattataactccaaaaatggtgaaaccaaatgtgttagtcttagaaaacacatctccacacccctgtgaagtctaatctaataaaaatcactttacaaaagtatttcataacactacctaagactatactactataaaccgataaaacttgtaaaaattcataactccctaatggaataagataaaataaaaattctttcacctaaattcattttagatcagtaccaaaccactgtgcataaatcatgcattttagagcattttggattttcagctctttcggtgtttaattgcatattgtgtcctttatctagataattgcataatcggtgaaggagtggattaggtgctaacatttatctgaccaaggcaagttttctcctcccatcctttgaacacattgaatcccatgatttgaggaatgaaaatatttgtttggaaagttgcatgtgaacttagactatatcggtatttaaaattgggttaaggtagttataacctatttgctgcattccctaccttgaataattgatcctccctagaaatggttagagtacacttgttgtgctcaaatgggtttatatatgctctatgtgcaactacttgcttagccatgtttagaactatgcaaatgctcattccatcaataattaaaatgtggttttgatacttgaacctttgctggaataaaatgaatatgatgggtatttgcgaactaaaatgtgtaaaaatgtgattttatacttgggcggcaagtggtgtgcatatggtgttagttgcataccgatagagggagtgttagccaaagtccataaggaccgaacttgtgtcacccatttaaagatattcgtacatccacatgtgctagtatgggatgactaagctgattaatctattt

SEQ ID NO: 96781 - DNA, 553 bp, Oryza sativa
cccaaacatatctctaagcaaaacttgttaagcacgtcgatcgattctagaaacaatcgcgcaaccgtgtttattagaatcggttgtgtcgactgtatcggatatatcagctgacctcatgacgggccatatgagccgatacaaaccccaggtacagccttctcagccgagtgcatactctgaactttgaatcctactctacgccgaatccgcttcgatcccaatgctgaacctggatgatatcttaccaaatgtggatgctaacacatgccccacaagaagttgctatataggaaatcgatgggatctgcttaattatcttgtccgaataaaactagggcgtttcattaccgagcgtaattgggccggtactacgctcgctgttaaataatacccaccgctttgatcattgcacggcgtcacttacggtttaaccgctctagccaaaacttttcccaatttgacagcatgagctctccggcgacctcctagaattatccggcgatccacaggcggataccctacgacaccaatcttcgatatggacaatgtc

SEQ ID NO: 96782 - DNA, 722 bp, Oryza sativa
tagggtgtgccttcctactctgtgctgcgccgtcgctcgtagattactccatcccgctcgccggcgtacaccggcgatcgggagagcaggtctccggaacctctgccttcgacgtcctgcaccgggagaaggcggcaataaggtttttgggaagcgctttgcgcaactgctccctgttcgtccgcgacggctcgtcttcctcttcgctcgcgtgtgcatgccttcgtagacgcctgcgaaaagtttcgaccaagcagccggtctttccgccacctcggtacgtgttcaatatgttgcgcatatttgatctgttcatgttatactgtgtagtttatatatgtagatctaatgatgcgttcatgctagttttcatctgtaatgtcatgatttatttatggaatagattaaatcattatatgcttataatctcaacaaatggttccacataaagctaaggaacgtgatgctcttcttctactccaaaatgaagtaaagaaaaagactagaagttcagagtaggaatgtacgtaaacgatgatcagaaaaaggcagtcaatttacacacttctccaatccgtttgcaccagacagctgcaagcattctgcagcatcttctgatgaaagccccttgtgaaatgtattcagctcctcaaaaacatctataaggggaagattcacctgttattatatgcccttacaaagcacagcattaagagtgcttt

SEQ ID NO: 96783 - DNA, 512 bp, Oryza sativa
ttagtatctcaatatagagttgtatcgaagtattagccgatacatgctagatctatctaatcgactacgctatgaatgcttataatcttcttgttaatatatatttcgatctaagtgatttatattgtctcggcatggcgaccgatctatcccaatcatttgatttaagtatatatcgatattaggattatatttcattaataaccacagctgatcgaatagatttagttcgttcttgtttatttatatttgcgatcgactcaaatacaacattggctcaaagatagatgatatgtcatcggcaactggccgatcggctatcatttatagatttaactgctatttttctgtctttatgttcgacgatattttgtgcattttttttataaatgaaagaaatgaagtgtgtcaaagtattaatttcgggaacggcgatataataacgaaattggtgattaattatcactaataacacaacctggcgtacatggcgtatacgtatgaatattgtg

SEQ ID NO: 96784 - DNA, 822 bp, Oryza sativa
aaccctagattgatttcgcgtatattgcgtgaagacggcgggttggtttatatagagaagggtcgcttgatcagggcgcccgcacgatctccactgcgcgtaatcgaatcggataagtcgcgcgtaacttatccggactccacgccgtttgcacgcaccggatttttcagaacgtttccaaaacaaaaacgaatccgaatttgcagcaaaacaaaactgcaaaaggaggctgcatctgcgcaaggtgaggaacctgccctgccaggcgaggcgaggcgaggcgagcgagtgcgcgcgtgtgttcccccctcttctctccaccacacatgcttcaagtggctaggagggcatcctcccttttaaggaggtccccctctcctagaataagcaaggtggtactaaactccacatgcatgtcatcccatgaggtgggcttttgtgattttccaaataattaatcttcgagtgagctaaggctcattcattaattccaacaatcccccaccaaatctcaaaatcccactgagatttgccttttccaatgtactgtttatataccagcggttcgatggagaccgattaaggttgaacatccacctagaactccaagctacacttactcacaaattgaacaatggactatgccttgaattgcaagtcttatgcaagcaagtttcactcagagtcttatctggtactagaccgtttgtagactacccctcgggtggagcgtataagtcatactcctaggtctatagtaagcttcatagaagattcagccaaaatctccatagactgcgaccaacagtcaagctcacaaag

SEQ ID NO: 96785 - DNA, 593 bp, Oryza sativa
tcggcgggaggtgtttgttctcgggtgtcactatcgtgttcagccgcttcatccacatcttctgccaattcttcaccctccaggaatgctgctacatctagatctatggctggcagaacatatgcagtagccttttgtttcctaggcttgttctttgcagccgatggtgcaccagccgactttgctcttttctttctaccagcatcaagggctatcggcacacggggcagatcatgcaacaatgttgaagtcttgggggtatggtagccaatgactggtggagccaaaccaccactgttgggcaggagtcctagagcatatagaatttccacaccactgttgctatgatgaggaggacaagattctgttggctgcaaaaagcaaaattacataagtcaagattagtacattagcttacaattgatagaattgacaaagaataagattcttacttgagggacagcttcaggaatagatctgtcatatacattgaagctgatcgatgaaacaaatgttttttccactctatccaccatcggttagatgcagcacttctcaacattctcagtttaatattgtcgatactgcctaaa

SEQ ID NO: 96786 - DNA, 1195 bp, Oryza sativa
tagtagaaatcgatccagtaaccatgttctttgcagcataacctgtccaaccacatatgcttctagttttgaactcatgggtggatttggtattcaaactggccaagttagccgatgaagtgatatctaggcctgttatcattttaatatccaagagagttggggtcatgggtccttgagagaaaagaaaagcattcatagcagtggaccagaaataggttgcagctaccatcataggttcttccttggccatatctgccacagttagggctaaagcttgagatatgccaatttcttctcaatgggttagtttgctagccgacattctcatgtaccaagcgggccagctcttctcggctgatggccaagatttgaaggtgttcttccaaaggctcagatctgggttggcgaatctaaaggggattcgattggtttcaccattgatgaactctgtgggatctggattgctgactgggccaaggaaaatttgatgttcatcggttatgctagggactgctatctgatgagaaagatgctccagaggacaagaaatcgaagattgatcaaagaaagaaccaatctcgtgtgaaaaagagggagtttagccgatggtgcttacctcaacgtactcgacggttgatgctctcggagggctggcggaggtcgacattgtcgatgacgaagattggtgtcgtaggggatcgcctttggatcgccggaaaactcgaggaggtcgccggagagctcaagacggcaaattggggaaagttttggctagagcggttaaaacggaagtgacaccgtgaaatgagcaaagcggtggctactatttaaaagggagcgtagtaacggccaaaataaaatcggtaatggaaaccctagttttattcggagaaggaaattaagcaaatccacaacatttccaatatagcagactcttggggggcatgtgttaacaaccaaatttggtaagatatgaaccaggttcagcattgggatcgaagcggattcggcaaagagtaagattcaaagaacagagtatgcatcggctgcgaaggcattagctggggtttgtatcggctgagatggatcggacagagggcagccgatatagccgatacagacgatacaaccgattctaataaagacggttgtgaaattgtttctagaatcgatcgacgtgcttgacaaggat

SEQ ID NO: 96787 - DNA, 599 bp, Oryza sativa
caatataaaaagggggtagcgcccgactcctaaaagtggatgtatgtggactcaaaggatttaaacaggttcaagccctctgattgataggtaataccctactcttgtttggggatttaatcacccggggtgtatattgttctgacgatcagtttgtgtcatgccccctatagggcctcctgcccaccttatatagtatggggcacagtatgcaaggatagaaactttacccaatacagtatcggtttcctaaatctgttttccaatattatcaaatcagcactttagaccgctctataatataaaaggaaacgtaatacccgagtcatgatcggttacatattccatagatataagcgatcccttatggctagtcggatagccatgccgtgtgggtatgcggtacccataatttccccagtagcccctgagaccttcccagtcggaaatataatcttctctagagctagtttacttcaaagccgagtgcttcaatcatcttcgccatgatctcccgagcccctttaccaaatatgaagcactgtggagggatgaaaaataaatcgaggtgcatcgaatatatgcacctaatagaggca

SEQ ID NO: 96788 - DNA, 724 bp, Oryza sativa
actctagaggatccccctcagcaatattccattccatttccatttttaccaccaaaataaattctccatgctttcatgtgctttcttctcctaaaaagaaaagtccttttgaaaaaaaaaggacaaaaggagggaaaggcatggttatgaaaagaaaaaaaaaataaagttatgctctcacaagcatgagcatgatgttgaaaaaaaaatgtttagccatgccctctcctaatcaatgaaggaaggatttttgggagaagaaagtaagcacaaaggagaagcatttttctttatttttcctcatgtgacatttccatcatataccacacacacattgcacgatcttgatcttgagtatgcttagttatctgctttagtctgagcttttgacttagtaataaatgtgaatgcaagtatgccatgattgatccctaccgagatccacatatcaaaccttaggataggaatcaaaaaggcaaaatatggtgaggaattcaaattgatacacttggagagactgagtgaatcatttgaggaacttggctttcttttttcaaaatcatttgaaaacttccggaataagagttgaataaatattgggtgattggttctctaaattgcagttctgtcttccaaccgcccaagacaaggagaagcagtgtctcgtgtgaatcaggggtaagggtaagccaccatgccaaagattatttaatctgcgagagag

SEQ ID NO: 96789 - DNA, 1288 bp, Oryza sativa
tatatggtgaaatagtttcggcactggcatcccttaagacaatgaaagaaagatgaaaagaaggcattcctattggtatagttctcttcctatttatatttgagtttaggaatgccgtactattaagagggatgcaacgtcgatatgtttgcgtatgtctcggtgctcaatgtgccctattatatttgagttttagggtttagggttagggtttagggtttagggtttagatcttgttattggttgagttgggtagtcctctgagttagctttccatagaatccaagttcatcaaaaacagactcccgagcgaaaagttattgtcgttttactctgtgcttttcgaaaactccgaaaatttcagaaattccgaaaatggctgcgaatctgagattggcttctgtatattgtcggacatatccgaaaatgcttttcagaacttccaaaaattacagtattggcctccaacagctagtttttgaggggctcgggtatataaactcctccacccctcctttgagtggctgctgttcttgggcaacattagatacatccaaagccaaatagccatccccatttccccacctttgtggtgcctctttgtgacggtgatttgagaagggaagagagttggattgagagagtgaagagttgagagctagtgagcttcacttcatcctttgtggttcctctttgtgagagggatttgagaaggggagagagttagattgagagattgagaagttgagaactagtgagcttcactccatactttgagcactcgagttcatagcaagcaaatcttcggttgtgtttattactcttggggactaaggtctcctagacggcaaggcgtcgccggtgagcacccaaggtgtggtgtgccacggaaagtttgtgaaggcttcgatttcgcctccgcaagggaagaaatcaagagtgaaaccgaggagtgcatttgtgcaacctcgtgaggaaagggttgaaatagacccggtcttgtggcccctcaacgaagatgtaggatccgtggatccgaacttcgggaaacaaatcaacgtgtctcctctcttggtttgcttgttcttgccatctctcatattgtgcttgagcttgtttttacccgatctacttgcatgcttaactaatattgttggtgaccttatatcttgtttagataccctgtttatcactttttgattcatatacattttgtttatgcgagctacaagttcatagctagtgtttattctgttatccgccgaacttttcggttgagaccggaact

SEQ ID NO: 96790 - DNA, 569 bp, Oryza sativa
aaagaacgaatgcaagattactgtcattactattcttctccccctaagttgaacatcaaatttaagtacaccaaaaaggtttccttccacaaattttgagtatgcatgttcttcatgaacatattaatagtataagtcatatatgtgcgtgcaaatgcacatgttgacaataatacaacttcttggtgtatcaattctaacaactaaacatgttgcatttaggccaaaattgcttcaaatgttaatgaccaatttactcaaaataatttacatacatccataaaaacaatacttcatttgtaaagtcatttatacgtaaaagatggacataacattatcaatcaaattaactatagacactgcataggtacatagtcttttgatagataattttggtgtagggcatattggcatatagacttctcgactaggtattcgcaaattcaatgacattgtatatacttggacacaattaatataaattagttgaagcttatcttctatgatagtcatgcactaataaatatctctaagtcaataatatactctcttcatggctaccgagctcg

SEQ ID NO: 96791 - DNA, 615 bp, Oryza sativa
aagcttcatgaattttggcataatttttagacccctgcatcatagtgaaacaatctagatacttagcataatcatattctggaaatttgtagtagctgcattcatcttttcatgtagcccaaaacataattgataaaatatgcatctttttacagtagttttcatacataacctgtaggctccacgaattttggttgaatttttgagtcattgcgtcatggcataaaagttcatataatactgtatagttctgtcctgaaatctgtagattgtcagtttcacaaatttgtgtagcctaaactataaatgataaaatcatgattcctttagggtagctcctaatctaacccatctatctctctgatttttgtcaaaatttttgtatctttagagctagacctaaaaatttgattaagacagtaaagtgatgaatcccagcacctagcactcatgtcggattaacccctatcctttgaagattattagaaaaccctagtgcaaaaatttattttattttaagggggatagtaagccatatttgtatcaaaaccaaagataaaatttttaaccctgcataattcttcttagacctaaaatagaaatcccattctaagt

SEQ ID NO: 96792 - DNA, 727 bp, Oryza sativa
tgttacttgaaggcagccgatcaggttaaatactgacgttggcttagattatataggatatccaccactctatgaaacatccagcggcttgattatctagatgttgtccttcttttcatacttatagctgcatcagttgagtttgaccttataagtcgtgattagaatcacgatctctagcctgctttctggttgccgattagggtagtatcggggtttcagccaatcttacctgatttagctttatgttccatatgcttaactgatatgctagatctgccctttatgttaagatcttgttacaacaaagtatattaggcttctgtttgatatattttacttgctttaatatcttaatatagattagtatcggagtattagcccatacatgctagatctatctgatcggctatgctatgaacatatataatctcattgttaatatatatttcgatctaagtgatttatactgtctcggcatggcgaccgatctatcccaatcacttgatttaagtatatatcgacataaggattatatattgttaatatctacagccgattgagtagatttagttctttcttactaattcataattgccgatcgattcacatatgacattggctcggtttagagataaatgatatgacatctgcaactagccgattggctatcatttttggatttaaccgtggtttctttgtctttatttcttattgattgcaggat

SEQ ID NO: 96793 - DNA, 1350 bp, Oryza sativa
cgaccaaggacgtgaacacgcaccccggccgagccgaagaagacagttttcggctgcgtgaactttacgcttcggccggagcgttcggacgcctggccggtgcctgcgttgatggcaaaatgggaccgcaactggatgcagaagtggttctacgtcgacaacccatactccaccgaggacgacaaggcgaactggctccgctttcggcgccttcctgtttccatcatcgccaagccaagtgtagagatcgacggcacactagtcccggctcatccttcttcacaacattacgcggcggctaagtacccgcgacctctatgaggaatggtgcagaaatactcctggtatattatggttatagagtttatccacaagcgcacggatataccattgtagcatttcacccgaaagtattctaagggtatcgtatttattttatcctttgggaagatcatgtagagagaacttgactaataatttatatgttacttgtgataatcatattctaagcaggggttaagataatccaagggtagagtgacacataagcattagctactcattctcataatatattatctaaactaaatggaaagaaaagagagagagaatctattcctacacttctaatatacatagtatacatacattctagttaaccgatatactagctaatacgctctatctgatgccctcctggtacttcgagaagctatccctaactgccgagttccttacgatagcccgtcatgaccatacaaccggggctaaatatgaaggaataccctccccagggaattaacttaggattatatataggcgcggaggaatacccgtactgagctgtcaccatcagcggcccacctctcatccgcagtatataatcccaaataatgatatcccgtaatatagacaccacgtctaaactaccagatactactctaatatcatcatcataacatagagtaatttcataagcaaacattatacccacaccaaagcatctcccagataagctaggcgtatattcagtataacatgaacatcatgtaaagtaggcattcatatactcagaaagtatttcaataccataaatgtatatagaagagtattctaataaaagtacaaagcttacaaaagagaagagaaaagctactagagccatacccgaactcttccgaagacttccggactcctgatttctactctattcctattccaccagctagatactactaaactaagcttgagagaaatgagagagctcttgcttgaggtgtgtgtgtgaagtgagaatggcaacttcttttatagcctcccaatgacggttttgacaattggaatggtcgg

SEQ ID NO: 96794 - DNA, 560 bp, Oryza sativa
gcccggctccgattggtgatgcttggtgagccgccatggatgggtcgaacgatggctgggaccatgccacggcggcctggtttggtgcttggtttgccccgaagcatgctgtcggtgcttgcggtcgaacggttggtgccgaagcagcgttgatgaaatcgaactgtggtccttaactccaaggcgaagcccccagacccggctgattcggcggcaaccagctaggcgcaccttgacctgtattcccctccggctgtgccgaaggggctgtacctgaaatactgtgggactggctaagttgttgaaggaaagcttgaagctgcgtttgcaaagccgaagccccttctgccattgtttgtgacacttggccaggcggctgagagtgcgcttgggcagcgaccggctgagcttgcagctacgcgtgaggggccggatgtactgctgtggtcgaaggctgcccggtgaagtacactggtgcttgcatggcttgtgtcggaaggggctggatcggtgcttgcggatagacttggggtgagacgtaacccatcgaatactggagg

SEQ ID NO: 96795 - DNA, 644 bp, Oryza sativa
  unsure (1)..(644): unsure at all n locations
tatagtataattgggctgaatttattaaaatctaattggacttacaataggtctaccccataaacaagttgctcactatatggaccttaataggccacatagaatctcattacgatttttaggcttgatggtgacgaaaatggatgtcataactctatcacgacagaagaatcgtcactagattaatgacaaaaaataagatttcgtcatagaacgccattagagacgcatgataggtgacgaatgtcacagattacataacatgacgtaaatttcactgtttgtgacgtaaatgaaacgtcacttatcataaaatctcttgtagttgtgcctgatgtgcctgccatcgtcgagttggccacctgcatggctgccacatgacgtcctcgagcttccctggcaggctcacatatatgctctgctgccacaaaaatatcaaatggaacaagcttttaagaagtggagcaggggtgataggaactgaccttggtggtggtgacaatctgtgactccgaagtangctgcagaagaaaaggagttcgcgtaagtgaagagcccaggagggagaagtcaagccacttgcaagagagatgcccttcaccttcaagagctcatcgatggctgggtgtgggtgtaagtccccc

SEQ ID NO: 96796 - DNA, 876 bp, Oryza sativa
atatatggaaagtcacatatgaaccgaggtgcatctgcaccatgaatctagaccattgaagaatgccaagattcacgcatatgtatggacttgtgcctatattcgggtgtgtgctgaacgcattaatcaaggtgaaaagctagtacaggacggcatgcatgcacagtttttttttcgagcggccgataatacccttcgactccaagctatctgatcaactcattttttggtgtcctgttgctttgctcgagtagggtcggataggacgcgatgacccttgtctttcatgttgacctgctaggggagacagggaagtacacggcgagtgtgctgctacgtgcaggttttatcatagtaggtgaaaccccgcgcattgctgcgaaaatttagtatgataacaataaaaaaaagcgtgtaagatagctagataacatcatattagtaaattaatgtggtttatgataatttaaatttaaatagtacgtagaatggtgattcaaacgtaaaaagtaaggtgatatgactttaaggaaaaagaaaagtagggagatagtttggacggtagattaatcatctaaaggctaaaaacaattgatgtgatatgacttaattagagaaaaaagagaaagataatttaaaccatagattaattatttaagcactaactaagtgaggatgaactatataagtatatatgatatcataaaacataataaagatatacattgaaacattatgtgaattatgttggatgataatttaacatgtttgtatttgaaaagcttttaaattataaaaactataaaaatatagcatgtttgcatgatgtttaaatgtgatgattgttagtggataatgatgtggcatcttgttaat

SEQ ID NO: 96797 - DNA, 577 bp, Oryza sativa
aatatagttaatttggatattcaattttaaattttacagaaaataatctaatagtgagcacaaataaaaattatttatatgatttagataatataattgtttaaaattggactattataaaatattttttccatgtaactaaaagaaggaaataggagagaagaaatatgtgggggaggtgatatttttttccatataactaaaagaggaaaataggagagaaaagacaagtgcatactggataggcggggaaggtatacgggccccttttttttatcattgtatttggataaatcataaaatgttttttccatctaactaaaagaggaagatagaagagaaataaaatatatgggggaggcacatacgcacgtacacaagcatatgtactggacgggaggggtaggatatgagggccactttttttatccctttctatttagataaataaatctaatggtataaaataatgggcccaccgtatattagtgaaaatcgatggctagatgattaaatgccacgtggcgatgtacgagcgattgtgggagttctatgtggcggcttaatagtgtttata

SEQ ID NO: 96798 - DNA, 667 bp, Oryza sativa
ctatagggcgaattcgagctcggtacccgaattctgttatacaatgctccattgcaatgcctggatgttttacagaatacaatatagttgctatctcatgaagtagaaacgttatctttttcatgctgtgttctgtatgcatgcaaagtttatatagcctatatatacatgtcttttcttttattgaactgatgtttgcatgcatgatgaatgtgggcaaaggttctgtacctaatctggattacttaaccagttctaataatatctttactgtgagcaaggttcttgccaatttcatttgatgtgctcaaatctctgtcagactctattccgaagtcccttggtatcaagaatttttagagtaaatgctgaggaatgtcttttgccacttgtctaatgtaacatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaatta

SEQ ID NO: 96799 - DNA, 665 bp, Oryza sativa
cctataaatagataggtaccccttcagggtttcttgggttttgtttagattaaagtttagctttgctactttgccgggtaatcccgtgatcggttagatcgccggtttactcattacggaaccccaagttatcatttgtactcaattcctatttacaattcagattgcttttatcttgttcttgcttgtttctttgatttgcttgcaggaataaggttgatctgcactggcaagatcaacaacctatggagaggtgtatcgatcgctaaggcgcaacacaataatgtctagtacggttgtagttgggtcgtcaacgtttctcccaaatcgtagttatcatcaactcaccgaaagatcgggccaacaacagcctagagtggagctcaaggttcattaggtggtatcagagctttcgttgctcggtgagtttttttctacccataaccagaaaatagccataaaaaaataccatcatttacctagccatattgtgccattgcattggtcttttcagttttttcttttttgagttttgggttgcatcgtcatgtgatgttgctgggcttaatgtctaggtcatttaaaggttccagttctggtcatgttttgtaccacagtcatcgcagccaccgtgtctctgttggcgtcgggacctacgaaaacgg

SEQ ID NO: 96800 - DNA, 651 bp, Oryza sativa
actcttatacatgacagtttttctttttatgctgcggctaaaatataatgaattttcagagaagactttacacatatgtgtaatactccctccattcgaatttgatcaacctatttcacctgggctccagactaaggtacacttgcatgcaaaatgaaaagacgagcagccaatttttatacaatgaagcatcctatttttgctcaattgattggcttgaatgagaacggaagagccaggcattccttgcatgccaaagctataaatctgcatgcaaatctgattggctagcatgtaaatcaaagagccacccaatccttgcatgggaaatcaataaatttacatgcaaaactgaacagctaccacatccttagagcaagtccaatagtatagctcactactagctccaattcatctatagccaatctaatagccaattcatacaatagttgcttactatactattaatatatggtcccacctgtcatacacacattgtgtcttggagtccgtgctgcagctggctacaaatctgtagcccgctgctcttctctctcatcatttatctcattaaaatatgtttatagccggctaatagcctgctattgtacctgctcttatgcactgatcaattctgaatgttttgctttt

SEQ ID NO: 96801 - DNA, 847 bp, Oryza sativa
cctgaaccagtataatccttgctttctgtttgcttgatgtcgtactacgtagatcctcgttccaacggaccccaataccctctatatctggtctagggtatcccccgtcgacatatatatatatatatatgggagcgtatcctatgcacacaggccctcgcgtatatacaccgtgtacaccaactaaaaattatcacaaacaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgtttttttttgttacggctaaaatataatgaatttgacgttaagattttaaccctaggtgtaatacaattgaaagtatgtgtatgattttttctagattttttggtgacattttttagttggtgtgtacgtgtgtacacgtgagggcctgtgtacataggatatgttgcctatatatatagtagctctattatatacccctcccttagaataactattctacaccccctccctaccagtccagcctagcccacacctccttccctccccacgggcctccctgcctcctccccgcgcgcgcctccctcccttctggtgaccccgcgcacgcctccctcccccttttttctctctctcggtgctactcttttttttctcccttctcttgcggctactccttccaatctccctcctcattttttttcttttttttctctccctcctcttcccggctcctactcctaatctctccatccggtttcttttttctaaaaaaaagaaaaat

SEQ ID NO: 96802 - DNA, 2687 bp, Oryza sativa
  unsure (1)..(2687): unsure at all n locations
cccttttgttttctattagatcgatctatttctattctaatggaggatcatccaggcgatctcgcagtcatccgcagacggcgtcatcggcaacctcagttgttctcagccggcgtcattgtcaaacatacgttggtacttggtaggtcagagtgggccgggatggtgttatttcatcgttctgccgtcagctcgattccaggggtcggtgatgcccattcggatgatccctgggtgttgaatgctgcatgccatgccgttcctcattcttttctgctagatcgaattcccattactgctgctaaatggcagtatatatatggcacatgattattcatcttcgtgctgccaagccgatgataccttgatcgattactcagtatgattacatactgctcgttcttctacaatatgtactgctcttttttttttggttatatactgtcttttctacctatgatatgatatagtcagatgtatatactaagtaaaagatcatatatactgctttctttggagaaaaatatacgtactaaaagtacttgaaaaatagtatatactgctccatcgagaaatgtagtatatacaactaaaaatgactatgaacatggattaatttgtagtatgtactgacaaaaagaaaagtatgaacctagatttgtagtatgtaatggcaaaaggaaagttgtatcctttcattctaagtagaaatcagtatatctcaattcataaatcagtacatactgattacttgaagaaatcggtatagcccagctcttgaagaaatcagtgcatatccactcagacaaaaatcagtatatactcattccaagataagtcagtatatactcgttttaaaaaaaatcagtatatactcattccaatatatgtcagtatatactcattcggtcgttccaacagtatattgcagctaccaatataacacaaagtagattatactgaccaaacataaaaagtagtctacgtggtatatactgagcaaccaaaaaagcagtataaactcctttagccacgatgatgcagtatacactgaccaaatataaaaagtaatatgttcagtatatactgaccaaacaaaaagtagtatgcagtatcaaacaaaaacgtagaatgcctaatatactgagcatacgaaaaagtagtatatgtctgaccaaacagaaaagcagtatatactcattcagtccggatcgatgtagttggaaagaaaatttcaaagcaactgcgtgccaacgctctctccattaaaaaaggggagtacataacacctaggtgtacagagagtgtctgtctctctctatctctctatatatatatcncngatgncaactacttcgtcatagaataataataaannncccctttgatttnacaatctcctccttgatgaacacattggcaaactcattaaaaatgttttggtgtttggaaaaataaaaacaaaaaaaggggttttgggggggggttttaaaaaaaaaaggctacactttcgtacaaacgtacacatcgtgctcaaaaatccaaaagaaaacttatccccctttgtaaaagaaagaaattcccaattgaaccaacaaacgtgctcttctcaacaactctccaaaaattcaccttgcttcttctaaaaatccaaaaaattttacattacttctcccccttttggcaatgatttcatcaagcataggaattatgttcattaatgttcaaaagcttagcatacatatagcatatcaagtcatgtgttgcaataaaaagaagatgaacccatctataatataacaagcatgtattaaagtataaccatgaaccaaagattttacaattaagcttgaatcaacaatcaaaattcatgatttcaaacgatttataatgcaacatcttaacaaatacataggttgaagaataaacactaaacacatatacctattgcatttatcactctttctcaaataacctttagcacaaaataaccaagagaatttttaactttttcttttcttgagccttttttctcatatttttctcttttattccggatacgtccctgtcgtcaagacagtttccagagattcggcacctattattttgctcacatcgaatacgtccttgtcgtcaagactgtttccaaagattcggtattcattttttttcatatttttattctctttttcacaatgagcaattaaagctatttgaggaataacaattcaataaagcatatatatagagtatttacaaatcaaaccatatgctagcatcaacattgcattttttttaattcaagtatagaatttaagtgtcatgcatcatctcccttaagagcaaaatctaaatctcatgaaaaaactagaatacatacaagctatgctagagacaaataaaccttcaaagtattgctagcatgcacaagaaaataccatatgcataaacaaagctctcttttatcaatttttctcattgtcatattatagcttgataaaaccatgaggtactaattccccctcaaaacatgccaaaaggatgaattatgcccaattcaccatgaagaaaagcaaatcgattagaatccaaaggtttagtgaaaatatcagcaagttgcaactttgtgtccaaaaactgcaattcaacatctctcttctcaacatgatccctcaaaaagtgaaaac

SEQ ID NO: 96803 - DNA, 1478 bp, Oryza sativa
tgctcacaatttctatgtggctgctgtagtgccaaataaataactgagataataggcactattaacatgacaactaaattgtaatagaaattgattggggtgtgaatttaatactaatatgtactggaactgaccacaattaatagattttgagtgtcaaactatagttaaaagtaatacaaactgaaactataactatagttcgaaatacacatactatggaaaaaacgtgatataatacaaatatgtacttgtacctgatacataaacagagttaggaaacaattgcatcaatgcaaaataaaataaatcaggaaatgtaagtaggaacattactttggtatcgcagtcactgaggagcaaccaccagaatagctagatcaatatggacttgctgtcctatgatagtgagagcatgataaaaactaacacggctgagatgggctttattttgcaacagctgagctggcagactacaaagcaaattttgaaaaaaaaaaagagaaaaaaaagtgacatgtacaagtcaaaagcattgtgttgttcaatgaattttgttgcaacattacctcagtttcccatggatcgatattcttcagctcagctactgttttctgttccactcaagccagacaccgtgatgcgccaaaagattcagccatgtggtatgtcaattactgattttaaaaggcgccatttcatagagtgcattgaaaagaacagacaaaagccataatcaggatggaagtgcataccaaacatgtgtatgtgtaagcggatttcatatagaaaaatttccatcatatcttgtctaaaagcaaatgaaatatgatgcagcaaaatttatcaccactccacaacaatgtattgactaataagaaacaatccgaatagctatttcctggtaatatatagtggtagtattttacgacaaaattacagatatacaaaaggcacatttttataagtaaatcaggctaatggtacttattctttttattgtaatgggtgtgtggaatgtgttacaacacatcagaccgattataatttataaactgtgtatgatattacagttatatatcagcctagatgatatatacagttatataagtaattataagctggttatttcattaatatatagctgagccaacctacaaattaaaaccgaaagtatgacagatctttttacttaaattgaagtgccatgtgtaattaactcgacacaacctaggggtgacgggattaattaattgatacttactattaatctttgtagtgccaaaaaaaaattcccctctggcttgttagagacgacggacctggcgtagtcctccacggtgatgttcttctggtagtggtagactggtagcacacctcgcagcctcagaccatcttgttcagcggctcttagattgaccccagcatggctacgtgatatacggtgacccaccattgcccgtgagaacactggttat

SEQ ID NO: 96804 - DNA, 697 bp, Oryza sativa
cggaaataacccaacgggcgttccttacgtgcgtgcattattccttgtcccaggaggcaaggtacaccaaaagttgatacaattcagagtttaacaagcggaagcgtaaatagttaatttattacatgggcggcgaaggcccagcacacacaaagacaaacgggaaacagcggaagactagggcgacgaccacaggcgcttaacggcaggcacgagctaaacaccaaagccttcatcatccaggggctcctcttctgggtttgggaaaaaattgagcaagactgagtacaaccaccgtacttaacaagacacacccataagtgcagaataaatgcaagggagtacaagggggttatagtataaagggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccgaactggcaacccgaccctgtgtcccagctcgtcccaagccaacccaggccaaccatttcaacattttagttgttaagcaggttttaagaattaaaacactaacttgggtacattgctcggcttgcccttaaccgagggcgcggctattcgaatagattatactctgatcagaggtgtacaac

SEQ ID NO: 96805 - DNA, 803 bp, Oryza sativa
agccatgtccgctgcaaaaatgacagaaacaaacacagatatccaatatccccagctccccagcatcacccattcatacatatgcattaacatacacagacatcaacatatttcacacaaccacacattcaccgccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcatcacagttgcataataagtgttcatcattgcctaaacatagaagttcaacattgttcatcattttagtttaagcctaaacattcctttggggttaattatttcgcggaggatgaagctggctatctcctcgcgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatgttgtggcacacatggaattcgcactggtcacctatttgttgcttcaccgggaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgt

SEQ ID NO: 96806 - DNA, 629 bp, Oryza sativa
cctcatcgccgtcgcgcccacttcctcctctggcgcaggctggagcccagacgaagacgacaaacggtgagcgagtggcgggatgcgtgtcccactcgccgaggagctctcatgccctcccgccccttccccattgccgttgcacccacctcctcctccggtgcaggctagagcccagacgaagacgacgagcggtgagcgagtggcgggatgcacgtcccgcttgccgccgccctcgccgaggagctctccacccgtcccgccccttccccatcgccatcgtgcccccttcctccctcggcacaggttggagacgaagacgaagacaacgagcagcggtaccggcgagcggcggtgggatgcgcgtcccgtcctaccccttccccattgccggtgtgctctcctcctcctccggcgcaggttggagacgaagacgaagatgacgagcggcaggacaggcgagcggcgtggtgcgcgtcccggtctcagccgccctcgccgaggtgctctccacccgtcccgccccttccccatcgccgtcgtgccctcctcctcctttggcgtaggctaaagcccagaggcgaagacgaccagcggcgagtgagcagcagtaccatcgagcggcgggg

SEQ ID NO: 96807 - DNA, 1157 bp, Oryza sativa
aggggggtaattcgtactttttcctattagcagagacaagtgcacagaggatgcataaaatctgactcggattttctttttctttgagaaacctctggattcatatcatcgagtaaatagctgagaaaatctcatgtacaaaataaaaaaacatgtgtgggacagtaaggaggaacttaatgtcaatttattaaggcttggtttaaataaaaaaattgggtcaaaaacgtcacatcaaatgtttgacatatacatggaacattaaatgtgggaaaaaaccaattgcacaatttacatataaattgcgagacaaatcttttgaggctaattacaccataattggacaatgtgatgcgacattaaatattggctaatgacggattaaataggcttaataaattcgtctcgcagtttacaaacggaatatgtaattggtttaattataagcctacgtgcaatactccaaatatgcgtgtgtatacttcgaaaactttatgcccaaacaactaaacacacggccacaccctaaccagggtgaaagcgtccttggagaaccaaaagcagaccgcgagcggtacatcgatcaatgtacagtcccaatttcagagccaaaaataatatttgatttaatatactctaaaaaaaatttaaccgacacataagcatttttatgttgatacgatatggaaaacctttaacagagttcagacacatatctatttgtgcagaataatgtttaacgagtaacatcagtgattgtgtctctggttgagtggggagatctgcattatattacttgtcaccagatgtgatgttagaaaaagggatttttaaagttcctgcaaatatatatttttgtgtgcatatcaaggttgctttgcttagggatcaatgggaaatcatgtgtgtgcatgggaaaggcagaattgtgctgcatgcactcagaaagttaaggggagaaaattcagtggtccatcacagacaggagggctaccaggggagggacatcacatcaacttctttaaaaaaattcctattggcattagagatgataatgctcccctctttactctgcttcctattaaggcccttgcgatttaataatttctatcttcattattattgcactttatatgtgataagatcatgtttttttg

SEQ ID NO: 96808 - DNA, 567 bp, Oryza sativa
catatgaaggattactacacggcataaaataagaataagagtaccatgtaaagaaataagcaacaagacgagagggcgcccgatcttttaggcatggattgggcacccgatgggaagcattttcggatacgttgttggattcaagtgttgtataatgtatagggcacgaaacatgataaatcattacttcgttaggactcatacatgtttaattttgatgctggattcatttccatataatactttaaaaactttaactatactattaagccccaaaaattttttaattaacccactatttctagtgatatttgtgcttgtcacctcacctcttgggcaaacagtctattttaaataaaaatcattgaagggtatattttcaaattttgaaaagtacaagtctaattctaaagaagaaaacatagcatccaagacatgtccacatgtgagtaatgttatgtacacagaagggaaaattatattatacttatgcaaaacatataatcctttattttttaatctatgatgccgttaattttcgacataccgtttcatcgtattaaaaaa

SEQ ID NO: 96809 - DNA, 1052 bp, Oryza sativa
agtatgtcttgtatttccgtggatccattatttgactttgcaatatatgtgatgcaagcaatgctctactcttttctataccctaagttccacataaaccttattagatgggaggaaaagaaaaggcacaatcatatgcctttgtgaggaatcatacactttgagtaatcgagagaatcaatcgaggagtaaagcaaagttataattttgtgttacttgaaaaacccccaagttgttcttcatgaaaagttagggttacttaagtcaagattgttccatttctcaattgctcaggattgcatggtagacactacaaagatccacaagtataggtatgactttgaataatttgtttacgtgattattagtaaggaagtcgtaactttgttgtagagtccatagccttcactcgggatgagcaaaggttaagtgtgggggtgttgctaacggtccttaaatcataatatttgaccgttaatacctgcatataatgcaataaaatatggtatccaacttagtggtagggattattactaataatttctactagtgttggtgaaagatgtgtatgtaggtaatttgaggagaaaaaacatctgtcatgcgacaaaatgcacctccgcgcatttaggacgcgtttacatggattggaggcccaataagtcaataaaaaccatttagaattgggccaaaacatagcctaggttgttgggggcccattaaggaacctcccgaccgaaggagaggccgggaggagtgtttttgggtttggccgaaccattcctggcacctcccgccatctgcttccacgtggacaacttggattcctcccctatgttggttgcagggtgttttggtcatttcccatacccctaaccgtcatttggagcctatataaggaggtcttcatctcacttcaagcacacacaactttgagctgaattacaagaggctctattgtatcttttgtacattagaataaggtcgagagtggggggaagctctggaggagtgcccagaagtttggcgctcatccgacttcttccttaacg

SEQ ID NO: 96810 - DNA, 580 bp, Oryza sativa
ctccatgcactcttgtctttggggtgggctggtccccaagtccctcggctgctggaacagtgaaggtcagcatcaccctaactatgagggtgcagctcgttggtttctgcgatagattaatcaatttttttagaatattatatatcatatggattcgttatgtctttcatgtattgagtaagttcacggttaccgttatgtggtcgacggtgctgtcgaccgatgttggattttccgccactcagttgatgtgcaactgctgcgtttttcgatgggacttcctaactctttgtgcgcagcagcagtggcggcctgggggatctgttgctcttctcggatctcttgcctaatcttggccctcatcgactcgagcttttcgtcgaattcatatgtcagctcagctcatatcgactcccggatcttggcttcaaggcgtgcatctttctccgccttgttggaagtccgcttcttgtactgccacgcgtagtctggaaatccatacttccagggaacagaagacccaacgccccgtgtccgtccacggtgttccttgttgcccaacgctttcgtgaggaggtcg

SEQ ID NO: 96811 - DNA, 992 bp, Oryza sativa
tggatcactaacatcatcatcttcatcaccttcctatcatgcctccaaaacctagcctactctactgccgttcatgggcaacttcgtcttcgtagccaaccatctctgttgccgccggtcatgattaccgcaggtcatctaccgttgtcgactagtttcttcgtcttagagggtaaacatactgacacctgtcgccaaaagacatgcaggcctgttcgcaaaaaaagagttcaagatgataaaggatgtgctcaagattgttcgtcatcgacccagcactaaccccgtgcaaattgaaactttgtgtatctcatgctctttgtttctttaggagtcctccaaaatctatttctgaaagcttccatctcagaaaagtgcctaggtgcaatccatccctattcgttttaacacggaaacaaaaattggatcaatcaaaaatctttttctaaatccttgcatgctggattttattggatttcatttctcgttttcctgttgtgtttgggacaaaaggacggatgtctgagaatatgcttgtattttgaattcaaaatattatttatgaaaagaaccatgattaatgaaatatcttaatatttgcaaataccaattatcttcctaaaaaccctttaatacatattagaacctctctgatgtatttgctttataaatgaagttatatattacaacattgggggaaaaatcttttacggggtaattctttgaaaatactattttacaaaggaaacataattttgattatttgctatgaatccttgaaaaggaacaagccatttggagaataacttgcaaatgacatctattagtaaaataaatccctaaaaggctttaaaaggaaagtccttctcagacaaagtctatctttcctccttaaaaggcctagcccagcccgcataatagcattcgttattatccgagtatgtttattttttttaaccaagatctagattaaatccattttcttaaatagt

SEQ ID NO: 96812 - DNA, 2725 bp, Oryza sativa
tagaaaacttgtctatcaaaccacagtatattaaaactaaggtgtttttttatttttttaattcaatcttagtgactgttctttaacaaatccaaaaaaaatattattactaataaatatgttttttataccatcaagataaccctccttccgattggttcattttaacgtaatttgttacacctgcctatgaattaatacatatggagaagatatacaaaggctagacctcgcttccctatgttatgaattaatgtgttattttctgaaatacctaatcaacatgacttctaaaatttaaatttaatagtaaaatatattttttccaaacaaaatatgtactactttagtgtggcttaaatatatggatgcagtggtataggacagatggatggcattggcaaattggcataactgcgctagctatttacgcattccgtcaaaaaaaaaacaacttttgaagacgaatctgatctggaccatcatttatcctgatttatccccaaaactacaaagtttctaactcgaatgtgaaacattcaaaaatcaatttgaagaaaatatgaaacttttatctaaatacccaaattgatagagaagaaaggggttcaaatgagattgattgagcgaatgaatcaacaaacgaatcggattcatgagcaagaatttggctagacgtatgaggctatgaaagatgagactacagaagatgatgttgtggtattatttatctcttttttctctttatttatctttgatttttcgtaacagagctacaggcatgaggtgagctagcttggttctcgttgaaatggatagttgtgcattcaataatatttttggatggttgtgcacaatgatgaaatctcgttgatgttgaattaaacaaataaatcacagtattaactacacaatatatgggaaataatactacattaagtattttgaactggttctgatgttaggtgccaagcaagatgagtatataattataacattctagaattattatctctaccacggtcttttgtgtgtgcataaccatattaagattcaatactttttcatcattccatccaccccactagtccccaattatatggacatgatccattgcaaagcaaaaacatattactaataattataaaactaagaattaatgtaggtgacacatttgtgcgggcatgtatcctagactgagtttgataaatttataggaacggaatatcaaccgtatgatacctaccacactttaaaagtattattttttcacaaaatttctttatcggcattgctttgataatttttcaagttattagttagctttataatatataatatctagttcatccctataagcaattatttgtgtagaaaaatttctaacaaacactacaagaaaaatgttttacagacattttctctttgatttttctcattatttctctttattttttgttgcagctgccagcgtgaggtacgctaccttgattcccgttgaaattgaatggttgtgcattcagtattattttggatggttgtgtataattaagatatctcgttgatgttgaatattagattattaaatcgctacattaactataaaatatatgagaaatctatactacattaagtacttgcgaaaagtccgaattacatccctaaactattgggtgagtgcgaattagaattaccccgctaaacccaaaaaccagacatctttcaccttcagctattgatagttgagggtgaaagatgtttagttttcgggtttggagggcaatttgtgcattattgtgaattgtgtctacaaatgaaaaggcattttataaaatgtctctatgtcttatgacatcttactagatctcttgagatcaacttcttggcgatgatctcgaggagctcccttgggaggccagagctccagtccagcagtgacctcacgctcacgcacgccatggactaggatatggacaaacgatttcaatggaatatgatgagagtttgtgcagcggcagaagcggactgatggtgatgaagaaagggattcagctcaaactaatggattcatgaccaaagaattttactagcatgcatttgattgagactatggaagatgagacttggatgatgatgctatgatattgtttgtcattttttttatttatttctctttgctttttctttgcagctgcaggcatgaggtaagctacattgtttcctgttgaaattgaatggttgtgtattcaattttattttggatggttgtgcataatgaagatatcttgctgatattgaatattacacgattaaatcattacattaactctttaaagaactgagaaattaatactacattaagtactttgaaccagggttggaaatttcggactgaaatttccaaaatttcagaaatttcggtcctttcagacccctccgatacgatattatttcggccgaaatttttcaatttttttattttttcatgaattttggtaatatttgttcaaatttaactaaattttgttcaaacaaattggaaagtttggaccgatttgtttgcccttccacgctaacgtcaaggagtcggaattcgacatagaaatcttcggttgttcaaaaactctgatgcgccagaaactttcaatttaaaaaattgaaaagtttttaattcaaatgtggaacgttcgaaaatcaatttaaagaatgtgaaacttttatctaa

SEQ ID NO: 96813 - DNA, 598 bp, Oryza sativa
gttgggccgaataaactttgacagatatgataagatctggttgggctcaaaattagatgggctgaatccggtgccaaatatcagcgtccagtagcatatgttgcctgccagataaattcttgaagtactaccagcatgtttggttcttaactaacattgtcataactcactttagacaatgttaggtaagtgtggcttgccacactttttgtggcctacaaattgtaagccacatttgtggtaaagttaggcaaaagattgagtctatgacatgtgggtaagatggtaagaaagtgtggcttggcataattaaggtaatgaaccaaacacaaggctaaggaggtgtggcagtctaaagtgtggtgtggcaagttgaagcattaaaccaaacagcccctacctccatcccaaaataagtgcagcagtggaaatccgtgtccaacgtttaccgtccgtcttatttgaaaaaactatgaaaaaaattaaaaaagataagtcacgtataaagtattaatcatattttatcatctaacaacaatgaaaatactaattataaaaaaattttatataagacggatagttggcacaaaaacctatg

SEQ ID NO: 96814 - DNA, 590 bp, Oryza sativa
tacctacagtactgagtataaaagtgacacatgtcccaatttgttgcgtctcgctgcacgtaatttaattaagcagcgtagtcgttgctaggcgttgggacagaagcagaaagaataaatctaagccaaagatatgattttggttgccaaaccaagcaaaggatctgacgctcgaatctcgatcgatcggcaacaaatctagtgtgttatcatttggtgttaattatagtttgcttcactgctcttcggcttacccattttcagaggaaaaacaaacaaaacgtttagttcgcttctaagcttacacagccgcgatcaaacgtacgctgcactcgatggtagagttttttccatacatgcatggggggatggcatggcaaatatagtgttacatttttgctttcttttgtttttaacaaccagtatctaaagtgcaccaatattgttaaatataccagagaaaaataagataaacaaagctaaaggataagttttgagagtaattttgcttttgctagggctcaggttttaattagcatcctccttaactttcgctgctaaaaattcgttgcaagttttctaacactatg

SEQ ID NO: 96815 - DNA, 1098 bp, Oryza sativa
ccccccaccccccaaaaaatttaggcccaaataggttgcttggcccaaatagcccataaaggtctaggttggagggattcctaggctcccagccactcaggctcagccgcccaccaccagcgccgatagccgaccgcccccggcgcctcctcctcaactccgcgccgccggcgccaccaccggcgtccccaccccgcaagcccgcgtctctgcgccggtgcggcgcctccacctccgtccgcacaacaaccgtcccctcccctcctccgcgccggcgccgcgcggcctcccctccagcctcccctcctccgtgccggcccgcgcggcctcccctccgacctccccgccgtccgcggctcctcgccgagtcgccgacgacgacgccgcgccgtgctgccgacctgccgactgccgtccgcccgtcccttccccttccgtggctcagcccactagccaggtaacaaatagatgcctaaactaaatggctagatttgtgaatttgtgattagaagatttgtgaatttgtgattagagattagttagtctgtgaataactgagaatgcaatttataaattgttactaattagtgaatgtgtgctaaatggtaattgctattgtttgtaggatctatgttgattgttggactctctatgttgtaatatttgcacatttcgaacttgcttgctaagtaagccgcttatggatgttggaagacattatttctatcgcattttcactaaatttgtatttgtatatcagttttatggtgcaagaaaattttatcatgtgacatgaacttgtgaactaggactacccaaggaaaaattcctgcctacgccactggatgccggtgtcaccggcgccaagcagacgagcatgacggctaataaggcaaccgcctgatgcagtgtactagtggtaggagaaactcttttaaacactcgggtggacgtccactcgtttcttgcatgtcatctaaatagttatgaaaaattttcaaaaaaattgacatgataggttaatatgtaatactccctccgtcccatattataagggatttcgagtttttgcttgcaacctttgaccactcgtcttat

SEQ ID NO: 96816 - DNA, 624 bp, Oryza sativa
ttcagtccaactccagggcttgggcgaacaaggatattcgttgaggtggcgccgcaagaaactttcttctgtttcttcatagccccagaccaaacaaaacagagagaaggaatgaggcctggtttagttcttaattttttctttaaacttctaacttttacatcacatcagaacttttttatacacataaacttccaactttttcatcacatcgttccaatttcaattaaactttcaattttgacttaaactaaacaatccctaaatcgtgtgcaggcaagaaagtctgacgagatgtttgcttctaaatcacgtacaccctaagagcaagttcaatagtatagcccactactaacttcaatttatctatagccaatctaatagtttattcatacaatacttacatactatactattaataaatggtcccacctgtcatacgcacactacgtcttaaagtccgtgctacagctggctacaaatctgtagcccattatccttctattttctcattatctccttaaaatatgtttgcagctggcttacagcctgctattatacctgctctaattcagttctatccgtttcatattaaagaaagaggacctgtgagactagagactg

SEQ ID NO: 96817 - DNA, 562 bp, Oryza sativa
  unsure (1)..(562): unsure at all n locations
tagggcagtcacaatgcgtcacgtaacgtagttttgaggagccaaaactgccacctagactgagaaacttcataagcaacaagctccacaatgcatgtggtctactttttccctacactgggtcccacccgttatctctcctaactttttctctcctctctctctgccgaacccagccggcgcgtcccctcctctactccgccgccggcgcccctctttctctcccaagcggcggcggcggatggagcggcggacacaagcggcggcgaatggagcggcggacacagggggcggcggcggacgacgcggcggcccaagcggttgacagagaggcggcggggcgatcccagcgccggacggagcgccggcgtattcantgatggcgcccggcggagcggcgataggacagccaaatccaccggatctggcgtcggcgtcttcctcacggagtcttcctcgcggacgacgagcggcggcgtggtcgtcctcgcggaagtcgctgccgaccggagccccgtcgccgtcctcgtcttccagccgccgcacttgctcccctgctttt

SEQ ID NO: 96818 - DNA, 524 bp, Oryza sativa
ctccgtcacttcctcaacctcactaatgacaatgcacagtgcccgctggaaggccacttcatggtaaacccgcctctaaccgggcaatcacaagattaaaaaaataatatttatatgatctaaattattattattaataatagaaaaataatcttgttttgtttcaaaggagggattttccttttttttcatttaccttgagcgaagctggaccaaattgggatctaatatttttttgtccgttgactttgagcccttcttttttccctccctcctccccgcacaaattttcataatctctccttcattatatatgacaagccatcccaacaactttgcctagccactaaatctaaccatcttgattagctgaccacactaccaagggatccctccttagagtggccctattaaagagaataataataaaaaaaacaccgtacatgatgtataatgcttggtcatacctcaaagagactggtgattgtgtgaagttagagctatagcattgacacacagcgaga

SEQ ID NO: 96819 - DNA, 578 bp, Oryza sativa
aagacagggatacaacaaaacttacacaaccagctagcggtaattcgtagattcttttttaacaaatcccatccacttattctacagaagatgtgaatatcacacctgccaaaaccaagagatgaaattaaaattagtggaaagacctttgcctaagctaaaaggaaaatatcaaagtgccaatcaaataatgttggggtattggtggcaaacagttaaacagcaaggggaaggactgtgaacatctagggagctccgagcctacgacgaaacgatgccttataggatggctattgttagggctaagaacagattagaatcaaacgagaacacaaggggggtcgacgggaaggcgaggttgttaacctcgctgccccgtgccggagttgtgtaacagatcgagaatgacactgaagattgcttgctttattcatcttagaggcttacaattgtaacgaactctccaaaactaagggccactttgaatcaaaggatttatatagaaatttcgtaggtttaaaaacttataggaaattttgctatttggccctttgattcaaaggattaagctttccaaa

SEQ ID NO: 96820 - DNA, 654 bp, Oryza sativa
gtacaactccatcttttttaggaatactcactcatcggttctagtgccaaagattaggctcctgaattttagatggatttattgtgcctgcaaaaagtttggtttcttgcaagtcagccactggtactatgatcctattactgtttttctcttctatcacattctgccctgctacttgcaaaaaagaaacaaaaaaaaagagggggggaaggggtcagaaggtccttacctggagaattataagttattgtagggttttccttttttttatgttaattaaatgatattttgctgctcgatgtttataaacttgtgaagttcacagggctggccctgaggcaggtcagtaaggacgaccgatctggacccccattagttaggggctccaagcccatagatggtacctctatatgcatgataataaaggtccaatcgggccaacagtatggctaccgaaggaaatcaggatcaagggagaggacacgtcactccagtctccagacgtgctctcgtcctcgcctgttcctcttctatttcccccagacctcctcgttccttcaatcctttcctgagacaagcgttggtgttgccacccctgtctcttctgatttctttctgtgatttgtttaccactcggaccagttttgctgactt

SEQ ID NO: 96821 - DNA, 683 bp, Oryza sativa
atgggctggtatcctttccacgccgggattttccacggggattagaccccgatcccagccgggaacggcccaaccgaacaagccctaacggggaaacttaggctggctggccacagcatggacctcactcatctacagtaaaaatggtcggagacaaaaggaaatcaaccgaagctggccaatacaaacaatctattctcagggatgcatgcatggttgtgaagataactgagaatagaaggcaaaatatagaatctaacaactagcttgagttcatacggtgtgcttgaggtgaagtaaatacatgtttaaatgtcacaaataatttaagaagaatattaatggaaagaaacggcaacgtaatggagagaatacaaatcacggatagactttacaattgctcttacatgcatgaaggtatatttaaagttgaatgtgccataattgttggtgaaacggctggggctctaataatagcagcaattggagagcaaataaagacctatgattttattgcagcattttttaagactaagctatatatatgtggtctccatatttgcaggacaaatatcctataaatcattcacagtcaaagattctaaagtttgacatcagttatgataagtattaattatcagcctggaaggggaccatagtaatatccttaggatatagctaga

SEQ ID NO: 96822 - DNA, 604 bp, Oryza sativa
tgaatttcactctgcatgcataagttgcaggattaggctgattgcagaagattcggtgagttgtttgacactcgagagaacttggtttgttttgaatttcggtctgtttatttgacctgttcttgtacctgaaacttgaaagactccgagtaagaggggagtaaacgagtgataagccccgcgatttgttagcggctgtttttcagctaaccatctttcaatttctgtactggtttgtcagtgacttctgcatgtggctgtgttgtgcgactaccttggtccttcctgattagtgatggggtttagcgcatggtaatctgtttaatgtgcatgcatgccgatgatctttcatgtagactgtatattcctgtgcttagaagccatctgtggatcaaatccatgttgtcttccaagcaattagctcatctgtgatttgatttgtactttactctttgggaagaatttttttgtctttatagcttttcttgcatgaattccattccatgatgcatttggtgtttcttgattggaggcagtgtttgaatgcaagggtcaggttgcgctggtaggtatctgaggaattcaggaattgaggatgatgagt

SEQ ID NO: 96823 - DNA, 523 bp, Oryza sativa
cagattactataatccaataatctcctctagagaagctagcttttttcagattattgagtggctaaagatccactactcttagatgcctctaataatccagagaaacaaacaactcatagcttattttatgtcagcttattataatacagcttagagtaatctgatttaataatctagattacaataatcttaagctgaaacaaatatggccttaatcgataagtatatcactcgcttaaaacttcttccttctaatataatatattgatgtgtaatatttttcgcattcgaaacaaaattcagttaaaacttaaaaccctgcccctcattggttgtgtggctaattaaattggctatactcaaactcggaattcggatccggtgcagttacagttgtaactgcaagttaacactgcacacaacaccagccatccgtttttctgatcaacggtttagatgtaaagctacagtggccacgtgaacagtacccgtgctacagtgctacagttcgcgatctgagct

SEQ ID NO: 96824 - DNA, 517 bp, Oryza sativa
gccaaatactgatggcatttgcaaaaatcatccaacttgaaatcatcaggtcaatggagtcaccagggctcaaaaaccgcccccaccaaaggcccaatcgccattgcccgtgcccacagttctcattccatggtgtccaaaggggagagagcccccctggggcttgatccatggtagaagctgataggattcagaaggaatctttggaagtggggagcaagctgaaatgcgatgtgctcatgtccactaccttggcattgtgatgtgttgcactcattatatacgatgtatgccacgagaagttcattgttccttttcttcagggcactgttacagtgtccctttcagagtttcaggatccatccatctctaagaagcagtgactggatggatgggttgttgagaagaaactagtgcatcactcttggccaggaatcgcaaatggaagcactagagaatggtaccttattaggagaagaacaaaaggaggtaaagtattacatgtcatctactcatg

SEQ ID NO: 96825 - DNA, 584 bp, Oryza sativa
tcgatctggtatcaacgagaataagtcaataccaagtatcacatgatacctcgtaagtataatcacatgatacctgataggaatcgtctaataccttgcaagtatcatttgatacgtggtagaaatcgcatgatatctaataggtatcatgtcctgatacctaaccggtatcatcccgctcgaacgggattccgttgtaaagcatccccggatgctgatgtcgccgcacttgtcggggcagcccggcagctgctgctgctgagccgacgccgctggtgtcactgccgccgcgcagacgaggaagacggttaaggcaagcacctgcagatgcagggcacgtcatttctgtcatgatagctaaaactattgtctcgttgctctgtttgcttaaatggccgcctgatttccatataaatagattatagattttactccctccgtattttaatgtatgacgccggtgattttttaacaaatgtttgacctttcgtcttattaaaaaaattatataattatcatttattttatggcgacttgatttatcatcaaatattctttaagcatgacataagtatttttgtatt

SEQ ID NO: 96826 - DNA, 526 bp, Oryza sativa
agattcaaaggtggagtagtattattttaagacaaggtgctactttatttacttatgtcctgcaggagttggtgtgataatttgatcaaggaaatgaatagcgtgggttcgatgatgaatgtgaatgaaagagtcaaatattatgggggtttactacggaattaggtacaagctactccgtagattgtaatcatctgaaagagaacgttccgttctagcactgatttttctcaaggtgcctcatactgtacctaatttttatatgatcctgtctgaatgtgcttgttatcttgcacttctctgcgtaagatgagatgtttatctattctagtattctactatatccaacttaagatatccgcatattcgaggaagtaattatttttcttatatgcattgctagtctaaacaatcatgtgttgtacatgtgtgaaaactgaagctttttgtgtctgtgaagaatacttccatagtaatcaattatttcctactatgtaatatactagtagttcaaaactatccacat

SEQ ID NO: 96827 - DNA, 599 bp, Oryza sativa
tatgaacctatcaaaaagtaggagataagaagtgatacatatcgctttatctccatgaatttcattcttgtcatgattaaggtccatcaccaaagaatgcatatctaccacatctcattatcgggaaataaccttgttgaaaacttatgtaaaagagaggttaatcccataaacatcggtttatcatctatcaccaaagtaacaattacacaaattgtttaatccaagatctttcaatcttttctctcttctgtgatagataataatccgatataaacaatacaaagagatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagaccaagttagaatatgtgaagtttaatacatacctcccatcatttttacttttatatccaaataatactagtcaaagaaagactcataaaaacgttagtctcatataattagatttgtcattaatcaccgaaaccaaatgg

SEQ ID NO: 96828 - DNA, 562 bp, Oryza sativa
ttcattgtgcttttattaagatgcactctgacatattttttcaggtatataccagtgctgctaatctttttatcatgaagaataagtttgacaggacatcacgcattgggcctaaggtatttttcagtccttgtttggatggtcagggatccgtggccatcacggcccatccaaaatatggactttgtttttgtgatttattctggcaatagatatatcctcgaaatactcctatatgggttggtctttaattgacctatcatcctaactttggtggaatatttttaggacattattttttttccatgttattctacctgaggctggccactggcatgtttatttattaaatttcttcagaaattatattgaagtcataatattatatgtgtaacttccattaatgatagtgttctagtgtcacaacacttcagccggctttgtttctctgtatcattacagttctcttgcatcccgacgccctaggatattggatacacagaaagtacttattaattactatgctatgatcctgttccaggtaattgtcagtgagtacgct

SEQ ID NO: 96829 - DNA, 1193 bp, Oryza sativa
gccgcccgccgctccacttgtgcccgtgcgtcgtgacgatgatgatgagagagagaggggaagatgggaagatgaggtcttacaggtgggccccaccattttaaaaaaagaaaatgctgattggatttcaacctcagcgccacgtgtatgccacgaaagattcataccgcttcagattgagtgaggggggtaatttgtccggttttaatagtttgaggtttaatatgtctggttttgtggtttgaggaggtattcggacgatcgcgatagtttacaggtaattcgtaccttttccgagattgaatgattttgtcaaataaacgtgaactggttaaataggcgagcacagtcagctaagacagcaagtctgggtggtgtagttggttatcacgttagtctcacacactaaaggtccccagttcgaacctgggctcagacacaaacatgttttttccattttttttcaacaatatgaatatttttcttaataacaacagcataattacatgcaaaaaatatttctccataacaataaccatttttttcaacaatttgaatatttttcttaataacaacaacataattacatgcaaaaaatatttctccataacaataacataaaaactgtaaccacatgcacatgattttttttttcaaaaattcgaatatttctcaataacaacagcataattacatgcaaaaaatatttctccataacaataacataaacacttgataaccacatgcacatgattttttttttcaaaaattcgaatatttctcaataacaacatcatacttacatgcaaaaaatatttctccataacaataacataaacacatgcacatgcacatgcacatgcacatgatctttcttttattttaaaaaattcaaatatttctcaataacaacagcataaccacatgcacatgatctttttttttaaaaaaaataaccctccatatcatcgagcaactttaacagcataaccttttctttttcaaatatttcctccataccaacagcataaccacatccacatgatatattttttttcaaaaaaaaaatcttcatatcatcaagcagcagtataagctgcaaaaccatatgcacatgaagtcaaatatttcctatacgacctatatagcatcttagcagcacaaccatttgcagtaatgcagatgatctcatt

SEQ ID NO: 96830 - DNA, 629 bp, Oryza sativa
ttcctgcagcccgtctatttgtgcatagagtctatttcaagaagaagaaccggaggaggaagaggtagaagcatgagagggccgacttgttccacgacgttatcgcgcccacgctgcagccgatcacgcacgtggagaggacctgggcggctacggcgtgtgcggagaagagaacaccaaccggctgcgcgtgagggaaggagccgcctgccgtggcgcgcgtagacaaaggagctcgccgaccactactccgccggcaaatagagaacgggagaggtgaggaaaaaaaggatgagatgttttttttttcattttgctcttactgatatgtgggtcccataagagccacgtaggataaaaccgcttgaaaaccattgaaggagtttatttgcaccggttttcaaagataagggagatgttatacccggctttacgattaagggagacgattcaacaaagggtaagagatgagggaggcaaaataggcttattccatgacgaatgcttctctccccgtagcagcccaggtgcacatgggcccagcaaccgcagccgcggaggcagcactcgcccgccgcgccgccgacccgctgcccgcgctccgccgccgcgacgcgctcccgctcccg

SEQ ID NO: 96831 - DNA, 510 bp, Oryza sativa
ttcctgcagcccccgaacataagtgtcggatgattataagatccagtactaatgtcttcttatcattgccgggtgaagcatatgtataactcaaacttttttttttcaaaaaaccaccatcggtgttgggttttatcaaccgacactgatgaggaggcactgatgtgttgtcctgtgatagtgaaattatctgtggattggcctgcatccatccatccacatgtgcgtacttgtactagtataatttttattacacataagatgcgcacactactactatacacatactccctccttttcaaaatataaacatttttagaatagtgacaagttaaaccttttaacttcgactattaataatagcaaaaagataaaaaagatcaatcatgtaaaattgatgttactaagtttatcattaaataaattatcctaatatgtaactcttttttattttaaatatattactttcatagatattattggtcaaagacctgacctccccacctctgc

SEQ ID NO: 96832 - DNA, 650 bp, Oryza sativa
acctctgattcagatcagttacagacttgcagtgagttgattctacagaaagaggacaagcaacttttaaactagaaatggacggacggacgcctctttgccagggtccttagactgaagaattgaaatgaaggaaggtgcatagcatagcagctacacaaggagacgaatagcatcgggacgtgaaaaagaaacaaacacatgtaacatgtaacactgcaaaatcaaacaaattagcgccatgtgtccaaatggcagagctctgcagccatgcaaaatatgcaattcctcattcagaggaaagcatcctactagccccgcaaccacaacacctgtccccaacattcagagcaacctactgtgtctgtgtgcagtcagtcaattactgtacacaacaagcatctacagtagctaccaatgcagcaaccccctttcgatgaagaatcatcaaacaaacagttcatccttcaaccaggaaaaatattcagcagtcactaatgctgtagtactacgtacagatcatgtgaaacatatgtgttgtgttgcactgtggatgatggtttgatggctgaccgtgatgacctcaatatttgagtaaattagtcatcccaattaagctcccaaacctgactgcccaattatttgttttg

SEQ ID NO: 96833 - DNA, 704 bp, Oryza sativa
tatgatgatatttgtatggataaattccttctgtgctactggaaggaaatcaattcctttgcacatttcgttgagagaatagttaccgctccctctattggtcagaccgtgctcatcatgactggtcagactgcgccctacctcggccagatcatgcctcttgtggccggtctaaccatctcactaactgtcggtcagaccaagtaccaggctggttagatcgggctacctatagccgtcggtcagaccaagtacctggctggttagatcgggctacctatagccggtcagaccaacaccctggagccttttcctgattttgtatgccacaactaatggtaccgatgttaattgttatttgattttgtatgccacaactaatggtaccgatgttaattgttatttgccacctataatactgttggtcatgttattccatatacacatggtatttgcaccgataattgctataagctaaaccaaaatcatcaagaagatggattggctcaagacgcgtagattactttcaaaactctgttgcgcctttacattttaggccataaatataagaggatgatcaattaagccctaaaggctagtaataattcaatgtcatataataaatgttgatacttgtttgtgatcgttgcgaaacttgtaaagcttgactgcatgcacgcattagtcaattttataaagatgtg

SEQ ID NO: 96834 - DNA, 744 bp, Oryza sativa
cctgcagcccagaaggtccttacctggagaattataagttattgtaggggtttccttttttttatgttaaataaaatgatattttgctgctcgatgtttataaacttgggaagttcacagggctggccctgaggcaggtcagtaaggacgaccgatctggacccccattagttaggggctccaagcccatagatggtacctctatatgcatgataataaaggtccaatcgggccaacagtatggctaccgaaggaaatcaggatcaagggagaggacacgtcactccagtctccagacgtgctctcgtcctcgcctgttcctcttctatttcccccagacctcctcgttccttcaatcctttcctgagacaagcgttggtgttgccacccctgtctcttctgatttctttctgtgatttgtttaccactcggaccagttttgctgacttgcctgtaattcgttttccctcttctatagatctggttcagagctaggagacatataaaggctcagattggtgattcttactaacagtaggctgctggtatgattttcttggctataatgtaggagtatacagaactaagatacagttttggaaaggttctaaagactagtatattttgaggtgttttttcagatataaaaatctgaggtattcatgttttgttagtactatttcagattctaactaatttgcacatcaaggtactaatgtactccatattttgttagtacttgtg

SEQ ID NO: 96835 - DNA, 585 bp, Oryza sativa
cgatttgcgggagattttgattgcggcggatcatttttgaggaggagaaggcggtggctttgggcggatttcgcttaggtagggttttggtggattgggcggttttggggggaagttttaagcgatcgtgggcttgattagggttgtgcattcctgtagtcgaattgtttgattgttgtggagttggctttgccgttccttgtcgaaggcgatgcttgcgtgatggcacactcagttcatgttgtgacaattcttccttctttcaaaattttggcccttggattaatagttaatctttcatttgtgattttctttgaatagggtgctgcattttgatcaatacacttagcctaggaatgcattagtgtttacttccttaaatagttttatgtatcagtttattgcacatcactgtgcctggtttaggcaaatattgttcttgatgtaaaaaagtgttttttttaaaaaaatatttttaggtgttatttgcaacccttgtatgcaccaagttgaaattgtatttcctatctgggctattgcagtgccccttgaagaattaaaccacagttactgctgcaaattggg

SEQ ID NO: 96836 - DNA, 684 bp, Oryza sativa
aggggaaaaaagggcaaaagagaaataaaagtaagagaattattggaccaacaccatggaccctcaccacataacctgcaccatccaattctctgaagacccactgtagcattattctgaacttgtacacttcatttatcatcttgtcccagactccagttaattaccttcaatcaattactacctttttactagatgtgtcggcagagtagtgcatctcctatcactaacagcagacaagtttaggtgtgatatgatagcaactattgtttgtacctgagttagttagatcgatgcagagctgacttactggaataaactgcagaaacgagacttgccataatctgaatttctaactttactgtagtatgttttctgctgttcatatatacaacactgactaactgaacagtgagctgcactgactgcaaaagagattaaaatgttcagaaacatgcagtcaccgatggtgatcatttcactttaataatatgatgattaggtcgtgatactaacgaacctctctatatctccatctctctctctccttcacgtgaagcctcgcacgagtgcaaagccgacagccagcaccaccgccaaaaacgcgaggcgagttggagttggagctggatccctctcgccattgctctctctctccagcctcattctcttcccctctcgtgc

SEQ ID NO: 96837 - DNA, 618 bp, Oryza sativa
ccagtaaggaacacgccctagatatttcactaccaaagaatttctacacctcaactgttaggggcacaaaagagagttatgctcgccgggcatggaggtggagctcatactttagtaaactgcagctgggaaacagaggcaggctaaactgatggcgaagagtttgaagacggcgatggaactggaaaccagtgttttgatgcttgaaatgccaatggagataccctccctttctccaaaaaaaaaaaaaaaaaaaaaaaaaaaacctgcagctgcgacaagccactacgtacacttctccatgtcgccaactataaatccgaatctgcctaaacctagaacgaatgcaaagagcaaaaattagtactgataaatgataaatctaatcaatgagtgagtgagaaatgctggaacatttaaacacaacaagaaaatcagattctaatccaggctgggggtttattgatttattttgctactagctatgtagaattacaagaaagaacagtctcatttgactttatccatttcttttgcctccagagacactactggttgttcctcatgagtaacaaaagaacaaacggcacctttagcaccaatcaacatcattttaaa

SEQ ID NO: 96838 - DNA, 788 bp, Oryza sativa
gggggccatgagcctgtgactagcactcttgcagattcaaacaaggaaatgtcagttcgtctcatggaaaaacgaagggagatacaatcttcataccggggattgactaggctaaagatcatacaaacgatagctagatatcctccaaaaagtactcgagaccaatacagttgctactaatcagttgctaatgcacagttagatgcacgtccaagagagaagcagctcaaaataacagacgacgtggaaataatttaattcctcacagtatcataaaagttgacagagctttagtttcacctcagttgaagcaaatgcatactgatgcgacaaaactgcagctcacgacaacttatcaaagggtcatctgttaatgctgtgaataacacttatgcacacagaacaacttgtgcacaacgaataaccttttttttttaatcctgaaatcgccttcgcatccataaaactcttcacaacttgaaactacatcaaagatcattgctggaaggtctggccgcatagccgcatatccagaggacgttcccgatatccgacggatattcattctcgtttaaaaaaaatcatccatatttgcttccgtatcccatactatccgtccttcactatccgctttaaaaaatgcatccaaaaatcagaaacaatccaaacagtttacatgttggctgagaagcacaacagcaattgctagcaaacaatgcgcacatgcaaataataaacgtgggcagagaccaaataataggcgctgcaagcaccacaataattaaatt

SEQ ID NO: 96839 - DNA, 709 bp, Oryza sativa
acaccataatatcatacggagtactatgaaacaaacaagaaacgttcatcgtcgaccatccctcattttgctgctatgtatactctatgtgtgaataatcaatccaaatgcacgcaacatgtacaagagataagacataaatattgagcgcaccttcaatctagtctagctataaacagaagagtctagttgctgctggcggcggtgttggagataacctgcacagtgcccagtttactcccccattcggctgacggcggtgtcctgtcaccgtacccaaacatgttaatttaccacgtactcacattggtccaaaccacacattccaaacatgaccacctatctcaacaacacccttactatcctcgcatcattcatcatgcgagggatgtcccctcgtatactttttctttcaaatttaatgcaaatagccgtgaaaaattcttaaaataattgataacgcatagtgatatctaccagtccaccgaaaatcaagttcaaattcgacctacacattgagaaaaaaaaagacaaatttagatatgaacagtacactactattcatacgcttaatttatatttttttttatatatctcaatgtgtgagttgagtttggacttaagatttggtggagttgtataaatatgttgtatgagtgttgttaattttttccagaatttttcataaccatttagatggtttttaagc

SEQ ID NO: 96840 - DNA, 1250 bp, Oryza sativa
ttagcgggcctttgcatgacccctgacagaattggtgtagtgccttttttttgtggagaacctctcaatttgtggaaaatgatgaaagatgagctgcagaattgagctcggttgagactttttttttcttttccgattggaatatggcctggttggttctctgttgtctacatcgtaaaatgttggtttactggcattcactgcttattttgctttgcggtgaatgaacaccgttcacttgcactgaactgaggtctgagggatcaagcaaattttccggaaaaccataaaataatttgaaaagcgtgagcaatagcttttataccgtgaaatatagagagtatttatatttcctggaagccatgaattatgtttcttctgttgcctcttcagtcttcactgcacaaatcatgaaaaatggcactaaaccatgagcttcattgcatagttgtatatcagtatatgaaagaaaaggagccttacaaactgatgaagggaaaagcgtttttcttttcaatccaacacatggctgatttgaagcatatgagattatgagacaggcttgagtctgggactgaatggatgaaagaagaaacatgcatatgtcgtggttggaggagattaataaacaaaagggtgtactagtgtaaattaagtaaggtataatgcacccgtacgtggtggaggcaatcaccagttgagttgtaaaactgcaacaagtatatataagctgctatgctatgcacactaataatttttgattgatgagatttagggcggctaagggtaataataataaaattgagttcagtagtagtagagtccaagtgaggtcctcggcaaggtggaggaacgaggaggcctgcttccagctccagctccagaattgttggcaatggagttggagtaatcatccttgtgaaactgatacctgcaggaggaagacgaagagtacctggcgctgaaattcctctcaagcaaaacttcatctgccctcctcatccccaacctgccgccattgaatgagcttccaattccactgaatgagcttcttgcgctgacgctgctgttgcaccggagcatctggccgtcgtaaccccttgcccggagctccggtggcgccgcccgtgcctcgccggcgaacgcactggcagtggcacccacactgttggtggtgctgctcttcttgtgcaggaggccccagatgctccaccccttgatccccttgttcttaggcttgctctttgcct

SEQ ID NO: 96841 - DNA, 685 bp, Oryza sativa
tcctgcagccccctagctatatctaattaattaatgatcaacaagctagaatgtatatagccaccatgcaatataatggttgtgaaggagacgcagcaagcaaggcgaaggcaaaggcgggcggcatgatcgatgatgatatatcgatatatatggagacgatcgacgcacacaagatggagtgagccgtgagcgagcgtacgtacgtgcgtgcgtgaggaattatacaaggcatgcatgcgtccgtgcgtgcatacgttgccttaaaattaaaaccggccgcaagagctagctagctagatccaatccagatcgacgtgcacatgcacatgcacgcctcacctgttcatgcatgcaaatgttatatgcccaaactcgtacctaataattatctagcggagtttttttttgtttttaacaattaatactagaaaaaaatacccgcgcactgcaatggttgaagggagagtggattttaatccctcaagagatgttccctcgttatttacatgtcaatcaaatagttatgaattttttttaaaaaaatgtgaagatgtattaacatgtgatatatcactcaacaaacatgcaacttcaaattcaactttcacatctcgcagcaattttttttcgttgcgagatgtggaagttgaatttgaacttgcatgtttctggagtgatatat

SEQ ID NO: 96842 - DNA, 536 bp, Oryza sativa
actggtgtagttttgcctgcttccttgtatcaatgcaataaagtcctctgttctccatcaaattatatttaatgatcattgcttctttagataggacaagggaagaagtggctccaaaaccaagatttgcagattgttaaggatcaaagaaacattgaggaatggaagggccaagccatcagtaccacaaggtaccagtgctcctagcctatcagattaaaattctatactattattgtgctaatacaacaggattccagggtatacaattcctcagcggtactgataaaccagcacaattgttagtaaagacatggtttccaagttcatagtagaaagtcaattaccagttatcacaacaatcctcctggtagaaattctgaacatctgatcaccttctcaacatggcatgagtcgatactattgtaaacaaattaatcaatttgaatgtcggtctcgctgtttggccatccgcgtgacacaaagcggtcttgctccatcacctcatgacaccgtgcgagaccgtccacgtcgtc

SEQ ID NO: 96843 - DNA, 1815 bp, Oryza sativa
cctcgtcgtccatcatatcgaacgccgacgcggccgcgatcatcgccttggcgctccccgacggcgacgacggtcctccttcaccaccaccaccaccgcctcctcctcctccgcttcggctcttgcgacgccgctgccgccgccgccgccgcctcatcacccgccgcatgacgcccgcggggagcctgacggtgacgagcagcaggatctccagcagcgccagcgggcagcagcagcacaccgccgcgcagttcgccgccgcctgccccgccgcctcccctcccccgcaccccggccgcggccgcgcctcatcctcctccacctcctcctcgccgcgctcccgcatgtgctccgatcctctccgcctcctcgccgatcggacgagagagtccacgggaacctacccgtgggtgcagtggtatttagcgagacgcgacgcgacgcgagggaggagagagagagagaggacgacggtcttacggcggttggtggcttgtggaggagagagaaagagggaggagatagatggttagaggcggcgagatggcgtggcgttggttgcttttgcagcctgcgccacggaacggaggaaaagatcaaaccgcaattttctgttactactagtacatttaatttatttaatttaagggaatttgattaaattgacaatattaatatttcctgagctggtaagttgtacttccttcgtcccaaaataaattgatctagcacgatatatgacatacgaatctaaatagaaaagtaaatgcttgtgtggatgacaaaatcatagtactataatgtatcacgtctaatattaaattgtgttattttgatatagagaggactaatgcttatgctaattaatcaaatcgtggtaataaagtcgtgtttgaatgaataaataattctcaaattgttttttcgaaacgtgagaaacaaatatttaccatctcacccaataaaaaaattgtcgtccacgtttcaaaaattatcgtccgaaaaaatctcaagcagaacaaaaggataaatatttgtttcagaataaccgcttgccaaatacccattagataaaaatacagtaaaaaatcatatggaaacggatgaaatactaactgccagctagcatctggttgccaaaaaaacgcaaccccaaaaattctctatctttctctctcttttttcctgaggcacacgccagaatgccaggttagtttacgaacgacggccgccgcgccacgccaggaagcagccaatgtgtgacgcaatagagatagagacggcggagcgcgtcgcttccgcggatgcgtcgtggagtccgactcagcactcggcagcccgagctcgacggagcgagagcgagacccagcgccgcacgcggtcttggtgggtttcccgatccgacggcacagcgcttcgctgctaagcatccacggtttctctccgtagttccctctctctctctctctctctttcttggggaacttttcttgctcctctatagtggcccagcccagtgatgtcggcgttatcgtgcgtgattgtttttttcttttgaactatcgtgcgtgattgagcttagtgtttgacatatatgacgtaattgaagcttgtctattcatttttttaattaaagttgcgtaattgatatggtcaagtgatggcgatgggttggtgacaataagcagtattaagcgtgtgtcatttggttagtgttgttaagaaatgccaactggacattattatttgaatctttgatcagatagcagtggagcaagcaacaaatacaagagacaagagcagaataagcttctg

SEQ ID NO: 96844 - DNA, 1603 bp, Oryza sativa
atttttccatacgggtcacttaagcagccgtatgggaaaatgaccctcgatttttgcagacgccactagttacggtccgcatggaaaaatgatggggcctcgtacagaaaaatcacttttgtaggagtgcatattataaaacacttttcatctctagtatagattcactaacgtacttataaattgaacatatatatgaatcacatacataaatacattcataaaactattcaaaacccaaagcgtcttagcgtggaacagagagtagcaattaaggagcgggcatgatccaacaagggtagtcctcgttggtaataaaaaaaaaacaagtactcctagtacttaatccaatatagtagagttaaattaactaaattttactttatatttaaaaaaacttactttgttttattaattaaactaaagtaggacaaatattacacagagagtcatgggtcggtccatacccatctctgatctctatgtaccacaaattagctgatatctccgcctaaatagtattatagtagtactaaaatcacacttttaggcttcctaattggctcaaatctagaagcaagctacgaagtgattataggctgtagctctcctccgtcccaaagaaaagacaaaccctggtttccgtgtccaacgtttgaccgtccatcttatttaaaaaaattatgaaaaaaaattaaaaagataagtcacgcataaagtattaatcatgttttatcatctaacaacaatgaaaatactaattataaaaaaaatttatataagacggatagttaaatgttggcacgaaaacccaaggtttgcttttttttaaagacggatggagtagtttggttcctggtgatggaacctttccattctgattctaaatcctatacttggcacggtgcttatatttgtagctaattattctttctatgacagacgatgtgcacgtcaaccagtaagacacactctttagaattggactggttgttgaagaaaaataataatacctgatacgcttatagtgattttgtgaaatctcaaaatatattgatccagctttaaaggtgttcaaaagaatagagcgtgtatgtttgcactgtgtttgggaaaaaatatctagaagcaagattacaaaaacaaaactggactagttgttgaaaaaaaaaaacctgacaaaaaaattcctccccctgttcatcccgaaacttgagcagcgaacacaatatttgaccccacgtttgccagcagtacggaggttgacggacggacaattcgtcaattgctatccctgcagaagccgttctagaacaacaagtgcagaaatcgtagtcaacaactgtactgaattgcctgtatattgtttggccaatatgttgaatccaaagcattgccacgagtttcagcgtttgctgctagtacagaaaaagacagaggcgaaacctggggggcaatctggacgaaggctcagaagtggtccaccccccaaatcgcacgcacgcacgcgcgcaatggtcaatcgaccaagcaatcgagcggagcactgcacaaaatttctcccgcttccgcttgcaaatccaatcctaagctaaagtttgat

SEQ ID NO: 96845 - DNA, 675 bp, Oryza sativa
agctcgtgcctcgtggtgtcgtgggtttgtggtctcgcacatgaaagcagcatgccgggctcagggctaacggggacatatatttatgccttttgcatattacaattttgctttgccaaaagggagaaaggcatattcgatgaaaaagaaaaggttttgaaagtatacatgtgtgtctctgttgctttatcatttacaaccctatcgattaatgaaacaatgtatacgtgcgtaccttgctaggcacgttcgaccatgaaacaatgtactggctctagctattcacatcattaagatagtgctcaaattttccctgtacactaagggcataggcaagaagaacgatagggagccatcgtttaggttcatggtcatatgatgtaaatgacagattgataaatgtgaagtggtctgtgaatgaaactcttaaatacgtgttctaagcgatctataagtgcaggctgtatccatgaactttggtgaataacctcataatcaggtactcgttcaaggttgttaattccgatcctggctgatagatattagcagtaagagaaaaaagacgaccgatatatcatgtgataccattcatgctcagacctcgttttttgtagtatatctcgtggtcgagacatctcgcatttgtctctcttctccctgttggtacatccgcat

SEQ ID NO: 96846 - DNA, 575 bp, Oryza sativa
tataattagaggaccctcctcaaaaatgtgatgttcatggagtgggtgtgcaggtggaagatctatcaccaccacattgccttcttttagcttgacaagctaaagaatatgttcatcgacaaacctgatgatgcaatcgagctgctcttgccatctatcattatctccatctacctcatcaagcaggcttatcaagaagtgactatgatcacataaagccttccaaaagaattttcaaaatttcacttccggacagaactgtgccttccccaacctaatctcacactgtctagattcatgtactctacagcatgcacatgatggacgatcgatataagacatgaacacatcctatgcatgctctcccaaccaactgcgtataacaagctgtataaacatgctatccacatcaatactgatcctcacaaactgaaccacatgatgacaatgatgattaactcgctagcatctaaatatgcgtagtgcatgcctgcctatctaaacagacgttggtatctccatacttgcctccgtatctggagaagatatgtgaggctccaattttctacatattg

SEQ ID NO: 96847 - DNA, 663 bp, Oryza sativa
tatgtgtgagggcaacgggggaccactgttttgtttggtacgtacacacactacagagctgctaatgcaatccagatgaggaatcagggtatatgaagacacatacatcaagctctgagcttctttaagaaacggacaccatgaccaccacatgcccatccaatctacatcctggggggctcctccaatatcgaacatcaggacaacccatgtgaatggacactcgtggtagaaccatagctaggacacgatcacaaacaagccatgtcaatccgagtcaactgactacatcagcatgctcatgtatggctagtgtgacaagtcagatagagggcacccacaaagccaccactgaccactcgctaagccaagcaaagagactgtgaccactgataccaacgatgaattcacaattcggaaagaaattaatggcgctgattacattaaccggctgcatagcatgtgcccacacccgccgcgcgcgtgcgggggtcaagccgacgcgtgcccacacgggtgcccaggtcgaactctcctccaacgaccgatcccacccacggaacgccacaattgccctacgtgaaatgtaccgactgatgcagccactacaaccccagcttataactataactacgaagtgtgaaaaaaaatggagacgcgaat

SEQ ID NO: 96848 - DNA, 702 bp, Oryza sativa
cgaggcaatttcattgaattcatgcagtgctttatggagctacacaaagtgcttttacctgcaggatcattaaaaagcaagcaaaataaatcaacggttcgtatgctagagctgtggtaaaggtacaacattatatagcaccaagcaagaaatcaactaaatttaggtcgacagaagggtaggtttcatttgaatgccatccagactccagcagaacaaattgaaatagtttaaactttaaacagcaaattgacaagttaaaacaaagaagagctgaacacgacaaaactatagatatagttgccttatttctatctatagattacaaagagtagtgaacagtggacaacgccaagggtacctgataattcttgaccacagagaaaaacttggcaacaagtaggtgcacttagtggcaaatcgagcaaatcatttggtacaaccgaactcccattctgaccaagtttctcataaatttctctggtcttaccagcaacatgcagaggcgtttcatgcaggtcaatttcttcaatccaaggattgacctgcaacatgcccataatggtctgcaagactagttccccctcgactcccctgcaacctttcaatgataggtttcggagagtagtattcctttctaagcttgtaaagattctgacaacatcatttggcctcaagcttacatcatcgcatatggccaac

SEQ ID NO: 96849 - DNA, 1632 bp, Oryza sativa
gaatgcagaaacccaaccaaatcgctgccgccacaaaagcaattccatccttatgaacaatgcagccctagcaattcagtccacgggaaagggaaaatgcaagctgcaaggactgtgctttccagatggccgggtatcaacaggaggaggaggaggaggaggaggaggaggaggaaacataccacgggtggtggagggaaagggagagggacgccatggacgcctcgccgtcgcaggaggagccgcccccgctcgatcgctggctcgcttgtgcctgtgccgttttcttatcttgcgttatcctgtccaccgaggaagctagacgaagcccaataaggaacgggctggatccgtcaaggcgtcgacgatggccgggcctacaaaaaaagcccgcgtacaaactgtgcatttctctgggccctgacaaaattttgtatttttaaacagaaattttggaaccacctatacatttgttgacaaattttcttctaaaaatttgacagatataattatagtacaattatagtgtaattacactgtaacttgtatgtaattacactgtaacttgtatgtaattacactgtaacttgcatgtaactacagtgtaatttgtatataagtttcacgtaattttgaatcgttagatctattaaaaaatttgttctagtgaggaagaaaaaaatcacatcacacacatatgtgaaagaatttgttatggagagatttttgaaagttacatacatgttacattataattacagtgtaattacactacgattgtactgtaattacatctgtcaaatttttggtgaaaaatttgttgacaaatatatagcaaatttgagaaattttatattttaccactaataacaatcaacgtcgttctatgaattgttgcagagagtgcgagttctaagcaagcatttttcttccgtttttactattgtcgttagtctcacctctaacaccttaaaaacactattttgttgacacccctatttcatattacaggtgggtcactaaaccatctgtaaaaaatgattgttcacaaacgatatcctaagggaaatcatttgcgaaaattagtattaaaagaggtggttactacttgtgaaaaatatcatcgtgtgatcaattagctaagtaacaaaataaatttgcatctccccctcctctcactccatcaaccgcccgaactgcggatccaacagaggcaggttatggaagcagcggaacatggaggcagcatgcctcatgagctatggatccagcatcggtgggccttgagacagtagcggacctgatcacctgacaccggcagtcctaaggaagaactacatgcgcttgaactcgccgaggaggtcgttcgaggatgagaacagggggtggatacagcgtaggggcggcggggtctcgagccctcactactaacggtgaagactatgagagccctcgtgaagactctactaaaattttttaccatatgtagatgggaagagtactataactctatttagtttgcttagaccccactgctatttctttctggatccgtcactagatgagaccactgcttggcgacggcaacggctacatccgtcgatgtcgatggggtgactgtatatgccacct

SEQ ID NO: 96850 - DNA, 682 bp, Oryza sativa
tacgatatcaatgttcaatggtatgtacactcctgattctagtcgcagcttcatttatcatgttgattctgaccattgcaacgaattcctttgttgatcttcttcatctttgcagcagcgactaatcaatatcgagagcttgggagagatcctggcatggcagcggaggatcgagcgatttcaatcgtcgttgatccaggagcagatggaaggggtggttttctatcttcgatcgtgccaaaggtaaaaggcactctcgttccgccacacctttcctgtctctttccccatcgattcctacatttgttcagcaatgaaaatccaacgaaaaaggggctcaaccgctcaattgcgtggatgacgttattgagatttttcagttgcaattgacccccttatactgtttgctgtccatgtctagggtgtgtttagttctaaaaaaaaattggaagtttgaagaaagttaggagtttggaaaaaaaagttgaaaatttatgtgtgtaggaaattttttgatgtgatatgatgtaatggaaagttgggaattgggggaaactaaacacggccggttagctttgcacgttgctgcacggtgcagtctttaatttcttgaaaatgaagggcccacatctcaaaaaaaaaatgcccatgctcagggtgtgtttagcaaatgtgacattgg

SEQ ID NO: 96851 - DNA, 682 bp, Oryza sativa
ttcgttatcactgtgagagatattgcatgcacactactgcgtaaatgacgtgttcaaacattggactctcttcaaccgcaagctgatcccattattctcatgggccgcatggatcggcagctgcagctgggacccatgcacaggtgcaagccacattatggctgtgtttacattcatagacaggatccaaacttcagtccttacacatgacattgacctgtcatacacagataactctacagtcatatcatctctaatatcaatcaaaattaaaactttacgctgaaacacatcctataactaggatatatacgtactgcacgagagaacgtgctggtgcacgagacttgcggattgtgggctcacggtgtgcatggaccaagtttccaaccgcactctgcctgcttcgcccatccgtgcgacgaccccccaactctgaaaggctgctccgacatctatgaactatgattcgcacattaggttcgacattataatcacctcattaattactgtcacgcgtatactgtcattctccctacttgacccattatttgtccccggatcgacgtcacaaaacaaggctgagcatgactacgcaccgatagaatgactatcatcggatgcgtgagtgactcatgcagccgtgtctgtgcacaaagcgagatgagaagaccaaactcac

SEQ ID NO: 96852 - DNA, 1429 bp, Oryza sativa
agtttcggccactctcaaaaaatagtgcacgccgtcaataaactctttggaccgccggtcagcgtacatccattgccgatccatctacatgagtcgaaaaaaaatcgtacgcaaataattattcttacaataatgacagtcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcattttagtttgttttctagtattcaagattaactttcactataattttccttctcaactattttataaaaccttctttagcaaatcaactaaatttctatatattctttcttccccacacaaattttttttctcatcaacttacaattaaattttggagacaaaaaagtgtgcaaaacatagctgcaaatgtaatatgacaaaaaaaaacattggaggatgaagttgcaaaccttttaggcacctccgatttgtatgtaatcaccaaaataaattcactagaaattttggcatgacctcacctcttttttgaagaaattttgaagcttgctcgggcagctggaggaggaagaagacatatatataggggtgggactttagtcccgattggtgttaccaaccggggctaaagatccgggatcttaccaactgggactaaaagttacgatctttagtcctggttggtgttactaaccgggactaaagatcccgaggggcctgataggccctgacagcatttgaaccgggactaaagatgttaccaaccgggactaaagatcaaatatgcccgttacctttttgaaccgggactaaagatcatctttagccccggtttttattgcatccgggactattgtggaattcggcctaccgatgaaagatgatttctccaccagtgattgtcccagttgttagtagccactgcttgctctgtaagcaagactgtaaatcacagtggcctccacgatcacgttcgttacatgcaagccactcgtttgggcgtattaatttagcaacgcgaaagtggagtagagtagcgatagctttcgatggataacggtggttgtcgcacactaaccacgcctcgcaatggcccggctccccggtgcggggaggcacgtggggatcgcgaggcgcgcccgccgccgccacatgcccgcgcacgctgccgcacgggccccgcgcgcgccacctcgtcaccgccgtggccgcgtccacgcgggctgcacggcgagcgagcgcgattagtggggaaatcatgaggctaattttttagcgcgcatatgctgcacttttgcttcatcgagtgctcctctgtggacagtggacacatcacacatcaactgt

SEQ ID NO: 96853 - DNA, 3132 bp, Oryza sativa
ttttttattgtgtgcaacgatgcaaagtatggcctcataagatccttcgatacatcgcgagcaacgatgcagcgtggcttagttgttttgtgtcttttggcttcaaaccatctttttgaagagaaaaagggtctcaaccttggatctgcatatgaatttagctgatatgattttttggggcaagttttgttttctgtgttgtttcatcattgatgcagcagtaccattcatttgatatattgcccttaatggttccgatgttgaccacttataaaaggtatcatgcatctatctatctatacttctaaagctggctggtcatccagccagctgattggaccacgtggcacagctatatttgcagataaatagatggattagcactgtaaaaaaaaagtaaaaaaaaatagcgttcaattcagtccctctggatcaatctaggtggctaccgaaacaacagccgctcctccgtccctccgtagctgctgggctgcacagcccagtgatgcacgattaggcttggtagtttggacgaatggttcccctccgtccctcacagcctcacgtgtaggatttgtggcacaagtttgtgctgctcctctgctaatcgcatgagtaggagctagcataaatagaagaaaataaaaaaaaagagaaaattagaaagtgagaaagaaataaataaagaagtaaaaaatactactctccgtgtttttatagataacgctattcacttttaaatatcacatttgatcatttatctatctactactacttaaaaaaataaataagaggtgcttccatcgtccgtcaaaaaaaccgggtgaaaaaaaaccgggcagaaaaaaccaagtttgtccgataaaaaaaccggacgaaaaaaaaagtccgatccaaaaaaaagtgaaaaaaaaaccgggcgaaaaaaacacccgtccctggcaaaaaaacacccgatcccttaaaaagggaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagaaaaaaaaaaaagaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaatgggcaaaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaaataaaaaaaccaggcgaaaaaaaagataaaagtccgataaaaaaacggggcgaaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggtgaaaaaaatccaaagtaaaaggaattatatgtgacgcggtaaaaaaaatcgatcgggcgaaataaaccgggcaaaaaaaatctgtccgatccaaaaaaaaggggaaaaaatcaaaacgattccgactccattgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtcttattaaaaatatccaataggtataagtgatatttgaagtatctttaataataataaatgatacttgcatagctttcttaataagacaaacgtccaaacgttatattcaaaagtcaacactatcatcgtaaaaaaatacatgaagggtctcatctttttgcatatgcttatgtatatcagctaaaattttaatttttcaactttaagtttggagttgattttgggtgtttttcatggtagtttatttttgagtaaatttcacaaaactacatgtactttgctcaaattatcacaaaactacctatttaacgtgatgtatcacagaactacagatttaacaataaatttatcatagaactacaggtttaaggctaagtatcacaaaattacagatttaataataaaattatcacaaaactacagattttgaggcttaaatccttagcactaatgttatgttgacttataattgatcaattaatgtgattaaattgtcattaaacctgt

SEQ ID NO: 96854 - DNA, 625 bp, Oryza sativa
aaatttcaggtggacccaattaattattttatcttttatacaataatactatgttttttggcacatctttttttttaataaagaaagtgcataatgtgatcttaaaatggtcactgcatttggctttaatttgatgataaaaagatgagcgtatggctggcgttttcctaatccaggctattgtgattagaagcttttttttctactttcaggtccatttatgccgacctttgttttgttcatcaaaaaattaaacatcgccctgccaatccttttccataaagtgatttatcatcgcacatatgtaggatctaagtggagagaagtgctactttataagagcagatgatgatgtataaaatgtatacatttcattatctgaaaaaaaatgtgtatatttgcaaccaaagtcctaagtgggcagtgcacaagttggtgtgctgctaggtgatccctattgttcctgcagctcatggacattgacatgggaaagaaagaattagtgggcaaaaataggtcactatcatatagatttatgaattccaaatccctaagatcctaaaatgatctgctgatttgattttaatgccagagaacagggcattgaatattaagtacttttact

SEQ ID NO: 96855 - DNA, 534 bp, Oryza sativa
gaaaaatcaaaaaaattgttgttaatgctctcaatgccgaccccttacaattgtgtggcgtggttgcagaaaaagacagttataattttggtcctttttcccctaacccgagaaatatgggctggatttcggccctataacaaaaactcatgccatgtttgggccttttttcttggttttagtaccacctcggtaacggaaggcggaggagggcgcttcgctatgtatataagcagggggggttgttcgaaacttctaacggccttttggctaaaatccagggtttgtttggtaaagcttaaactttttaatttaggcacaggagtttagtctggggtacaactgtttaaatccagccccccttttttaggttattttgtgagataactttggtgccatttttggaaacgcttcaaatttgtttagtttttgcagcgtttatcttggtgattcggctcatgagggaattcatagttgcatgtatttcgccactcccacaaatagaaaataaagcgcacatttccccgaaaagtg

SEQ ID NO: 96856 - DNA, 535 bp, Oryza sativa
accaacagtttcctgagcagcatgccagtatcttaacctcgccgccgatgggttaaaaaactaaaaaagagtttggcaattttctctgtctagtccgtcaatatgcgttaatatgtcagttggattcgttattgtctctagtatttacctataatattctttttctctctctctcttttgtttagagttttggttttggccttcatgatatgcgactagagttcttggtgtgcttagatgtacatagtctttctggacataatggatattatattagcctattggatgagttcattaacgatgtcttaaggtgttacttctatttgttaattctttttaacaatggcatcacaaaggtttcagtatgttcattgttggtcagttgaccaaagcaaatactatcaaggtgcagatggatggatggattcctttgttgcgtatcttgttgctattcaagttgatctttgtgaatcagtgattcagtgtattgaaaggtgatctttgtgatcaggggaggaattgtcattacttaata

SEQ ID NO: 96857 - DNA, 961 bp, Oryza sativa
gaagcacatgtgcgaaaccgtttcctcagccaaattgcagaggtcacagttgggggcagacacgatgtttttcttatgaaggctctttttcgttggaagccgatctttagcaagaagccaggcaaagactgaaccttgagaggtgctttgttgtcccagataaacttctaattcgggcagagaggtgaaccactgcattgggcaagatagagctgacttgtcttcggaatgtcactggtattcttcgcccaactactgcagctgtggcacaaccacctcgcagcacagtagtttgtgtcatcgcagcagctatgctggctgcgttgcagcagctgcaatatgcagcggaacactgcctatgatagagagcacaacgtccccccctttacccccagaccctagtagtaaaggtttcccgagaactctgcaaggataatcttctagttcgtaaaagaaaattgactctttttaacgtgctccaacataataaaatcctagccgatgattgttttgtgatttattttccaattaaaaatattttttctccttccacaaatgcatttatctaacaaggaaagtaataattacccttagtaaaatatgcatgtatatatatgcgtgcatgcatggatataaccaatggttgagaccatttaattttaaaaaaaatctgttttttgtttttttaaataatgaaaatggattacatcttcgtcccgtgccagtctcataaatctttttttttgtttttttaatatcccaaataaacataatgtatgccgtatgatttgcactagaaaattttaagttttaaatgactgcaattctgagtcgtgaattgttgctatgtaaaataatattgaaagaacatataatacaaaaggcataaatttcttttgataaatttgtcaaccggggatacccatagaccggacaaatggagtattggagtacgttggta

SEQ ID NO: 96858 - DNA, 783 bp, Oryza sativa
catttctctaactagaatggtttttttatttttgaataatatgtccacaacgaataaaagattacgtgagaatatatgtactcctttaaaagactctaatggtgatggcagtaaatttgctacccaactgttcatattggttttgcagtttttacaaattgtcccctgatatttattaatattgtgaaatgatccactatttagttcaaacaaatggataacatataatcaaatgagcaaacaagtgatattaagatatttgataaaaaaaatattttgatatggcatattatgattcttctgttaatagcaaaatatgggtattttgctagtaagcatgaaatgaggaaagagaagaaaaggacatatttatacacactatataagcgagaaatgcgtagttttaaaaaagcatatcaaaatagtaatgtttgtattagcgcagtattaatgtgacgtggatgattaaaaaatatttgactaatagtatgcaactatttagcatataaataacgatagagcgttctcttgaaagtttaacaacagctctcgtcattagatgaaagatctttcttatcttgacttcacatgaagagagcggacagttcacaaacgccctaccacatgcgtattgggacatcccataaaaaatcaacctagtactgaatatgacatatcctactactataaatctgaatatatctcgatctagatttattatattagaatgtgtcacatccagtcctatatgccattttatggaatggaggttgttcgcattgg

SEQ ID NO: 96859 - DNA, 621 bp, Oryza sativa
atagttgacagagttcctacccttttgccacaggaacctgcaagcagccaaggtagcacacattccagtcagttatgacagtacatacacatgaattcaagatgtaaaacagcattgagaaaaaaaaggctccaggtgattaatgacagaaatgtgggcacaaaggatgtagcagctggaaagtggaatcttattatgtgatgcacacgcaacttctagaagcaaaactgaagattctgaaggaactgttaaaacaaaagcaaagaaatgttccactagctaagtccgagctctaacttgtaaactcccatcataatcatgaattgcttgtaatacgggtactaaaagtacaaccttacctccattgtggggcttccctgtgcaagtaacaccttgagagaatttcttcagctttccttctgtctgcaacagaatacatgaagcatgaggttgacaattgaataagaacaaacaaggtacttataagttccaagaaaaagttgtagaaatgtcagtcatttatatccctcagtttagtcaccttcagacgacaagtgaagtaggcagcagtctggaaggcgataatcctcaagatcagatgtgaagaccccaagccaccga

SEQ ID NO: 96860 - DNA, 558 bp, Oryza sativa
tcgaataattatatataactgttgtatgcttgtttaatttgatagaaaactaagttaatttaaaatcaaaaataattacaatacattaaatatttgttaattaaaacatgaataatatgtggtattaatttataatcaaattagtttatttagaatttgaaaaaaatcttgtgataaaagagatgaggaagtaaaatatagaagattaatctaaaagaatagaaaactaagtcaatttaaattaaattaagtacaacacattttgtccaggggagatacccgtagatgtcacaccctaaaaattcaaaatatataaattgttgtttaaatggaatttttagaaataatttttaaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcctcttttg

SEQ ID NO: 96861 - DNA, 759 bp, Oryza sativa
tttattatctaaagtactttaagtatacttttcattttacatttgcacaaatttataaaatatactccctccatcccataatataagggattttgaagggatgtgacatcctagtacattatatctggacaggctctccatatagatgtattttactggttgtgtcacatccctctaaatattcttatattatgggacataggaagtaagatattttagttgaaagaaatatatcttagtattatgaatcttacgcaaacactaggatatatcttatcgaaccaaaatctcttatattttgaagtaatatacttaggctgtgttcaccattgcttgttcccaaggaacagtgcgcaacgggaaacggagtggtccattagcgcgtgattaattaagtattagtttttttttcaaaaatggattaatttgatttttttaaacaactttcggtcgcaaggaaaagagttcggaagatcaaagtgaagaagcaaggcaagtcgcacattcccccttgagcatgttgatcctaatttataaatgttttaccgtttgcaaataaatatgcatgttttgctaattacatgggatcaggttttacctatctgctcgcttgtgccatgtttacttgatatctatcctttgtcaaccttgggtgataaatcgactagctcatgttacttatgtgacctagctagaactatatgcttagccatgcttaattaccactagctcagtcgatgggataattgcagtattaga

SEQ ID NO: 96862 - DNA, 581 bp, Oryza sativa
atcatctcggcctccaggaggccggtctgaccgggaaagtgccgccggtcagtccgccactatgtagccggtctaaccggccagggcacgccggtcagaccgccactatatggccggtctgaccgcccctggtcaggccgaacccagtgaatttgtgtagtgaattttcacaaatgaaaatgcaatgacctaatgtggcaattaaaatcatctttttgctaggtcattacccctcttaatagtacggcgaaactaaaattaaactagcaaatttgatcgccctacacctcgatcaattctaaattaaaacgctagttttaccgtcttctttccctttgctttgcgccgtcaattttaatccattgataatcatccatgcgcacatatgacgtggacctaacttaaaatgtatagctcaaagacaacggttagtccacaattagtgcttgtcattaattaccaaaattaacaccgggggcctagatgcttcaaatgatatttttttcgaaactagtaaaattacaatggattccattaacccttaaaataaataaatttggccaaaggtaatgttgcatttg

SEQ ID NO: 96863 - DNA, 743 bp, Oryza sativa
taccgtatagccctgatttgatgaatttaggcatacctgaggacgagatatgtcaatgggcgaaccgtacctcacaacggtttggtaaagcaatctctgttgtaaaacctccctaggtggtgttggtagtcctgtgcatatacgacttattaccacctagataagtgtttgttcagattcagtactgaaattgctgacacaggggtttctgttttgtttccatgagtaaattgttttttattttattgtttgacaataaaaggcttggacttgtttcttaattttgtgacaactttcatatgtcagttttatttacgagtgaagtacacaattgattcttagactgcgagtgtcatctagctctctaacctctcaagatatactttttgtcgtataggtttaaaaggggttcaaccgacttctgtgtattgatctacaatgtcaatcacataaaaaaacaaaattagaaaaaaaaagcatcatcttctcttattatgttaaggtgagaaaatattaaataattgcatatttaacacaagtttgaaccggtattatggatctgccactataaaaagtgtaattggatatttaccataaaaaatggttggaatccaatatattgccatgggactgacagtttagatgaacactgttacaagattgacttctatgaaaatcaggacaagaataccccttcccaagaaattgaaagattaacacatcatatgccaaaactcacgcat

SEQ ID NO: 96864 - DNA, 644 bp, Oryza sativa
gaaatacctcgattccaacacaaataggcagttgcgggtgcttgtcacctttcccttcagaactcttcttgtcatccagatacatggaatagccgatacatccatatctgaagtcggaaaggttgcaccttcctggatagcttccatctcaatttctccaaccatgtgatcagggactgatgcagaaacatagaacagtcagccaatgccaaccattgcgaccgaagaaaacaattcagattgagcatttaaacaatccataaaaattaggccaacagttaagtactccattaaatgacagcaaattcagagtaaatgacaacaaaacatttcaaaccaagcaaggagttacggcgcagtgcgatggcatgtaacactgtccagatctgcagttctgctgctattaggcattagcagtggcagtggcatgctaactagcaacaagtcaggatgaatacaaatatcgatcgtgcgttgtggtgtgtggtaaggatcatggttacttccaaaagttacagttgctactatgaccgcgccaatccagcagttgcgattgaacatctacgttccccattgttcctgcgtgcgtgcgtgcgtgtttgcagggtcactggaataaggtgccagaaaaagctccggcgctc

SEQ ID NO: 96865 - DNA, 504 bp, Oryza sativa
gacacttgacaattagctgccctgcggaaatcccattatttatcatgttaaactgctgctaggttgagttgaagactgattataagaaacttgcgctgcatagagtaaacttaatttctaaactctaaggaaaccatttgtgtgttaaatatcatgtcggtttgatctttgacccaagaaagggtctcctgagatggttactaattgataagtgataacaagattaaccgtatgagcctcccactagggctactggacgtgctaccgaatcttccagttagtttaaaaatggtttgtcattatctcaaggtcccagatttttggcatttaatgcagtctgccagcaaatatttagcttgtgatatatttaactgtttagacaacaaacatccagaatgtattaaaaatatttctaaaaactatgaaacagttttcttcaaataattaaatgatttttctgaaaggctaaaagtaagcagatgcctattgatgttcagattccat

SEQ ID NO: 96866 - DNA, 736 bp, Oryza sativa
gatctctccgatctcgatctctctccgtcgccttcgacgccgccgccttcgacgccgcgcaacgccgccgccgcatgccaacgccacgccgccgccgccgtcgccacgccgccgccgccttcgccgccgcgcgcgcaatgccgccgccgccacgccacgccgccgccgccacgccacgccacgccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatacatgtatatatatatacatgtatatatatatatatatatacatgtatatatatatatatatatacatgtatatatatatatatatatacatgtatatatatatatatatacatgtatatatatgttacttcgcatttatcctaatacattttttttatcttgcagaaaagacgtgttgtcggagtcgtccgtcaagcctgagtggaagagctagccctagaaggaattggagaaggcaagtgacgtaataatata

SEQ ID NO: 96867 - DNA, 812 bp, Oryza sativa
ggtattaccaacggggactaaagttaagatctttagtcccggttggtagcactaaccggggctaaagatcaccgggatctttagttccggttggtattaccaaccgggactaaagttaagatctttagtcccggttggtgctaccaaccgagactaaaggtcccgggggggcctgacaggtcctgacagcattcgaaccgggactaaagatgatctttagtcccggttggtaacacaaaccgggactaaagatcaaatatgcccgttacccttttgaaccgggactaaaggtcatctttagccccggtttttattgcatccgggactattgtggaaatcggccgaccgacgaaagatggtttctctaccagtgttagatgggtgtaatttaatacataaacttataaaatgctcgtttagttacacgaacttgtctagttcgtgcgaacgagaaccaaaatagcttcgcaatgttaattttacaaaagttgatgttgattagaatgtgacgtgcatacgtgtaatgagtatgcataagacatataatatttataaatttgatctgtactttatccttcatcatggaagtgatgaatttcatatatttctagcccttatattattactcggtttttttttatcattttctacgatcactatatctcattctatttttattgaagatgtgtttttctaatagcaaccttctcagatatatatttacctagtatcccgatgagcccctaaatcagtaagattggccatgttgtttgtttttcgccttcctccgcacgcaccagacaaattcatgt

SEQ ID NO: 96868 - DNA, 1377 bp, Oryza sativa
tcttcctggttgcctccgcacgcccgcaagtcgctcgatgaaatggcgacctcggctttgacgtttctactactggtacggtaccaccagacttgttatcactaccctccctactgctgatgagtcacttgcaggattcagacaatgtttgcatctgtaaatatcgttacaggtgttcttagacttctttataggattgaccgtgaattcgtccaaatctgacaaatgctagtttttgctgtaagtatgcatgatttccgtaaaactgggcatgtgcggtcgaaatttacttacagtaggtgccttgctgctggaattaaaatttcatgtgggcgaagaatatgtccacactgatggttggagacttggagtgtatgataatatctctcattccatgaaacattgaacaatcatgttgcttctcaagtccctacagggctacacctgttgaatacacaattgaacatatctcttctcaaagcatgaccaattctagatttttttttttcctgcacatagcatttccttatcattgttgcatgcttcgatttaccctgtccaactggctactgtatctgggcatgaatcggtaattctgttttatccagcttcgatccatcaagcatatttggttgatactatctaaataacaatgttacttgtctatttattacgttctcttagtatgatttgggaaagtactattaccttttttttcttttgctgaaactttttttcgcaatttgtcacaatctctgattgagcccagacagagttcattttagaaagaacacatggccacatggtactgtagttcaccaaagtacatgttcaggtgatcgttttggtgtaacaatatcaaaattagctcacctaacgccttctcagtcttatattggcaacatggcactgtcaatgacctcaattttctttataccatatcatcactgactccgtactatacagtacggacaaccttaataaatcatggaagaatagtcaaagacaaattaaacatgcgtatcataaattgtcaaagactgattatttttttttaaaaaaatgtctattgtgagattttggagccgcctatgccttgttcagagagtgtaagattttgaggaaacggttgattgatagtcaatctctgagaatctaaaaatggctggattcccaattaattttttgaattttatagctgcatattctcaaaatttgaagggagaatctgcattattttgaaaaattgaagattctgcgaaacgttataatggctagaatctgactgtactgtttctggaacatagtgggggtatttttcattcaaatcttgtgtgtaacaagtaacaacaagatccagaggaccatagatcacaa

SEQ ID NO: 96869 - DNA, 548 bp, Oryza sativa
cataaaccgtagatccgattccagtgaaacttagacctaaattcatctaaattcaaaatctacattttgatatcaaatttgctattttaagattttatttgaatttattcaaataccgtttgaatttatatttgacttttcaaatattttcttttatcccaattaccctttagcaactaaaaaactgccggttggaatttttacgccttccatggggacgatcgtggttttctatccccgatgtcgaaccgttggttgtaaagcccggcataaaccaaacccaaggtcgaagtgctgctcctagcaccccacgcttcgatgcgtatagcggtcggagcttcactattccatcgacccccacagcacgccgcacagttgttagctctcgggctctgtgtgatcctagctgctccgccgccacccacggttgttggagtaacacttccaccctattaaacctgcacccacctcctattccctcttgccgatatgctgtctgctgacacaggctagagaagacactaaatctagtcgttatgctgccaact

SEQ ID NO: 96870 - DNA, 947 bp, Oryza sativa
gttaacggcgtctaatatttagggacggagggagtaaaaattagaggagaaagccagccgaaaatatcatcaggatcagcttaattccatagcacgataacctgataagcatggatcgaagttggaatcggataaccccgatgaacagagcttagcttcgcccttgctaaaacaaccattttatggggaggttacttacactgatcatatcaattagctgaattctcctgaaaggttaccatcccctaaaggttaaattttttggtggagaatgggggtagcactggttttaaaagttattgattgggtacttcttttgacaaatgaaaaggagtttggttttttaaattaagaaaaaaatttacatttccggtctttgaattatggcaaccggccttaaataacataaataggattgtggggaagggacacatgtggcatgtcgggaatccactaaggtgaaggttattagccccaaatcccaagccgctacagtctcatgatatcaaattgacaaatatgtaagttcattgactagattgggggtacttaccataccatgtccttatgacatatcactaaaacctgcaatttcacactaaattggaacttttctaatgagtaaagattactagggagactatgggtatcaggtgtgtatatgacccgtatatccgattactataggaggagaccataactatggtatttgtaattgtatatgtcttagttgctagagttttcctatcggttatgccctgcccatgacggcgttggaagtggagcaggggatgagagagtagagaagatagatgggagtagatcggatcaattgcttgtgttattcataaattaatagcccttaaataggcttacaatgaactgaattaccgctaatgaggaaacaactaattaacttaatcctatccatgcaagcgtgatcactg

SEQ ID NO: 96871 - DNA, 662 bp, Oryza sativa
agagagagaaaagtaggtagagactgcagcgtggagtgatgattccgacggagatgggcgccgcatgacaaaacatggcaggttccagttccacgtgttgtttcaccacgcctcaatttctttttgattcgatctacgcctgccattttcgacctcatctcgatcggtactcgatcacttttattctaccactgtcaggggatgtttggttgattcactttaccgtaccacattttaattacgaactagtttcacaattttactagatggttaaataaaatattgtatttatggattatttttacactgcattatagatgttcttatactataatccttctataaaaaaaaagataaaccatgggtttccgtgtccaacgtttgaccgtccgtcttatttgaaaaaattatgaaaaaaattaaaaagacaagtcatgcataaagtattaatcatgttttatcatctaacaataatgaaaatactaattataaaaaaatttcatataagacagacagtcaaacgttggacacagaaacttagggtttatttttttagacggagggaatactttattaatcactagtttttattatcccaactatgttgtgccacgctttgttagccacggaatccttatgtcatactcacatatttagagtta

SEQ ID NO: 96872 - DNA, 577 bp, Oryza sativa
tcagaaattaattaatttatatttttaagaaacacggtataaacacaaacgttctcgcgtgtgacactcacctatatgagcatttttagaagactgggcatattgacgtttcgttgcgacgggtacgtcgtccactactgaacgaataattaaccgtaaatgtgaacacccatatcaaatttaagatttgaacctaaacctgctccgctcatttcgtgaaattaattaatttcgttaagaaggaaaaaaaggaaaaaggaagaagaaaagtacatacttgatgcgtacgtagctgcgtagtacgcttggatggatcggtgcaatatatgcaatgcaatcgagcggctttgtagtttctctctctagctagctaatatagcagctagtctctctctaccgaatccatcgtccgtccatccgtcggaggaggtaggtgggccagggcagccatgtgcgctcatgtggtggtttgcaacgcttggccccaccaccactttctctctctctctctctagactttctctctctttctcctcctctccaacccaccactcactaacctgtagtacccccaaca

SEQ ID NO: 96873 - DNA, 592 bp, Oryza sativa
attttagtgtgatccaccataatagcaatgtagttcatatacattgagcatgccctaagacgtgtaagctagcatagtaaataagtaatccctcctattctaaatattaaatatttataaaaaattgattaaatttaaaattctgtccatcagtatatagtacaaaatctaataagtttatgaattatgataatatttgtgagataaatctacatgtatcatttcttttattttgagactaagtatttaagaaattatcgatcgatagtaagttggtcttggaggagacgaaataccgtttatttgagttgcttcgtatgtgagactagggttcaatttgttggtccaccacaaagtgtgtttccaccctcttgccaacttgtatataagatctgaggttgataacgctggagtcacataatagcagagttggtatgacaattcaatttgtagggaccagattaaactttaaagcatgcaattcgaaccacgtatacgcttggattcggacgtggcaggttcctgtctttccgatccggatacggattaatggtctctccatccaggcatccatttcggcaaatatcaagct

SEQ ID NO: 96874 - DNA, 672 bp, Oryza sativa
  unsure (1)..(672): unsure at all n locations
cgagctcggtaccctgttattgcactcgatatcttcgactaatttgctatacatatgacgtggatattttttgatctgactaccggtgctactagtattgctctaaacccgcttcacgcagcctttgaattaaaagagtgtacagaacttgggttatgccaataacatgtttttttaacacgcaggagatctgcgctattcatttttcccccaccttgagagggaaccccaattttaggggggtaaaaaaaaaaaagccaaaaaatgtatatggtgttagagaaagactcgacactcgcccactaaggatacaacagaacaccacacaaccaatggaaaaaaaataaactattgcattagcatcacagncatagtaaagataccacggagcctagcacctcttactagacaccgaagagcgtcctcgttagcgatggtggctcaatgtacattggccaagcatgaggtacgtcgataacatattttaaaaaactactgtaataagtattggactctatnnctatgaacatggttaatgatggaaaaatttcctatactatttttactagtaatatgcccgtgctaaatgctacggtgcaattcgatttgtctttaataattgttaaaatttcatgttagcggaaatttttttgtatgatatgtgcatttgaa

SEQ ID NO: 96875 - DNA, 519 bp, Oryza sativa
ttatcaaatggttgtactctggaaactagccacaaaaaatgactgttttttcatcattgcttgtttgataaattactgctgtcaatgagagaccgtagtctacataaagcttaggggcaactgagaagtgagaactaaccaccaaattttatttgtttctcggagcattcttttggccacaatcaacacttaacaatgatactcttacaatatttccaagaagggaaccctttattgctggttggtttacagcataaattataccatgaaaagcctgttcttgtacatttattccatactcgtattactttagaacacaatgccatttttacctgtgatggtaaagaggactgctgatgttctgtggtattactggattactggaccattgtcagcgttggagcgttgtttgagtatgctgtttctcttataatctcttttgaaagaaaactgttattttatatttattttagtggcttaactcacaagaacagaacccttacaacagtagcatggtaa

SEQ ID NO: 96876 - DNA, 560 bp, Oryza sativa
gggggagagagccagagaggtgttcgtccgttggttggctcggctcggctagctgctgttgggtgagttaatggcgtgtgtgggggtgtgagttggtgaaatggaggagctggcttttcgagtgggcggggcgggacgttttataggacgggacagacgaactgggaaaatgtttttgggtcgtccagttggctcgcaaagttttttaatactacggcgagatgtgactttattctcctattttatactcctttcgtccctaaaataaattaatttaatagtgatgtaacacatgatatattactataaagtgaaaactgtatttaatctttttttatcttgggatttttgaatcatcgtttggtatgtataggaaacaaacattggaaaattcatttggattagtagtttgcccatgcatgcatatgttgtctatctatggtagggaagcccatttgtaaggaaaataatttcaattgagttctacggtatgctccattcctccataagtgaaaaaaatgtaagctttcttggtcatttttatcatttcctttttttcg

SEQ ID NO: 96877 - DNA, 626 bp, Oryza sativa
tgccttcttttaaggctgttttaataatataatagatatgaccgcccatatactttatattttttagactaccatcttataggcagaatttacgtattcaacatatctaaaaagtacaattgtatgtatatataatactagcttctatttctattatcagtatacaattatactttgtatatatacaactattatcaatcaatctccactgtcacaatctgacccatcatgatctaaccatgtaaatctttctctctttttctctggttaatatgaaatttctacacctcagtaccatgttttcaagcttaataatagataatagacaaggaatggatcgataaaaaaaatattgcaggaatttttgacgcaattatccattttatgcatgtccatgttcttagttactactcaattcgtttcatattatgatttgctttgattttttgagtcaaattttaagaagtttgatcaaatttataaaaaaacattttcaataaaattattggaatatatttaatgttagatttagtgaaactaatttagtccaataaatattactataggtttctataaactgggccaacctaaaaaaatcaaagtttcttatcatgtggattggaggg

SEQ ID NO: 96878 - DNA, 534 bp, Oryza sativa
cccgacccctcggggagacagagggaggggtggccacgtcaccttcgggcccgacccccccgagggggtcaggccacgtgggtgaccgcggctacccaagcctctagtcacgatacccccggccccatgtcaccgacatatactgtctcgatttgatccgatctatcaagattgtggttaataatcataggttgttaatgattatactttaacttgttatagctgatgttgtttttttctttactttgcgaatgatgataagcttcaattaatattttagtgcattggcctacatctaggaatatatataattgttaagttgatatctttactactttcaatcttatattgtctcagtttgatttgatctatcaagattggttataataaagttagaagattttgcaaatatatattatgtagattttggtcgatgtcactttgatcctaaatatttatatccatcggttacagccaatcgatccaaaatttcatcggcatcggatgggcacccgatccaatatcggccctatg

SEQ ID NO: 96879 - DNA, 569 bp, Oryza sativa
tttcaattacagattagaatagttaacaagtttgaatgcagctcgtaataaaaaaagtgtcataaaagccaatcaaaaagcaggggcaaaagctaaatatgcatattttgtatagtatttatgtgtcaaacctaagtgaccttagaacaacagaaaagacacaaaagagattgcagaagtacaagatggataatacagatttgctgctcatgtatttgaatttgaccactacatagatcccgcagattaagtgtataggtgatatttgcaaattcgtgggagtgcagatgaattatacgtgataatgtcagatgcaaacaaaacaattatttccaatgaggattatcaccacatcatttacgactatgctttacgcttttcctgtcaaagtacaaatcacaatcgcactgtacatggcatttacgaatagggatttgtaaaccatagtccatatatgaagtatataccgtcaagacaaacaattatcatggaatatcagtagggcctatttcaagcatatgcaagagtgttgacaaaaccacattttgagtacccgtcagctcagtggc

SEQ ID NO: 96880 - DNA, 885 bp, Oryza sativa
ttatacatacatccagttgggttagcgtggaagcaaagcaaaacacacgacactgattacctaatttcttgttataaatacaacccgtatgtatacgcagaaaacaaaatttgatgcaaagagcaacggaaggaatatttgcaggtttcggaatatcaactattcctgattacctgtaaagaaaagtggaggcagaatgccctgattgcggattttacaccagtactgattcgattattagcacagtagtcaaataagcagctaaggtatgggttagattgctccctaggagcagtacagatccaagatctttcagttgttgttcagaggtggtagctcctctagattctagaaaggcaggggccagcgggagcagttgttcttcaggcctaccaccactcaacaatctccatgcatgattcagtatagtcctcggcttttcagactaataatcagagcgtggtcacagcaagaaagcaagcatgttgcttgtcttgttcctggacctacgtttacctacgccctgttcgatcgaacgaacgatcgatcgatgccatggtggtgaaaaatcatcatgtgccagccacagtgacagagacgcgatatgcagcaagctaggcgagccatccatggacggatggaccacgtaggcgtgcaatgcagtactccgatgcaggtccagtcccttcactagttagtcccatggccttttcttctcaagcatgttcatggctggggtcatgtatatagggtctgtttgggatagctactagctgctgtagcttctcataaaatctccagcttcccccaaacagtccatattgtcatccatattctaagaatatatagttgtggaatccagaaaatgaactagaactcagaagc

SEQ ID NO: 96881 - DNA, 533 bp, Oryza sativa
ccatttaaatcagttgcgcctagtgaagattccaatgatagcttctcatggaaaactaatgtaggatctttattaagaaccacgttatctttcataagttccacatcattcgaactactactcccagtagtttttaacattccatcatgaaactcatcaggtatatcttgcctggcagattcagaaaccaaatcttttcttccatcctcctaaagcaatgttaataaaaaagttcacattatgatagcgtaataatcttgtgagtccacaattttggactaatttcaaaatatgagtagaatatggcatgccaagaaccctgaaaggcatatatacctgttcaaggccagaagcagtaggtgtttgtgtatctcgtggtgggccagaaaatccagagtgattgtcaccacttgatccttcatcgtcctcatcaatatccctgacagtactaacaaaccaggaacttagcaatggcttatcaaggtcactttcgaaagacggttcaaaataattttggtgccagctatttgaga

SEQ ID NO: 96882 - DNA, 700 bp, Oryza sativa
catacggtattgatatgggtctgtagaaggtaaggaaaaccaaccgtgtaaaaaatatacaataacaatagggctcctgctgttagccatttaagctaggactttgtattaactactccgtatgaaagggacacatttattcattttgtttattttttcttggtggacactgtcatccatataaaatttttacatttaagagccaaggaattaaggaagaataaagatttatgaatgagaaacaatgaaaagagtgaagtacagaaggtaatcacgttaagaaaaatgatgtgagaaacgcctaggagtcttccggctagctccacaaggtggtgggctagacgacctggattcgaagtttcaccccttctaattatttgatattaggtccttccctaatattcacgtcttttttgttaagaaaaatgatgtaaccatctataaggagcaaatccagaccagaagtgctcaattatataccttgtggttatatacatggtcatgtaatttgtttttatggtatgagattttaacatcacccaatcatgtaggccaattggttctatggtattgagaagcagatcaagctaaagtttatcttggcatgttgaaatcctaagcatcatcatcatcatcatcatcatcatcatcatcatcatcaatacaagccatatcttggctgccaggtgtccatttccag

SEQ ID NO: 96883 - DNA, 708 bp, Oryza sativa
cccagatttgaagagtccacaggttgatcatacataccccatgtactcgctgttctgacgacctggcggagtttgccttcgcaacccctaacaatagatgtacaagtaaaatgcatacctgctaatctagcttgcaaaatggtgggtggtagcgacattggcaacgaaaatgcttcgtctgctgaagcttgtaaagaccaaatgtggagcttcatgtacaaaaattagagtacttgtgaacatttggtcatggaacaatccgttgtagtgcgttgccattgctgtacagatggcctccatttcttacatcttgatgtccttgttcttgtgtttctaagtacttcctccgtttcacaatgtaagtcattttagcatttttcacattcatattgatgttaccaatatgaatgtgaaaaatgctagaatgtcttacactagagtgcatagagcatgcttatctggttttcgatgcgtctctagaaattggacgaaaaggctaaccatcagtgaatgtgagaaattgcaacaccgagatgcaaaaatttaatttgtaaacacagacttacatgtaaatgctccttgatggtctagtgcttatctaagcgaaaaaatagtgcttaagcttaacaagcacttcgagcgccccattacactttgatcccatcaatacaacattttggccataagaatacagcatattgcctttgt

SEQ ID NO: 96884 - DNA, 518 bp, Oryza sativa
ttctgccgcaaaggatgccgtggcagcatcagctttcaacggcaagtttttcccatcccgcggcagacagtcaaaacagcggggggtcgacaagtcaatgtttttgacacgacgaacaccataaaactttaaaacgtgtttgagagttgacgaaagaaaaaaaaaacatacccagaaaataacacaactattagctatgattaattaaatattacaacaattcttttaaatttaaaatttaaaaatacaactttttaaaatttcttttgtaaaagaaaatatcgtttagtattttggtaagcgtgaggttgaaaaaagtaatttttttctctgtgttgttgctgaacgcaacctaagatagcattaaagaagtactcatgggacaaaactttaacgaagtaaaactgaataaaaggatgcaaagtgcaaaaactaaaaagagtatcagagactaggatctaatttttcaagctgttttcttgaatttagatatatatataaaaaataacttatcttta

SEQ ID NO: 96885 - DNA, 533 bp, Oryza sativa
tgcacgcctgcaggtcgactctagaggatcccctttggttttttggttgaaggataaaaattggattcgtcaaaaagtaagggacctcatatctatcctacatgggccgacaaaaactacgaccaatcttagcaacttttgggcctctcggcagtaggccattggctgtctctgttcacgtctttctagccttctggccgaacgcttggaaaccaactctttgatggtccatcatatggagacacaggccgcggcccacggctcatcccagcttgcaggaataagttcacttggtgcccctcaaaagtgattgaaatctaatctgtgaccctaaaccacaaaaccggatattttgaccccccaaactatggaaaccggtgcaatttgactccctcagcggttttggagggcggtttcgctaacgcggcgggattgaccgggtctcccttacacgtggagttgacgtggccttaaggtggcctttaaattaaaaaatatatgggggacccatttgtcaatgacacagaaaatag

SEQ ID NO: 96886 - DNA, 2215 bp, Oryza sativa
tcttttaattctgtgcaaaattttcaacactatcaacgtttaaagaggaaggtcaatagtgcagcctactactagcttcaaatcatctatagacaatgtaataaccaatttatacaatagttgcttattatactattaatacctgatcccaccctgctattgtacctgctttaaccatgcgtgatgtggcaaaatcggggctggaacatgtacattcaaccggggtcttttttgtacatcccgagaccaaaccgtcctgtcagcagggcgttccttcctcgtggtaatggtacgagttcattagcaataatcggctttcgtgattacacatcagtgtgttagaatttttttttttaaaaaaaacttgttactagagattaaaacgattgtatttagccaaaaaggagaaaaggctgtccaaacattaagaggggtacacttattttagtctttacacgatggtgggatctcctcgttgattcaactgtattatactctctccgtccatgataagacaattcatactacaataaaatctgtacagattcattgtactataaaatatcccatccacttttaaattgctatattataagacgaagtgaatagtttatattctctgacttttattcacctcatacatggttcgtagaaatgcacatcattcggttgccaaaaagaagaagaagaagttttgagaattgagatagctttagtacaaacccttgttaaaccaattagatttaaaaaatcgaactaaaatttaatttttgataaattttgtccgaatttcacgagttttccaaataaatttggacctttttcttcaataaaaactgagagatgttttcaatcccgcaatggcttcgtgacccctgtgaagaacagatccgtttggagcataggaattgtttaatggaccctctttggttagttacctgtacattccttcataaaacatcagtacagtagctgcttaattggatatgtatagatacagtcagataatcagtagcattattctagactcgtagtgcgattgtcgctggctatctgttggcttgtccagctaacaaccggtcagtaaatatacatgcatgatgcagtgtcctagctatctagccgtagccactaaataccctttggcaaaacttgaagggaattcctgagctttcttgactttgatatccagactacgaccaacaaaaaagctagacacactacaaacaatagctgtcgacggcgacgtagatgatgccgaactaatcccagcttacgctttcaggggatcagcattcagcaagtgtcatgctatgtactacacatcgagcgtttgctgcacgatttctttcgttatcagcgtacgtgcgtactcatgatacatcattggtgttctcacttctctccctggcatctcacatggtaggcctacgctgcgtccaaccggggcccgaacaaaggcggatcgaagtaaaactagcataaaaatggggacgagatctccctctcctttctgtgttgcaattaatctctcgcctcagataccgtgtacagtacgtactcgtgagaaatcgacaaaaggtacacgtcaagctcgctcgccgtctcgccggctcgccatggtccgtggccgccgcggaaaccccacgcaccaccgtgtataaccacaccgccgcctgctcggttgattggaattttttgctgcttctgctgcgggcgcgcgtgtgcacggtgcggctagctagctagctcgtcgtctctccccttattgccgccgcgcgtgttgggccgcgagatgccgtcgttaggtggcggtgcacggccacgcgaacagtagtctggccagttgcttcgcgctctacggggatgttagattgacattatttttaatcctgtactccatccatcgttaagagttagacacaattgttaagaaagtatgtagaaatgaatggtggaggttatgattagatgattagtgagataggtggaaaaagtgaatgatgaaaggttgtgattggttgagaagagaatgttgatggagaagttgttatattttcaaacaaattctgagagataaaagttgttatttttgagacggagggagcattatttttaagttgttaaaaaatacttacatttagttaatgctaaaatttaataaaatttattttcactaccatctatacacccactatatcagcacaactgcaca

SEQ ID NO: 96887 - DNA, 571 bp, Oryza sativa
tgacctaagtctctccataaaaaattcttaagcatatggtattgtctagctttttaaaagagaatgatatatttgtagtcttcatatatccaagacttaaatgaagatgttgttttttggttttgtaattctaggttaaattgataatcagaaccgaaacaaccattttaatattcatttttttacatgtatacgtataattgccttttttacgtagtacttacatatatctacctataatagatcttgttatgactatacaatggattttggctatatatttatatatttagtataataaaattaaatagacttatattcagatttattgtattaagatatattatactctattcgtccaaaaaaattaacctaggactgggacgtgacataattttagtatagttttttatttttttaatggaaggagtagtgttcataagaccatcagtgacgagcacccaccaccagtccgatctgatcatttgtgaaccgtctgatatgtggagaaacagtacaacctgaggtgggctttaaataacgcctccgcttcccaaaacgccaaaaagcg

SEQ ID NO: 96888 - DNA, 739 bp, Oryza sativa
attcctgcagcccaggccctttgcactgcgggaatatcaaaattaggacccgtgtatttagcctatgtggtatcttgtggtttcttgtttgagtgacttgcactgtaagtgccctaagcgcaggcgtggaggaaacccagcacacagctcgccggcgcatggacgcgctcgtggatagggccaggagggcgcgtagcgcgggcagagggaggcgcgtgactcccccaacgaccacgccaggccatagggttttttgaaaaaaacccaagcataggccttactcagcgccgatgtgctagcggagggagcctgagccctgctggattctgtttttttttcgataacaaagtttattgatcattataagcacagtcaatgaactacactagatatacattctccataactggagatgattccaaagctaccttatgtttgatagcacaaatgagatattctttgactggctattggaacaacattagttgaagtattctctctagccttttttgcaagaaagtctgttgttttgtttatttgtcttcaaacccacttggcaggaatacaaggctgggttgctacactctcacggctttgatgctcatgtccacagaagagtacaacatgtaatcaatggaacacctagctatgtcatttatatcctttgtttcaaactacaacattctatattcgtgttgcttgtcatatgaactaccttatttgtagtcatggacattat

SEQ ID NO: 96889 - DNA, 538 bp, Oryza sativa
agaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgcttttaaacatttgttgctatctaaattccatttaaggtcgtaccttatcgcccagcatcatcttattctctatttgtattccctccatctttcagatacggatgtagacttggatgtgcccgtgcccaatgaagaggaagagcgcaacatgaaac

SEQ ID NO: 96890 - DNA, 1276 bp, Oryza sativa
tcataaatcaattatgaaaagatgaacaaaagtgtaaattctaaatgatttaaatttgtcaaaatttgcctgaaatgcatgggaaaagagatccatttcagctagtggcaagaagattcttctcttctttgctctgtcatcagcaaacttcaaagaactcatctacaaggattaattagtcattaccaaccacatggattttagtacggaagaatttgtagattatttatgcagagagagtgtcaaacctgtttaattctcaaatttttttcctaaaaatatcacattaaatctttagatatatgtatggagcattaaatatagataaaaagaaaaactaattgtacagttaggggggaaatcgcgagactaatcttttaagcctaattagtctataattagctataagtgctacagtaactcatatatactaatgacggattaattaggctcaaaagattcgtctcgcggtttccatgcgagttatgaatttttttttattcgtgttcgaaaacctttttcgacatccagtcaaacgtccaaaattttttatttcaccagctaaacatgccgtaacaaatgtgaatgcctttaggggaaaaaagaaatgaaatttcagtgttttggactgggtatacatccaaaagtgcaggaagaaagctcctgtatttcagcataggcaagccactgcttcttgccttcttccatctcggaaatttcgtccctgcgcctgcgcgagaaagcttggtactttttccagggaggaggaggagctgcaggagaggatcccaagagaaacattggaagagaaaaaagaagcgcttcttttgcggttctggcagaagaagcagggaaggggatggtgaagaggcggctgttcttgctgctgttcttgtgcttgttggctgggtcaagaatcgcttccgctgacaccaatccgcaagatggtaaagcttgtttttcctggttcttgcagttcttgcatgcagattagtttgatgagggtttttgcttgtattcgatgtcccattccgacgattcaccgtgaaaaataaaggttcaattccggaggtcaagttgtttttagggggaatttttagcgtcttataagcatatttggattgggaattcagttttagtagcttttggtgttcagaaatcttgggttgtattccctcaaaagaaaaaaaaaatcttgggttgtgatctactgttcaatttgtctggattctttggattgggtttggtggagatggccccaagaaaagatggtaga

SEQ ID NO: 96891 - DNA, 598 bp, Oryza sativa
taaatgaatttactatagttaaatgacttaccattgactttggctctctttaatatgccactaactttactatttttttctacaatatatcattaggatggagtacttttaaaaatacctaaaatacaattcgagttacacaaggggttaacaaattgattgaccccactacaagtttcgaaaaaatataattttttcatgtagcctccttccaaaatatagaagtgtatgtatatttcaagattttgaatttacatgtattaactgttttgagaatataaatatattttatatgctaatagaatactctttttattgatgttcttttatgtaaattatctttcatatgatataaaatattttttatccggataccttttgtgtatgtgattccgctttcataggctatataaaagtagttttccaaacaaaaaaaaggaaatcacaaaatatacacaaaaacttctatattatataaaagacaacacaaaaacttttatattttttcgaaacttctagtggatcaatcagttataacctcttaggacttgaagggtattttagacttttttgaaaaatatccattcaatcacacagt

SEQ ID NO: 96892 - DNA, 697 bp, Oryza sativa
tgaataatgtacctgtattaaatgcactggtctcttatttagtaatgtatctagatacatatgctgaatttttatatatagaagcatatgttgcttttacacatgaaggtgtatatgctatcaggtttctataatatggttcataagtgaacagcatcaaatgtctacgttactttagtttgaatgtacacgctgatataaaatttagagagcattcttggaatgtacatactggtaagaaaatttagatgaattaaatccttatgccttatatgttttttctcacacagttgtaagtttgtttggagaaggggacattcacaaactgcttgaaagaggtgttttggtatctcaatatatgggggaatatttactactgcttttagtaactcctagataatctttttttacatacatgcataactaaatttgcatatatcttcatgtgcaattgcgctctctgatattacaatggtaggatttgtctttgaattggtatagtgacgtatttctgattcattaagggcaaactggggagtagaactgttatgtgcgagatattcagtttatatttctaaccttgggtgcactttgaataaggcgaataggctcagttgaatctgttgagttacataaagaagaggtggatgtattgaactcactaatgtttttaggatgatgcttactggattgccaa

SEQ ID NO: 96893 - DNA, 1287 bp, Oryza sativa
gtctgctccagaactacaaaaagagaggatatgggggaggttgacaatagtatccttgtggttttttctgttttcgtgatgtataactgataattgtttattgagtaaattgcgcttgtggtacaaaaatttgtatggtgggtgcaaataggtataataacttgcaaattgctcatctcggtgtagtaacttgactagtccgtgcgaattgggccaaaattgtcaatgcaaaccaaattgttgtaaaacatcacaaacagatgtggcatgatagcttacatgtatgaccatgttttggatatcttatttaaaatccaaagaaaaagagaaattagatgtgtaaaattacatttttgatgcatagaaaagaatttatttcatgtcttggaaaaaaattgtcctgtatataagtcgtataatgtcgggccaggaaaatttcgtccatgagccttctggaaaattcattttatttctcattctcagacactatttcaccgaaaacttattttaaaagtttatttccatggttggacattgataattgtttcacttttgtcaatctaaacattgaaaatatcaagtgaataatagttacacattttatcaatccaaaaattgatgcgtaataaaaattactcattaatatgtaccatattagatcaattttgcttgcagagattgttttggcctaggttcgcacggacttggcaagttgttgtatcgaaatgagcaatttgcaagttgttgttcttatttacacccaccacgcaagtaccataagtgcaatttactcttatttatttttctttagaatggttgcatcataattacaagattaaaaattaatagacaaaataatttacataattagtgaaagcacatagtgttttcttggtttagatctgaaatttgtatagtctaccattttgttctcacttcaaagtgtataaacacatgataatttttcacaactaaatagttcatataaaaaaggaatcacccacaacatacatgcaaaatcacgctgttgttcctttggtccagatttgaatttggaaaaaaaaatgaaaaaaagggtcgatgaggggattagctcctcgcagtcgcagccctagctgccagccgtgcgccgccgtcggcctgctagccgcgtgcgccgagccgccgcctgttcgcccgccgccgccgcctggctcgatggatgttgataggtgggagggttacgggagggaggtgaggaggtggcagtttcgcgtaaatacatcaaataattaaaggacagtgggt

SEQ ID NO: 96894 - DNA, 536 bp, Oryza sativa
attttgaacatcttgaaccattttgcatattccatgtatctccaggcattgaagggctattggcagtatatacaagtgacagctgaccaataatttgaacgataaaataaaaatcctttctaattggcatgctagtcttgagaacaaagtttcaattattattcacttgcttagttgctccacttgtgcaccttgaggccctgtttttgcacgaggtactttttcctgattcacagtaaaaaaaaatgttaattccataatggagtttcttcagtgtttgtagacgctgcgaccaaatgacatttttgtttatttgatagacctgttaatataagctcatgtaggatagtttatcatctgatattgatacatcacagatatacctggtaattgcttggtgcaatgtatactctgtagtaactagctgatgaaatttcaatttttgatactatgatgctgtgctacttgtagttaactagttatttcctttttatatatacatttcaacataattgtagacatttatctctttgata

SEQ ID NO: 96895 - DNA, 504 bp, Oryza sativa
cgcgccggtgagtcgcgctttcttgatccccgccgtcgtcgtcgtcgtgggagtccagacactgcggctccctcttgcgcttcttgccgtggccgctgaacctgacgcggtacagccggagctgcgacgaggcgaggtcagccggcgacgtcacggcgtactcgtgcataacccagcccgagctgccccgttcaccctcggcgaagaagctcagcacatacttgcgccacgtgatctccaggccttcgtcgccgctgccgtcgacgccgcctccaccgtcgcctgggacgaccagccgctcgccatccacggccatccgctgcccctgccagaaccctccgccctccacggttcgcttctgtcgctttcccttgccattcttggcgcgtgcccccgcgaagaagaaggcctcgtcgcctcgggtgtgatccgcaagaggcgtccatggcggcacgctcaggggatcggcatccacgatgacgccgtcgagcgggaggggcttct

SEQ ID NO: 96896 - DNA, 592 bp, Oryza sativa
cttcacattttagtgggattattttaatatattttaatggatttacatataaagatgcagaatcataagggcgtttgtggaaaagttgtggggtcagcagaccatacagccttatgggtggctccacaccactgcttccgtgatatatatgtaatgccaggttagctgaattaatttgctctagtcatcaagaaataaagtagtacaactggtagcatgcaaatacgacattttcttcatttatgttgttgacgtgtttttcggccaacatgggatacacctagtgacttgcgggtatagtcaagagagtctctaaaacctgctttgatctccttggtttaggttgccttcatcatacctccaatgggtattgggacatcattgaaccctactttgatgatgatcacctccattgtcttggtctccacctttgagcgtttttcgcccttcttctctccttccaactcgtcaaccgattcttttgtttgaaactggcttttggttgtagcggagaagcaatcatgaactgaattcgttggtttccactccatgatgaaattgtattggcagggatggtagataaggggatcct

SEQ ID NO: 96897 - DNA, 579 bp, Oryza sativa
tgcctgcaggtcgactctagaggatcccctattgttacatgtacttgtttgtacttgcatttaatatattgcagttcgcattatttggtcgtcagctaatttgcagtgaaagagatcgatggcaataatgcgtgaatcaacatttcaatattagctttgataggatgatcgggacgcgtgcttctacgtgctatccgtgacaaaaacacacattgttttggaaagtcaaattttaaagctctgaattactaataccttataatatattgacgcgcaattcttttgcgtattcgtgaaaaaaataccaatacttttttaaggatatttagattggattcatgtatgcatgaagcttgtatatcaatttgtatacatcttatcatatattgattagttctttcatagatatatcactataatttgttgagactatcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccg

SEQ ID NO: 96898 - DNA, 695 bp, Oryza sativa
tcaattttcattctaggtggcaacttatttaatgttatggacaccatcctaatcattgggttaggaatggccttagagcaagtataatagtgagctataagcctactataaacttagggaggagagaggtagtgaaaaatcaagggtgttggctcttatgcaagagctagcttatcacaagatccaagacaaatacattaaatgcataattaagagatagagagaggagaagaaaatattgtagccaaccttatagctaatctattatatatattggctttaagatgggctaataataggaagtgagctctaccattatccttactcttagagcaagtgcaacaagaataaatgaatcagcttctacttaagggcatgttcactttatgccattttcaactttaccaaattttagcattaccaaaattttggtaacttcttatatagttactaaaatttgacagcaaactaaatgtagtcacttttttttaacaattttaccaaatttgataagtttgaaaatgacaacaaagtgaacagcccctaagtatgccaaaggaatgtagctcaactgtttcgacaacggggtttaagcgttagacttcgcatttatgctcaggtttacagctattttttaagtgatgatggacataccagccaacgtttctagagtgggtacttgtgcgtttgaatag

SEQ ID NO: 96899 - DNA, 507 bp, Oryza sativa
caaacaggatgctctgttataatttgaaaaggcagcagcatgtgtttcaagttacttaaatcagcaatgtatgtgttttccatgtaatgttggttgaaaaggctgatgcagttgaaccactttcatccattttcagatttacttcccaatagaaactgtaactgcagaccataagaacatatggccgggttaaaggtaatagtgataaatttaattctcttgcatattactgcatcacagcattgattgatgttcacaattgaaactatataggatttgatcagtataggagtatacaagcactttcatccattttcagatttacttcacaatggaaactgtaactaaagaggatgagcatatgaggcttcaggaaatggttatcaatttagttatcttgcatgttagtgcatcacagggcaccgcattgattgatactcagcatccgaaatcttataaatgagaagagaaaaggagtagcagacacttgccttacccatgaacgca

SEQ ID NO: 96900 - DNA, 697 bp, Oryza sativa
cttctttctcctcctctgggtcgtagtcgacggtgaagaagtcgtcgtcggcggcggcggcgcatggggagtgggagagactaggagagggttgtggtcggaagaagaaggagcaggtgtggtggagtggggtcatcgccatcggcgggggaggggtgcaggtgcgagtgcggcggaggaccaagggcaaggctcctgcgacgcccccaatgccaaacccaatcatcatcatcttctccaccccccaagcttcttcttcctcctcttggtgccatcggccatcccatcctctcccgcgtgttgtagggcccatgggctgaatcatttagtaaggcccaagggatgcgccgtggtgcgcggaagtaacagcccatcgctgctcatggaaatgccagtttctccaaaagacgctatgtttataacaagtaaaaaaacaccagtaacaaaaaaaaaagcatgtactagtatctatctatctatctatctatctatctattatattattaaaatagctttgaataaagacaccacgttcgctgtcgaggctagttaatcgaagaaaagagaaaaaagctacaccgttagattacaatgaatataaattaaagggtgtaggtttatcagaaaaaaaaattttatcagtacgaaacaaagtctatccaatacataataggaaagttactctattatattatta

SEQ ID NO: 96901 - DNA, 528 bp, Oryza sativa
tacatgcggtattgttcttaattaccagctgaccactgcgacgcaattttggaattttaagaatgtaagatcatgagaggtctctgtaaaacgaatatgaaaaagtcggtgacaaaaccacatgactttgcatatgtattcaactcacgatcagatcgatggatcggttgcaaaagacaatatagtcacggtgcatcgcaggcatgaaaccttttaattgctacctagctactagtactattcgtagcagcgaacgattatttgacttaatttgcatccatgcagataatacagattccaatcgagtcgtacagggcagtgatctatccagtatccatgcgtgtgtacctgcagtacatatagtttttttttgccgtaaattttaagcatcttaatttacactgtgctcactatcatataggtatagctcaattaatcaagtacgggccacggctgtctttgcattcatcggtcaattaatcaagcactgtggatcgatcgatactttgatagatcaaggcgtggatg

SEQ ID NO: 96902 - DNA, 679 bp, Oryza sativa
  unsure (1)..(679): unsure at all n locations
atttcgagacacacaaaagaaaaagaaattcgacgctagccagatgctatatatcctgataccctgcaacctggagccccacgcatgcagatggtaaagatgcaaatctttattccatttccatgattccatccacacaaaaaagaaacgaacaatacagagaagaacaccaagaaacacgcatcggcgcagaggagggtggaaaacgaacccaatctcaatggtgattgggttcttgtttcttgacttctccaccttttcctgccagcgcctaactttattcgaagatacctttccctctcacgaactcgacgccttcattggaggcacacgcacattactgcgacaagaacgtatgatagaaaataataaatgccggacaggaacacggaggaggaatcaatcaatcactcactcactcacttttgatttgggcttgagagagagagagagagatctccagagtcaagccgcacgttggctcctgctctcttcggaaccacgtgaatgaatcccctnctnttncttctntntntnctncacctnactcactcttaaccacaaggaacgaacaaaccgaaaaagagccaaccaaccaaccacgtacgtgcttgtctgctgcaacgccgcttggtcgggcgaacacngncgggtagtcttcgcgagcgcccggcaccca

SEQ ID NO: 96903 - DNA, 531 bp, Oryza sativa
  unsure (1)..(531): unsure at all n locations
cattgagtgacaatcgactctcaaagggngcatncgagctcggtacccaatttcctcatgaaaggcttcttatgctgaaaaacattcgactgactagggcaacattttggttcatccagtaaccagtatggaatcaatcatttttcaaaactgcattggaaggacctcggtcattcatatacatattgcatatgaagtaacatttttgcaacaatagaagaagttctgccttttctggttataatcttattactactgaaacatgaatggtcctgggaatctggctcactttataagcaaaaaaatcactttgatagcttaatttggttcaagtttatatcatctgatatcgtccacatcaaggagatttattagcaccagctgaaggataaaatacattaatagtgaaggaggaaaccaatgctcttaccttcttagaaataacattactcattaacttctccgaaaggtgtacctgtaattacaaagatagggaataagtttgtgtatgtctggaaatatatgatacag

SEQ ID NO: 96904 - DNA, 687 bp, Oryza sativa
ggtgatcatcccattctacttctactctacatttggtttctttctgtacaccatttgtctgatgatgcatatcttgcctgcctgtggtttgtgtatcaaatgttcaattgacatgaagttcctgcggtgcccttttttcatgtgtaaagtagcagcataacaaaccttttgtttcgcaaacaattgtggtacaaaaccgtcttattgtttgcaaccatcatactggtagggataagtggtatcccactgctcgagccaactgttgttaagcgaacaatggtatgcgtgatagataatggctctattggtctatggctatggcatttcaactaaaattatttttgctaatcatggcaaatgatttcaatttttcattttctggtgtcttttcatatatattacaaaaaacaataccggttagattatttactctgtagcctcatgtcccagtatcagggtgtttaccagtttacttgccagcaccttgccatttattttcttctataataaatggaaattgttattgtaatgcttgttgacatgtagagagtgtgtattactattattgaccatgcttattgccccggtattgttgttgatgaatatgttgacgttaaaacctcatctttatttgtcaatgctaccaccttgggaacaggacatgctatatatagtactttataaaca

SEQ ID NO: 96905 - DNA, 529 bp, Oryza sativa
tttaaagaaaaggtaaatttttagtttgatcaaactatcaaaaaaacaataaatttagtatggaacatatcataaaactatagatctaagatgaaatattacaaaactatatatttaaaaataaaattatcacaaactacaggtttagcactaatttttaatcaaaaaactatattgtgtatagttccaatataacagtagtgtgggatttctttaaaatgtagttttgtgatacttgaccttaaatttgtactagtttcattcatagtaatttttgtgctatgtatgtagttttgtgatataacactttacatttatagtttcgtgatagtttgtttgaaatatattaagtcttatgaaatttactaagtttcttttttaccgaaaagatcaccatcagtagtatgtagtctcattctgttacaacctactccgtacaaaacaagaacagagatgcatcgtgtatactccctttttctctaaataagtataattttaactagtcaaatgtatatatacatgtacgtag

SEQ ID NO: 96906 - DNA, 564 bp, Oryza sativa
ctggcaaacagacacctctagctaattagtactacacctctagttaattagctctatcttaaatcaaacatttatatctttattattaatttatacaaatttatatagtttgacattgtaagattatgttaaactacactgagttttgaaaattaatagtcaagattgaaatatttgacttaaaataaagctaaaacaaagcaatttaaaatggaaggagtcctacactccaatgcacggtttttactcccaagctggcccaggctaagtaaataaatttgatgaaccgacacggtttcgcgatgcagcttaactgcgtctcaactaaaagttctcttctatactttccaggctgtgtgaaattgaaaagacatgcaagcatggctaatccaattaattgttcataaaagaacaaataagcatactggtggtgcgcacacatcgtcttcaattcttcgtctacaattctttcaacagaatctaatttaatacacgcgagatctatccgaatctacagattaattaaaaacctaatgcaaagaataataaacaaactgtatttgg

SEQ ID NO: 96907 - DNA, 541 bp, Oryza sativa
atagtcaattcatacaatagttatctataagcatatactacataactaatatctggtcttacctgtcatacatacatgcaccttagagtccgtgctgcagctggctataaatatagttataaatgcgtagctcgctgtctttctctctcctcttttatcttctcgaaatgtgtttatagctggcttatagcctgctattgtacctactcttagagcaagtttaatagtatagtccactactagctccaattcatctatagccgatttaatagcgaattcatacaatagttgcttactatactattgatatatgatcccacctatcatacacacattgtgtcttggagtccggctgcagctggctacagatttgtagcctgctgctcttctctctcatcttttatttcattgaaatatatttatagttggctaatacctgctcttaggagccttgctccctcccgcagttttcctgccttgcccttcttgtttgcaaaatggcccaatcataaataaaactagctgattccccgtgctttgt

SEQ ID NO: 96908 - DNA, 550 bp, Oryza sativa
tagtccatgattagccataagtgctacagtaacctacatgtgctaaagacggattaattaggcttaaaagattcgtctcgcggtttccatgcgagttatgaaattagtttttttcattcgtatccgaaaaacccttccgacatccggtcaaacgtccgatgtgacaatcaaaaattttcttttcgcgaactaaacatgcccttatctctctcatgttggagagtacaaagagaggagtatcatatgatgtcagtcaatgttacaccaaccaaccaattgaggctgcttcactcatcaatactagtataatggagacattggccctatgtggtattggagatgtaggatttgtgagatccagttagtagatgcaaggtcagttgagacatcactcgcgcaacatagccggcacaatttaatacatacggtcccaatgtctggtcgtctgcattgcaaaacacacagctctgcctctggtggagccgtggaggagagctctcaacttcgatttgcttgcttctgacatgttgcatacagttatacgttgtgt

SEQ ID NO: 96909 - DNA, 904 bp, Oryza sativa
aggaaagcaaagggtcaatggttgggtgtacacgaaatattttgatatctcaaaagcttggcatgctggactcagcagttgggtgttttgcagttcaatcgtgcatgcaaaatgccaacgttcaatcctagcatcaagtcaagcaagcatggctcactatatactacacacatgcaagtgcaggacacgcccatactccatgaggtgatggacaaattatgcatttatctatgcctctactagtcctagaatgcgtagcacgtaacaaatgcataaacaggtgtgagtgagtgtctgtattgcattgcacttgagaaaagaagctaggcaaatatgaggtgcatttgtgggtttaatcaaatgacctgtctggggtctgcaaaccagaataatggctgttgtgctttcttgtgctgctaatgtgtatgtgacacccagaaaaagagaaggcatcgctacgcaaaatgtctttagtttcagtcataattatttgggtcaagtccgatttaccccctcaactatcacagaagtacgacttaccccccttaactacgaaaccagatattggacacccctaaactattcaatccggatacttaacccccctggggctcttttttaggtggtttcgatctaaagctatcacacatgacagtccaatatgagggaggaggtgcatcatcagcaacatgcttctccctctccatgggacccagcaatcagtggcatgcacttcttcctctatcctttctgttccaatctctacccaagcctgtgtaagcactagctcacctgcagccctcaagatccacaagacggttgttgtcatacgtacatgtaatcaagctagatagttctgaaaaatcactctttgaaaaaaaaaaactccaagaaatcaaagctg

SEQ ID NO: 96910 - DNA, 580 bp, Oryza sativa
cctgcagccctataatgttttttttttgaaagagacgtgctatctcttctagcaattttccctagtaccgtatacgggagcagtagggacatggctatgtgcatccggcttgatgtaaaagccaagtttatattccatttaatttcttaattaaatgaaacatcagtatcaggagttcaggaccagagaatcggaccagcaagaaatatatataatatatccatgcatgcatgcaaaacctttctcatcactataaataggtacgcaaatctcgatcgagctcgccacatcgatcacaggctaacagctgcaagaaagcaagcttaatcaatcaattaagccaagtggtacattaattaattacctcaagcaagagtaacaatgcaagctacttggtccaaggcgtctctgatcgtcgccgccatcttcctcgtcgccggcctcctcctcagctcggcgaccgtcgtccatggcggcggcggcggcaggaggttcgtcaggagctacgacgagccgtgcaaggagatgaggctctacttccacgacatcctctacgacttcagcaacagcacgggcaact

SEQ ID NO: 96911 - DNA, 528 bp, Oryza sativa
tttatctactcccaatataattattctctatttttataaaatctgacgcaatgattacttaaaagaacttatttaagctaaatgggaggtgataaaaataaacttaatatgaaacggaggtagcagccaactactggcacataggagtacatattgtcaagtgtctcgtccgttttctcccaggcaaggtcattctttcttttctacaactgtggtgcgtacagtgcagcagcagttgtatgcacttgtgttgatctgctgctaacgagttgttctcgtttggaggtggagaagaagtgagttgtaaatgaaccgacagaacgatggccacaaataaaagcttccatagttgtaaatgaactgccggccggcctgcaaaatgccgggtctcccgcgccgcgcgcgacgatcgagtggataagacgatacgcgcgcggccaatgcatgcaatggatggaaatcggcaatcgagtcgagcgattgaccgaatagtgtgggcgggcgagggaggaagaaatttactgtact

SEQ ID NO: 96912 - DNA, 719 bp, Oryza sativa
ggggttcatatttataccccaagtacatattagtccgttgtggacacgactcaaacctttctaaagttaagataaaaataagaccatatacggcggtctcttaccaaatctaataaaaaccgactcaatatcctaattaatagatataattgccttaattgagctccatctctaattggcaatgacggttatcccaatctaagcccatgctgagcctaagtcatgccatatcagctgtatcggccatcaatcttctcaacttgttcagtcttcaacctctgtttccagccgatgcggtatccagccgatccgtagtctgattctgaatccaactcgattcaacaccaaatccgcttcgattttcttccttctccgaatctgatgcaaattttcgttgttaacaaatataccactatttttatcaattgtctatacaatatgccattgggccatatactttgtaaagaattcccaaaatgcctaaggaaatataaggctgacaattgatttatcttgtcagaagattaagagaggggatcctctatgaaaaattttgtctatcctcctagcacatcatagtagattgtgtaagtttctatatttctgcattattaactaacttttgaaaataaaacttacatattatatggtacataaattgtgttattgtttttatttatgtaagtaatctttcatatgatacaccaaatatttttgtg

SEQ ID NO: 96913 - DNA, 612 bp, Oryza sativa
attttacatttatatagtactggatcctcatgatcctctttgctttggtggtatgctgcggaatgggatggttagtttggcaccctaacataatcatgtccgagagaacacaagacattttaaagaagtccaccaaatcagctgggattactggaatagtactattcggattggtgaattttctcccattttttgatctggtatggttgcttgtctgaaacacatacgcattctactgttgtgtccattaattgttagtttagtctaaaaccttttggttagttagagaacaaatcatgttcagtatcagtttcacactgaaattaactttggaaatgtatcattgcttaataagaggaacatgtatttattttggtaacatagtttttttcagtagtaaatagtaggtatatacctatgcaggcacaaaataagttcaggacaaccaagctaggtttcataggatatttgtgtccttgaggctaagtagcgatccaattttgaattgctgcacccaccccttgtagtatcatatttcatcatgtgcatcattatccacttcactgttcgttcctaccaagggaaatcactcagtaatgtaattagtgtggc

SEQ ID NO: 96914 - DNA, 679 bp, Oryza sativa
tgttatgttgtttagagaacatcgacattagcttgcaggcaagttgttttatagaagtggaagatgcagactgattcgagatatatgtcattgtttggctgcgaagtctgcccatcctttcatcaagttgcagcgaccgtctggtgacgtggaaaatcatgttggttgaaatacctcctgctacttgaactttaatgttgatgggatagctatacttcagtgttggaggtgtctggtacccctgcatttaatagttgattagtaatatatatatttcattatcacatccacccaaaatcccttatatttatctagttgtattgacaatgataaaaaaaaataataattactaccgcatagtaatcaaatatggaaggtaaaatgaaacagattagtaaagaaaagaaaagttatcaaagctcttactgataattagcaaaacaagagttatatgctagccaaatatttcagttgactgcagacactaacctgaaagcataggtcatttaggtataattaactaaagagattgcagctaggatcagggcatctgcagtcacacagcttgggcatcattatctacatcaagcaaatctccaagcaaattcaggtaaggccgtgtttagttcacccccaactaccccaaactttcaactttccatcacatcacatcacatca

SEQ ID NO: 96915 - DNA, 518 bp, Oryza sativa
gcatagctaatggggaacagctacatctaatgccaacgccaccacagatacctagcaaatttcatccttaggcatctttaatttgttttcttagactcaacaatggaaataaccaacctgaacaaactaaaacccatttggtttttagtataatcaagcaataagaccacaccttaaccaaaaattgggataatgaaatccaggtgtcattaatttccatggcctaacaaaaaacaagtgtagaagcttttcattgatgacaaattgacaactgaatggagcagcgcagccataataattctatcatggattattaatcagagtattgatcaggtttcacaaacattgttacgtcttggaaaaggacacagcccctgcttaattccaaactcatgtcagggtattaatgatgttttcactaaatgtacaacagacacatcatttagactccaatctcttcctttagacacatcatttaaacagctgcaatacgacttgcagattatctccttttctat

SEQ ID NO: 96916 - DNA, 758 bp, Oryza sativa
ctaaggcgaggcggaggaggacgaggtcagcctcggtggcgatgatggtgggctcggctggggatccaaaagattatagcactgcatatgattttcgcttacatatgtatagttagcatatatatgaatgatattattatattggtaaaaactctaattaagatatgtatgtacatactgcatgatttaaaattaataaaaattgtaatcatcatatatacttagcgtaggaattatattaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatcca

SEQ ID NO: 96917 - DNA, 1404 bp, Oryza sativa
catttacatcatttacacgtgatccaaacacccttagaaatttctaaaaatcttcgtatatattatgaaatcaaatatacaactttccaaatattcaaaactaaattaatccacatatgtgcaaacaacccaaacaaaccgaacaaatccatctataaatggcggcactcttcatacatatactctctcatagcattagttaattgtgtttaataagatgaatagtctaaaaaatcaatggtgttatatattaaaaaacagagaaaatactatatatacaaaaaaaacaaatagtatttaaagtttagaaactccattattccactacaataaattctcataaattcaggactgtacgatttcaagtatttctactttacaatttatatgttagaagggtaattagaagaaaatcataaccactatgaaaacaatcccaaataaattattgacagaaacaggtttagagtagaatcaaagaatatttcaagaaaaaaaatcacccgcatgcaaacattcataataatggttcaatcaaaattatattaaaagtcagacaatgtttcaccctaaatatgttttgtaaaaaacatttttttaactattaattgcaactaggaagatagcccgtgcattcgtgcggacatgtatattattgattgtgtttgaaaaatttatataggcggaatatcaacccattgtaagatgccatatttcaaaagtattatttctctatgaattttcttcattggtattgcttagataatttttccaaactatttgttagcatttaaaatatataacatttgataaacgtgtctaacaaactaagtgtaaatgcacttaaaactaaggtgttttatcttgtttaattaaattcataggggctttttttaaaaccctaaagaactattattgttaataatgtgtattatttgtaagctagtcctacttagttggttcagattgacacaagttgttacatacatgcatataaattaacaaagagatgtcgtatacctccttccttgtgatatttgcggtatatactttctctttttcaaagaaaataccttgttaacatgaatccaaaaaattaaatttaatagtaagaaatataacttttcaacaaactatatacaacaaccttagcgtggcttatatatgcaatagtatatcgagaaactaagcatttacaaattgttataaaaatgggacatgcaatggttggtccaattttagtaaaaattaagcacaaatgcttttacgaacttattaaattttctccaaatagttcaatttagtccttattgacattttttgtttcctattttattttataccagttcaaaatttaggcgttatggatcttcatatcgttggtttaattgtgaatacaacaat

SEQ ID NO: 96918 - DNA, 600 bp, Oryza sativa
tctccctactccgacctctttctccttcctgctgatttcttctctccaactatgttctttgatttcccgttctctacttctcttcctaatctacttgcttgttccccttaattgtattcaatacttgagcagtactctctggatcggttattggtgcttctccttctggtgttgattttttgaggatgaattgagaacataacactaggcagctgacgtgttagatccacgtgggtttcatgctgactcaatcgattcaacctcatcacattagttgaaaccgggcatagtagtgcactagtgcttagatcttcgtgcatcttttggtattgtaagttgatggacgcgttatatctggtaatacgttttaagaaactcaacgttcaaatggcggacctaaagtgaacttattcctgtgtaatactctgtagcaagaattgggcccgatttgattgtgcaagtagaagggaaggcccaaagatagttggctttgtgatatatgaagtgacgacgctaagattgggatggttgttgttgtgatgtgcatgggatggaatctgctagcgtggctgtggatgcgtgcgatatgatgcagcaggg

SEQ ID NO: 96919 - DNA, 520 bp, Oryza sativa
tcatctattcttaggcgagcttctcgaagatgtcgttgatcagtagataatgtgcttattttgtatgtttagacgctcttctttgcagatgaacttggaaactataaggactaaggtgagctcggggcccaggacaaggccgggcctaaggcagacctgagtctacttcttaagatgtagatcttgtatgtctctacgctcctcttattgagtagcataggacttacaaagactaaggtgagttcgggacccaggacaagaccaggtctgaggcaaaccttaggttacattcctcttcatagagcagtgtgtaacctagacgtgctaaggtgaacctgggacccgagacaggactgggtttgaggcaaaccttaggctacattcttatccccgaagacaaacaaaggactcaccaaggtggggcccctagccctatcaccctaggagtagctttttatttttaagaatgatttaagcatgtcatttattttacttctaactattttgctagagaaatggg

SEQ ID NO: 96920 - DNA, 725 bp, Oryza sativa
ccaactgacctagcacattcaatatatacttatgccctttaccaacatcgtatcgccataaaaacgaatctccacattatcctcggtccattcaagagcttctttcactcgtgaccttagttcatctagagttgggcgggcgggaaacaaaatggtcttgaatgacatatctcaaactcaacatgtgcaccaacgtaaggttccaccactctaccactgtactaaacacgaacaagtctatccatctacaccaaaaaaaattgtgactttataactaaaatcacatcttccttcctaaacgtagtccaaactgacatattataaccaatgcataacttaaattgtcccaaagctactacttcacgaaaagtatttaatccacatccaaaagtaccaacaagttaactagtgcattaaacatcaaaatattacaaatactccgtcatacaacccaaccaacttctaattaacaataataaatttctataatgctaccgaattcggctcccattcatataattcatacctacaaatttaacctaaagcctctggtccatcaaattaataattcaacgttgcctcaagtttattttttcatccatctgtccaaccaaaccatctaaaaattcacattaccacatatataattcaaaaaatcatggcactaccgaatacattgcacacatgtatcactataataagcaaatcccaagaaaaaatattga

SEQ ID NO: 96921 - DNA, 694 bp, Oryza sativa
acgcgagtatttgtaagcggcttgtgacgagacgtggaaggttgtgggggtggcaatggttttggtttggtttggtccagtgggcgagaggtgcagccgtggaaggaagtctatcctgattggtggtcacggcgtgcacaggtcgcactcgctctggaatggaatgggcaaccttaaactgaataaatgtttctgcatccagagtttcacagaaaatgaaggtcaacatgccagcacagaaccaagtgagcgtaatagattctctgtgagcgcctgtatttatactatgtttctaaagaaaaaacatatcagcataatattttcatgtggatcaagaaagtggatgtaaaatgttatggttgctttagaagaaaattaataaattaaataaaaaatagttatgattagtttattaagaagaaaaaaaataattgaataaattaaataaaaaaagttatgcttggtcgaaaggtgtaaaaatagttttattcttttttagtattgagggagtaagcaattctcgttggtcggcccatcatcaactcgtagagtagcactccactatgacaatctcgatcggcgattaatcaaacaataagccttaaaacggaaacaaatattcttctactactagtaggctaactacctcatccggataaacatagcattcgtcagagcccaataggggctgcag

SEQ ID NO: 96922 - DNA, 632 bp, Oryza sativa
ccctaaagcggtgatcaagaagccacaccttaacctttttaccatatattattatgtctatgatccaaatgtgggatcaagttcaaggaaagtttgatatgactaactcgtagttagaaccaaacactgcactaaactcagtaaaacatccttatcatacttgggtaaattgaggcaaactttggaagcaaccaaacaccctcttcatgctggattttccacaatttgaactttttgaaaaacttattgcgcatatagacccttgaaaaaacttatcccgaaaatggtcattttggggcgtcaaaatagctggcgcagtcctcctaccaccgaggcaggccagaatctgtgatgcaggatgaccaaactttggtatactgtatcccgcaacatattgatcaagtacttcgatggattttacttcttaataaaaacatattatacagcaaatgaaatctcatatatgagttgccggataacacattttggacgcatcaaattcgaactcaatttagcaaaatctatatagttcagacttgggatgggaggagtgcttatgtgcattacaatacataatctggagtatactattttgaaacaattgtgcatgcctcccatcatcatctatagtc

SEQ ID NO: 96923 - DNA, 703 bp, Oryza sativa
aaaatagctgaaattcggaattaaaaataaggaatattgaaaaaagttttcatataagaacccaatacgagattaatcaaaattcgaaataaaaataaaataaaatccaaaattagaaaaaaaaaaggatagtccaagtaggaatacaattttaaaatagttgaaattcagaattaaaaataaggaatattaaaagaagagtccgtataagaacctaatacgagattaactaaaattgggaataaaaataaaaataaaatccgaaattagcaaaaaaaataataaaagaagagctcaagtaggaatacaatttaaaattagctgaaattcagaattaaaaataagcaatattgaaagaagaatccatataagaacccgatacgagattaattaaaattcagaataaaaataaaataatatccaaaattagataaagtaaaagagatttcaagtaggaatacaattttgaaacaactgaaattgaaaataaaaaataaaaatattaaaagaacacaattcgatattaattaattttttttaaaaaaatctgaaattagaaaaaagaaaaataaggttccaattaggaatacaatttataaataactaaaatttgtgataaaaataaagactattgatagaaaagaccatctaaaacacatgacgagataaattaagtaacaggcatataaaggagtagtggtgg

SEQ ID NO: 96924 - DNA, 506 bp, Oryza sativa
agagagtcgacgtcatgacaaagaggaccgctaatttagatcaccaaaaaaaaaaaaaactggaaaagaaagctaacctgaatggaagatttgcgttactttctcctgcactgctcagcatctatgaatcttcacaggaacgaaaggaagggctgacacaaaccgatgccttcatttcccggcccagatgtacgccaccaacaacaccaacaccaacctgaacaattccgagttttgtgactgcatttggcagttggcgcgtcttggtttgtactatgaggttttagcatatggttcgtgatcatatacttgatacaaaatcaccatggccagtaatttttttttgccgtgtagtagagactacatagccacttaatactagttaatactgttatttgtcgtgactagcattatgtggatgttaatgcatcaacctacctgaatgtcctcgcaaaaaggtaaaagagaaccactactacctgaatgtaactgccatggccccatgc

SEQ ID NO: 96925 - DNA, 1036 bp, Oryza sativa
acatatatgtcatcgaaacaccaatgagaagcaagaattaattagagtatatattatgtaatagttaaattagacttgcatttgttaaaataaaagcaattctaattgtgactagcaattctcaaaagttacctactccttataaaaaataatgatatgtcaaactgatatcactaaatttatcatgaatgtgttttctctattcgtataatatttaaatatcaaagattgtatatattcttttcacactgtactgatctcctttatcttctacttatgcttcatttgatctagctggatggctgagcttattcaggatacatgaaacgacacatatcattagtgcaagattaattaaatattgaatataataaagccaaaatagatgtatttaatttttaaacttttatataaaatatattttaattatacacaagttgcttttaaatatatacgatgtaggttatggttgtcaatttaattatagtgcataaaatggttcagatggatttagatattattatatattccaaggtaaaaaagtacgtacatatgtacataagcaggccgggctaacgacatctttttattttcttttttttcactcggatagaaaaccaaactgcccatattaactatgctctacttacgttgtaaaaatataggcacatgtcatcgaaacaccaatgagaagaaaaaattaattaaagtatatattatgtaatagttaaattagacttgcattttttaaaataaaaacaattctaattgtgactagcaattctcaaaagttacctactccttataaaaaataatgatatgtcaaactgatatcactaaatttatcatgaatgtgttttctctattcgtataatatttaaatatcaaagattgtatatattcttttcacaccatactgatctactttatcttctacttatgcttcatttgatctagctggatggctgtagctggatggctgagcttattcaggatacatgaaacgacacatatcattagtgcaagaataattaaa

SEQ ID NO: 96926 - DNA, 746 bp, Oryza sativa
tttttcagagtacagacatttctttatgtagaaacttcgctgcgttaaattcatgatctcctaaagttcctcccacgactgtctgaaatgccattttgctgcttgactaaagaaatgaatattatgacgatcaaagacatggcctacaacccctggcatgtgttatgtcacagattgtttagatactttgcctaaatcctgccattattcacctggacagtacaactaagttcttcaattctcatttgcaagaatgtgaacatacaaaaacatattatacagagttatgagtttgaaacttttgaatatgacaacatgcactaatgcaaagatgaagaccagttttcactctaaacaacagttggaatcatattgattctggcaatttacaggacgcaataaatttttttgaagtggtgcgcagatgaagccccccatccccacccctcaaaaaataaataacggcagcaggcaaataatttaaagacattcaggtccttaattgctattcatcaatcagccaatacacatgtaattgcgtaatacttaatcagggttgacaacatggggacacaactctcacctttgaaccaaatcacttccagtgccattttgaaatatgtatccacaaaaggctgtcttttcacaaatttcagatgcgtcgcttgcaatttctaaattgaagaaatcctcaataagcttgtacttttcagtgttacaagaaactgtattggcactggcacata

SEQ ID NO: 96927 - DNA, 917 bp, Oryza sativa
tttatggactcttctttcaatatttcttttttaattccaaattttagttatttttaaattgtattcctacttggactctttttttttctaatttcggattttattttatttttattgctaattttgattaatctcgtattactttcctatttagactttttattcaatattgcttacttttaatttcgaatctcagctacttttagattatatttctacttggactcttcttttctttttctcgaattaatgttggaatttctagcctccacagcgaacgttgtgcctcctttcaaggtttgctaatttcagattttattttatttttattccgaattttgattaatctcgtattactttcctatttggactcttttttcaatattgcttacttttaattccgaatttcagctatttttagattatatttttacttggacttttcttttctttttctccaattaacatgggaatttctagcccgcacagcgaacttagtgcctcctttcaaggctgatttaataatataatagatagataaaaatagagagcagaccaaatgagcctaaatcgaattgcgtgaaaaaaacgaagaggaagtccaactcagcagataaggcctggcttagtttcctaaaaatatcacaacgaatctttgacacatgcatagagcattaaatatagattaaaaaactaattgtatagttagaggggaaatcatgagacgaatttttttaacctaatagttcataatagccataagtgctacagtaacccacatatgctaaatgacggattaataggctaaaaagatcgtctcgcggtttccagactagtatgaaaatagtttttaatcgtgtgcaaaaacccttttaataatccgtcaacatgtgtgtacacaaaagtatcttttcgtg

SEQ ID NO: 96928 - DNA, 676 bp, Oryza sativa
ctatcaaaaccagtgcagatgaggtccctcggtggtttggacggcggttttggctgatgtggcgcctatgtgactaatttgactagatcttcgtcccatgtggcattgacgtggcgctcacatgacaattcgatttgaaaaataatagtcatggacccacacgttagttacaaaaagatagtaatttaaaatggtggggccacatgtcattcttactcccctcctcatcttcctcagctcttccaatctcccctctcttcatcttgtcttgttcctgctcttcttgatgatggttgttatgcaggaattcagagacgaagaattagtgccctgcagctgctgattatgatgatgatgatgagcagttgtggatttagggctggatatttgtagcaggagatatgcataggccgagagtgttcttaggataattgtatcatctcgatgtaattgactgagttaaataaaaacttccattatctaaaaaggatactctgctgctgctactaccgttgacggtaaaagagtaggcggctcgcagatgctgccgattggtggttgaatcgggtcgatgtcgtcgtcgcactgccggaggggagcacggtcatagcaatgcacgttcatgtgcctaccaagcgcctgctaaccggaactcccaccggcagaagctgcacat

SEQ ID NO: 96929 - DNA, 1305 bp, Oryza sativa
gactataaagaatacccatgcgttgcaacgggtgaaggttatttaaattttattattgttatacggtttagttaatgtgaaatttactgtgagaattcgcttggatatgtatttttctagaaaatcatgaactacaattaggagtccaatcatctcaagttagtatacgagttttttttaaagagatttcttatacgactccttatgtatttcccaaagcgaacaatctagaaacctgactcaaatagatatccgtatttccaaaagcgaacgaacttaaaaaccgactcttacacggataacgtaccaaagtgccggcaaaaacatctttaatttttataatagtagagatatagatttggctttcttttattctaacttatcgtccaactactaattactaactacgtgcgtacgtgtcttgaaatctttgattgctctgttatatgactgtgggctacaattgttaggccccactcattctatggctctttgtaccattgctacaaaatatcaaatagatgttagcacaatagataccggaagtgttaaaaccggtacctataagcattttcccacctctacggtccgaaaatataaaaaaccgacacctttattataggtgtcgattctgtaaaaaaaaccacctatactaaaggtgtcgattttttaaagtaaaacgacaccattaattaattatagatgtcggttttttaatgaaatgacacctatattaattaaaggggctggttttcagaaaaaccggcacctttagaatcgagccgagccgagccggaggagatatttcttctcccgatggggcccacacatttctcctaatgacacatttgagtggattaataggaaagattaaaattgatttcacccgttatagcgcgaattcgagctcggtacccaaatagtcattattagcctttctttattaattatctcgatccatcggcttacctttttcttctgtgtatccttacgctgccgtggtcgattgattggttatacttcgatgcatgctacaaattatatttacccgtgcgttgtaagaaaaactcttaatcatctttttttgggccatatacaagaaatgatgtttttagggcccatttagttcacgaaaagaatacttttgtgttacacacatgtttgaccggatattagaaggggtttttggacacgattaaaaaaactaatttcataactcgtctggaaaccgcgagacgaatctttttagcctaattaatccgtcattagcatatgtgggttactgtagcacttatggctaattat

SEQ ID NO: 96930 - DNA, 665 bp, Oryza sativa
tatatagccttttcccccttctcatgcctaagtgcagatttcaacagggatgttctttgcggaaacaactgtgtattgaacaaataaaacatgtcagtaaactataacatacataaccaccccatgccatttgctcttcacaattagcccataatactaaagatgcagatgtagtccctcaaccttggggaaattaggccaataacctctaagtcatctgtatttacagacataacacaattcacactgaacttcctggtgacatgaccaacaaatgaaatcatgtaaaccaaatcatagctgctgtattgctgggggggagggtgattatatttttcagttgggaaggggaaggaaaacgcatggtaactaacaaacatgcaaatgtttactcttctggtgttgcttgagtatggaaaattcaacattctaactactcggagagttaggaaccagaacaaggagaagcaagaacgagtccactaatacaacatggtcccagttgcagtggaatgcctctggaaagatgatacaatatccttttacttttcttccgaggtgcttgtcacatatgaagctgggacactttaagggtctttgtgaaaagtttgcagtgatgttcgctacataatgacaatggggcaccacccggagggggttactgc

SEQ ID NO: 96931 - DNA, 710 bp, Oryza sativa
attatttctaaattgtatttctatatgaactctatttttctttttctccgattaatatgagaatttctagatcgtgagagcgaacgtggaggctcctttttctattcctttaataagttaatagatgtattgattgcaaataaagttgcatgctacttcatctgtttcatattataagactttctaggatttcccacatcatatatatgctaatgaatctagacatatatgtgtgtctagattcattagcatatatatgaatataggcaatgctagaaagtcttataacatgcaacggagggagtagttataaagttcgtacctaaacttgattctgagccaccttaaaattattattcatattccttgctgtcttagtctatttattattacatggtcaattattaacataacttagtattgcttgtttagacaattttacactccatgtttggtatatggatgtgaatgtgttggtcagtcgatgtgagtgattgttgaaagacgggtggagacatgagcatcacccgcaacataagacttttgcaaataccaaaaacttaataaaacaaaataatttcgtctgggacgacatggatacaatatgtgtggttctatgaaacaacaagccatcgattgtagtaagtaaaggaccgagtcaagaagctacgcaggaaacaatcagagtatgattccattgcttgagtggg

SEQ ID NO: 96932 - DNA, 602 bp, Oryza sativa
atgagttgtatctggtttttcgaataaggacaaaaaccaggcgacgatttaagagatctaaagtgaacttcctgtcgctggaggctgccctcttcctatttttccaatcctcttcacatcggggaaagttccgtgtggttagacctaactgctcaatgcttcaaatgagatctgggagcggccggtagccctggcgtcgggctgggaccgggaggttcaatgcctcgtcaaggcttgaaaaattagaaaacaaaattgcgaaaaatcaaaagaaaaatcaatgcttaattagtaagtacctagaaaaaatgtccatttgttgcaacgggtaaaaacattttttacattatactttttattctgaggaaaaactcatttccttttcagtcccagtctaacctgttacctccgtctgtttggcttgcctctctttggctagcctacaagtaaagccgtaagcctagctcgcctaatcgactgatgtcttcaatctctggaagacaatctcgtgtccaaaccatcctagaaccgatcctccccatcaatatgtgactgtcgtcttcaatctctgaaagacagatcctccccatcaatatgcgact

SEQ ID NO: 96933 - DNA, 518 bp, Oryza sativa
cactgagctagtttgatgaacattcgcgttctcgcaacgagtacgcacggcttatagcacaaactgatgaagatgaacaaactagctaaaaactagacaaaaagtagatgcgaaatcaaaagagcgattcaattggttaattgtgttgaagtctattgttgcctcaattgaaccagtcatgaatcttataaagaggttgatcttgtcttctataaaaccctttcatggattactcggatagaaatcaattagaattcgaaaaacttaacccaaataagaaaacctgagactggttaaaattagatttagagttggagtcagtcggtttgaccagccacatgctgctgattagaccagccctatggcgacggtcagatcggtctcgtgttggcaattcagatcttttttaaaatcgatcatagttttctatttcgtgtgtagatgttaaatttagggagaactttactccaccagtagattggttgggttggggttgggtttgcaactttgcatagcgt

SEQ ID NO: 96934 - DNA, 511 bp, Oryza sativa
aatgtcagtgaggtgggagagaagagatgtagaatgggtattttgggcaatttgaaatacaatagcttgcatttggatacaatggtgtccagggtgtagaaaatgatatatgtatgtaagagagaattgtaatggtatgatccaaataagtgaatagtaatgttccaaataggtgaatagtaatggtagatctttaaattgtggaattcgtagtggcaccgattaaattaaccatagataatacttgggagaagtttagtggcaaggaataatctccttagagaagatgccaaattagaatccttccttagagaagcatgtaaaattggaatccggatccagaggttacccatcaactcatcaccgatcatacagaacttgatcgaattaatgtttgatggcgacaattcaatctccttggtggtggaaagagaaaagtacatatacttaaaattattcacttctcaactatcaggtttgtctaaaaaatacccctcaactataaattcgg

SEQ ID NO: 96935 - DNA, 798 bp, Oryza sativa
gccaccactctactcctttgtaggcctgctacttaatttatctcgtcaaatgttttagatggtcttgtacatgcatagatcatactggcgaagatattgtaccttaaattttatttgccatgtcttataaaatacaaatatgcttaggccagggcgaccgacgggggtggagcaggatcgagcgctccccccctccccgtgcgcacgttcccctggccccaccacgtgtctcaaaaaatatttcacttaatgtactcataatatttcacagatctaatgttgcagtgaattaaaatattattttacaataaatcacctacatattttaaaaaccctctattaaggaaagtcgttttatttttttgttccactaaaaatgtttcacctagtgtactcacaatgtttcactacgtatagatctaatgttgcagtaaacgaaacttcttttgcaacaaatcacccacatattttgaaaattctctattaagggaattcgtttttatgttccacaaaaaatgttccaccaagtgtactcacaatgttttactatgtatagatctaatgttgcagtgaactgaaacattcttccgctatttgctaaagtattatttttatataaggtgaaataacgcccgatttaataataagctaaaaaaatttcgccggaatatatccatgtgtggtcttggtttgaatatttaattgcaacgaatttaatgatgtaatcggatcatgatttggataaaaaatttaagagaaaaaatagcttaaagtggttttgcacgcatgcattgctct

SEQ ID NO: 96936 - DNA, 1107 bp, Oryza sativa
aataacttgccttgctccaatgcaaataaatccgtgataggcaacctgattatccgatcctcgaaataatacaggttgccatccaaaataaaatagactctactaagaaagacgaagaaccaaattcaataaaaatcatgaaatagcaagaaaacaataaagagcgagaaaggctgggtttgggggtgtaaatatctcctttttattgggtatagggattattgggctaatattttgtgtggaggttctcgagggttggaggctaaggtagagaagggatcaagcaactaatgtcgctatatttcatgtgtgggttttggtgccttggagaataaaggatataactggttaagtgagtatgtggctagtattggctggtggtagggttaggtagtataatatctagggttgggtatagttaagttgattatggaataggatagcgtatcaactaggctctatagtttatgtataggtctctgtaggcagagagtatgctcgatgggtgggtatggaatttggatgatgactggaatttaattaggaaggcatcggctagggtttggttgtttgctagtcattgctagagtcgggcagtataacagctagatttggtatcttttctagccggtgtcaacaaaaaggataacgactagaggaataggagatttgtgtaggtttagtggggtggaagtgttactccgacaaccgtgagtggcggcggagcggctaggatcacacagagccagagagctaactgtgcggcgtgctgtggaggtcgaggggatagtgaagctccgatcattatacgcatcaaggcgtagggtgctaggagcagcacttcgaccttgggtttgagttttgccgggctttacagccaatggttcgacgtcggggcctaggtgaccgcaaacgtctccatgaaaggcgtaaagtttcaaccagcggctttttagtggctaaagggtattttggattaaaaggaaatatttgaaaaggcaattataaattcaaacggtatttgaataaattcaaataaaattataaaatagcaaatttggtatcaaaatatagggtttgaatttagatgaatttaggtccaagttt

SEQ ID NO: 96937 - DNA, 572 bp, Oryza sativa
gtgttttgttagatttctttccaaattttggttgtgtcattatgagtgggaatgggaaactttcagaactaccaattttggtagaatagcaatggtagaacgtggcaacaaaatgaacagaatgaataggcccatagatatgataccagtgtcttcgaagttcaaaacaactggagcagagatgtctatgtaatcagtctaagagttcaagcgactttttcattctactgtctagataaatttgttcactccttcccaaaagtaaatgtttttacactattttcccatttctttctagaaagcatgccaaaagcatacattaaatctttccactttttcatggtttagacctaggcattgatccatactctcaaagagtgtagtttttacggtcaatgaacaagagaacgacgcaaagatttagaggttaacagatagaactgcagataatgacaaggcataatcgtgtagaataatatggatcacctatgttctggctgaacgtttagatcaaaatacccgaatatggataatcccctttgatgccctaattcatttttaggggattgatg

SEQ ID NO: 96938 - DNA, 507 bp, Oryza sativa
tcttcttgaaattaaaatatgaattccaacaatagttatgttcgatttttataatcccaatgataataaagagtatgcggcgaacgggtcgtagaagagtatagtggtagcgtttgataggattttttaaaggttcgggcttctaaatattgtaaaaaaaaagaaacccaacgagacaaaaaactgtaaaaactataaggtccatttttaaaggtttgggcttctaaaaagtaaaaaaaaaccaatgataatcatgtttaattttaaaatctcaatgacattaaagaagggcggcaacgtgtgaatcgtaggggaggacaataacaaagtcgctgacgttttggcggaacttatagaaagtaaaaaaatgaacgtaaacgataattatgttagactattaaaatagtaatgacaataaagagaagatgcagtggacggtcgtagaggattataatggtagcgtttgacgaaacttctagaaattataaaaaagaagcccaacatgac

SEQ ID NO: 96939 - DNA, 712 bp, Oryza sativa
agttctaagtttaacggtggagtcatacatctgtcttacataagctaaaaaaagtttctccaaccaagcttttgatttaatagtataagtttggcttatggctttaaaaaaaccaaaataattgcttgtttgtttgggtttaaactttttggctcataataaattggcttataaatctaaacaataggcccttagctaggaccaagcatccattgagtttatagattttgattgcacatgtgatctctgttcacaccaagtcgatgagatgcacggatgcatgcaagcgcctcaaacatttatgccataatttttatggaaggatatgtttaacctataactcatcaatagagataatctatgctctaattggttcacacgatgctaccatttgcacatataccgagcaagacatctaccccttccagtccacattttggacaatgatatgatatctaaaatatataatatatacaataaattattttttctctttttattatagttcgctgtaagataaatctatatatatattgttctaataactctaaattaaatattatttgagttattgatagtaaaagatatgaaagttacctaacctttttcaaaatttcagagggagtaaaatgctaaattaaattatttactataaatttgtcatagtagcttgtgattataaatgcctcacacagtcacatgattgcaatga

SEQ ID NO: 96940 - DNA, 646 bp, Oryza sativa
acagattccgttgagtttggtattaagcagttacatgataggtacaagagcaatgggcatttaggagaaggttcagatcatttggtcagacaacagagtaaccagaagtttaagatgaggatacctcctctttttaagaatcataatggcactaaacttgtatttccgaaggtcaatggagatgaaatggataatggggtttcagttgcagggaacggccatctgggatgcaacctgaacaactgtactctttgcagggaacacagcttagaaaaccataattcaagtatcttgcacaaggataacttatgtgccagtgccaatacagtttcttgtaacactgaaaagtacaagcttattgaggatttcttcaatttagaaattgcaagcgacgcatctgaaatttgtgaaaagacagccttttgtggatacatatttcaaaatggcactggaagtgatttggttcaaaggtgagagttgtgttccccatgttgtcaaccctgattaagtattacgcaattacatgtgtattggctgattgatgaatagcaattaaggacctgaatgtctttaaattatttgcctgctgccgttatttatttcctgaggggtgggcatggggggcctcatctgcgcaccacttcaa

SEQ ID NO: 96941 - DNA, 501 bp, Oryza sativa
tgtatgcaaaaccaaaaggtgcacaaacttgtgacgagtgaggttgtctgttcagcagagctacgcatttgtttcttttaggttatgtggagtgacaaaagttggaagtttgaggaaagttagaagtttggaaaaaaagttagaagtttatgtgtgtagaaaagttttggatgtgatgtgatgtgatagaaagttggaagtttaggttagttcggggtgaactaaacacggcctctgtcttatatatgctaggagtagatggttgctgcggtagaattgtgtgataatatagaagatatgagttctaaaattttctttcttatctactataatatttttttcatgcatacctttataaattatctaaatgttataaatgattggattgtatatatggtgtcttttagagggaagagatgcaatttacacccttgataaatcatccaaaggctaaaaatagttaaggtgatgtgaacagattgtctttacacccttgattaa

SEQ ID NO: 96942 - DNA, 561 bp, Oryza sativa
ctttgatggaagcaaacatattattgttgttgttgttgttgttgtttaagattaaatcgttcatattttttctgaagatgaaatcattcattttttttttcatgaagagggatcttctttcctgggaacaaacatttctttttatttccgaggatgaaatcgttcatacttttttctttcaggacaaatcttcttagcacatgtttatcgaaagcatgaacgaaaatatttcatcgtcttatgatatactctatctcagtttgtaattataagcatttctaaattgcttagcaaatattacagataaagagaaatatttgttaaagaaataaggattacaggaaatatttccttttactaagttatcacattggttaatttttaaattggttgtattctcttctcagcacctaattgtctggttgaatcccattcattggaataagtgttccccaaaaatatatattgtatacaaaatttgaatattataaatgtttgtatttggtagcaggattatccaactaaaagatactcctaacaccttttctattaaaggctacg

SEQ ID NO: 96943 - DNA, 572 bp, Oryza sativa
ctttctctgcatggcacggcatctcttcatgatggtgacgagaatcataaacattcccttctttttggttggggaacgttgccacaaggcttcctacattccagccccaatcattccaaagggtttctcctgcagattcccacggcaatgtttccatgtcccagcctacagcttcatgatggcatggcctgtgaaggtgagactaggctgacatagtcctcgttttgcttatgttaattacttccaccctcccagaatgtaacaatctagggcccgtctcatgtctagatacattttcatcctattttggttgctatattctgggacacaggtaatataaaccgcaacaacttattgttgaagatgagactgacatagttatcgttttgattaggtttattataaaccataacagattatcaataacttgaaaagtaaataataaacgatacttatgtatgtttatagcaatttaaaagtaaaatgctgaaaaagattgtaaaattactttaaaatttagagttttaaaatttaaattttgcgatttgcttataagctgaggggttccccat

SEQ ID NO: 96944 - DNA, 542 bp, Oryza sativa
ggcgtccagatttggacgctgttctaagaagtgtccagaggtggacgctgtaccgaagcacgtccaggctcggtttggggtgcccatgccgccatgcggagaggcgccatcgtcaactctcctctcctcgggcccaatgttggtgcagggctcgggcaaggtgctgccatgcccgccgttcacttcgactctgggagactgcagcagccgccttccggcttctgtctccacaacgtcagtaatctgccgtttacctcaactcacctcgaaggctctcgaatccggagaggacgccgccgctttctgccttcacgccgggaggttgcagccgctatccacgttctggttgagtcatgctggaacaataacccactcgtgccggcttgtgttgcgtcgtctgtccgcccctcttggttcctaacagcaagtccaggcatcgcctcactccagatggctggccgagcaagtatgctcagttcatagatcttggtattcaagtgtatatgttctgcaatagaaagtttacaaagaatgcaaaatta

SEQ ID NO: 96945 - DNA, 599 bp, Oryza sativa
  unsure (1)..(599): unsure at all n locations
agaactctgttctggatgaatttggacatagcagaatgctaaatggcgacaggctgttattagagggcgatgtgcttttcatgttgtttcgggggaactgaagacactagtactgtagcacatacatctgacttgttgcttctgcctctcgaactgatccagcaatnnnnnnnnnnnnnnnnnnnnagtatcagtaattagtaagcgtataaggatggtattagtgttgatcgggatattgtagaaggatggatgtattatagtgttgatcgggatacttagaactacgagtgatagcttcgtgctacgctgttctatagtcaatgtggcacaggagaaacgctagtatggcctatcagagcactatcagctgccgccatcaagcaaagctgaggccgggctgtccaggttgcttcagggctttgggagctttcgattgctttccactcccctccatctccatggcgcacaacagcgacgccccgtgaatgcacgacgatgcatcgtgcaacgcaatcgcgtcgccataactccccgctccctttcacgccagcctaacaaccagaccccatcgtcccggtgtggcatggcaaggcatc

SEQ ID NO: 96946 - DNA, 520 bp, Oryza sativa
cacgatcttagaactacacaatattattaatcaaggccgtgaacccacacgaacctgccttaacccaaggcctacgatgattcgaccgaactggcaacccgacctgggtcccagctcgtcccaagccaacccaggccaaccattccatattttagttgttaagcaggttttaagaattaaaacactaacttgggtacattgctcggcttgcccatatccgagggctcggctattcgaatagattatactctgatcagaggtgtacatctttacccacaagacacatcttcctcacgtgttgccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggag

SEQ ID NO: 96947 - DNA, 607 bp, Oryza sativa
  unsure (1)..(607): unsure at all n locations
atagcatagacacggtgttaggctagaggctaggactccatgagtcgtagagataggcggcatgtgatgacaaccctgtgatgctaacattgcctatgctaaaactgagctaatgctcaaatttaggctccttaatatgagatatttatttatagtacatatcaaatattgctaattggatcttggtccttcatgagttgttgaaaaattaaaatgctaatcgcttgtagcctgactggatgattgtaactttctgctttctgcttcctttgcagttcatatttttttgcccgactttcattcacttttaacactaaaatttgcannnnnnnnnnnnnnnnnnnnnctgcaatgtgttgaatagtctcacattggttgtggaagggcaaaggacctaagatataagtggggggagcccctcacctcaatggctagcttttggggtgggaaatgctctttacgatcctacaattagtatcagagcctggctaggttaacatctctggcccgatggacacagtgtgtgaaggcctgatggaccgtgggtgcctgcggagtccgtatacctgatggaccgtgggtgtggggcccgtatacggtgaagggg

SEQ ID NO: 96948 - DNA, 703 bp, Oryza sativa
gtggctgacatacttcataattgtgcatagcaatacatcagtcactgtgttccattcaaaatgctatgcacattcaccaatagatttgcaaatcaaacatatttgggaagtatatagggcttgttcactttggtgccaaaaacaaccttaccaaaatttggcagggtaggaagtggcaagttttggtagcgttggatacttggatgtgttttgttagatttctttccaaattttggttgtgtcattatgagtgggaatgggaaactttcagaactaccaattttggtagaatagcaatggtagaacgtggcaacaaaatgaacagaatgaataggcccatagatatgataccagtgtcttcgaagttcaaaacaactggagcagagatgtctatgtaatcagtctaagagttcaagcgactttttcattctactgtctagataaatttgttcactccttcccaaaagtaaatgtttttacactattttcccatttctttctagaaagcatgccaaaagcatacattaaatctttccactttttcatggtttagacctaggcattgatccatactctcaaaaaagttttatttgggaactaaatagggcctaagagcgagtacaatagcagggctacaagtcagctataagcacatgtaaaagagagaggagagaagagagaaagaaaatcgggctataaatta

SEQ ID NO: 96949 - DNA, 552 bp, Oryza sativa
atactcaattaatcatgtgctaatgactcatctcgttttacgtatctttccaatctcctcaatctccttctcctcgaacacaccctaagtagcactacgaactgccccctaaactgttgcttgtagtaccttaattagctgatgacttctcactttctcttcctcatattgattttcaatataatccatcggaaagaacaggttgattgctattgttttcccttgttatcatcgacctttgcatcttgaacttgcacagctggttattagtagttggatgggcatgctctagaaaagttaaaaaaaaatgttaatgatcactatcatgggtcacctaatgatattgcaaggatgaaactcaccaaagtaactgagtgtatctttattgcttcctttttgatgagtgaaggataaaaggagagcaaaagtagaacttttttttcataaatcaatggaaaaattcatgaagtgagtcagaagcaattccatgttctctcccgcaccaacgaatgtcaactattgtgaggtaagtgatgaggatgagcacaaagg

SEQ ID NO: 96950 - DNA, 547 bp, Oryza sativa
cacaccggtttcttaccatttctaccgttggaaaataaagcgttgaaaaagtctgattaatcctataaagtatggaccacccgggtaaatatctcccaaaagtatgaaatgggttcaaataacctgtagagtgggtttgggccccgggaccacgacgaacacacagtgacatgaggatgtaattgattaaatgcattttactcctaactatagcggcttaggaaagaagtaacgtgatcggagaaagttagtgattgaactattcggctgaaattgggtaacgtgtctgtcatgcaaacaataccactcggtcgcatcaccgcctaaaagaacacttacaaaccatcctcacatgtttctttagaaaataaaaaaaacttccaaacaactttgatatgttgtttttttggaacacggtataaacgtaaatattcatacacatgcgtgcacttatctctataaactatatatatatatatatatatatatatacacacacacacacacacacatacacacacacctaatatcatatctctttaactag

SEQ ID NO: 96951 - DNA, 678 bp, Oryza sativa
aattcctgcagcccaacctggcccggcgacgtactaaacggcaaatgcatggctggaatccattctttggtgggttcttctctcatttgccaactttgttcttttgtttttcatgtgtatattttttaactgctaaacagaatattttttaaatatatatatatatatatataggaaagttattttaaagaatcgtactaatctagtttttaagtttttactaatatttaattaatcatatgttaataaggtaacttgtttttcatgcgggaagaaaaagttcttttaactctccttctcccgaacgcacgaggtgttgtttggcgtagtcctcttatcctctcctagctaaggggggctcccatcggatggcctaataagctaaagaaaaagctaaattttaaatttttaaacttaattctaagattgattttgagatattttcaacgtagttttttttcagtattggtttttaagtcaccaagaacatatatataaaagttttacctacaaatttatttttattctctaataagtcgttttgacttattaggaaaaaaaaccaaacgatggggcctggggtgtttgggtgtcaaaaataagtttttaggccccctttgattcaaaggtaattcataggaattttaaaggattccattcctatagtaatttttccta

SEQ ID NO: 96952 - DNA, 943 bp, Oryza sativa
caatgttggaggggtggaagacgttggccagcgacgttggcctgcggtctgcggaggagcagctggggagttggggcttcgagaggatgggagttgaggagcagcttgcggacttggggctttgagaggatgggagttaaggagcagctggggagttgccacgagtgataaagctgacactgcgacctctcaagccgatttattttggattcaacaagcacatatacatagaacaccagatataaaggtgagttgaaaaaagtttgagttagggagtacagaaatgacatatacatatgaacacaagagataaaagtgagttgaaatattttgaaatagggagtacagaaattagactgggaaaatggaagcagggaaagttagagagggggattacatttgggaggaaggaggagaagcagggaaaaaggaattctcgaggaagacgatgactggttcgtttcggtctcccgtgtagtggcagcagcctctgtcacgcggaccaccctccaggtccactgaagaattggaaatcaggcccagtctaaagcatcgacatgattacatgaaggcccatattcttggtagcatctacggcctgctgcacagattgggcccatcctatctctttcttttttacgaccaaaacaaactcgttggctcatgcaatgcatctacgggaaacagtacagctcggaaatggtcacacacaaacacaaagggtataagggcatcaacaatcaaagatacccatagggtgtcctcactagcagaaaacactcttagagacacccatctcacaatgaaggctacacctaggtaggttcttcaaaatctgaaacaattggatgaaggtactcaagctcacagtgggtgtcccaatctaaaaatccacaccggatgttttcctatactacccctcttctccccctcccctctcttt

SEQ ID NO: 96953 - DNA, 967 bp, Oryza sativa
tagaatcgaaggcgccaattccttggttcctttacgcttagttcatttgttccaaatggatgaacaataaactttcacaggtatttacaattttccatgagaaatctatatgagctctattctattctttgagccaaccactggtcacgttttttccccttcttgcattataaataaacaagagttgtggtcacaatcatatatatttctcataacgaattccttatcgctgaattttctatgcctacgtatgttcacttctatagcaagcattcatcatagttatattgctatgaatgttagagagagagagaagtaggagtcattgagtatacacctaaccattcaatccaaaatcaaacaaccgaagactacacactccctcacaccgataagtttttctcataataacaaaataactcatcgaatataactgtactttatacaacatgtcgtggtcgttaacatggaatacctcataacctacaagctcacatattggagactttaacttttatcaaatattttgttccaaagcttacataagcatatgaagaattgggggattaagattctgaaaagccgctggttagtagccaacttttaagaacataaaaaaatctatatctttcagtttttagttttttaactacgtaattttagaatctagatgattaaagatcttagataaattttgctagaagctccttagaagttattatgacttgggacggagagactccgagagcgctgcaaccgcaaacccgcaacgcggccgtgctcctcgaatttgacgagatttggcgaagccgcccgcgcgcggcgcgccctcggtccctcgccaacaacaggcgcgacgaatccggttcaaatccattaaagaaaggggccccacacgcgggggccacttcaccgacatgtcgtccccaccgccgcagcgcccgccagctacgttcccgcccgcgcc

SEQ ID NO: 96954 - DNA, 555 bp, Oryza sativa
ttagtacttgcccactatcagcagcagcaacccccacaaaattttggccattcaccctttgcagttttgcactacgccattcccctaccgatcatccccatcgtggccctacccggcctgcctcctactatatcgattcagcagttcaccctttcctttcagcacaatgctagctttgtcatgatatacacattttcacccccttttgttttacatactgcaatttagcgagagtgcttctccggccgtggcactgcagttgcacaattggctgcatttactttgcaataggtaccctcaagaaaactttttgttgcatcatttttaggtaggtaggtatgctagatgcgccagcccccaataggcaataacacagaagtacatcctctgtgcaagaagaaaattctagtagtaattctcttagtcaatcgataggagcagagtatagaatataccatgtcatactatctttttttcatctaaactatactaccttcgtctcaaaaggaatctaccaatctaaataacactatatccagctttgtaaccaggagt

SEQ ID NO: 96955 - DNA, 942 bp, Oryza sativa
accatgatttgagcacatgtaggtaccaattataatatacacttatatggcaatatttgtatatgtgttcaaaacactttacccttttatgtttcctacattttaaaatcatctatctcggatatgcattcctatgtttttttcccctaatttcccatatattacatttatgcattccacataaacctaacaattggtggattttaagatataaatcgaacaaaaaccctaaggaagattattagtttctcatgtccatgatcaaatcaataccaatcgttgctccacgcctaaataagaactaaaaaagatggtagatcaaagctagcaccgctataaaaaaagggggaaaggggatgatgcacttgaatgccatgcatatgcctagagtctattattttgtttaagaaaagtataacatatgagattccaagtattctatctggtcggagattgctgcagttgacgcttttggtcatcttgcttggtgcctatttggtacccattcatcatcactatcagacccactttccgtcatttgaatcggatatccttctcttttggatatctggtcgcgtcgcttgccccttcctaactctttaacaataatatatgttcctttactacttgttttcatcgtatcccgggctcgactttggccccgtagatgggagcctccacgcctaggcatgtttgctaccattcccttcccccttactataggttgccttcgccgtaacctggtggggatagagaagagaataaaacatgagcgattagaataataaggagagatgtttaatatattgagaaccaccgaagttgttgaatgtgataaccattgtattaatgaagagataaatatgtagaccaattatgcaccttttcttgatataaatgctacctccaagactttaaaaaaaattgtcgaataccaactct

SEQ ID NO: 96956 - DNA, 871 bp, Oryza sativa
tttaatataagattactttatttgtaattagacttagtatgtaattattgactacggaattggtgcgacaagtaacaattgactattgtagtcttaattagacttagcatatacgcacgaaacacttagcatatacatgactattgtagtcttagcatgtaatattatttgagttttaatataagattattttatttgtaattagacttagtatataattatttactagctaggtttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgttttgtcacgtcctgataaatccatcccgaattaaaaatcattttctaaaaggaataatagaattaattaaaattcgaaaagaaattggcaaacactaaaatacgtacaagaaaaattcgaatgtggccctcaaattttagtggaattttcagagcacaaataataattaagaagaaataaacaaagttaaagtggttttataaaaataaaagccctaaaaagtcttcttttcccccccttcccttcttgggccggctcggcccaactccctccctctctctcctctcccccgcggcccatcgactcttccccgcgtgcgcgccgctgacgggcgggcccgcccgccaccctcgctgacgggtggggcccacccgtcatcgcctacctcgcgccgcgcccggcgatcgcccgtgccctagtgccccccccacccacgaatccggcggatcccgccgtccccccccgccataaagagggggaaa

SEQ ID NO: 96957 - DNA, 515 bp, Oryza sativa
tttctctttatactttagtttagtattctattgctaagtggagtagaatagaacagctctcggagtcttcgaaggaattcgggtatggctctagtagctcttctttattcttttggaagactttcggaattaatggaatattattctttatatactctcggtactttagtttatctgagtatcggctttactttatatctgtatcgttatagttgtgtagctagcctaccagagaggtgcaatgtgtgggtttaatgtccgattattcggttgctctatgtcattcatagggatatagagtagtatttaataatgtagacgtggtgtctagattattaagtatcattatctgggaatatatgctgcgggatagtagaggtgggtcactgatggtgacagctcagtacgggtattcctccacgttagtaattattcctaagacaaattcctggggagggtactcctccgttagtggtacatagaagtcatgggtgactgttgggtcgatgcttcgg

SEQ ID NO: 96958 - DNA, 1504 bp, Oryza sativa
acaccaactattacgtcgacttctgcccgccgacgagcggcatgacggctggcgacgacaacggtgtgcgtgacgggcggcgactcctgtggctaagctgccggatttgtgcaaccgcacggcggtggtcctcctcccgcctctcgcctgcttcggcgcccacctgcccgtccgctcaccgggaagaagagagagagaggagagggaagaagagaggagtgaggatgaggaagaatagagaagggagagggaagaaaggagtgaggctgacatgtgaggctcccgtgggccccaccatttttaaattattattttttggtgtaactgatatttggccccacggtttttattattttttggatagaattgtcacaagcgccacgtcaaatgacacgtgggatgaagaactagtcaaaccagccacgtaagcaccacgtcagcaaaaaccacctttcaaaccgccgagggacctcgtatgtatcggttttgacagtttaggaccggttgtttctggttttggagttcacggatgaaaatcggattcggtgtaaagttaagggacctcggatgaacttattcctttggtccgtaggttcaaaagtttggcccaagtatggtacgtaaataaattcggcccaaagcggaaatggtgggcgtagatttcacaacagatcacgcaggcgcaacccgccgcacaacgccggcgagcgcgcgaggcggactcactcggtcactcctcgcttcgatctgtgtaagtatctgcttcgatcatgctacagtttctttcccgctgcggattttgatttttgacacgcggttgcagggaggcgggtgggtggtggccgggtttggtgcggagcaggccgcggcggtggctggcggaggcagagcgcgcggtacgtgctcgatgaaatgctcagcgggaatccgtgcccattattgctagaagaaaaatcgcccccttcggaggtgctcgacgagtgttcgacgaaaggtgtacaaggacgcggcagccttgtaacggcagtgttgtgatttttctgcagcccagtttgctcggcaggactgcgctgctgatgcgggcgctgctcagtttgtgccaggtgcgtctcctctcctacttcgattttcttgcttgttgaattgctgatgcccatgatgatttcatttgttcaatagaattgatgctcacatagcttgaaggaaatatgtgaatatatatatagtacaaatatttgaaatgtgcctactcgtgaaagcaaaaataggatttttttttggaaataatacgattttaaaggaaaatcgcaaaaatataggtcggttagacgaaatcgcaagtttggcaccctatcgaatatccgtggttcgacagggtacctatcgaacaaccgcagttcgacagggtgccggcagttcgacaggtgataaaataatttttaaaaagaggaaaaacactgtagcacactgtagctgagaccctatcgaactgggctgcaggaat

SEQ ID NO: 96959 - DNA, 889 bp, Oryza sativa
gaccgtgcgtcgtcgcgcttttccgcccgcctgaccgcgatggtggccatgctcgccctcctctccaccggccttttcctctcccttttcccgcgcggacctcgtcgccgtcgtcgtcgcggagccgcagctgctctgcgcgaaagccaacaccatcgcagccagcgctcggttgggtcatcccgtccgtcgtcgtcgcgctcctccgcccgctcatctgcgatgccgacaccatcatctccgcggtgcgcgcgacccatgtccccgaccagaccaagctcatcaacgccatcatggaggccggcggcgaccacgtccggaggtgagcagaggcggcgtcgaccatggttgttgcaaacggcgttgtcggtggttgcaaacggcgctcatcccatccctcccttgctccttcaaccaaataaaaaactggaatcgtcctattctacaaaccaaacacccgaatggaatcatcccaatcctaaaatcagggatggtttcatcccatcccacctagtcccagaaccaaacacacgctaaaagtaatttacatatattatagaagtaacttagaacaaaacgaaagtaactttagcatgtcatttgaagtaaatccgttgtagagataaaaacatggctctatctagaaattaaattaatcagcataaattatggaattaactaaaaaaataataaaagtaatcaccttagagcattatgaatgtataggaagtattttaatcaaatctaaaaataacttatatatatatatacacgtatatatatatatacgtatatatatacgtatatacgtatatatacgtatatatatatatacgtatacgtatatatacgtatatatatatacgtatatatatatatatatatatat

SEQ ID NO: 96960 - DNA, 649 bp, Oryza sativa
agctcggtacccgtacaacgtatgtattgtcgttccttggatgttgacacttatcttctcttctgttcttatgggctttgcagctgtgtgaatgtgctaaacaatctaatcagggaattgcacttaagtcaaactgtacgcatctgtctcaattgtttgcaagccaaaagatggtgagaaaccagttatatttgataacaaactgcagagcacaatatcctgattaacattgctgccgctaccacccctaacctgagcacctgatccacacagcttatgcaagaggcagcagaagtagcaccctgtgactatgaggctatgagccaaggcctccgactaaagggagagggggaaaagtgagtggactgacaaagggcgcattagtcatgaggtagctgcaaattcatggtggagtggaggaagaacctgactatgtcaaaaaaatgtagccaccacagcaatactaactggccatggacaggaaaaagaactgttgaattattcataaaagtttttcccgttttgttggggatgcaaataggtgctgcctctacacttccatccactgtattctggctaagtggctaacgttttaagtagaactggtataagcaaaaaccttacatttaactcattgaatcagaaacct

SEQ ID NO: 96961 - DNA, 510 bp, Oryza sativa
caccaaaacaaaagaacatcacacaacatgacacggagtgacttaagctctagcaatacaccaaacagaaccctttctagccacagcatgcaaaatagcagaaatgcttggggaggcactgttgaaatcattacggtgcttccataatgcacatgccactaggataaccaatttagtccaaagcgtaagaaaacatagtccaaaatgaaaagtcgtgctaatgcatgaccgaatatgcaccttgataaaaaaaaaaacgcttcaagttacattccctcgtcacttaaagaatcgctgaaggtaagtaatttttttacacatatagagaagggaagggatgagcaaaacttaagacaagcttatgtttttcattactctgtatatagaagacacacaaacggacaccactacacaccagcaaacctgcgggtgtgcttcatgctctcttaatacacataccccactaaagagacgaaaattagtagaaaaaaggagaggtctgaagtgcta

SEQ ID NO: 96962 - DNA, 666 bp, Oryza sativa
ggagaggagaggagaggagaggagaagagaagagaagagaagagaagagaagagagaggagatgagaagaggagaggagaagagagaactgacgggtgggtcccacatgtaatagggccaaatgagtaagggcagaagagacattttgtgcttcagttaacaccgttagatgcccttaacagaacagggtcatacgggagcttcgtttttgaaaaggagggtcaaataagcaaactctaaaaagtagggtcaaattggtagttagggtacaaaacggggtcaaataagcaattgtccctaattattaatgccaattaaattttctctcctatcatggtaattcctttaatgagcatgtcatatatatacaccaccaataaaaagcaagtggtgggggtgagtggtgaatttgtctcgccaccaattccctactttttgtgaaggtaaaaaaagaagagcattggccaaaggaccccacctattagctgaaaggtatgcataaactaaaaatgagatctggagaaaatgatggcaaaaatgggttgatgacaatgtttgtcccctctcccccggccaaaaaaaaagtgccctttggtaccttctttttctcttcaactcatttaatgtctacaatacattgtacatgatcacaacattgggagtgct

SEQ ID NO: 96963 - DNA, 683 bp, Oryza sativa
ccctagtgtaatcttttgaatttggatagcttaggtggatggttgggcctgttgcaacatgggatagcgttggacagtggatagttaatattaattaattattacaactgtttaatctttcaacttctgtttataaatgctcactttatgcaaataaaccactttagctcttctttgatgattccctgcatcatgcctctattccagtatgacttgctgagtacagtgggtagtactcagtcttgctctaatttttcccaaccccagagcacgagtatgtgtcagatgaaggtttctccgaggagtaggcttcgtccgtgccgtcgaggatgcctgtggagtggtgttcccgctgcagttctagtcaaggcttagctcctgttgtctttctttctttccgctgcatttatgtaagactttcatgatgtttgtaagacgtggatctgaatgtcaacattgtcgtttgtgtaccccggccggtcctggacggggattttaatgcacattctgcttggaattctattcgcgaatttctgggcgtgacactaaaagaccaactttatctgaagccgatttcccatctatcaatgagccaactgtagttggcgagggtaatgagatcacaagccgtcgatgcatgtcttttggagaagcaacatctacctacaatggatcagagctgt

SEQ ID NO: 96964 - DNA, 614 bp, Oryza sativa
atttaaaaattttataaaaaattcaaaaatatttagttacacgtaaagtactattcatattttatcatctaataacaataaaaatactaatcataaaaaaatttcaaataagacgagcggttgaacgttgaacgtgaatagtgcagaactacacttattttgggacggagggagtacgagctaggcagccgcgtgcaattttggctgtgtttagttacacactaaaaatgaaagtttaattaagttttttaaaaaaattggaagtttatgtatgcagaaatgttttaatgtgatgaaaaagttagaagtttgaagaaaaaattgggaactgaactcagcctttacattctctttcaatgaacgaacgctcgatcgcaggttgttgacggacgcatgcatttccacgtgctgaataaaaatcatactccagcaatgagcctgctgcctacttcgatgcgtcgcatatggatatgggccatatgcaatgcagtgcaccccacatcgttccatatacgcacggcgcacaccctgctaattaatttggtcaagcctgacctttactgctcgtgctaatactaatattcaggcccacttctattcttcagcttcaagca

SEQ ID NO: 96965 - DNA, 594 bp, Oryza sativa
ttgggaatcatcagaaaattagccctcgtaacattgggggagaagctgcgaaaaaatttctatgcaacacggactaatccctcatctctggaggcctcttctggtattgtgacaggtagctgacgaggatcttaaagcaatctccttcccaccactcatcctccggcctgcgcgcttgatggacgttggtgtggcaactgccggcaccaccggcctcctgccctggttctggtttgtcgcttcatggatgctgcccatacttctacattggtgaaatggggctttctcccccactggaaatatagtcatatataattcggcatattttaatccagataaataacatagtaagcatgacatgttaataatggagtgatccaatgattagtactaaacatgaacatgctaataacagtaatagcatcatctagtaacatatttaacactaatatgagtagagtaatatacccagtgaacactcgagagaatgatgaggcattggtgttgcctccgttgatgttgacgttctcggttttgcctcctacagtgctaccattccctcctcctccagtagcactggcaccgggtagacat

SEQ ID NO: 96966 - DNA, 972 bp, Oryza sativa
agcacaagcacctcacctcctctctgtctcctccctttttttcctttcaacagcacaagcacctccgtcgcacagctcttctctgtctcctctcacagcacaagtaccaaatccaagcagcagcaacagcgccaagcacactaccaacgcacagctcttctctgtctcctctcacagaacaagtaccaaatccaacagcagcaacagcacaagtacactaccaaatccaagcagcagcaacagcacaagcacacttactcactccttccttcacaagcacaagcacacctagcactgcagccctgctccctccttcacaccggccgcgctgcagcagccgtcgccgtctccggcgtcgacgtggcctctccgcctcaaccgtcgacgctgccgctccacctcagcagtcgacgggtgcagcactcctccgctcacagcgccgccgctacacgtcctccccaacaccagcgtctccctcctcgacgagctccggcgaggctagggtttagccgtcgccagccactagccggttggctctgataccatgaagtcttgtgattttttctctggaagcttcactttctctattgccattctcacttacatatacatgggatgggccctcttcaatagatgggccagcacacaagacacacacagataactagtctatttacagcccaacaaggaattctatacctaccttccatctttagttgagggggctgaacacactacctacccagggctgaatgagataggcataggtctgcacaccccacacctccagctagcaggctttgttcgtgcgctagatatgctttatcgctccacctttgctgagctgcaacgcgtccgcacaagggtagcaactttagaaaggagtatcttgcctaggttttgccagggataccatactccggagttcatgtatggagaagatgctatgcttgctccagcgaggacatacct

SEQ ID NO: 96967 - DNA, 1527 bp, Oryza sativa
atgtgcttgaccaggcaccaaaccaagcggatcgggtaatatccatgagaaatcaaaccaaaaccaaacaagtggattggattgttgccacgagagaatcacacctaaaagttggagatacaaatctcaactatacaaatcacacctaaaatgaagaggcaagaactcacctgagccgagagaggggatagacgaggcgtgccggcgccgcggcggcggaggacgacgagcaaggcagcggcggaggacggcgagcgagcgagcgaggcggcggcagagatggcgagccgctcgatctcgtgtgtggaaacggcgacctagggttggggacatgcagacgagaaatttcagaatattccatccgattcgtagcacgttcaggattaaccatccaattcgcatgtctttcagaatccaccatcacaagagctaatttcttcatttcacgccactccgtccatccgaagcagcaccgtctatccatcagttgccgcgtcctccgtccctcgccattcctcgtcgtcacctccagctccggtcagccaacctcgtcgcacacccgtggtcctgccacataagaggggacggttcctggtgcacatgtcggaggagctcagctatcgccgcgcaggatcgccgccaccgtgtggaccacgcgactagtgcgctatgtcggacgagctctcagtgaggctgagcttgtggatgaccaatagaattgcttcactaatagagcttgtggcagttggggatgacggccgagcatggggatgggcggacggcaccaatggcgatggcggtggacgaactcgggtacgatctagcgacgacggcggacgagctgtcagatcccggggtcaaatgtcaccaaaaatctgcagattcgagcaaatttgggctaagtagctacctaataggattcctaagacagaaattaagctaagaaaattaaaggatgccgcaagataagcaagtaggaactagagtttatatttcttgatccccttttcatccacccagatcgccttttatggagtacggcatctgagtgaggaggctggacaactcagtaggctgtgattacattaagttttggagttttaggacaaagcagtacagacacagtaattactgaaatgaaacagctccctcagatttacatcattgaactggtatcttagcatctgggctgcccattcccgcaactcctatttctctttctgataaacaacttcttcagataagcagggcctgacaatgcctcccccattaagacccaggtcctcatgggttaaaccagggaaaagtcttggatataaaggatgcatcctcccaggtagcagcttcattggtagattctcccaaagtatcttccactgcacaactggagcattgtgtcgagggatcagtcgccgctccaaaacagcaagaggggctgttaatatgttgccatcagaatcaatcagaggaagcccaggttctggaactgccttaggaccaatatggtgtttaagttgactgacatga

SEQ ID NO: 96968 - DNA, 1343 bp, Oryza sativa
ctatcttaaaatataaacacttttaaagttagacacatgtattaagaaaacagatttaattaaatagataaatagggtgtgtggttataatttgttaagaagataatatagaaaataatttatatgaattgaatgtaatttaactggttaggtttcttatggtggaatcagtgtacttgggtttaatttctagatttaacacggtgtttatatttacgactaatttttctttcagtggtaggtttcaaattctatatttggtacgggtgctcgcatttacggctaattattcttttagtgatgagcgacgtatccatcgacagcgaaatacccgtgatgattttatcaatctcaaaaaaaatatcggctcggtcttcgaccctttttaccgaaggtgtttataggccctgtttagatcctccaaaacgttttgccattttgtagcactttttgccattttggatctaaacactagtagcaaaagttggcaatttggcatttgacatttgctagtccatagtagcaaattgtgccaaaaaatgttttgggaccactacctctctctttctctctgtcactttagtgctagaatggcaaaactttaacatacatctaaataccaactagtacttttgcaatgccaaaacttttaccaccaaaacttttgccatttgctatttgccatttcaaatagatctaaacagacccatagttgtaaggcgtgcgtgtgtacgtttctacagtttatcatattgtaaacacggaaaactagtgacatatgccgtcaccttttttttttttgggctgagctagagagagctctgtcgagtaggcgtgttgacaccatgttgccatcctctcctgcaccatgatgtggtcatcattgccgctcgtggctcgctgacgccccgggcccacgtctgggttcgcctttctgcctgcctgttggctgttgcgaccggccacctggggctcttccctcttcagtttgggcagccagtgacgcgtgtaactgcctgctggttttagtgagagttaggtacaccaacgtggtggttgttggctactgctgctgccagaggcaagggagcatgcatgtcatgtttggcctaagctctttagcttccaatggtcaatgatgtgtttgtatttatatatagtgaatatttggtctggctatagggccctgtttttgagtcatttctgttcttttttctgaattaatttaattagaggcttcttttcaatttgttacaggtcttgacttttaggctgctaacagcaaaattgtagaagtcttattcaaaaaatcgccacctccttctctaaatgttgacactagt

SEQ ID NO: 96969 - DNA, 543 bp, Oryza sativa
tttaaactgaaatttattcggttattatgatacataagttacatgcacgagctaattcgcttgaagatattgagttacggagaaaaataaaatctattactcttactagctctgccaaacaggcttttagtaggaagtacagtggcatcgtgtttgatgcagagcagcagaggtcgagcttccaaaagacagaaaaaaattcaagtgaataaaattgaaatttctgatttgatctataaaatgtggagtagtagatacgacctttcaattcgggaaacatcaaattaaaattgctaagtttggagcattcgcatctacaatctttttacctttcatcattgagacacgaatcaactatagcaattccgatgtagacggccaagccacaacaaacaagaacacgctctaattcattgggggcgatagtgattagtcaaggttgtttcaacgattacgatgtgaaactttgaaagagaaaccccatttgttatcgcacacaccatactcaaaatagtactctctccatattttaatgtatgacgc

SEQ ID NO: 96970 - DNA, 700 bp, Oryza sativa
gtggaacgattatatataaatcgtccaggtagcagcctctctttatcttagataatgattagcagaactgcaacatgggaactatgcagaactggtgcatggtaaataaacaaaagtttatgaaagaggtaacttcattagaccatgtctcttctagaagatactttttgcagttagtcaataactcaatatatctgatataaatttagataaccatcaaggaggatagagagagctcagatcaaataatgtatgatgatcagtagcattattatttatgaaaatttggtataaattctccttatcttgtacaatgtctaaaagaactggaccgtgtaactatgtggaactggtgcatggtaactacaaaaagttcatgatgaaccataagaaaaggtttggtgggaaattacaaaaatagtcagaaaggcaacaattatgaatcggaagcaaataaggaggatatagaaatgctcaaataatgtgtaatgattcttagaatgactatacaaaatctttgataatgtctagcaaaactgcagcatggtgcatggtaactaagaaaacttatgacaaaatacaagactgaaatttcatattgtactgggtcaagtaggaaattaaaaaagaggttgtaaaagtaacaattagggattgaaagcaagattgacatgtactgaatacgaaaaccattggaagg

SEQ ID NO: 96971 - DNA, 894 bp, Oryza sativa
gattaaccccctcatcttgggatcacctagacactgctattggaaagacattcttcttaaagacggtcagaggtaccaccgagctgattgagaagatggtctcaaatatgggttggagcgaggaacgactccgaatccgtcaatacggtatgcacaccgtcaagaggacggaaatgctggccactcagttggatcttcttattaagagactggacaacaatgagaaggacgccaagcagggtgctgttaaggccctggactcacatgacatgtgaggtccgtggcaatgccagtcacactgggatggatcatccgaaaacccgtaaggactcatgctcacgagagcaacaacgggtatcgtccataaggagatcaaggatggagcattgctccatggggaagatcaagtacggaccaaacccacaaggaggtcaaggtctaccccgaaagacggacagtttcagcaatttcatgatgaatttcctaaagatcaagaagaaatgaggatccgtcgataccttaggctggcacccaagaagccaggaacacaggtcggtcaacctgcgttcccagtttcgaagaagccattgaccgcaccaaaaacaaaggaggtatggcaggttaaagagaagacacctgttcctgtacctttgaaactgggctgtcacgccctaaaaatcgcctaaattaaaaatgcattgtttaaatgatttttagaaaatattttaaaagcctacaagctaaaacctaattatctaggaaaattttcaacataaaagtgagctagataaaattttattaaatactatgcttgctcttctattttctagaattttctgggaattatttgagcaagggaagtatttttttaataattgaaacaacatttcacaa

SEQ ID NO: 96972 - DNA, 589 bp, Oryza sativa
ataaacgtatatgaaattaatagccatcgtagtaaggattaatagccatcgcattaatgacctttaggcactgctgctaataatcctagtacaagaaaatgccatgtcatggatcatccaagaaactagagtaatgatgcctagagtagaaacaaggcaaaagatggcacagatattccagcaactatgctgtcctctcacaatccagaaataaaatgagagcaacaaatgtcagtacaattccaggcaccaagaacagctggaattcgcatatctcaattaaggagtttacacaattgagttcacaattcataattatttcacggctaacacattaggagctgtttaaaaacaacaatttcatcacaactcagattcacatatctcaattactcgacatcactatactcaccatcatcattagggatcataattgtacattcattttcactatcatactgccctaaggtatcatcatcgtcatcatcattgtacaggtcatcttcttcaacttccagatcccgttgcctgcgaatctgatcaactagggactttggtacacttataccatcttcgttgactggttgtt

SEQ ID NO: 96973 - DNA, 902 bp, Oryza sativa
atagaaattgagaaggagttaaaaattgagttggcaatgagatgaactccttctaccggccatccccttcttatagtgcacctccaacggctataattgtgacacggacccactaaccattggtgtgcaaaagaagggaggtgactattgcctgttgacggtcgtcatcgatcagttacatccgtcaatattaccggaataaatgaagaactagttatgcttgcaatgcatttagtgtcataataaaataaaaaccactagcacttggttcactaaccctttgcagagaatgagccataaatggagaagaatcggcatcaaaacaagcgaataatcaatcggacgatgtcgagaaacagaattgtgtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctag

SEQ ID NO: 96974 - DNA, 555 bp, Oryza sativa
acaatctagtagtccctaggggcagcaaccttttggaaattatattcaccagtggttttatttattcagcctcatgagtcctggcactataggaagtcattgtagtagagatattgattccaaacagtacctatgttcatttgattccagtatctaactatatcatacaatactactaatagtataaaaaaatgagaggtccaagaacaagaaacagaaactgcattatgtaagaagaggcatatcataagatgaagatgtgtacctaagcgcaaccaagtcaaggaggagtggtctgatgagtgacctgagtctgtccaaatgctatcatctgtcgaatgaggttctgagtatctgctgctgacttctgagtatctgttattgccttctttaggttctcaatctcctcagcttgtttctgagcttttgcctcagattcttctgcctgggcttccaacctctggaccttttggcgaagtcctgcagattcttccttctcagcctccaattgtgcttgtagctcctgcatctgcggtgaaatagattttggagcgg

SEQ ID NO: 96975 - DNA, 536 bp, Oryza sativa
acatgttggtttgtttaagacttgggagttaaatatgataactgagcgatgtcaaagatattaacagagattttccatgatttaataattgtgaaatttgtaatcaacaaacattaagttatacctggtttggagtctcaatcaccacaacatgcacaatagatgagtttttaatgtggaacatgaaaaatacagatctgcagtcatgtaatacaattatctaagcaacagctaaatcattctagttaatatgagagctcctacatttacaattagtataccatagtacaacggctaaaacaagaattgcgaagtaactatatgtattgcagcaattcatactcttattcgtgtttataaatactactcgctaacttctgcgttgcaatgctttttattttttatgtttaaaaatggttaaagagatttggcatgactaaataattgtaaaatttgtaattaacaaatattgagttgtacttgatttggagttttagtcaatgtatttattttggagtctcagttctctcaacata

SEQ ID NO: 96976 - DNA, 720 bp, Oryza sativa
gtacagtagctcatcaaccaccctatgacattcgaaaataaatgcatatttgaaataaaaagagaatttaattatatgttcaacatgctcaaaggattgtgtttagtatctgtgtgacttgccttgcaataatttcaattagtcttctggatcacttccgatgcactcatgatccttccaaacgacgaaaacgacaaactaatacgcaaaacgaggaaaaaactaaggaactccaaataaacagtacgtaaaaagtaaataaacatgtagaccatgattttagatgaattatgagacttgaacggcctcattctgacttccaatggattaattatgaattttacaagatttaatacaattaaaacctatttaaaaggattaaacagattaacaacacaatttataagtaattttaatatagatctctattttatacaaatttagcaacttgaaacacattaatccgagttataatgaattagatatgatttttctaagtttaatatgatttttgcctaatacagaaaagactttactaatttattaatgtattaaataaaaggaaaaagaggatgaaggacggtggctcgggaaacgaagttcgccagcgatctagggcataagggcgcgaacggagggcactaatgcgaaaagtacaacgcggcgaactcaccggtggctagaacggccgagattgacgacgaacggcgacggcggcga

SEQ ID NO: 96977 - DNA, 600 bp, Oryza sativa
aaagcattgcaccttcccgaatcatagtcgcccactttaaaccaatgtatagactcccagcgaccccgtgggcttatctccgtcacttctcagtctagcagtccacaatgaaccatgctatacaatgcatccggttgttgtccacgctagctcatagttattatggttaacgtttcagaacagtagctcgtgaaccggttcttaattgtcatgagcacgactatcaaaaccatgtgctcataacccaccataatcaagttttagttggcaaatttattatttaagcaaacatgactgaccatcgtgagctcctattaattagatgacaataagtgatagtgaagcataagttatccccttaatgagctaatgtttctaagcatgactaagcatcatgatagctttagctaaaatcatataatgttctagctaatcatattattaacctatttacaaaggacaagtaatcaatgtcaaaggggcataacaaagcatataggtcaaccctccggtgacactcgaaaataattcaacagttgaatagaaacaatagctttaaacaagttcaacatgttgaaaagggtgttttagaatctgtga

SEQ ID NO: 96978 - DNA, 695 bp, Oryza sativa
aatggccggcaaggagcgggagaggacggcagcgccgacgccgacgccgacgagatcgagcgggggaacggcggtcgacggcacgacacctaagcgccctaaccacagtcctcacctccacaggcaccgcgccctcaccggggaacgagctccctgctccctccgccgcctccctccatccgtgataacaagatccggcgctctggcctctccgccgattgcaacaataagattcgggcatccggtgtatgcgacaggctcacgacacggccgacatcgagcctgtcaagctggttaggtgtcacaccctgaaaatcgcaaaattataaatcgttgttaaaatggaatttttagaaattatttaatgattaaagtaagtgtgtgaataaaatctatgaaaaatttgaacattaacttgagctagataaaatttcattaagtactttgtgtgtccaagtattttcagtatttttcttggatttatttgagcattgaaagtatttttaataaatgagagatcatttcagtatttatttaaattaaaaagtaatttaaatcctctccttagtctggaccgaattcaacccattccctctcctctctcctttccttagcccgcagcagcccactctccctctttctcttggctgaagtccgatttggatccctcctcttaccagcccatgaaagaaagg

SEQ ID NO: 96979 - DNA, 562 bp, Oryza sativa
actatagggcgaattcgagctcggtacccaatttgtttcttcagatggcgtatttcgcctaatcaatgtctagctgcataaatcgctgtggtggataaatgtcaagaggactttcaggatgagttcacgaatctgcgtagagactagaatttggatctacacaataactcaactgtagaagtccctaacactgtcatgacggctttactgatacttctcaatcctaagatccaatatttggtacctatgactgaagcaccaatgcttctatgcaggctggacattctatattgcttctgttcagatgatgattttcaccaacaatattactgaacgactactgaggaataaagatgactcgttatatagatggtccctgcttaattccatagtgtaatactaggattgtttttttagcaaatacaacagttgaagggcatgtttcaggtgagctcagcactattcttttatagaactttctatatattaatttcatagagtattttttttaaatccatttttcaattttactatgtgtatttaatttggttcaatggcaaat

SEQ ID NO: 96980 - DNA, 601 bp, Oryza sativa
tttaaaaatatggttgttttaatatccaacattactacgaagtaaacgttggttgtgatggaattttcccactcgtgttcatgtcctagaattacaaattctttcagtagtaggtgacgtacccgtcgaaagcgagacgtacgtagtgacttcgtccatctcaaaatatgtcatcctagtctatcagaagtactcatgggggtatgtgcatgtgtgtgttcacataggtgagtgcgcgcacgttgtaagcgctcgtgtttgtactttgtttctaaaataatatcaaacatattttttgtttctcttttaatttaataaataaaacaatagggagggggtgacagggttgtgtagatgtgagagtgaggaggaggtggagattttatttttctaatttttctaaatgatttaagtgagagccgatgacagggtgtttcattttttctaagaatttccaaggtcatttatccgttttttataggacgtgagacatgataacttaagattttatttttaaaaaatagatctaatagataaaatattggatacgtcaatttaattgatcaaatttaatctagcacctcgtatgtccagccacgtg

SEQ ID NO: 96981 - DNA, 654 bp, Oryza sativa
tgatgataaattaagtcataataaaataaatgataattacatataatttatgaataaaaaaatggtcaaacgtgtcttaaaaatcaatggcaccatatattaaataaatagagggagtaatacatatgaaccagggctaaaaccagcggccccatcgtttggcacgaggaaaaagcgaaacgatatacttgcaaattaaaaaaaaatatgaataaaatttttatatacgtgttcttatatcgatataaaagtaaaggctgaaaaataaactacaataaaaaaatcctaaaattaacttcaaatttatgtttgaaaattcaaattttggctgataagcccaaacaaaaagacgaggctacaatacattcatatactactagccaggataaatgtcgacttggaggtagcgatgatgttatatagcgcgatcgctagtacgcgcgcactcgacggcggcgtgcgtttcaggcccacaaggcctagcgccggaacgcacgcgccttctttcacgcttttttttcggtttctttaccgattttttttggtttttcccacttttttatgattattttttaatctttagcatgctttgagtttgaaaagtttaaatttttgagttgaaaatttttaaacctgaactttgaaagttccaaa

SEQ ID NO: 96982 - DNA, 563 bp, Oryza sativa
gtcattactaggataccatgcttgtcatcatgagaataccatgcttggcgtttccttccagcttaccaccatatgctttagactatgatatcccgcttactaaggataccatgattgacaacttgccattaactatctcatattagctttcctggtctccggtgctaggtacttctgctattcgatgcaagggtcaaccactttaactataagttatgcttcccaagagaaccaatttatcccccttgacatgctttgacgtcttcccgaatgactttgctgctggacttgttattgtctgatcgtgatcctgccaaatctgaagcttcgttgttagaggtgattttaatctgacctctgtagactatcttcgaacatatcacttggttcataactgggaatagctcccacgaacaagcagctcggattcactttctttacattcagtttacttcccattattatcttcaggttgtcctcagttagcattcaacgtattcctttacacctttaaccttgatgtgttctttcccattggatcatctcccaagacatggcattac

SEQ ID NO: 96983 - DNA, 841 bp, Oryza sativa
agaattgattttgtggtaatttgaggtttgtagaaatcatacaagtaaagcaaaaagttctatctgttgttcctcctggttgaacagagattatggaatacttggtttccctttcaatgatcaacccacttaaccatgaatagttggcagtagtctgattgttcaatctcgaaaaagtgttcttctatctgatttaaaattctgagcaaatggtgaggaaaaaaatgttttttctcaaagggttaatataacaaaaaaaatgaatttctatattcttgtcacaacgtacggataatttgctagcatatactccctctgttttcaaatatttgacgccgttgaattttttaaacatgtctgaccgatcatcttttttcctatcatttgattcattgttaaatatacttttatgtatatatatagttttacatatttcacgaaagattttaaataagacgaacagttcatgtactaaaaaatcaacggtatcaaatatttagaaacggagggagtacataataataacccaagtcactttgcaccaaacctgacttttttggtaactgggagtttagatatggtaagattaagtggcaatttgatttttagtcttgtttggtaagggtatgtacaaccgtctttattagtggctttctctattaacatgcaaataaacttggtgatgtgcaagaaagggaaaaaagagaaaaatagttgttacgcacgataacggctcagagtcgactcttagtatttattagaaaatattttgttgcatggggttgaaagaaaggaaagaattgggaaaaaatatttttttcgtaaaatatatatcgagagg

SEQ ID NO: 96984 - DNA, 1616 bp, Oryza sativa
ccgggccgggccgcccgtttggccacctctaggactgaggggagcacagctgtccactggattgctcgatgcactggtcactgggcagaggataagactatactgttgatgagtatcaataaatacataaatagtaaagaaagttagtactaataaattactcattgctggtttagattggtaccatcttaaagcatattattttgtgccaaaatttataaatatgtggatgcatttagttttgttactaaatattagtgatgcatagggaattttggttacaacacatttagcctatcctactaaaacttaaaattattgccaatttatcaaattattaacattacaaaatttttgacaggttcgtttgggcactaatctaaacatgcctttaacttttaaattacaatgttttaatggatgcaaaatagttataattagcgtaaaaaatattttacaatatttatataacttaagcaaattgcggttaaagtttatacctaaacaacaaaaggtagtatcaaataaaaaagaaacagtggagtagtagggttgattgttacatccaatttggccacatcatctgcttattagtttatacaatgtattgcatctaaaacattatctccaatacattataattatttaattagcttattcatttttatcctatacatattactctccaatttgctaccttgaagtttgtaaagaggtttctccttgtataaaggcctgaagggtgactctttctctttctctttctcctctcctctccctcccacctcacccattttcttaaaacacacacagtacatgtatgcactcacaaagtgcacacaatcatctctatgaacctctatgaatacacacaagcacaccacaatcctatgaatacctctttgttgatggatatatcgctatcactgaaaaataattagctaaacccagtggactggttctaccacaaggaacttgccaagttgagctacgctcacctcgcctccacctcaccaattaatcttacgtggcaccttgcagcttatgcttggatgttttatagtacttgctctaaaaggtttgttacgtactccctctgccgcagaagaacatcaccttttgaccaatcaaactaaggtatacacatttaattggaattttagaaaaaaaaaggaatcgataaggacgtcagtggtatttctcctcactactaatttgtaggagaatcgttataaataaatttgtctggggtggaaggaatagaacaatagggattttgttttagttggtgagaaaagctctgtcattataaggtggcataggcattaagagactatgtgactaagtggacaaattaaataagatatattatgattgtttgagataagagagtaggtactcaattgctatattttgctatattgtaagacaacttttaaatgttagaaattgctatatttgaaatgaagggagaatgtttttttattaacgatcttttttacgtaaaaaacactacggtcgttatttaaaaatatctattttgcaaaacctatttacaaatggaccatggtttatttagctgaagatgaggcttgataattaatgctttaaaaata

SEQ ID NO: 96985 - DNA, 741 bp, Oryza sativa
ctgctcagattattgcgggattatttgctccacacttataatattgcaatttttttgctcaataaaatgattcacaactgtcatgcatgtttggaaaaaaataaaaataaaaatacgattctaaaaaaaaaactatcttctactgcattaattgcttatacttgttataagctaagtataaagattattttatgaaaatattgatttaccaagttaatcaaatagatgattcggccgtttcatttcatctatataattttagagagatcatggataattaaacctacagatatcagaaaaaatatctttgtgtctctttttcttaattatttgattctgccatcatttaaatacatttaagatactcccttcgtcccaaattatatgcaccctctttttcaggaaaaatcaaactcaataacttttaactaataatcatactaaccacacacacatatatactagaaataaatgcccgtgcattgcaacgggtgaagaatattttaatcttattattgtgatacggtttagtgtagcgcccgttccgtcgtggcgcatagcgggaaaattatctcttaaaaaccctaattgcgaaatttgtttcttcgcttgttgtctagtgtccgtgccatctcaagatctcaatccccgatctatcgtcgagttcaattccaaatccaaatccctccaaatcaaattcctccgcaaaagtctaatttgcctcccccggggttgatgggc

SEQ ID NO: 96986 - DNA, 1237 bp, Oryza sativa
tatatatctcccttgatttctccacttcactgtcaaccacattgagtttaagctatgtactagtccggatgcctcctaaacctactgtatcattcaccaaaaaagatactctctctgtcccaaaataagccaatctcatacaggacgtgatatatcctggtatgataaatctagacacacctatatatttctctacacacctatatgtttgattgaggttgcctatatgttgtccaccacagctttctctttttgtgtagaagtgccagtatgtcatgcctctcatgcattgccacccatttctccaccccgcagaaagacatgaaaagaaaatatataacaattcagtacttgatcaatttaacaatctgaaatctgaactcccattgcctcctaaacctactagactttatatgcaagcacctagggggtggatagaaaaaacaatctggtaggcttagagcagagcagtgaggtggctgtgtgagcaacgggagaagatgagcaaagtcatgcaggctttttgtaggacaaaatagaaaaaataaataaatggattcaatatttgccatcaatgtagccattttttgagattgcagagaaggcacataagcacatacgttatcacatatccaaacttctgtgagccacccctcttaaagacttaaaataggcataacacataagagatgagagacagatatacttgttccggataaatcaattgtccactagctactctctcttttttttttgtttcatgaatgaactgaaaaaggaagaattcaggttcaaagaaaaatgtacacacacatacaaacgagtcacatgaatataatgctcagtaaagccacattatattccgaaagagaattgttgacgttggattgaatggccatccaaggttttatttaacactccatttttttccaaagtaatggctcgaaaatcaaataattagaatcagaaacaaatgttatggcgtttggctgccagttgaatcaaaatgattattggttccacatccaacctctctgattttttactccaaatctaacaccatcaccaattgaggtgagttttttcaccgctattcgtcacctccatcgcctcatattccccattgaacaatgtaacaaaaaccagctatatatcctaacctgcacaccgtcgtctcttgtgctctccaaccttccaagatctgccactagttctaatgctaaagggctgcaggaat

SEQ ID NO: 96987 - DNA, 739 bp, Oryza sativa
cactcgaaggagtactcctaactttggtttgctctagcatgtatccaagaatgctaatatctatatatagtcggcagtagttgaagaaaagaagcgaaatatatacatgcatggttgttgcatagtaaagttttgatatggaaatagtcagcaaatcatgggcatttccaaaattttgataaagttgtgtttggttttgtcgccgaatttaaactgaatttcttgtagggttgctaggcctattgttttgtttgaagcaaaccacagtatcaagcattgtgcagtaccaaagttttagcattagatggggacacgttaattaactttataaagataatacgtacatatccacgtatattgccctcaaacatgtacaaacatgagagaaaatttctattgtgttctttcttttttttttccatttgcttccgccaccatttgaatagtttctttacaataactaattttctcatgatggttgttgcagtctgtatgcagtgaagtttatggaattatggaggctaagagttagaggtttgaatgggttatcaaatggggacgagtcgggaagttcatctgaggggtattcctagcttggggacagcccgggcgtcatccttgtcagagtgtgtctatatgggcctgtgtgtatatggagctggagctcagccaaacagtttcagctccaccaaaactgggagtggagctgggtggagctctctcacaaagggctgcagga

SEQ ID NO: 96988 - DNA, 750 bp, Oryza sativa
acttaaaacaaaacggaagtaactttgtcacggcattaaaagtaaattcgttgtaggaataaaaatatgactttatctagaaattaaatttaatcagcataaatcaacacacgtaagtttaacaatttttaaaagtaacttcaatgttaattggaagtaacttttgtatggttaagaagtaactctctataaatctgtttaatcaccgattgtttttttcctttcatttttgcttttcatgtagaatgagaaaagaagataaaaccttcgatggattgtaaataacattgatggaataactaatgagaattagttaggtataagatgtaatagttacttcctgataacctttctaatatgtaataaattacttttaaattaataaaatatttgaatatattcaatatgaatcttgatttgttacatattttgagtggagtacaatgatgcaaatagatcttaaaaatgatatgtgatttaaaagatataagttattaaagagattaaaaatatatatactattgtatttttcaagttgaaaggagacactagatggatcacaaaccagctacccgtcacgtccaacgaaaaaaaggcatgtattagagttactttcattttattataagttattttataatatatgtaaattacttttaggctttgttgaatttacttttatatgtctaagaagtaatttagtgaaatataaaagtaatttagatatattataaaagtaatttataattt

SEQ ID NO: 96989 - DNA, 786 bp, Oryza sativa
cagggacctaagtgaagggctcaattcctttccaattgcatatttggatttccacattgcatcctataaactaaaaatgacataaaaaaatttgcaaaatagaaaataccaaaaatataggttagagtttattatgctaggtaagacaactagttctcttgttgagatgatgaatagtttctctgttttatatctcttatatatgggttcacggttaagtacgctctgaaagattgaataaatagtagccacatattatccgggaacctgaggtaagtgggctgcacttgccgaactaagtctaggttgtcgcgagatgatatagtgataagagttgctatgatcctgttctaagtttgacttaaattccggatgttttattttccaaaatgataaacttaaaagttcctcatttgataaaaattcctaccagagccaaaaattttcatatttgataaaccatatatattttgggcgcttgtacttccattgaactttgtcaaaatcttgagacttgtgagatacttttgatactctatgatcaagatcatacacccacatatatgcacatgcaaacttctgcactagaagttagcattcattcattccatctatatccatcatgctatcacccaaaatcaagctctccaattatatgctttctccttccaatataatatcctttccaaaaagagataaaaagagggaaaggcatggttaggaaaataaagtcttgctcctcaaaatattgagcatgataaaaaaatgagtagccatgccccctcc

SEQ ID NO: 96990 - DNA, 598 bp, Oryza sativa
cttgctcattcagctagttgaaaataactttgtcggatgtcgtcataatacctttatgcatattctatttcggatggttgccatttggtccaaccaagttgagagaatattaatattatactcctagttaagcacagctagtatagcacggtacgtatggattgaaattaatcgatattaggggaatccaaatccaaacaaattaaaggtcttgaaattatccacccacatatatattttaatttcagtggataggtgaaatcatattagttattttagtactgtaccatcccaacttccaaacaagttggaagatgacatatatatagtagcgccatggcaattattgttgcaaacaagggtcatgttgttccaaaaacaacagctgattaattaggtaaaacctcttcagcgaggacaaaccatgtcagctcgtagagtttaattagttgttgttagtcagccaagcacttacgatgcaagcgaagtcccaacgccatcttgtttatttttcactactttcagtcaatattattggatatataacgcgatcaaaaatatttgcaggaattaatgctcatttttcttacatagacat

SEQ ID NO: 96991 - DNA, 505 bp, Oryza sativa
ttcgattagattgaatattattgtcgaatcctgcaagtgaattagttgagaagttaagtgtttttttaatcaaggttcgagaagttggactagctagcgtcagattagtcacgctgtaatgcgtgttaagctgccagcaggaccattggcaatacggctttatttagtgcttacgcgtgtacatacttctgtcgccaattaggcccgtagatatacagtatatatagaaatactaccataaattgtataattgagttataatgggaattagacgacaatgactttattgtacacaaaataaattatgcaccctaattttaataaagagttggcacatttctctgctgataagattaccactaggaaggttttacaacatattgcccgttgccttagtatcgtatataaataaaaaaaaaaccttgattcctacttctagttattctgcctaactgagttactacttattatcaattgtgcattgccctctaagtaaaatcagttc

SEQ ID NO: 96992 - DNA, 770 bp, Oryza sativa
aaaagtttctatacgaaagttgcttaaaaaaaatcaaattaatccatttttttaaaaaaatagctaatacttaattaatcacgcgctaatggaccactccgttttccatgcgtactactccgattgggaaccgggaatggcgaacacagccttagtagttagtagggcagctggaatgagaacataagcccttgtttagttcccaactttttcttcaaacttctaactttttcatcacatcaaaactttcctacacacataaacttccaacatttttctttaaacttccaattttagtcaaaattccaattttggtgtggaactaaacacaccctaagtgggaaatgttctgacaaactatttgattttgtgtttgaccaatttttcccctagcttgcttggcaaggaagttgcaggggtatcctcaaagatatatatggatatgaggacgtacgtacggtatggctaagatatatctgatcgaatattgatttcggtatcagtcttcggtctggtcatcaaatacttagttatagtataaaatagtcgagatcaatcaattcaatctcaatcgtcataaaccaattgtatgctacgcaaatggtaagtctggtggtcaatgtcctcctaaagtcctgggcctcgacctcagcctcacgttgagatatctaaatcaaccaaatgtattgtcattgtgcgctggatttagatcaaaggactagattagagtataggcataggcgcttgcaatgaatttacagttgtagttg

SEQ ID NO: 96993 - DNA, 686 bp, Oryza sativa
ctacaatattattttttatctgtctagacttgtctacatttatgttccactctaccgtaattaacaatcaccacttctccttcgtcgtttgtttacatgcagcaagtaaataaaattctgattgtctgctactccttcaatgaaaaatctcaaaaattttgtgattctctcagggcgacattttggaaaagacaatccttataaacccatttctttgtaagtacgttgctgtcagattacaatagtgcataaaccacctttcaggatacaggctaagggaaaacttatttgaaccaaaaaaatcgaatggcctcagtagcctagtacaaatatatctatatcacgcacacaacatacacatactcgggctgtgcagcccacagcatctgagaaggaaatccttacaactgcaacattggaaaaattttactacgcatccttcgaatgcttgggcatatgttcttgattcggcaaaggcgctgtcaattcaaaatagtcatcaaacacgctgtatccagacacgctgttggagcatgctgcatgcgctgaatgcttgcagttgagttcccaaattgggaaaaggttgtctatacaagagctttaactgcatcacaaaatatatggtttattaagcaagtcgataagaacccaaactatcagaatggtcacaatctaagctgtaagtt

SEQ ID NO: 96994 - DNA, 529 bp, Oryza sativa
cacaataacattttacagccatgattaacatgaacatctcacattacattcataccgcggtataagataatcgacaattcgacatagaagggttgaaactatagctgtgcgcttgtttacctacattgttacatggcaaattgataaaatatctacacgtgaaaatcaggtaaaaggcacctgggctcatgacagaaacagaagggcatgctccattagcaaaagcgtgcgaaaaacgacatatagagtatagacagagatatttatagctcaaatgatagaacttatcactagctacacgactatactgtacaaagcaaacttgaagtaggaccatcaataattgattccgttccactatggttcagaaatccttcactaactgacaagctcaaacaagctcccagcttctcaatgccagttttttttttcaggatacacaaacaggaattgctgcgtcattttttgcccttctgttttcccagatgcttttaaaactggacttcagatttagcatatacctaaaaat

SEQ ID NO: 96995 - DNA, 837 bp, Oryza sativa
tgtccagcctcatcgtgagaaacccaagtcccgagaggaactcgagcgccaccagttggaagcaggaggcatcccacttgatccagaggaacgggtgtgcgcgttcccccagtgtacgtcgtgcggtgcttgccagcgattctcattggcactgtgccaggaagaaccaccggtgctgtgccgtggtgcctgggtccaaccgggtgcatctcccgttggctcccagtccgcctcgtacatctgcacaggtatcgatgaggatgactcctcatgctcttgccttggtctgttgcgtgtcttcctgtaagatgtacctgcacaagattcttctatggtctgtaggggaatggttagttcctgacagttgtacaaatgataccccgcattgggtaatgggatttcatttgtacaaccggggaaaaagtatatcaatgagccatcgtctccatgcttaagtatatgcccttgtactaagtatgtttcatcctcatagggacggacagtggatatatactcgatctgatcggtggtaataactccaaggccattcgctatacgggtgatcaaagaagtacactcaacaggggcagtatacttaatactttctaactgtcacgtcctgataaattcatcccgaaataaaaattattttctaaaaggaataatagaattaattaaaattcgaaaagaaattggcaaacactaaaatacgtataagaaaaattcaaatgtggcccggagattttttgttaaattccccttggtctaaaaggagcccccaaattttagtggaattctcagagcccaaataataattattaagaaataaacaaagtt

SEQ ID NO: 96996 - DNA, 501 bp, Oryza sativa
tggtagtagggccacaacttggaccacagaacaagaacttttccaaccacatcattagaaaggctgtgtgttccttaggggttacagaaccagttcccatgttctgggtgatgaagccaatccaacctccgatgctcctagttttgtaagagaatttgcccttggtattcatactaactgggttagccgatgatgtgatgtctaagtccatgatcatgactatatccaggagagttggtgttattggtccttggttgataaaaaagcattcaaagtattggactagaaataagctgcagccgatagcacaggctcatctctattcatatcggctacagtgaggactaggcactgttgacagtcgttatcgaacaatttcgaccgtccatattacccaattaatgaagactagctatgcttgcaatgcataaattccaattaaaatgtctatttccactatgtactatgctactaacatgtatgcaggagaagcacatataa

SEQ ID NO: 96997 - DNA, 560 bp, Oryza sativa
gaggagaaaaggaaagaaaaaagaaaaatggaaagattcccgtgattttgcatgaaagcccctgaagttttgggaaactaggtgcatcctgctctgcataggaaatcttgccttttaaacccttaacttttcaggaaactcacaaatagccctctgtatttgggatatttgtttgaatggcattcggaatttgcaaatatcaccggaaatcatattctcgcataaaaagagaccacggacattgacctttgacctcgactttgcatgtgccttttattgctgatgtttatgattatgaaatttatttatcgcatttacgattattgattatttgtgatgcttttattacttttagttaatatcgttgaagttgaattttgtgtaccattatattgcaacacatgtgcattttaccggcatttaatttgcgcatattttttaataacgaaagatgacaggcatcacgaattagaaaatttgcaaaaactagaatatctctgacatatttatttaatgtcgaaattacgatagagcgagaaactctatggtaccattaatct

SEQ ID NO: 96998 - DNA, 642 bp, Oryza sativa
cataaaaaaaaccatattttcctacaaatactcataaaccaccacgtgtactcctaaaaacacttttaaaccggcatgtggcactctaattaaccgggggacccactattttagatttttcagctattagatttacaattatatagtggacccgatattatacgtcattagatctatttttcaaaaaaaaagaaaaagaaaatagcatcgatcccctcccattccgcttaagtacatttccatttacgtgaactccatctgtgtacgccctcccctctggtcctttttttttctattttcatgaatttcatgctattttaggtagatgggaaataggatttattataatattttttcttaaaaaataaaactaaatcactgtccttttgtagaaacggacgtatgccttctccttcgtggtccaagggcggtggccacccttctttttttatatattatttaaattcaaactagactggataattttaacccattaaatattaaattattattattatatcaaatagattgtttaaccttttgatttacaaaatgcacctaaattagaaataattaaagaggttaaataagaaatacagcaccccaaggtttttaaaatagatctaatttaaatggatttat

SEQ ID NO: 96999 - DNA, 578 bp, Oryza sativa
aaaactaagactactattgagcagtaacaaggaaacactaaaacttaatagaaacagacattagaaattgatctcctttcacacatctcagtttaagtaaagagctcgaatccagtttgaaacagcctacttgagaagtaaaacctctcatttaggcagtacaggtacgtcgtaaccaaagctcctaacttccaaaaacaagagtgggaagaattgcagcgcaggaggtcgtttgctacacctcatctcaaatcaatcactccggtatgcaaagcaccgcccctaaatataaaataccacgtcatcatcatcataatcatcatccgccatgaacaccaacgatcaatgaaggcaggaaccacgagactccacgcatcccccctagtggatttacacatcacgggcaagagaggaaccgagaacgtaaaaaggcgggaggtgggggggggggacctgcagcttccagcgggatgaggaggagacgccgcctcggcgtacggcgaccgggcgggcgactacgacgaaggcggcggcggcgcgggggcggagggccgccatgccgtggttgaggggggatc

SEQ ID NO: 97000 - DNA, 620 bp, Oryza sativa
gaaaaatttagatgggcgaaatatcaacaggatgataactgccatgtttcaaaagtactatttctacataatttttctaaactatttgttagcttttaaaaaatatatatttaattcattcgtataaatagttatctatcatctgtataaataccaaccatgtttcaaaagtaaatatttagattgtttggaaacttgtcggacaaataattaaacgtaaactaaaaagtaaaatgttttgtcttgtttaattgaatgtttggtagccttttttaacaaatcctaaataactattattattagtaaacatgctttccttatttgtaccatcaagttagttctcttttttgttggttcagattcatacaagctgagaggggaggggacggctagtgttctgttgtgcccatgtgagaggagggcgaagtggagggggtgttttgttcaaaatgatttaagtgaaaatcgatgatcctgtttcttttatcaaaatttctaatatcctttttttctaaattttaagatgtagcacatgacagcttaagattttctctaaaattatatatattggttaaaaataatggatccacctattaagtacaaattgatggtcacatgtc

SEQ ID NO: 97001 - DNA, 522 bp, Oryza sativa
aattactgtttactatagttaaagttaaagaaaatataaagttcgacatctaacacattaatctagaatctacaccctccgttcaaaaaaccaatttatatggatgaacataatgcttgcgcagattcattcctataagttatttttttatacgaaagtaggtactacagctcacataatcacactgttatcaattattttttgtattctcaacatttacaagtttaaaagttacattccaatcacttaaagtattttcgcaggcatccctctctcactcaatctctcatttcctctctcgccctgcacctcactatagtcgcatgtttcacccttgtcctctaaactgtttaggccgaataggggggacgacatttaacacccccccccctctctgcttcaacaagtttagtaataagttcactctagatccctcagtttgtcgcctagtctaattttcatccttagtccagaaaaccagatacaacgcatccatcaactcacaaaaccgtgcagaatagg

SEQ ID NO: 97002 - DNA, 528 bp, Oryza sativa
cctctcaaagaaacatgtattcacagacagcacaacgccacactgccctgacatgttttccagtacagaatcctcagtagacaaactaccaacaatctaggacaggaattggcaatctgggaagcttgaggttacaaacaaaagaataaaaaataatatttcagtcgatataacactccatctactgcaaactcaaattgttgaagaatcgttgatttgtttcttacccaacaaaatatgaaggcgatggatcgacggcaacctgatgtcagggtgacggagaccccagcaagccagcacccttgaccacataggagagattccctactattgactgcatttacaccagaagggctataagcatctcattaaatcataatatggtcgatagaatgtgcacttggagtgatcactgtttgaagtacccgaatggatttttttcttctaaaaatgagctcatatttgtcttaaaaaaaggtttctttgaacaattatgtacagcaatttttttgtctgaattaaccaaat

SEQ ID NO: 97003 - DNA, 604 bp, Oryza sativa
aaaaatagagaaattccaagaaattctaagaacaaacaaaatatttatcccatgattttaacttaagtcggtggacccactattttcatccgccagatcaatttaaacaaatccttccacctacaccattgtcccgtaagtagccatggcaaccgatactcctataccgccacgtggcatcctacagacgctcataaaccgccacgtggtactataataaattatataaatttataaaatttctaagaaaaaacaaaatatctatccactgattttcattaagttaggtggacccttattttccaacaataggtttatctaaagaaaaatcctacctaaccccaaaccggggtataccatgggcctgtacgttacatacgtttcttttataggatagtacgtacttccacccatacttccctcgatttcttcatattttttacatatttattatcctattattagagtttgaaaaaaaaatttttttattaaataattcagcaattataacacctaaatcaaacaactaatatttatccgcttatatctttaaaattatttatgattaaatcttcagctaaagaccaaatttccacaataattt

SEQ ID NO: 97004 - DNA, 544 bp, Oryza sativa
tcaatgttgcctgcatagtgcatttaatacagtccactactgatcagtactttgccaggaacatcaatgcatctgcatctaccagttcggaatatgcacgtaagtttccggtacacacctcgtacgcaactagcaaatatcatacttcctccgttttataatgtaagttattctagcatttttcatatttatattgatgttaataaatttatctagatatatatgtctagattcattaacatatagaatgacttacattatgaaacggagggagtataaaattttagaaaaaaacacacatatttccactaatatatatatctagatgtgaaatcttatcttcaaattcattatgttttagccttaaaaagacaaaattatgacatttttaccctcaaaattatcagatttttcacaaatataatgaatttgaatagtaggagattttacaaatatgtgtaatactattagacgtaaatgtctatttttttataaattttttatgacatttactagttggtgttaatgaatcgtgaaaaggaag

SEQ ID NO: 97005 - DNA, 590 bp, Oryza sativa
aaaatattcccggccaatgatttttaagggtaaataaatttttttttcctcccattatttcacttgattaaattgcttaactttttattcaatttctaggaaatgcatcattaaatgatttttaatcccgaacgaaaatcggggcgttacaaatctaccccccttacaggaatctcgtcccgagattctgggatggctagaaagaaagccggtgcagatgggcggtctgactgatctgcaccttgaactgccacattctgcttcgaactgattgattgactggttgatcaaacctgcacgattgaactggctggattcgacctttctgttcctttgctttgccaaaactggaccgactggttctgcttgaactgacccagtctaggactgcggatgctcctgaaacttacttagtttggactgaactgttgaggttagcaattttggtaacctgagaattcaccacgctggctataagaggatgaaaatggaatctggcatttataaatcatttaccctatgtccgcttcgactggtcccaattcaaataacaagtaattccaggaaaacctgcttgacctgtctttcgt

SEQ ID NO: 97006 - DNA, 589 bp, Oryza sativa
taattcatacggagtataccccgaacacgacttgaaatgtgacgaccaatcggcattcgagcgaccggctctcacaagtgacaaaaccgggagcaaaaaaaaacaatggaaaaacacaaggcggccacgcgggaggtccatcggccatcgcaattgaagcacggcgatgggggtatctgcaggttgtcccgccccgcagggaggtggggcctacgactacgatgaattgggatctggatcgcggcagaggcggggggagcgcaggaggcggcatgtgagggggcgtgcgtgcgtgcgctgtcgcggtggtggagccgtccgcgagatcgtgccatcggtccttcaccgtggatgctaaccacgctgcatttatatttgctgcgtaaaactcctctctgcttcccggcttcctgctacgcgcacccgaccgtgtgattgatattgatactgataagcagtgacatccgtctgtaaaacatacacactccgtcccataaaaaacccaatcttatttacgaacctggacatatacgtgcccaggttaatagctggggtttgccttttttttttggacatagtagtatttttt

SEQ ID NO: 97007 - DNA, 635 bp, Oryza sativa
aagatcatgcgctcgtgtgtcctcgtgccagtccacggcaccctgctctggtcgatttgtagggggattgcgttctttattcatgttgatctgctgtagatgggggcgatcttgagccggaggagtagctagtttcttattgatgcggtttcggggtttttagagatttaacacggtttcgcggcttctctttagcgatttcttttttcatgttgatataatgatatccacggtggatgttctagttatgtcatttttatcttgagtgctttgtgtgattgtttttcaattgtgggtagagaccatattattgtcgttaagatgcatgctctgaaacgcgaaatttttttgtaatgggttatatctagattatgtgtattgctgtcattcaatagtcttttcttaatacaaggcgcaaccgtcttttcttcaagtaccagtatacaagtcggcaactgctcaactccgtacttggtgcatgcaagcattgaatggatggttgcatgagctcatgatattcggttcattagtttaaaggcaaaggatcctccactagaatgcttgcatgcacgcgcaaaatctgcaggacacgggtgcatgctgctttggcactagatgcgatgaactgatcaaag

SEQ ID NO: 97008 - DNA, 549 bp, Oryza sativa
tttgtggcattaaaggatttgccaaaggtgtgatgcccatttcggcctgtttatcgtgaaatggtgataaacggacgcagctataaggtttttaaggttgccgggtggcttcgggcgcaccctgggcgaaccttagaagactacgatcttgttcattcaagacgtttggaggacatggctcgcttttggcgaaaccatcagaagactgatcggcaggaggcgatctctcaacgtcgttacagtctagtctgtatttcacccccttctcctcttagggttgtgtatgatattagtagtgatgacgaacctagttcgttcgatcactccttagagagagagagatcgtgagggcgaagatgtaatttatctgtaagccgggctgtaacgccattgctcctttctcttcatttgtaccattgtgatgtattcttcgatacatttttatttaaaatccataaaggtgcgtcttatttccttttcgctatttttgcattgtcacttcacgtgctttttgttgggtcggaacgtgtcggcccctttgcatatatt

SEQ ID NO: 97009 - DNA, 641 bp, Oryza sativa
tgatccgcgtatatatataatctgcacacacattttgctctcccttttccacgtggggcgagacgtacgtggcgcgtggccatgtacgtacgtacgactcgccgatggaaacagcaacacgcacggggaaaccgacgcgcatgcgcgcacgccttgatcgaaacgccgtggcgcgtcgaatgatcgcgtggtggtggtgaaaaacccgcacacggcgctcgcgcgcgccgcgcagagaaaaaaaaaatctccggccgcagcagaggcgcgcgcgctgcaggttgcagctgcggttgggcggggcggggcggatgcgaacaaagctcgcgaggtgacaggatagcacatgcgccgatggccgcggaaggaaaggctcggaagcagacggacggcgcggccgcccgatgctggtccgcgcggatgccgggttggtgtgggcagcgacagctgacaaaacgtacggcatgatgatgtgcgtgtgttgctcctcatcctagctagtagtacgtactgtactgtcctagtagcaagcaagcgaaacacggcacgtagctaggagtaagactaaagcgcagctaccaagctgtacataacatatatacgatcgacgatcactaaacctcccagcgctgatcgatcga

SEQ ID NO: 97010 - DNA, 687 bp, Oryza sativa
gcaaacatatatggacaccatatgttgtggctgtaagcctgtgtaaaccctctgaagggcatatccgtttggggacaaaacgagctaagtgttggaaactcatgaaaatcatacctaaaagttttataaatttatgaaaaaaactacatataggtgtagatataaaatacattttcacaattctccagttcaaacttaactttatttaggtgtaacaaaaaagacaaatttcaggtgaatagtgtcctcttactattaacctgaaatttgtcttttttttcctcttaaacgaagttgagtttagagttgagatttggtgagaatgtatttcatatctacacctatctctagtattttttttcatgaatttacgaaactttttgatatgattttcatgagttttcaacacttaactcgttttcatgaaaatatgtcctctttcgttttggaggaaattcaaaggttttggattcctaaggattaattcatatgagtatcattcggttaataagaatgtaggtataggaaacaaagtttttttttacaagttatagagagaaaacatagacactttttcatccactcaaacctttttggaaaattcctatggattgaagttttcatgcattcctattcctccacttttactattcctatatgtttaaattcctccaaaatgaataggcc

SEQ ID NO: 97011 - DNA, 908 bp, Oryza sativa
catgaaatcacaattttaggattctgcaggaggcatataccccaaaaatgatgatctgttttggaaccaagaccagcttttttgggctccaaaaggccaaagccttttagcttcaaatgctagtagagtaaattgccagatgaatgcactttactacacgaacttgtaaaagacttgtttcggtacatgaatttgttcgatgcatgtgaaacaaggtcaaaatgacacatcataatcaattttactaagttatacactgattaggacgagatgtgcatatggaggtggacatgagacatgcatttgtgctttattattctttgttctaccccttgcactatttctcagtatttttgtgtctttctccatacaatctttaggccttattaacccctttttattgaacaaatgtatatgtacttagcatttttctcacacatgtgtttatgtagtatcctaattaacactaaaataagattagctttgttttttcttttggccttgattcacatgcacctaacaagttcgtgtatcaaaatgagcgttttataagtttatgtactagattgcttccacctagcaagttcgtgtaccgccaatgcaatttactcatgctagtatttggagaaagcatataaccaaatgacggtttgtgcttgaatcaaggatagcttttctgggctcaaaaggccagagctgcttaggttccaatgaagatgtttctttcgtgctttttgggaggatcactgcgatggcactcctccgatgttgctacttgcatatacttctatactttatttaacttggctacaacttgaaaatgaacgcaaccaatcaccacggctgtacgatccaacagcattttcagttcaggaaaactacaatacattagatttagggcgcaatct

SEQ ID NO: 97012 - DNA, 667 bp, Oryza sativa
agctcggtacccaaacatatagtaattatatctacaatttacttcattctaaaactaaacatacacatgctagatcattttcataatatttcaatccaagtcatttcatcatttctctattatctaacatatagtagattaggaaactaatgccgtgtccggctaggtttctgtctttgtaaccctgccccacccccaacctatataagacgagcaggggccctctcaagggtagatgaacacataaccacaaccaaattttcaaatcaatacataactcgcggatacaatcctcaaacagaagtacggtattacctctcatcgagagggcctgaacctatctaaaccattatctccgcatctatccatttttaggtctctgcgctaccccgtttattgttgccaaattccagtttcgacaattcctatgatttctatgaataggttctagcattcaaatagaatatttttattattctacaaattattcttgtgttttgttaaaacttggcctcatggtacattgctgaatgggcctatttggcctaactaacatcaattgagtcgggccatgagcccatggcttatgtgttgtgtagagttttctcgatgactatccactcgcatcaatgtgatatatctcatattattatactatagatttata

SEQ ID NO: 97013 - DNA, 674 bp, Oryza sativa
gttgactaccattgagttttgttgtctaaaggagacattgcccatattcattctcattaccaccttctattggtttcatgagactctatgcaagtatccatggatatacgaggagatgcatttttcatatgcttcttcttcttcttgcttaatacttcttgatgtgggcatgtaccagcgttagtgtgcactccaacagctagttttcttccttgatgggaaggtgcggtacgcctattcggaggttccgtaccgtttgccagatctcaactggctccccttctatttggtagggtaccttttgtgactttgagtatgatagtccctttcttaaaaaaaaaatctttgccagatttttttgagcaactttcactatcaaacatgaattctaaatgaaaaggggcacttttccattctcagatatacttatcaccatttctttttacaaaaaaagatacttaccagctaccaccacactatatatttgcatccaaactttatagctaaattttattaatgaggttacgaatattttaaatataattgttgaagtctgttgcacgatatagcggtatagctatatacacaaaccttacttaggccccgttcggtagtgctccaaactccaactccagtgggagctggtgttgacggtccttaaatcataatatatg

SEQ ID NO: 97014 - DNA, 611 bp, Oryza sativa
  unsure (1)..(611): unsure at all n locations
aagcaaggctcccgtttcccggtgtaataggagaccagaagtcttcacccgttaaatggtgactgacaggggcacccccgtgtcaggcggcaagatttgacaggccccatcatcaagacgacgtgtgcttggcttcccaagtcaagagataagacatgcatttaatgtaaagattataatacttctccaccggagctaggttaggttgttgggcccatgtggtaaccccttgaggtataaaaggaggtccaggcctttaatggtggagagggggggacttctgagcgaactggcgcttgggtctcgcaaccccaagcacttgtattctacattcaatcaatcatgcacaggagtagggtattacgcttctcagtggcccaaacctgtataatcctcttttgtctcatcgtcttggaggggcctaaccccctcaagatcacacagctccgcttgccaagcactcgaatctcatccgctgcccccggccgaactcacaaaggggagtctcacggttccctggtggtggagttcattctccgtcatttacaaaaaaaaaaaaatttntgnaaaaacccttgtggttttagagttcattgtatcgttgggtttta

SEQ ID NO: 97015 - DNA, 544 bp, Oryza sativa
tgagaaaattccttcaatgtagtctggaccttactagaatagtcgagtgccttaacagttcagctagcaacagctatttgctcttcaagtatcagatcacaagtttaagcaacaattcatcagaaaggtccaaacatttccttagggctcacatgggattggaaactcatcagtcaccatcaaagcaaagccataagggagatgtggtctacagtaaatttctcgagagtaagaagaaatacaaaaaaacaactgttcagggaacataaacttcatatttactaatttaatcattcttggttgactgcaagcagaagttctttactggacgtcccaccctctcctcattctcttatttgatatttgtcaattagtgctggtttctctcctaccacttaacaaaaagccctcttgaccctccaaatccccataagacagcacttgacgataggcaacgagtaagaccattatgtgggttctgtcgcaatgagcaacatgatcacaaagccacactaatcaaactgttgtacctaacatataaact

SEQ ID NO: 97016 - DNA, 850 bp, Oryza sativa
aaaaacatgcatatttacagtgctacataaaatttatacattctggtggtgggaggatggaagggaagcccaagggcggaaagccatatatacataaatatatactcctttggtaaaaaatctgacatggagtttttccacggatttaaagtgcgacttgacataatttataattgataatttatgaaatctaataaatctttggagattatgaaattcttttcaagacacaaatctatacttgccactttatgtggtcaataattttgtcaaattgcaagtatatttagtgtaccaatagattcatattgcaaacgactcttagaaattaaatagagatttgctagattttagatgcctaaaaatttgtatattttcggtaacctaaaatttcatattactaagccttattcaatatggaatttaagttcatcttaactacaattttggagttacacatgattaattttactttatttgcgtctttttctgaatttttttgcatgcaattttgtaaattttaatgagttataagttggtttgatgtaatattgtaaagtttttgttagaataatttattaaccaaccatgggagaattataagtaataaatactccctccatcctataccatagtaacctagctagtactgcatgagatattttaggactacaaatttagacatgagttattcagattcgtggtaccggaatatgtcttatcatatggtactatttactatattatgggatggaagtagtgatagataagtgatgagaaccattggattgtttatcttagggatgaaaaagtaacaattttttaaaaaattttaagcgcctgaaatata

SEQ ID NO: 97017 - DNA, 837 bp, Oryza sativa
aaaatataccaaacctcctctgtcctaaaatataagtattttagacttcgatatggtcttaaagatactattttgatcaatatataatatctataaaaataagatgttttaaataaaaagagttacatattatgataattcgtttaatgataaatctagtaacatcgattttacatgattaatcttttttattaattattaaaagttaaaaatgtttgacttaatactatcctacaaatgcttatattttaggacggagagagagtataaattagacatatgttagtaatatgaatttgaatggagtaaattacgagggagaacttgtataataatagtctctgttagggctgtcaaaaaaggtcgaagcttgcaagtagctcgagcttggctaattctaggctcgattcgagctccaaacgagccaaacccgagcttgagcaaaaacttgcgagctttatcgagccgagcttgagcttctactgagtttaccgagcttatacatagcgtatagtttatattgtttgtttaccttattgatttaataaactaatggatatatatatatatatatatatatatatatatatatatatatatatatatatatatatatatatatattaattagtatctatttacacaataaattagcatgtgttagcacaatatatttattttaatcattttttactcttttattaattaatgagaaaataattatacttatcaatggattatcactaaaatatatcttacactacttattactgagctcggtagcttagctcgagctcgaacgagctcgagccgagcttgcctaaaagctcgaaggtg

SEQ ID NO: 97018 - DNA, 3082 bp, Oryza sativa
ccaaccgtgattaaagtggtgagttaccgatcgggactaaagatccttggcccccgacatacatctgacaggggatgaaccgggagtaaagaaccaaccgggactaaagatcataatttttataaccgggactaaaaacaatctttactcccggttctttttggatccgggactattgtggattttgccggatcgattaaagatggtttctccaccagtgaaggggaggatgaacagcaggagaagcaagattcaaaattcatgcatctcagaatattcatggctggagggctagcttggatcaaatcaaagcttcacatgcatgtatctcagaaatggagtttaaattaatgctttcatttggtttgctgttgcagctcaatagctggctgattcttgtcagctctgcgcctctgcacgagcgagtctttttgaatgagaattaatggccctaaatccatgtgtattctaaccaggttttataaaaccgtttgcccaccgaaatccgctccctagcgttttcgtgttggttatcataaacttagaaaaaaattatagaaatttcgcacttaaatttgtttttcttaatttggcaggcttactaagtggtttatcgatgcaaactggctcaagacaggtgatagtcatagtaactaggtgattgtcgattttttaatataataagaataatttcattaaaaatataactacgcccggtctctacatcaacccgaaatgcacacacagctagaaaagaaaaggaaaacaatctaagcaactatgaacgtatcatattgtttacatcaactcatacaaaacacaataatctagacaagaatataaagtgatacacatctactctgaaacaatgatttcaagaaggacctaatgcttgtctatcacagccataaaaaaacaggactagattttttttattgggagcttgagataacaccttcaataaagaaaataataaacaagcatcgacgctgtcgaatctagataaaccatattagggttttcacccagagtactaatgacgactctgggtgagcacgatctgctcacaattgatcgtagctgttgaactgattttagcaaccacgaatcttccttatcaaaatagaagtcgctacctgcgtacgtagtagcaaccaatgcctgatcaccaacaacacagaccaagcagtgatgatttgtagcacgttgggacaaagcgctactaggtaaatggaagaagccatcattgtaatgaactcccgaaaataggaataaaattatcaacgaacatatccaagtgtctcgcctggtatcatcatcgattagactagcaccactttatgggagggcaccatcgtggccttcattaggtaggcatatctcccttattggatcttgttcaaatcaatgcgatgaccttcgcggcgcttgtttgttaaactaaataaagcgatctgctggttgaaatagaggaccaacggtgaaggcctgaactatcggtcgatctccctactagtccacaccatggttttatctttccgatctacatccgccgcccaccactgctgatggctatagtagaggcggagcagatcggatgaggaggcgggctagggttggggagcctccccacgcaaggcaacccaagaggccgtcttttctattttttttttcttaaatgattctaactacttgatcgcccattggatcgtagtgtttggggaatcaaacaatataataatggatatatctttcctgagattatttcatgaattaggcatggtgacttttatacatagcttgtactggacgagattggttgaccaacctgttggtaattaaacgaattgtaagaacaagtgatcaattaactaagactgtagttagcctcgattaatggtcagatctgcatcaactaatggattattttttgaatactaatgtagtctttgtgcatagaacatcgtgatcacgagtactaagcatctaagccgccaaagttaatataagaagtaagctgctaatattctcgcatcccccgccaggtgttaactgccaataccctcatttatacaaatccatctaagcaacgtactacacgtgactagcactaggtgcgacaaacggtagcaacgtttttctagtttaagaaaatccgaggaacgcttaggggttctatagctagctccgcaaggtgatagattagcaggtctagttttgaagtctaaccccttttatttatttgataactagaaaaaatgcctatgcgttgcaacatgtgaagactattttaatcttattattattatatggtttagttaaggtaaaattcactaaaattcgattggatatatatatttttttaaaatcatgagctataattaggaatccgatcttctcaagttagcatgcaattctttttaaatagatttcttatacaactccttctatattttcaaaagcgaacaaacttaaaaactaactcaaatatgaatatgtatttccaaaagcgaacgaatttaaaaaccgactcatatacggatgacgtacctatcatgattacggataatacatacttcctatcctatgacctatgaaatatacggatacaacatacctttgtatgtacgatatacttctatatacaataaggaaattgataagagattatgaaaattatcctccggagcttcgattctcttatccttctggtcacttggaatagctttggaggtagcacaacgcgcgcttatgtctttgacaacatcttttccccagtctaggtgattgacgatattccaagagcggtcgaatattgctctccactggcaaccttcacataggggtgtatacatggatccacactccgtccattctataatatatggtatcctactttttttttatattaaggagaaaggaaaagaaactacgtacggtccttatttgtcacaccagtttgagatttgccatgaaagtgtcttttccacagtctaggtgattgacgatattccaagagcagtcgaatattgctctccactggcaacacataggggtgtatatatggatccacacgctccgt

SEQ ID NO: 97019 - DNA, 1322 bp, Oryza sativa
tgggcactctcgcagtccagcaaaaagctgcaggttaattttctctctgtggcgtgcaggcaaccgttgaaaattaaggctctgattgcttcattagaagataatgaaagctttctgaattcaacttcagggaggttcagattcagattagttgggaagctcacaaccaacgtgagctaacccaatcttgtactgtactcgtactggtatagaatggctgagtttcagactttcagtctgcagtccgagagagatgacttgtctgattggccgattcgtcgtagtacttcaccgttttttgcgccttatgaggaaacgtgcaggtttgcatggaatgattggtgagttagccatgaatgtggcactgaacaggaggggttaccaaagctgacgcaagagaattgctctcgttttattttcttaaatatatttttcagtcggtgtagttcgctggctttggtttgcaagcacatctcttcttcttctagcccatcttgcctagttgcatacttgaatgatttgcgttatagcttcaaaatattccttgaacgcaaattttgctataagacatctaaagtttgtataatttgttgatagatatagtaaaacatgtgccacggctgaagaatattcctaaatttggtagttcgcaacatttttgatccaaatgaagagagattcataaaacagatgagaatgcccccgcagcaacaagcttccatggtgttggaagataatttggaaattatgcaaccataaatcttccatcaaaccgaagtatgttccatcatcactccagcgtcagctgaagtatattccatcattgctccaacgtcaagttagaaacttttggctctaagggctttatcatctttttgaaatttttgtctcttcaattcggttgaaagtatcccctaacaaattaccagcttttcggagtgtcctctaaccttgacatttttttacgatgtccaccaaacaattacacaaattctgagtgtcttgtggcaaaatttgtcttcctaaaaaacaattattctctcttataataaatattttatgtttaggggcaatatttttttatatttctaacaattataatagtctttttcaaggaaaatctaagtataccaattttttttaaaaaagcacaagcatttaaaatttttatggaattttttaactggaaggagtatttcttctaaatgttgtgtaaatgtcagctagttgatatgaaggtgtcagcaaaaacatagcagttattttgaaactataagttctccatgtattaattggacagaaatctgcagtctgaccagaaa

SEQ ID NO: 97020 - DNA, 747 bp, Oryza sativa
ctttgacaatgttttatatttctgatgcttggttacatatacttgatggtcacatcacagtgactcaggaaccactccgcacactaactctctctctctctccattttctttttccctccaacaattggggaaccgctatattcagcaagaaggagcccaaatctagtgtcttcgctcttcatcgggtcgactcctgcctcctccttgactccctgtgtctctgtaagaccgacaccaccgaccttaatggcgaccataatgatagtgtgcatgacgagaggggacgagaaaaaagggtgacccatggaggataacttgagggtgcgattgcacatgcaaaggcggagatgagcaacgatggtggctcatggagaaagagcggtggtggcgatgcgtggagtgatagttgttggtggtacgaggagtttgttgtcgatacgatcgctaatcgagtttgttaatttttgatacgtgggcaactagtcattataaagaaatagctaattttaaagtagtaaaaatattgagataaatgtgagagtactcgtattaactttttgccacttttaagatatggtaattaaaaatttatcactcacagtttatgacacgtagggcctgtttggtacagctccaactcctcaatttaactccaggagttgggtctgggtctgttcattttgtgagagagctccacccagctccactcccagttttggtggagctgaaactgtttggctgagctc

SEQ ID NO: 97021 - DNA, 503 bp, Oryza sativa
ttatacaagtcctccttcgtaatttactccattcaaattagacatattactaacatatgtctaatttatactctctctccgtcctaaaatataagcatttgtaggatagtattaagtcaaacatttttaacttttaataattaataaaaaagattaatcatgtaaaatcgatgttactagatttatcattaaacgaattatcataatatgtaactctttttatttaaaacatcttatttttatagatattatatattgatcaaaatagtatctctaagactatatcgaagtctaaaatacttatattttagtacagaggagtttcgtatattttcagacggagagtaccagatgcgttcaggaagtcttgacattgcattgcatgtcgatagcatcgcatgtcgatagcagcttataaataggcaaccacggacaagacgagcttgcagctatctactgtagcaaccactgtaacgggtaccgagctcgaattcgccctatag

SEQ ID NO: 97022 - DNA, 684 bp, Oryza sativa
tcttttgatcaacaaacatatggaccttttcccttttttattatataaccagcacagccatctattctttatgtgattccttttgtcaaggccggctgaataaagatttctatctacacaagctagattcaacagcgatttctttatctatatataatcactcttggaggacaattgaattaatttaatgctacctgtttgtacaccacttaactaaagaaattgagagagagaatgaaggggtgaggtgttcttttgttgttttgctttgcacactaatgatatggttgatcataagaccaaggatagtgcgatcttctcaggtcgtgtgggcttgtcctggcacggctagaggctttgattagctagggtttgggcagaaaccttaccttttatagggataactcaagactgctgctatacacacccgtgggtatttttcatgtaaatagtagtttgaccctcaagaaggtcattactcttccgttcaggaatataaggtgtattttgactgtccaattttgaagagctttgacgaactattaatccaataatatttaggttttaccataagaaaaggatattattggattcatgtttgaaattactttcttatgactctgattttgacagtgtaaaagtaccttaaaaaacatctttaattttccagctaaatcagatcct

SEQ ID NO: 97023 - DNA, 1942 bp, Oryza sativa
ccaccacctcgaatcagctcatcgtcgctggctccaacgggttatgagggcatcgcatggggcaacacttctcccaacgtacaacgctcgctgttcctctccccctccctgaaaaatccctcatgaatattaataaggaactcgtgtctcatttgggatttccattcttcacttggtaatgggagaagcagatgtgatgtgaaatcttttatgtggcaagttgatgttgaatgacgtgaaatcttttatgtggcaagttgatgttgaatgacatctatatgcattgtaaaagcccttactaccattccttttgttccaaagtaaatgaattttaatttagaatttaaaatttatacaaatattgattttaatgcacgaaaatctatatatttttcagttgtttacggattgatatctaataatcaaaatttcaccattgagacaacgggaaaggaatctctctcttaatcttaatgtttttagtaaacaacctaaaaatgattgtattgtaaaaacagattgagtacgtagttactggttttgtatgatttgcctaaagaacatcatgatcacactcaattgggacgtagcaactcgatcaacatgctaattgggtttttgggtggaatcctatatacttatatagttatccccactaagtatagttaatgctatttctctcttctcttattaagccatatcacctcaattatttctagcctttggatgatagatctatggtccaaattgtctcttttttcttctctcttacaaacatgcaatctcaattatttttaggctcaaaattatataaaattgtttagttttgataatcaaattacatcttatttgtacatattatgcaacctaattttccgcagcaacgcgacgggttatttatctagtaaaaaactatttttctgtacaaggacctctttagattgcagacgaaccgtaactggtcgtgtttataaaaattatcctcctattttcgcgtgcagacccttaaaaggaccacacacaaaaatcgattttcgcatgcggacctcttaatggtccgcactaaaaaaataagtctatttttgtaggcggacctcttaaggggccgtgattttcgcatacgggtctcttaaggatccgcataaagcctaggttcccttatctttccttctcaacacttcaaatattttcatccatatcctctcatctcctctctgtcactttctcacctcttcttcgcacaatctcactatgcgttgctctcctctctcactctcctctcgcggtaggcagtgggcccggacgacggcaggcggagggctcggccggcggcggagggctcggtggcggtcagatccgcctttggcggccatgcgacgggcggcaggtggcgcggtcaacggcgaaggcggcggctcccttggccctcccgcgcggatctggcggcgggcttgagtgggaggccagcggcggctctcccctgccatcccacgcgctcatctggtgacgggctcgagcggaaggccagcggcagctctcccccgcccgtatccggcggcaggcgcgggatccggcctccacatgcgcggatccgctggcagcgacgacgggaggtgcggatccaccggcgacgatggtggcagcgaccggctagggttagggttaggtttttgtgttttggaattttttttttcgattttccattttcgtgagaaaaacttaagcgcccgcactcgaaaattcgattttcgtgtgcggatgcacgtaaaattgcgattttcgtagaccctttagtatgtgcagcagtgcgggtagccagccatgtcgcacgcgaaaaccccttatgggtcatctgaaaaaaaatcatttcttactagtggaagccagaagaccaatacgtatataggacgatactattactagtacgtctaggtgatctgca

SEQ ID NO: 97024 - DNA, 629 bp, Oryza sativa
cgtagagagaaagttatgcaaacctttttcaccctcgctttcatatcaactacttcctccgtttcacaatgtaagtcattctatcattttctatattcatatagttgttaataaatttagacataaatcatatagttgttaataaatctagaattattaacaactatatgaatgtgagaaatgctagcatgacttacatcgtgaaacagagtgagtatattttagagtaagaaccacgtgatttcatgtcctcgaaaaaaaaaagaagaaaatccacatgctaacatgccaagttcaaaagagacgtacacttgcacatacattacatttcttttctttagaaaacaacattactacattcttttcatatgccctatacattgctccaactcctgtgtagcgttgtttgctccgctagccaccacacacacacacacacacacaaattaaaagaagaaaaaaaaacgcctcaaaatgtactccctccataaagtaaatgtagttttataccgtttatgtctaacatttgaccgttcgtctttcttgaaatttttttatgagtaagattttttattattagataataaaatattaatagcactttatgtgtaactattttttaaaaaaaa

SEQ ID NO: 97025 - DNA, 525 bp, Oryza sativa
  unsure (1)..(525): unsure at all n locations
tgatacgggtgtctaagtttatattaggggtgcacacatggttaaaattggtgaggtatagctaaaaaattttcttgactggttcctgtgcaacccggcacccactcctatactctactgtgcacccactcctatactctacctccgtccctgattgtgggtgtctcaagtagcgagcatcaactttatagtaatattggatttgccaagcaaacattgacccggcccattaaatgtgtgctaattattgatttagccgtgcccttaatataggagaatgcccagcatcggttgaccgggggaggtgggaaaatcggtccctccccctcccccacgtgctcatctgttggacccacccacttgtccctctcctttttccaaaaagatgtttcacctagtgtatttacaatgtttcactatttatatatctaatgttgcagtgaattaaaatattttttacaacaaanaaacccacatattttggaaaccctctattaagggaatttggtttattttttgttccac

SEQ ID NO: 97026 - DNA, 671 bp, Oryza sativa
tgtcagcccttaagtgtctttgtaataatgtaaatattaccgatataataaggatgtgcctttgtatcatgtttgagtggtgtcctcggcttttcctgggacggggattaatacactagcgtttgggaaaaggtattttttccgggcgcgacatggccagagtaaacttattcgaatagtcgtgcccgcggttatggcagggtctaataatgtttagtttcatacctctcaccatattaaatgatgatgataatatttgtttagctcctggtttgaaatggtatattcctggtttggaggtagaactgtgtagccgggattggttgttcagaatggttgggcctatgcaacgggtatgttgtatagcgttggattaatactgtttaattaaatactttactattttattaaattctggagtatttattaaatgccatttatgcaaatgagactatattatgccattctttgttattccctgcacttgcatatattgctgcgtgactttgttgagtatggtcataatactcacccttgcaatcatttcatcagacgaagagttctacagtgatgctgaaggtgtggaggattaggtgtagccctggtcaagctgcttgtgggatggagtagtaagaaacgttcatcttatttttccgctgcatggattttta

SEQ ID NO: 97027 - DNA, 651 bp, Oryza sativa
cacatgctttgccctgacttttgcaccaatcatgcctctcggttaccctccagagaatgcagaatatcgatcgagcattccggctcctatgcagtcgtcaaagtattctctacagtatagttttctctcgctatccgaccgtacttgactatactagatctccttgctagtaatatgtcacagctcacaatgtcatgcatgtgagattttttcgatccaagggctagctagctctcctagctactccttccgttccaaagaaaaaaaaaaccccaattttaaatttaaaactggacacaacctaatcttgagtttaaacctgaacccaactcattgtgttcaggtttaaactcatgattgttttttttacggagggagtagctccgacaactattctatgagtgatactcgtgcgtttcattttaaacacaaccgtaagttttcgagttcaattttgatcggccatcttatttaaaattgtctttataaacagtattatttgttggtattagatgataaaacatgaatagtactctataagtgacttatgttgcttttaacttttttaaagattttagattttctcaaataagaccgacgacttgagttagacactgaaatctatagtttcgtttaaaatgggacggaggg

SEQ ID NO: 97028 - DNA, 1129 bp, Oryza sativa
gaatccatctctgactatccacatctcttccatcgtttctccttctctcatctctccttcatgcaggcctcatcggatcgtcctcaaaacgagagcgacgatgtccttggtgaatagcaggtgtgatggcctcggcatggacgaccagtgggagcggcagtgtcattggcaagcagcaggagtggcgtcgtcgtcggcgagcagcgggtgcggcgtcttcgacgtcgacgaggcattggagcagcgggagcggtggcgttttcgacgtcgatgtgcaacgagcagcggagcggcgatggccacggacttaggcccggcggcagcagcgaccccgacgagcagtggcctcgacctccgacaagcaacagcggcatcgccgcaatctcaacattctgttagtattggcgatgattttattgatctcatcgatctttgattttgatctgagtcttttttttggctcatcaattttttttcattgatggaaccgagttggacacaacgaactatgcacacggttcacacaacttgctcgggacatggaaacagacggacgaacggaaatttgttctttgcctcggcagccagattggatgctcgtcctttgaaaatttgtgacttttttttttggaacctttagtgcttacccgattggctctccatggctattatgaagatctttgggctgattcgatcacaaccggatttgccacatcgtgaggtgttgcaaattaaggtgaaagattagttttttttatggatttggtatttatttatgtgttttggcttgcacctttataatttttgtagcatcaaccttgtgtttgcattgtgttattcaacggattcgattatgtttttttttttaaaacaaaacaatggaaaactaattatggtaagtgtttatgtaagattggatgcttgggatttttgtccgtgtataataattataattaatgattgtttgaatggatttagattgatactttaattttgtgtcttgtaattcgtacataacgaaggctatcaccagggtcctgtttggatctcctggtaaaaattttcgccctgtcacatcgaatatttggatacatgcatgaagtattaaatataaacgaaaaaataacta

SEQ ID NO: 97029 - DNA, 578 bp, Oryza sativa
agatatatcttctatctgagttttcaattggtgataacaaagtatgcaaccaatcagttaaatcattactaaaagttcatttcagccctgcagtgcttatctttccaaaactgtgtaactgtactatgaattaagagatcatagtagagtatagcacactaacgctggttgaacttctctcttgtttacaacattactccaaaatcatcttcaagaagaatctaacatgctatacacacaggaactaaacctatctcaaagggaaaaaaaacaatgacaaggtcatccacaatttgtcaattttagttagtgtaactagtaccatgattcaatcaatagtaactgtgttgaaactagaaacgatatcatactctgtaagtcaaaactattcttgtgatgaaagcacatgaacgtataccattattcgcatatggcttgctaatgtgatggttcttggtacatcaaccatatctgtgcaatagtctaggttaattaggcaatgccaaagtgcttagaaagtaataattctatatctaaataatcaacttgtacttccagttccagtttttgctgacatg

SEQ ID NO: 97030 - DNA, 1086 bp, Oryza sativa
tatagggcgaattcgagctcggtaccctggtgctgaaaaatatcattgtatcaaaaaacaaaattatagtatatatgtgtcattgacgtgtaggttcagtcctcacgcgttattcttactagcataacactactaagttacaacggatttcttttaataaaaatagctcattgtatatattttttgaagcccataacaaattatttttattatctaatatattatatatgattatgttaattttgctgttactttttaggtgcctattgagctagagctcttaggatttgtgggggttaggaaataagcaaaatctctcgtttgtgtgtcctacaaagtggcaggttattactagaaaaaaaatgctcgtacgttgcaacggataaagattatttttatcttattattattatatggtttagttaaggtgaaattcactgtgagaattcgtttcgatatatatttttctagaaaatcataagctgcaattagaaatctggtcatctcaaattagcatgcgagctttttaaaaagacttcttatacgactctttctgtatttccaaaagtgaactaacttaaaacccgactcaaatacggatctgtatttttaaaagcgaacgaacttgaaaaccaactcatacacagatgacggaccaaaataccgacaaaaatatctttaattttttgtaatagtagagatagagattacagagtataactatagatggcgatgatatttgctattcgcgtgaaattacgattgtacttttttttgagttatttgtgtgttcatgggagtacttcctccaattgttgtcctgatggattcggtggataacagtggactccatgcaaccttctctctggatcctcaggagcacgtcgagcaagtcctcctcatcttccccggaggctctgttttcttggtgctccgcgataatggcgtccaagaacgcgaacacctcctcgcggggccgcctcatccggcgaggcatcctgctgacgaccatggcaaggcgcgacgacgggtacaggtccggcaagctcggcgtcacgaacagcttgatccctcgctcgagcatcg

SEQ ID NO: 97031 - DNA, 633 bp, Oryza sativa
cgggtgggttttgtggtgatttggcgggagggtgtgccagtggcacgggttcgcgccatgtgtaattatacttgaaatataatactactagtaataataaggattacaaatggttggctccaccatggtttgaatcttttgggattttcggatttaaggttaccccgagtacatgtaagaaattccactgtagccgaaaatctccacattgttcgaatttaacaggaagttgtaaatttcaagaatttgcacgatgtcggatactcactccgttgaaaattatagaggtgtattttgtgttgttacaatctctccggctatagccatttgtaaatggttctagctatttgctctcatgtacaattaagctgctatatctgtttgagaaaactaaccgctaaatgtcttattccgctatttaaaacattgttacgattaggctttgattaataattactttaaatggacataatttttgttgcataaaaataatgtcattatttagaattatttaagattatgttttttataattggtccacgtctcgtccaaacgaaataaaataaattaaatacgtcttattttcatggccggagggattactattttagacatcagagtaactgattttgg

SEQ ID NO: 97032 - DNA, 500 bp, Oryza sativa
aaaccaatggtaaatctgaacttatttaggctgcgttcgtttctccaacaagagttggatgaaattttggatactcatggcacgttttttaaattgctaaatggtgcgtttcgtgggaaaattatatatatataaaaattgctctaaaatattagattaatatatttttcaagtttgtaataattaaaacttaattaatcacacgttattatcacctcgttttgcgtaaaacacttaatctttatctttatctacagagattcaaacaccaccttaggtgatgttcttttctcctgaagatgaagattaagttttttacgcaaaacgatgtggtattaacgtatgattgattgaattttaattatcacaaactttaaaaatagattaatataatattttagagcaacttttaatataaagctttcgtatgaaacgcaccatttaatagtttttaaaaatatgtcacaaaaatcttaattttcatccaattgaagaaaaga

SEQ ID NO: 97033 - DNA, 544 bp, Oryza sativa
tttaagttcctttggtttaagaaatttaatactaaatccgattaaaaaatcttttaaagaaaaccttaacttacttaccttggaaaataaaagttggactccttgactgcttctattgattggtgccaccccaccggtttttttttttcttagtaaaaaaaaaatacggcgtactccgtattatgggtttgttcggtagcccaaattttacagccgtcttgctgcattggacaaccaattcgttcggctgcacacaaactattgctccctacacttgctagcttcaacatctataggttgtagctactattggctagctgcagccgctggttgtttgcgctgtagtaggtcttccgagttccgaataagagcatctccacggtctctctaaatttgactctctaaatgtctatttagccaactctccatttaatttagcaaatcaaactgtattttactccaacagcctctctattcatcctctctattctgagtctatgataattgggcccacatgtcagcttcgacacctccttctccctca

SEQ ID NO: 97034 - DNA, 595 bp, Oryza sativa
aaaaaacccgaggtgggccccccaccaccaaaaaaaaaaaaaaaaaaaaaaaaactgaagaaagaagagaggagaggaaagagagggaaatgttttgtaagaagagaacctcgcggggtggcatcagcccacgcaggccctcagcattcagtgtcattgagcatgtaggctgtgcaccacctgtgctacccatgagacgatcccaggtgcctgtggaacgcagagcaagaacaccactccctccctctccacctgcatttccatcttgatcatatggaggagaaagccttagtttaaagctagcctgtctttgacactttcctactccctgtcaatctccattttaaacaatgaaaggcccggtctcaggccataactttggcaggtaacagtgtaaggttagaatttaatgatgccatgtaagtttcatatatatgtatgtttagggttgccatctatgtaagacaactgaagattgttttttacttacactggtcataacaacttttaagaatccagttcaagtgagttgataaaaaggtcaagtccataatagcgcaggtggctcttagacaggaaggtggtgcacatatga

SEQ ID NO: 97035 - DNA, 656 bp, Oryza sativa
  unsure (1)..(656): unsure at all n locations
gatagaatcgcattactatatggcgaattccagctcggtacccatcagctggcaggatgccactttgtttcccatctctttctctgttttctcatctcttcttctgtgccactaccacgggtcnccnatcgggtaagtaagttgccgaaacctgagccaccgattactcactcctaccccattagatcatacaccggagctcgtaacaaccaagctccaagaccatggtgtcagaagatctctccatccacaaacaacccattctcaaacccaccgactcgcccaccaagctccaagaccaaatgtcagaaggttccagggatgtgatcattgttggcttccaagcacgatctagctgatctcagtcggaccgttgcggtggccacatcacgcatcacatccctggaacaactccagggcacgatgtcatcatcgtcgccacagataaaacaatttattagntncagcgggggaactttgtcttcccccccccagatgggtttgatcaattcaatncttttaaccttggctaggagtggagaaataatcttttaaaaacccnaacgggttcgtgttcgccngtggnnnaaatagaagggggggtggaaaaggttcaaccccnnnaaagagggggaggatgaggggaaggggacggg

SEQ ID NO: 97036 - DNA, 513 bp, Oryza sativa
tatagggcgaattcgagctcggtaccccttcgtattaatagagagttaaaatcactatactccctgtctctaagactctaacgtctcttccattccatggttatttcacatagatttagctcgatcgggaaaacacgaaactaggggttcggagtttcattttccgaacccccaccctacaggtttttttttccccaagaatcgccaaaatttaactctgaaatttgatccttctgctacgttcttgcagactagcagtttttcacacctggccctaaaaagcctctgaaaaaaatttctcataatttttcgcattgacttagtgcataaaaacgatgagaaaaggggttcgcgagaataaaactccgaaccccaccaacacttcttttcactctgaaccttctgttccgttcttgcagatccaacgatgcctgacaaaatgttcaggatggctgaaacgatgatgttcttaaacgatgagagagaaaaaaatgaaacataatcccagttaat

SEQ ID NO: 97037 - DNA, 667 bp, Oryza sativa
  unsure (1)..(667): unsure at all n locations
gttagagtacatatcactatacgccgaattcgagctcggtaccccaatggcttaagaaaaaaaattatgacggacgatgagcctggtgtacgtgtggtgtggatcgtgtgatcctacgtgcgccgtcggcgtcaatcaatggcggctaggctccgtcccataaaaaaacaatctaatacggtatgtgacaaatcttagtactgattagaagatttatggtattaaaatgtgttgcatcttttattggatttgtttttttatgggatggagagaatagttgagcagccttatatatacgtgccgtgcaatatttgttttctgtcaaaaacaaacttgtgcaatgtttcatatagacataagatacgggataaagtagagaagatattactatctttgtcctaaaatattataatctagaatgaaatttgattcatcctanggtttgtgttagannnnnnnnnnaaggggggnnnaanagggcccttgcccctcaggaagtttggatgcagtttcaactagaattcnctganggaagcaggtggccctcccatattcttccatttnnnnnnnncnatggttattnntattgnnnaagcgggtggtgaggtgttgtgtaaaannccttnnanntcccntttcncctttccaatgagagtgtgttatattt

SEQ ID NO: 97038 - DNA, 611 bp, Oryza sativa
  unsure (1)..(611): unsure at all n locations
agatagtaatcgcatctttataggccgaattcgagctcggtacccgttgcggcgtggtgccatgtggtgtcncacagtggcgatctttggcatggaggggtttatagatgaagaggagtaaaaaagagaggggagtgtgttgatnatgatgagatgagagagagtggctgtgtgcgggtgggttttgtggtgatttggcgggagggtgtggcagtggcacgggttcgcgccatgtgtaattatacggaaatataatactactagtaataataaggattacaaatggttggctccaccatggtttgaatcttttgggattttcggatttaaggttaccccgagtacatgtaagaaattccactgtagccgaaaatctccacattgttcgaatttaacaggaagttgtnaatttcaagaatgtgcacgaggggggagtctcacttgggtcaaaatatgnnnagttttagtgnggggggggggttcccccctgnaatgggattggtaatggttttacctattcccccctttcctctctttaaagggtgatatggaggagaaaaatttatngggtcccccccccttttgnnnttgtgggaggggaggggtggaac

SEQ ID NO: 97039 - DNA, 580 bp, Oryza sativa
  unsure (1)..(580): unsure at all n locations
atgtatctccnagagtagaacaactcattactatcngccgaattcnagctcggtacccagttgagggggatcaccttctggtgtgtgctctttgatccatgtactcttctttttattggttgnaactatgctctcttatttggggggtctcttaatttgcacaagtgatcacttgcatacaaatactcaccaataattatggaattggttagtacgtaataaatccataccgctagatttggtggtaaacttttgtaaaatttatgcaggaattgatggtcaaatttcgtagttgaggaccgtcaacagcgacgatggttacgatatataggagtaacatattttggtcgggtcatttctcccagaccccaattcggcgatgtcttcctcatcggaaaattcgtagcatcagtgtctttatgtagattgnnacgatgaccattctcattttaagtgggccaatagttcggnnccntgtggagnncnaannnccccccctgccaggtgtgtgttgggtagagtattnnttcttttcaattatattaggtgataggacttggataccaaaatctcccttcct

SEQ ID NO: 97040 - DNA, 567 bp, Oryza sativa
  unsure (1)..(567): unsure at all n locations
cggtgtatanatagtagagcaccctattactataggccgaattcnagctcggtaccccaatcaacctcaattaaagaaaaaggatccagaaggagaagacgtttggcttattccccagttgagctgcctgtgggagtggagctgaagccatcgctagactgttattccgctgctgttttcttttcttttgtaagtatgtaacgttattattatgatggatttgtatattaaattatcagtttgtgtacctcggctgattcctggacgaggattttatgcacaaattagttcggaaattntnagtgaatttccgggcgtggcacctcctcttctatcgcctctgtcctggcgggcttcttcctcctctatctccccatctcccctctcttcatctctctcccctctcctttctcttatgggggtgtgnnngtgaggggggggaaggnagggggaggggggggggggagccccagggggaagggagagggggagagccntgggggggggggggtgggggtggtgtgaagtaagncgtgaggggaggnnaaggtgttggccaccttcctt

SEQ ID NO: 97041 - DNA, 657 bp, Oryza sativa
  unsure (1)..(657): unsure at all n locations
tcgtgtttcttnngatagaatcacatttctatangccgaattcnagctcggtacccctattagacgtgaatgtctatttttttataaattttttatgacatttactagttggttttaatgaatcgtgaaaaggaagtttgtatgggtattatatgtcccctaactaggtctctttaggtgttgatatgatactccctccgtcctaaaatataagaaccttgtactggatgggacacnnnctnntnnnnnnnntctnctcngttntttntccaccttcttcttttttcgaatgccccggtatctatcactctctaatgtattggctcgctttgctccttccacaatctccactttgtggaaagtccttcccctttccttaccttaccgctccctttgttcagcatatacctgagttctctttctaggggaggnnnnnaagggncagggccgggacccctctcccctggggctccggggagggggggggggcccccccccccagagggggggggggggggggggggggtttttngccagttcggaagtattaataagagtatagcgcgcgcggcccccccnnaaaaaaaagtatgggaaatgtaaagatgatattaattataatttgcttataggcggagnatagaaggggaggcatga

SEQ ID NO: 97042 - DNA, 661 bp, Oryza sativa
  unsure (1)..(661): unsure at all n locations
cggttctnnaggtggagctctgatgacaacngcgcgaanccagctcctacccatgtgtttggtatttagactattcatcaatagcaaccacccaaagactttaactttctaaattgccttgcactaccataatcagggggaattgnaangnggctgcatagctctaattaaagttcaaagcctacgatttctgagaagaatacttcaaattaccccaaatgtattcccagacatctctatcatgagacagattcacatcatttaaaatgactaacaaatagttcagctcttgaaaagcttaatgagagacgggtaaatgaaagttatcctcaatatacgtaaagagaaagttatgcaaacctttttcaccctcgctttcatatcaactacttcctccgtttcacaatgtaagtcattctatgagtggctatanngatagtacnngtaagaaacccaccactccgnnagctctagacggggggagggggcccccccccccaagggggaaaaaaaaaaaaaataaaaaaannnnnaggtgactacacanctagtttattttagaggngtttcccccnnccagaatgaanagaaannntagaagttataagaggagaggggncgaggggagtggnnccggctcgagggaatggattaggtgcag

SEQ ID NO: 97043 - DNA, 673 bp, Oryza sativa
  unsure (1)..(673): unsure at all n locations
cccgctattnagatgagagcgacctattcactatacgccgaattctagctccgtaccccttttgtaaacatattctatctatataagctatctactataaccaatcggatatacatgccatatgggtatgcggtacccataatctttccaatttcattctagctctgcccctgtctacaatgtgggtcttaaaagacccataaagttccttatgatgaaccttatacattgtgagacttaaccatgaggcattgaatattaagattgaccttaagcttgtggctcacctttaggaataaaataattggataaataaactgcacacgtagcgagtgagagaataataacaaggctctgtcataaaaaacgtgccatttcttaaaaatggttggagaaaacaacggaagaaaaaataacttagtttataaaaacaagccgcttcgaaaaaaccataaagaaaaaaaaaccgttgttaaagtaggagggtaaaggaaaccctccccccagggtttnagtgggaggggggggagagggaatnnntcnnttgtggtggtcgcggtaatattgaacccactttttttttaaaaaaaaaattannaannnctgtagtttttgtataattatttgccaanaanatgaatannntccttcttctaatggacccaagcgtttt

SEQ ID NO: 97044 - DNA, 658 bp, Oryza sativa
  unsure (1)..(658): unsure at all n locations
gctgttannagatagtatcacatgtctatangccgaattcnanctcggtacccattaaccaaggtagcacatatctagccaagttattgcaccaaaatattaaattatcaaattcttgtattaaagngcacccacttgctaaggtattgcactttagacgtcacattcttcttgtcctaaatagaacccacgtatcaacgtgttgtactgtgggtgtaatttactcttttgataaagtaaaaaactgaacttatacatatatagcaatgctatcttaccaatatttggtaactttacggcttactcggtttggaggaatttgaatccataggaataggaaaaatgaaggaatataaatgtttgtacacatcaatctattggaatttttctaagagatttgactggatggaataattcttatgtttcctctatataacttgtagaaaaggaattttntatntttagnancctaagggaggagtaagagggagagcctcnncaggtataacgttttttcttgttttanccanaaagancagctagtggtgcacgatgcatcanttttgaaggagaaccttcaagccgcnnacannnntagcagagtgggtgttgagtctagataaacctttcccnntttancataaggttgttttagagg

SEQ ID NO: 97045 - DNA, 661 bp, Oryza sativa
  unsure (1)..(661): unsure at all n locations
cgtgtttnnagtgagatcacatntctatangccgaattcnagcttcngtacccctatcaaagagacgtagaggatatatatcgatgaaggagatattctgaccagaattaccggaaatggaaggaaaaaagggccaattgcgtgtttgccactagtttgaaccggtatcgtggatttgccactgtaaaaagtgtaattgcatatttgccatcaaaatggttggaattcaatatacttgctattggactgacagtttaaataaacaccattaaaaaattggtttttatgaaaattaagacaagaataccccttcccatgaaattgaaagattaacacatcatatgattcattcaaaatcttgcaattgacaacccttactacacaacagaacattgctacgaggtcacaaaatcttcctagcaattcctgctgctagtgatgtagtatgtgttggctttgnttgtgagcnccaaggggggaaataggaagaggggnnnnncgggggggtgaggaagatgggtgtggntgcnntttgagagnnaagaanaagggggattggttataggtaatgttattcccnncnncnncttaggggnaatttnnaaaatttctttttttttttttttttcactcccctgtttgttttgtttgtttgtttttt

SEQ ID NO: 97046 - DNA, 637 bp, Oryza sativa
  unsure (1)..(637): unsure at all n locations
gggtanatttgatcgttacttaggcgaattcactcgtcccactagagtaggtggtgttcaaaacaaatgttaccttcaactttttaattgtacctaaaatgggacggattatttgggcgtgaatgggggaggattaactatatgttggaaaatagatttatttaatattttaaaatacttttaaataattttttttcacaaaatatgtcgtttaacagttaagaacatgctcgtgataaacgaggaagtcatgctgataaaaactcaacctaagctgattaataaccattttaggacctgttgaccaaggttagcagtaggggaacaaaaatagtgtattcaaacttagtggaagctacagcacttagcaactactgttacaaccgctattgacttactgcgcttaaataatacaagatgggtaccccgcgtgttgctaagggagaatngngtnataaggaaananannaancccaccccccccaggggtacgatacgagnntnnnangnngaagggtgttagtggagggcttnataattatctatanntcataaanaaaggtttgtttnnnnnnncagatgggggagggggaagtaatcccttgataaatnnaaaaannaagggcgtatttgtaaa

SEQ ID NO: 97047 - DNA, 565 bp, Oryza sativa
  unsure (1)..(565): unsure at all n locations
attgttgaatcgattactatgggcgaattcnagctcggtacccccgtttttctgtttacgaatgtttctttaatttctaacagaccaaatttggctattttttataagaaatattttggatactttaaatgatcatggcatcttttaacttttaattatacgttctatttgtatcattacgttatttatgcatgattaaaatcacaaattaaaatttgatacacctgttgactataattgcacttgtaaaaattgcattcattttattttgaccctttgcaagtcgttcaaacatagtaccacataaagagttgaaataccctagcccgtttaatccatttattctttacaaacactctcaagccaccacatggcactctaaaaaatagagaaattccaagaaattctaagaacaaanaaaatatttatcccattattttaacttaagtcggtggacgnnntaagggggagggaggaggaganncaaggagagagggagggtggggaccgttttccccnnnaagaccaccaggtccggtagttatatgacaggcagcttaaattc

SEQ ID NO: 97048 - DNA, 609 bp, Oryza sativa
atggctaattatagactaattaggctcaaaagattcgtctcgcgattttcttccctaactgtgtaattagtttttcttttaatctacatttaatgctccgtgtatgtgtctaaagattcaatatgatgttttcgggaaaaactttttggaaactagactgggcctcactggtgcgcaccactgcaatcacaacctcagacataccacaaaaggaaaagacaatgttgcaagaacaggctgttgttgctgtgattgccagttactactactatctcacacaggcccaagtcaggcatcttgtttcccttgcaagctacacctaatgatcaacaccaccacttaatcacactactcaaaagcaaagatcagaattaccatagtagtagtagtcacataatccatcagcaaagctgaaaaaagcattaacacacactgttaagcatcagacagaaagaaagaagcaaagctaacgaacccaaagaattttgttttgccaaagaagggcagaaaaacagcacagtacagaataaccaaccgtcctggaattccattgtttgtctactgtctctacctaagaacatcatgaatgcactcactacacactagtac

SEQ ID NO: 97049 - DNA, 649 bp, Oryza sativa
cacggtacccgggtatccaacgataagctttgggccgcacctcatggggtgggtcgagtgtcctaggcccatgcgacgtacttgtaaataaagaaagagagattccctagataagatataaatcttagggatcctgcatatcttttatagatatagaatagagagatttgtagatacttttcttgtaaccctccccctcatcctatataagagggggcaggggtcccgagagaggaggtcggatcatctccacaacccgacatatcttctttttttggcttctcagttcatttttccacatagggaccgagaaaaacacactggattttgggcactggatattggggattattttttttcaagggccctgaccatcattaacacctacggtaccatctttgtttaaatttgcgcaccccattaaatatatggccagtcataaaaatcgaccaccttgcttaagggccttatatggtcaagcgatcccacggtgaggtaagaatattttattttatagcatagaccagaaagagagaagaaacagaaaaaaaaaaacgtccgagcggttaggtagcagcggtgagcacacgcggcagtcctctcgtacagaaagccgcactactgggtcagaacagctccatctttataa

SEQ ID NO: 97050 - DNA, 654 bp, Oryza sativa
gtttttaggggcatggctacatcgatgcgggatctatatgttttaagacattacatatatacttcatccattagagatgcattcttatcatattaagtatggtatatttatactatttatacatgtgaaaataagtgatgaataccgggttatgtagtgtagatgaattttttagtgtattaataatgtatcatttgttttagtggtactaatacagcttcattattaaaagttcacataactcttaaaacgatgttagtaaacaatgatagtaagtagtaatgacaaacatcccgtttatatatgatcaggataaatggatttttatttaaatctaagagacatttttatcacattagtagtatattaaaatctaccatctattttatggtaaatatatttattttttattgtaggatgatctaaattctcttacactatatatatatatatagtgatgtatgattctttttagcattttttttaataacaaataagatggctgtgcatttatgcgaaattcctttccgatttatattctgaaaatgttctatagtttatattccgttgttatagtgtttgaaacaatacatgcatgcacgaatgcgtgggctatctttttagtttatagttaaaaatgtttatattttgaga

SEQ ID NO: 97051 - DNA, 809 bp, Oryza sativa
ggccaggtgggtcgccacgtgaaggggggtgtgctcttgcctctcgcttacgcactcgctctccatttctctcctttgcgtccggcttaattaaagcgggtttttcctccttattcttggctcttgtttttttttcttatcaacctaacacatttcttttttttccaagctgtattgaggttgctgacagctttgcctttcaattttacttaagttcatgaatcatatatcatattttttgcatgaagaaatttaggtgtagtttggtcagctataatgtcacgattggcagtggtgtgttagcacattattcatctggtctcgccactagcgtgaaacaaaactaacatagcggttcactgtttatgtggtctcgccacctgcatcaaacaaaactttcttggccgtttattgtctgtgcaatcccgtcatctacatgacacgaaacacttaatttcagaaagcagaagaaaaggtttattttcggtttttgttagagaggtccagtcgagaaacagcacacacaactattaccagaagcaacattactactactaataggaaaataaaaccaccaagtaatatggaagaaataatatttgaaaatatgccaacagcaacgacaagtaaagcaggaacaggagctggtgagtggggcccccagggggcgtgcctgcgtagcgtctgtctccgcgccagctgtcgtgcgggccccacccgggttcggctgcctttcttttctgctgccgtcgctacggacggtccggatcttgctacaccgaaccaaaccgatcccatcacccttaaac

SEQ ID NO: 97052 - DNA, 680 bp, Oryza sativa
agacccctgttccccgcatcaccttccttggaggccctcgcacccttagcactgctcgcaagagcacacgacctccgggcaagaggcccaagccagatccaggggccactacctctgagccgtggggactcaggtttgcgcgtgccagtgaccaccctctacctgccccgggatcctgcggatggctggaggactagactgacggactccttgaagcttcgatctcgtatcagatggtttttggataatatgcgagacaccccctcccttacctagattgacgagtagtttgatgattagttcgttgtatcttttggatgaaccttatttggactgcgtatgtatgcagtcgattgcatcatgattcatgtaccatttgtgaaactctgtgatgttatttatgatatctattgttgttgtattataaatgagtttattccaccatgcttgcaaaacaaagttcatatcaacataactcccttaatgggataaagccataggagctagttagaaaattaggatacttactccatcaacctacacagatggcaagccgacgttgggcaacaaccagcaatgacgaaactcagacacccgacttaaccactctggccggagttatggccacccaaactcaacttctgcaagctatcgcgaacaaccaaggcaaccgcggaggg

SEQ ID NO: 97053 - DNA, 707 bp, Oryza sativa
ctatgggcgaattcgagctcggtaccctttcttcatattttttacatatttattatcctattattagagtttgaaaaaaaaatttttttattaaataattcagcaattataacacctaaatcaaacaactaatatttatccgcttatatctttaaaattatttatgattaaatcttcagctaaagaccaaatttccacaataatttaactttgaggaaaagatgtcattttggattataattttagacttttgcatgccattcaataaattgtaaaaatatgaaataataacaatattatacacttcataataattaaatgatatctacaatcataaacgtaaaataaaaataactatgagtaatgttcccaaaatatttagttagaaagcaagagttatgctaaaaaataagcagctataccataaatcatgggatcccctaaatcatacaagtaatatttttcttatgtcttttgattattttacatttaaagacccatatttggggttatattttctgacttttgcatgtcattcaaacaattataaaattatgaaaaataatgatatatggtttatcattggatataaggtcacaataaagtaatgaccaaagttaaggaaacctaataacactgactattggtgcaaaaaaattacttctcccattcggatagttaataaatcaataataaattagtagatt

SEQ ID NO: 97054 - DNA, 586 bp, Oryza sativa
atctaaaccctcgcaactgtctgccaccacatccgagcggccgcatcctggtgaacgcagaacatcgaagggagaaacgggagcgaggggaagcgacctggagcacggaggggcgtgcggggaggatcaggaggaagggaagcttgcggcttccatttgacatctggaggtgcggagaacgagagagagacgagaggaatacgcgagagagaggaatacgcgagagagaggtggcaattccgggaaggggaagagataagggccttgtttggatcctccgggctattaaatagccctccggaatcttacgatttaggagtattaaacgtaaattactgacaaaacccattccataacccctaagctattttacgagacgaatctaacgatgtatattaatccatggttaacatatgattattgtagcatcactgtagcaaatcgcggattaatatacctcgttagattcgtctagcaaaatagcccaagggttatggaatgggttttgtcagtaatctatatttaatactccttaatagcaagaatccggagggctatttaatagatcggaggattcaaaccaggc

SEQ ID NO: 97055 - DNA, 725 bp, Oryza sativa
aattctaaatgaaaaggggcacttttccattctcagatatacttatcaccatttctttttacaaaaaaagatacttaccagctaccaccagactatatatttgcatccaaactttatagctaaattttattaatgaggttacgaatattttaaatataattgttgaagtctgttgcacgatatagcggtatagctatatacacaaaccttacttaggccccgttcggtagtgctccaaactccaactccagtgggagctggtgttgacggtccttaaatcataatatatgaccgtcagtacttgcatataatgaaataaaacatggtatccaacttagtggtaggtattattactaatcatttccactagtgttggtgaaatatgtgtatgcaggtaatttgaggtgaaaacacatccgtgatatgacaaaatgcacctctgcacatccaagacacgtttacacggattagaggccccataagtcaataaaaaccatttagaattgggccaaaacatagtgcaggttattagaggcccattaagcaacctaccagccaaaggagaggccgggaggacactttttgggttcggccgaaccaaccagttcggccaaacccgttatgcgacctttcaccgtctgcttccacgtggacggcttggattcctcccctatggcagttgcagggtgttttggtcatttcccatacccctaaccgtcatttgg

SEQ ID NO: 97056 - DNA, 509 bp, Oryza sativa
catgccttgaggaatggaattttactagctgaggtcacaagtggatgaatcatcactaagttagattgtatcgaagtcatcacaatgatgcaaaatggagggttctcgacgacagcagctgcggcgatctataatgaatgtgtggttctttctgaagcttctacattggtaactcttgtttactgtcctagagaggctaatttagtttctcacgagcttgctagagcagcctggcttaatccaccatctatttggttggaggagccagtagcttcaattaagcggttagtgagcgatgtaactgctctttgatctaataaagttatgagagttttccttttctaaaaaaggacggctcgtaaggtaaaaaggttacgtgaaaagcacatcaatgttgctgtggttgcagcaccggtgccacacgctcctcatcagcatgtgtgggcaccgccaggccagaccgttctgtacagctagcgtactggctttctccccttcccttccatggc

SEQ ID NO: 97057 - DNA, 3172 bp, Oryza sativa
ccattatatacaaaacctaagggtgtatgtggctaacccacaaatccacttataagttaaatatgggttagccatttacacgtaaaaaatctttatgtgtggtacattgcacctgatgtatataatagacagaaatatattttttgctactcgttccatcctaaaatatagcaccgtctgaccggattagacacatatcctagttttacaaattagacagaggttgcatcttatattttttcagatgaaggtagcaatagatttttaaacatatggtgcatgctctatcatgtacattttagaagggagaagaaaaaggaggtgccccttatctaagagagaacctacacaaacttcaagggataaagaaagataaccatcgatccagagcgaaagaatactagtagtgtgttgttaatggtactcctatacgaatacaagtgattctagttatacactgcacaaatacgaatatccagtatttgtgaataaagatggtatattctattagtaagcatatatgtgatgtggataaaattagaggtatcaatgaccactataactaaacatgttctaatgatgggtctcattttcttagaactcatgtgcaaccaccgactattcatgacatgtataccataaatctgctttatagacatttttgtgaatgtggaagggagagaaggggaagagagtcaaacccttagcttatcatcgactcttgtcacaagatataaatttaccttgctgcaactagttgttggaagggacaaagggtaaaatattttttttggtggtttaatatttaaagcctatgttatctgatgcagaggattagtcacaacatatataacatgttacttagggcatgtgccaggtttaattgttgaacatgcccttagcagctcactcaccctctctctctcctcacttttattctcaagctagacatccatcacacattcccttttttatacttattctcacttgtattgtacttgctactataatcatatgactcgtgaactaccgagaaaaaaataactccgcaacatcaactttttttaggtttagaggagagaaggccaaaagaaaaaaacagtaggaaatttagccacctgaacctgaagccccagcccagtctttttgcccctggatattaagtttgcattttataccataccaaaatagacatgctaaacaacatgcacatgatttttggaggttacaacatgtgaattttccttacctcctaacttatgacaagatccactctttcatcccttctccactcgcggcagcaacggatcttgatccactctttcaccccttcttctccacttcaggcaataacgcccgtggtgatagaattaagggcaacgaattagggttcgagataggggtaggaaaggttgttttggaggaatcataaaatggggagttctctagacttaggggaagtcaccagtggttgaggcggctcagtagtgggccgaagaataagaagttcggaggaagagggcggcatatgcagatctagtgaaaaggagccatcggaaaggggaaagaagcacagggcggggcggggcaggggcactcgccggagtggacgcagtagtggatccggagcagagtggtgatgtatttgtgggggtgggggggatggcggcgggatgaagccaacaagacagaaggcttgcagcccacctaggtaggatggtggcggcgtacaatgtgcaagaaagggtattggaggcttggaggctgagggtagttgatctatttaatagggtttgcaaggaaggctgagggtagttgatctatttaatagggtttgcaaggaaagatttggcccatcgcttttcaatccaatgggtacaaaatcgatcgcgtgttttaggggctaaaaacttgcaaacgatggttacacagtccctatatcaaaaatacaataggagtctatatgccacgtaaagaagttggcatgtatgtacatcacgaatcagtttccatctaggattcaagaaactaaccaatatttctagtttgtatttattatctcatcgccattaattaatagataatactaaaaaggttgtccgaaaccagtttgaacttggtgaaaggcataaaggtaaatgaacttttccttgaagaaaattaacagccatgatttttctctttttttattactatatataatatgggagctcctaacattttttttatgaatgtgagaatttctttcttttaagaccaccagtccaaatttctttaagagattaagaaggaagtatataacctacctttaatttcttatgcgactggctaaatgcccatgatttgctatggataaaggaaaaaataccacagtattttctaaaataaataaatcatatttaccatgaaatatgttacccacatttttcctataggaaaatgtggatatccacattagttttatatgtggctattcttttatatttaactataatagaaaaaagtttaaagggtaatatgtaagaattgcaacaggaataggtgggatggcagattctccgtcggtatacatatgcataaaagactatgatgcacctaatctggagaatgagaagatggttgagggtaggactgagtaaaaattaaatgaagggcggttaagtgagacaaaatccataatttgaaaccttgtatcccttatactccaaccacgaaacaatgaaggttaacattttgtatatcttttccttttttttgcaggatcataaagtaaaataaaacaaaggtcatgtgcatatttgatagaaaaaagtacgaattacccccctccccccccccccaacgaactatcgcggtagaccgtattagcccactgaacctgaaaactagacatcgttcaccctaaacttttaataccagacaaattatcccctcgacccaatccagaatggttttgtcctacatgatgtacgcgtgacagtccagtcagcattctatttattaaaaaaatgtaggatccgtctatcgtactcctcttctactcttcctctctctctcactctttctctctctcttctctctctcctctctctcactctctctctctctcactcttcctctctatctctcgtgggtcggcggcaagcgggcggacatagagtggtggcggcgg

SEQ ID NO: 97058 - DNA, 532 bp, Oryza sativa
gggtcggggataaggaggcgtggagattcgtgcggagatctctgcatcggctgaggtgtccgccgtcagcagtggtattcgtatccaacgtttaaccgtccgtcttatttaaaaaatttatagaaatttttttttaaaaaatagttacacataaagtgctattaatattttattatctaataataaaaaatactaatcataaaaaaatttcaagaaagacgaacggtcaaatgttagacataaacggtataaaactacatttactttatggagggagtacattttgaggcgtttttttttcttcttttaatttgtgtgtgtgtgtgtgtgtgtggtggctagcggagcaaacaacgctacacaggagttggagcaatgtatagggcatatgaaaagaatgtagtaatgttgttttctaaagaaaagaaatgtaatgtatgtgcaagtgtacgtctcttttgaacttggcatgttagcatgtggattttcttcttttttttttcgaggacatgaaatcacgtggttcttactc

SEQ ID NO: 97059 - DNA, 535 bp, Oryza sativa
  unsure (1)..(535): unsure at all n locations
cctgcagcctcagtgagcgtacgtcgcnntnttgggtcacccacccacttacgccgaattcnancctcgtaccccttaattttgtttaagaaagtaccatgctcaaaacacgtagataaccaaaggtcctccgtcatcaaacctagtaacccgtcagcgggatatgtatctttatcacatactggattaaaaaagactcttcggtcacaaaagcaattgccatttactaaccatctgaaatgtaccattgtgtatacagttatgaaatgtcatgccgtttagcagttaactacaccttggtatcaaaatatagtaatttttaactatatgtctgaaatgcttgtctagataaatagctataaattactatattttgaaacagagggaataacattttgctttgggcaaaactgtcagcctgataaaacaaaattaatacttccaatgacatgacaggaaggatttttgagtttctaagcaataaggaaagtnnnaatgagggaaagagacaagnnnnaanagctgaaaccccccc

SEQ ID NO: 97060 - DNA, 522 bp, Oryza sativa
  unsure (1)..(522): unsure at all n locations
agccttcggtctcttatccccggtcacgtgcgctcggcccaagtcagcccaggccaagccgcccctcctcctctctctcagccgccgacatatggggcccacatggcggggtcttctccttcctccagccgctcggccgagtccgagccgctgcgcctctctgccaaattcgctggcgaccatgatgtcccaagccgcagccggtgatgatgtcatgctgacgtcataaagccccttttcccttctaaaaataaatcttaattgtgtcataaatcataaatccttttctgtataaggttaaaatcagattaatcttaaaaaatccatttctaattcattgtaaatcagattaatgtgtttcaagttgcaaaagtgtataaaataaagatctatatattaaaattatatataaattgctgggaggggaggggggggggcttgnagaggggggggganatttnaaggggaggcgtgggaagggnttttcagtaaaggatgatgaaggcaaaatgagggccggtc

SEQ ID NO: 97061 - DNA, 569 bp, Oryza sativa
  unsure (1)..(569): unsure at all n locations
atacgtttatgtttttttgaagggattaaggagagggcaataaaattaaatgggagggttgtgttttatttttgtttttgataggaactgtgaaggttatggttgattaagataaagaagtatatgatgaaattaaatagaaaatggttgtagttggttgagatgaaggaatatgtgaagtaggataaattatatatattaaaggtagctatattttgagatgaagggagtagggccttgtttaactggggaaaatttttgggtttggttgtcacatcggatatacggacacacatttgaagtattaaacgtagagattccgttaggaaactgcgagacgaatttattaagcctaattaatccatcaatagcaaatgtttactgttgaatcataangngagnnaaggnnnnttntgggggggagggggggagggggcnnnnnttaggttgggggggtgtgatnaactttttggctgtttggnaaggaggagtgatggttgcaattctaagaacnaaaangttngnnaaaagggaaaaatattggagttttttaaaaaaaaaaaaggggg

SEQ ID NO: 97062 - DNA, 517 bp, Oryza sativa
  unsure (1)..(517): unsure at all n locations
aattgtaaatgaaaaggggcacttttccattctcagatatacttatcaccattttttttttacaaaaaaagatacttaccanctacgaccaggctatatatttgcatccgaactttatagctaaattttattaatgaggttacgaatattttaaatataattgttgaagtctgttgcacgatatagcggtatagctatatacacaaaccttacttannccccgttcggtagtgctccaaactccaactccagtgggagctggtgttgacggtccttaaatcataatatatgaccgtcagtacttgcatataatgaaataaaacatggtatccaacttagtgggaggtattattactaatcatttccactaggnnnggggaaagatgggaggnaggggnagncgggngnaaaagccgtagggaggagtgagggaggggggtttnaggggtttgntttttttttttttntttnnnnnnntttnaagcccccaggagaaattanattttatccttaatat

SEQ ID NO: 97063 - DNA, 673 bp, Oryza sativa
  unsure (1)..(673): unsure at all n locations
cggggctnnttggtgaactgactacgacttannncnaattcnanctcngtacccnttacaaaatcaggttattgtctgaacatgcacttgaaatatatttaaattcagtgtggaaacatgctctagaaatatttctagggggagggggtgaacagactttggcgggtgttgttttctcccaaggtgccttgcacgtgcacgattactagtttattaaaaggactgggctcgtatagccaatcttacaggacaaccccttttgggtggaagcagatcctctgacatgcagttgagtcactgatatgtgggtcctactttgctatggcccacacgtcagtgactcaactgcacagcagttaagtcacagaatctctttcccttttgggtacagagaacatacataaaagtcctgaatttagcaaacgactatnnaaaatctctgagcttgaagtcaccgctcctaggaagctcccagggggggaggggggaggggtcgccccccccaagggggagggagagtggttntatannnnncccnnnaagggctgggagtaatcatggtcatagctgtttcctgggggaaatcttcaagcgccnncnnnngaggggagggtgggagggggggggggagntgnnagggcctggnnncttttttntttntcataaggagaca

SEQ ID NO: 97064 - DNA, 579 bp, Oryza sativa
  unsure (1)..(579): unsure at all n locations
cttgctacatacgctgcttgtcatttcataaagcgttgtcaagttttgttaccctagtgaaatgcttttcatactttcatgggggaggtcacacacaccccacatacacgcacatatgcttgacttatacactggaagttagcattcctcatttgtcattcatttcatccatagtccacaaaataaatactccatgtcatttgtgcctcttcctccaaagttctttaaaaaaaagagagagagagaggggcatggctatgaaaaaaaagtgctcatacaagtatggagcatgatgatgagaaaaaaaaaagaaaaaaaagatngccatgcactcttccaaatttaaaaaagaaaataaatggangaggaggcatacaaaaggagttattttcattttcctttttccacttacaaaactannatacacatacaccttccccnccaggaccaaaaaagatgtcttggatttncgtgnnttgcttattttagtttgcaatatatgtgaatcaagcaatgctttactcttttcatncccnnnnaaaagatgaacctgaataaatgnanaaaaaaaaaggcccc

SEQ ID NO: 97065 - DNA, 577 bp, Oryza sativa
ccaattaccagtacataaaagtaaccaacatgtagatcatgattttagatgattttaaagacttgaacggcctcattctgacttcatatgaattagtcataaattttccaggatttaattcaattaaacctatttaaaaaagattaaataaatttataacacaatttatatataattttaatatatagatctttattttatacacttttgcaacttgaaacacattaatctgatttacaatgaattagaaatggattttttaagattaatctgattttacccttatacagaaaaggatttatgatttatgacacaattaagatttatttttagaagggaaaaggggctttatgacgtcagcatgacatcatcaccggctgcggcttgggacatcatggtcgccagcgaatttggcagagaggcgcagcggctcggactcggccgagcggctggaggaaggagaagaccccgacatgtgggccccatatgtcggcggctgagagagaggaggaggggcggcttggcctgggctgacttgggccgagcgcacgtgaccggggataagagagggaaggct

SEQ ID NO: 97066 - DNA, 532 bp, Oryza sativa
attgggatgggattcattttttggtccattttttaccattgaatggtgagcagtacttccttgttgattcctgactcccatctgaacacagaggacttggagctgctacattacgttgacagcgactatgctttcacctcccgccttcgtcacggctacttagcaggaaggtcttcccatggtgctcgatcacatcgccgcctccgcgcacttgctctttccccgacggtcgatgctggcaccgtgccgctccacctcaggcagagaagattagatcgcctccacggctccgccattccgaatccggccagttctgcaaatgaggctgctgacatcatcgatccgccatctcgcacagcttgatgggcatcatcgctcgcctttgcctcatgacctttccgttgccaactatcgaagctgcctaaatttactagcaggttaataaattcatctgggtttctttgctaatcatctttacctaatatatattggatctaattctttggtgctttgggtatattattggattttc

SEQ ID NO: 97067 - DNA, 607 bp, Oryza sativa
gcgacgagccaggctaaccccaccagcgccgcgcggcgatgccggtggagatgatctatgatgtgaaaactcgcccatcttccgcttgttcctcacccagaggcggcgcttcgcttcctccaacaataggtaagtgatgccccgcccctcccctcattccttcttccagaaccataatcttttgcttccgcaatgccctattgcttcaaaactcaaaaatccttcctgtcatgtcattggaagtattaattttgttttatcaggctgacagttttgcccaaagcaaaatgttactccctctgtttcaaaatatagtaatttatagctatttatctagacaagcatttcagacatatagctaaaaattactatattttgataccaaggtgtagttaactgctaaacggcatgacatttcataactgtatacacaatggtacatttcagatggttagtaaatggcaattgcttttgtgaccgaagagtcttttttaatacagtatgtgataaagatgaatataccgctgacgggttactaggtttgatgacgggggacctttggttatctacgtgttttgagcatcgtacattcttaaaaaaaattaag

SEQ ID NO: 97068 - DNA, 627 bp, Oryza sativa
gccataacacgatcaaaaacaacaagcgatcgaatgatacgggggagtcgagtacgcaccaccacctcctgatcgggcttctccttgtcaaacttggagcacgaggacttgttgatgatgtcgctggccatcttgtcgtgcggagaggagagtttatcaccatctgcgccgtgctcggccgccgccgaggacgacgccgaggtcgcggaggcgcagtccatggccgtgggcacccccacctgcggtgccccagacagcgtcgtgccgtgggtggtcatcatctcgacgcccccggaggactcggcgggacggggcgacgacgccggggtggaggaggaagccgccgcggcgtccatggcgcccttgggctcttccgcttcagtagttaagtcccgcttgccctgcaatcgagagagacatcaggaacacacacccgtgagtcgtgagcgtagttggtgccggagaaggagaaacgagggacggcgtacgaggtcgtggcggggaggcattgggcggcggcgccgccgcggcggaggagcagcccgacacggcggattctggaaggttcggcgtggggaggaagacggcttcgcggggaaatgaccagccgctccgcttttttttttt

SEQ ID NO: 97069 - DNA, 1414 bp, Oryza sativa
acaacaatcaaatacgcgcaacaaaatgtactattcatgtctgctaatggattccaatcacgctaggggctaaggtttcttaatctttctattgtcaacgtggcctatttaggagttaaccaacatagcatttatgggatacatatatatttggctaatcggtggtttagtctatcaaatggcttatggaaggattatggctaagcatgcatctatctaaataggacggtcatatactagaggttctattgttagatggatttaggatcaatcaaataattatagtgaatcatttgtattatttattttattgatggaagctttactttaattatgaacatattttacttgtcacaataaattataaaaggttaataattatccatgctctatatgttaagttcgggaagtttataatattatagttacagattatctcttaatgaacaatccggagttacaatcgaactatgaacatatgaggtcaagatttataattaggacttatctactattcatgtttgttatatactccccagtttgatatatgaaaaagataaattaattgtgtaactataatgggatgtacaatatatgtgtgcaacaaggtataaggttttggtcgcctactatacatgagcttatttagaaagtgtactacccaatgctccaagtgattcctgaatatattgtagtttaattatacattagctagtttctatgagtgatattgtatatgtgatgcgacaagtttaagcactggttctattgggttactaataagtggtaatcaatttaggcatatataagctattctatatggtattgcatcgattattttacttagtgattcctccacatctagctctattattattctcctaaacaggttaaagattcatctatgtgtgttcatattttagttgcataatcataaggctacacttgatttaaataacctataagccatggatttaattatatggccatcgaaattttcctatacatccattcatttgatacatcacataaaattagtttgtgtggttgttacagtggcaagacatgttagagacaaatattattatatctactctactgtacaatactaattttatttattaacatattttttttaagttgactattatgcatcatcttgatattaattatttaatgtttataaatatattttatcaaatagtgaattatatatcattggaaagcttatgaatttagatgaatttgggttcaagtttcactcaaatcggagctaaatatcgaacgaaatcctagaaatattatatgatttaatttagtctatgactaaatgattaaatataatacacggctaaaatccctagtaattaaatctgaatttctaccgtgaatcgattacttatagggtttaccc

SEQ ID NO: 97070 - DNA, 580 bp, Oryza sativa
agttagggttatccctaaatcaacatgtgctactgaactttctactgttgcaggcgcagggaaaaataatttcagtcgagatgtcttcagtagcagcgatataaataacttctagaaaaaaattaaataataggaatcaggaaggctataccaactaaagctggtacccgaataattatcctttttaatagtagtgcacacaatttaccaagatagaagtgtatacattattgcagcccttatgtaaactgctgaaatcctttccatgagcaaatatttttctaagtcagtcataaatgaagatagtaatccactctccatgaatagattattagtgtaattaagcattggtgacttgagctgtacagtatatgcatctgtaaattaatactaactataatcgatttacatgagtctctaatttgtctggtccctctgaagctaaagctgggatttttcttttggtgtatttgtttgtgattcatgaaacatttagatacacttcatcatctgttgtgcgataccttaaaaaatcatttactttgagtatacgtaaacagatctacattctacaaaatat

SEQ ID NO: 97071 - DNA, 913 bp, Oryza sativa
tggcccggggcgacgacggcggcggaccggagctcgacggcgacggcggagagagagagcgacggcgcgagctcgattccggcgaggacgaagggcggcgagaggcggaaacggacggaggaggagcggggagggtttaaatagagccgggtcgagagagggtggccggggaagggaggaaaccggcgcgggaggtctggccaccatcaatggcgccggcgagcccacttgtcaatctctctctctctgttcttcttcttcctctctctctgttcgtctctttctcattgcgccgccgccgagctccaccatggctgagccgtcgtgcgtcgtcgccgtcggcggtgaaccccagctctagtgtcgaccaaactgagagaggaagccctcaatctcttcgccgtcctcaaatccctcgccggccatgaagaagaaaacgcccgctgtcactgtagagctatctccatgtctgcctcaccaccgttccatacttaccttaacatgccgaagatttttcattttgattccatcctctctcgtgcagcggatcgacgggaacgccatcgtgtcatcgccggccttggagcgcgctctgcgcgtcgccgcctcgacgtcgtcaccgttccgggtgcagtggatcgttgtaggccgagccaccacgccatcagcttcacctcgacctcctctctatttacccccaagtaccctatccagtcgcgcagcgatcttagagatcggcatcatctttctccaactccggtcgctgagctccatctttgatttctccctctccggtgagtcccaatccgattccttgccatggtagcctctcatggacctttctaacacgaaagacatgcatgcatgacaattctttgaagaaattgagccatcgccgttcatccaaggtgaa

SEQ ID NO: 97072 - DNA, 757 bp, Oryza sativa
tcggcaaattaaagcacatcttgaaaatgttggatcttcaatgtgcccagactctgattggtgggatgtagtggctttgatgctcaattttgaaatatagtcatatcagtcattaaaaaacctatcacagtagaagctcctgttgtagttttctttccctaacaaattgaagggtccatgtggttttttctaactaattgagacctatgttttcagccaaccaaatcagatgaggatatcgacctgtatttttataggattcgcttgaaagaggttctagacgagaaagaataccttgtccacgagttggaatgtgctagacagcagctggatgaggtcaggtcaatgaatagtgaaattctgagagaaaacaggaaattgaaaaggtcgctccgtactagagatgttgaaggaatttcaaggaacgttctagagaagcttggatactgtcatgacatctttttatgccctaatgaggttgatgttgagaaattgcaagaactcctgtgtagatctgagtgcaagcttctatacacagttaagatacctggtgccacaacagatcattcttggaaagtagatacgttggctaaaatgtcaccattttgtaaggtggtatttcttggcatgattgaggatgtctacaggctgcatcggtccggtttatgtctgaatggaaagttctccttgaaagatttttgttggactttgagtcaaaaggtgaagtttagtgctgaactgagaggtctgtgttacg

SEQ ID NO: 97073 - DNA, 629 bp, Oryza sativa
tccttcacaaaaatattaatgtcgtcgtcggcctccataatctcaaaagcaacgacggatgccaaggcggatttctccctgaaaaaaaaacatattagaaaccaagcatagcaatcataggtaacatgtgcacctagcaaaacaggaaagtgttgataactcaaatactgaggccgtgacaacaaataaaatgcataatatgcataacactatcacctcatgtctgtatgcaaatgttgacagtgagaattgaagacaggaggtgatgttttgcagaattcaattgatggtgcacctttaaaatccaatcaatggagtggatgaacaattgacaggagtgacaaactaccatagtaaacaaataagctagggacagtacagagtacattgtcatggttcaagcaaaaataaaagcaagtagatatctatactccttttaatagggagtagtggcggtggtgagaagttaatcttccaccacccccaccaccaactccctacttttttttggaatgaaaaagaagggaccctgcatgtcaacactcctaccaccgacttcctactttttgtggtaagaaaaaatagtgggttaatgataaatttctttaactagtcttctgcccgtgcaa

SEQ ID NO: 97074 - DNA, 628 bp, Oryza sativa
taccactctttcatcctccttgtcttagtgtaagtgaacctcgagtcacattcttcctccttggcgtgccgcccatacccctctccctactcccctatgagctcaaagtacctttcttcctccttactaacaagcccctaggcctaatccccgtgacatcatgaggccttgcccctctttcttcctcagacctggccacaacctgacctcatccctggattgaaagttttttattatttgagataaaagtttgttcatttgggcaaaatgtttgatgtcatgagtgaaactttaggagacttgagttgagagtgaaaagttataagtaaaagttttgaatgggttaaaattggatgaattatgattcaaacgttttgacgataaagtttttgagattgccgttgaaagttttagatcataaagtttttgctattcaaattgaaagtttgaatagaaagtatcaacttgaaagttactgaacataaaggttttatatttcaaattgaaaacttcgattaaaaactttgaagacttcatattgaatatttttaaaattggattggaagattactgcattggtgcttagcagctgcttaagcttataaccatccctgattaaatgttcttg

SEQ ID NO: 97075 - DNA, 514 bp, Oryza sativa
ctagctagctggttatttacccaacgtgcctctctctataagtacatgtacatcaatttgtcccttcacaacccaagacctcaacctcatcattgaccgacttccgtcgaaatggttaacatcaaagaaaaacttacttaattattgcattattgctgttacaaaccttaattaattccaacccagtctaggtctgagtccttctttgctttttattgcgtaatcttggtccgtcagcaacaggagctgccgcgtgcgtcactagcggcaccacttccattttaaaaccttttattcatcttgtgtattcattcatcattcgattggattaattaaatgacagtactgtccaagatatatataaaaagagtccgtgttagctacctaagatcttgttatggtgtttaatttatatcagtaccggctactatcaaatttatttttatacggccaaaatggattttgcagctggcagcagatggacacaccccatgtgaaaatcaatctttttcat

SEQ ID NO: 97076 - DNA, 626 bp, Oryza sativa
gcagcccctgcacacaattacatgatgaagtaacaatgcctaaattatgatctaacaaaacaccaaatgaacttaagggggtggcttagtatttatacatgaagtgatctaggacagtgtgtatgacatggcacgtcgccctacgacaaaccagacccatctgcccaagtggaggtgatgcaacaccattggttttggtttctaggaacaaaccactcttacgattcagattggttggatccgtcggaaagagaattccgagatctttctatcaaatccccacatggatttttagatcaacgggtatgctcgtttgaatttggggtggtgcagcaaactgaaccgaaatattctatcttgcatcctcgttgagcttttgttcatctctaccgtcattcctaatcacaataacatcaccactagcatttagtagtactacccaattcagtaaatcattcttatgcaaccctacatggtaattaagttgacggacacgagctcgagcgattgatccttaatcactggttcaacttgtgtgcttgccgttggtgtgattatattcatgcatggtgctgatgttctcatcattctaagtcatggtgttgtgggtttatgccttcaaaact

SEQ ID NO: 97077 - DNA, 1570 bp, Oryza sativa
gaatttattaaaatctaattggacttacaacaggcctaggctcattaataggtttctcgaggtggcgacccgaaggacactgtcggaggcttggatggacgagagctgatggaggtcggggcggatgcagaagctaccgaccgtggtggatgggagcaatgatatattcaacagacacaagcgacgccgactgtgggggtggacggggaggtcgtctggcatacatggagacgcgacgactgggctgggtgagggagatgaccgcgatggacgaaagcgtcggtccggcgaacactggcaaaagaagcggccatggcggaaaccggaggagcggggtgctcctccatctatggacgacgggcccatagtctcggatagcgcgagcagcccagcgacaaattagtcgtccgctggttccctctctcctctcctctctcttcttatcttctacgtcatttaaaaatcctacggtaatggctattgccaggttatcgtacctgctcttagcgaagaaaattaaactagattcctgaaaactccttattcgttccccttaatttcaggaggagaaaagtggtttgaactaataaaagccatgtacgagctgtgtacttgcgtgtttaaagaaaaagatggatttaataaggccaaatcttcaatgcgctcacttttcagctcatcactccgtcacctcgtgctcgtgctgtccttccttcctgctatcctgcgtcgtcttctccacccccctctctctctctctctgctcagctcagctcgattcatctcagatcagcgcatcgaccgagcgagcaagcgccaagcacccaaggaggaaggagggggcgctgctccggccgaatcgatggctatgaggcacagggcacgctccgcccccagctccccgctcaccccgtcttcaaccacaaggtgcatatgctcattactttctccgttagctcccccctgatgattcttgcttccagtggctgtggatttcttgtccatttaagcagttcttgtgcagcatgctccatgcaatgctcctcttttttttccccaatttgttgggagagcaatgctccgtgaagctggggtgtggtggaatcttggtgatgctttgattcagataaaacaagaaatgggaaatgagaaggatttgtttatagcttggcttttgttttctttctttttagtttttttttggcatttcttagacatacgggctatttggtatctcaaacgaggattctcgatgttatatatgggtatttggtaccagatcgagcacaagaagctcaagaaatgctttttgggtgatatgccatgtgcttacatcggcaagcatcgcagcaaagcttcgtcttttagtcttttatatcgggtcaagtaggataagattagtgagaattttgattcagatccatggctaatggcttcatgtatgggcaatgccgtcggtggctagactgcagtaggaattggtaaccaagaacaagaatggatgtgaccaagtttaatctttttcaccttatcttttctgagaggaaaaggcacaggaagatcttggaag

SEQ ID NO: 97078 - DNA, 621 bp, Oryza sativa
atcgggaggagcattagcggttgtggaggctttgccggaggagaagaatggggatgccgtcgacgagcaagaggaggctgatgttcagggcggtgcgccagcggaggtagagatgccaggccaaatgcggcctagctcggggaagaggcccagctaaagtttcaataaaaaaattaaattatatttggtttaattcttaaattggctgcatagtaacgggctgcatagtaacgtgtctaagaaaaggattgggctaaaatgatattacaattaaatttttctttttaaagaattatgattatgattattgtgtttaaactttaaatatattttataatgctttagttaataataataaaaataataagtgactttattatatggtaaaattctcttttatttatctgcttattttatgatcattacattatgtttattacttaaagttattattattttatgcattgtgagtttatttgcgctgcaaataaatattgtaattaagtgtgacaaacaattgtcattctggccaaagctgattgaattttatttgatcacaaaattttattaattcaattcaaatctggccaaagttgttctgattgaattaataaaaggagt

SEQ ID NO: 97079 - DNA, 644 bp, Oryza sativa
ttaaaattatcctccctattgttgagatgaaatttaacgaaaattccctttcaacaattaaagatatatccaaacagctgcattaattccgagaagtataccccctgatcttcctttaggtggaagacaatgccacatgaaatcagcacccccagagaggcgatctaaattcatctttgacatttcaccctttcttgtctccattaacgcaacatagtctagtatttttctctctaatcacttaaaagtttggcacggttcttttgtttaggaggcgttgtccaactagtgaaaaagttaccggattcatagcttgtccctaattgctgcaaacctatcttcctagctcttaactttccattaatgaaagagcatgctagcctattgattcaaaaagaaaatgcatatctacaaatatccactgagaataaagtaactccatcgcctagactctactgtcttaaaaacttgccacaatcagaacctgtgttggaacatatgagaacataacaagaatataaatgcagaaaaaaaacaaaacagaagatgagaaagcatagaaacttggtgtttgagacacaggaattgttatccatcattccaatggaatatttcccttgtcttcagttcatttttattttcct

SEQ ID NO: 97080 - DNA, 600 bp, Oryza sativa
gactactatagggcgaattcgagctcggtacccaccagtgcagttcaaagttaatcttggttcagtcagagttaggggtcagaatcaaattcagttaaaattgagtttagagtttgaatctgatctacagctagatgccatggtacctatcaattacatgcgactcaaaatagttatagaaaaatttaaaaaaaacttagtaacatcaataagtaaaatatcggtaatcaaatgtgtctcaaagtaaattttaccataatatattggattatatgctacttaccaaatcctatcttaatataaagttatcccccactaactcgttaagcttaacctgcaaagatgccacatcatcatccactaacaagatgtcatatcattatccactaattaacaagatgtcacatcattatccactaacaatcatcacatttaaacatcatgcaaacatgctatatctttatagtttttataatttaagagcttttcaaatacaaatatgttaaattatcatccaacataattcacataatgtttcaatgtatatctttgttatgttttatgatatcctatatacttatatagttcatcctcacttag

SEQ ID NO: 97081 - DNA, 569 bp, Oryza sativa
ccaaaataacccgtcgttgaagattgcatagcaattttctcatggccgccgcggccgtggtggattggttgactggagggagctgttcgtctttgacgccttgacgggttcccgcgggtaaggagaagtaggggccaagaaaccctaggtttccagttgattggagggtttgactgctttgcagcgagtacaaaaactgggctcgacggcggccatgtcgcagcactctttccgcctccaaaccactggagcagccgcagcaagcaacctcttcttcttgttctttcgccgcctcacaaatcacaatccccccggtatgcaaatgcaattcctccttgttcaaatgttgaggatgcgatacttcatttttgtttaaatttttttagggttgaggggattatgtcaagtactgtagtaacattttgggttgcgttttttttccatgtgcttcatcagggtgtaaatgaactaaggggaaggaagggttctagactggagattgcattctggtcatataccaaggtactagatttttgctttgattgtgataaatctacaggaacgaatta

SEQ ID NO: 97082 - DNA, 550 bp, Oryza sativa
ccgagcccgaaagccacgaacgggaaaatgatttttcttttatttttattctaattggctaaatgaactttgtgctattaaaattacttcttgagctccgaaaattcacggataatttcggagagtacattcttgcccaaagaatattacaaaatattcccggaggttataggtctgtttttctatggatagaccaaactaaacatcatttgaaaatagtaatttagagagatcaaaatacaatatggcatacaaagcgggggatcctaatgggcgatcgattgcccggatactggggtagcgatcgatcccctgccccctacctacctctacccctacacctggtttttttttttggcaccgcattacttttctattttagtaaatttatacacataaagtttatacaccttaagtttacacatctaaagttcagagaccaaaagtttataagtcaaaagtttatatatccgattcaaatttgaatttgaattcaaatatttttttatatatagtatttctatacatctaaagtttatacacctaaagt

SEQ ID NO: 97083 - DNA, 630 bp, Oryza sativa
ccacatgtccccaccacatacttcgttgcaacaaattacctacatattttggaaatcgtatattaagggaattcgtttcaatttttattccacaaaaatatttcacctagtgtactcataatgcttcactataaatagatctaatgttgtagtgaattcaaacattctgttgtaacaaattacccacatcttatagaaactctctgttaagggaattcgtttgtttttttgttccacaaaaaatgtttcacctaatgtacttgtaatgtttcactatatatgaatcaaatgttgcagtgacttgaaacattctttcgctatttgctgaaacattgtttttatataaggtgaaacaatgcccgatttaaacgattgaaacatttttgatctacttagtaaaacaattccgatatacttggtgtaacaacgtgcaacatttaaaaataattcaataataagctaaatatttttttcattggaaaatatccatgtgcgttcttgttttaaatatttaattgcaacaaatttaatggtgcaatcggagacatgtttgaccagcttgctttgttatatctcgaagtcagtgaactccatatcgttccatagagcatgcagccacctgtggttgct

SEQ ID NO: 97084 - DNA, 923 bp, Oryza sativa
ctgttaggtacgcgcgcgaacatcttatttatgttttataaatttaactaaagatatcataattaggttttataattccaaccgatccatcacatattcacatgctcggggcactgagagcaagtttaatagtatagccaactactagctccaattcatccatagccaatctaatagctcatatatataatagttacatactatattattaatatctggtcccacctgtcatatacacgttacatcttggagaccgtgctacagctggctacaaatctgtagcccgctgcccttctctctcattatttatctccttaaaatatatttgcagctgacttatagcctgctattgtacctgctttgaggggttcaccatggtcaaagcaaaagtggcgcgaagggactcaagtactaccccgagttaaggaagtgacgcaacgtcagtatgagtttgggattgcgactgccgctgcagctaggccaggggctcgaaatttatgatttgacccagtcctgtgtaactttaccctactatgattttatattaattgcggcgtgatatggtttctatggatggatcaggctccctttggctgtgtttggctgtgtggtgtggcgcattttccatccacatctgagaggctccctttggccgtgttacatcaaaattgaaagtttggttgaaattagaacgatgtgatggaaaagttaaaagtttatgtatgtaggaaagttttgatgtgatggaaaaattggaagtttgaagaattattttggaactaaacacggtgtttatcggttttggaggttgaccgttgggtccatcgacagtttgggacgaagacttcagctaccctactccacatgtcagttgataggtgaatccgtcacatccgacttgctagcttagtggaacatcgaca

SEQ ID NO: 97085 - DNA, 603 bp, Oryza sativa
aaaataattaataactatcaatacaatacaaaattcaaaattgtgttgctatttttaatatattataataataaaatatggaaatatttaagctattatatgaggaaaaatataatgacgttagccgcgtaatctgcgcgggccatcatgctagtttgtcaaaaagcaagtgaaaaattcatccaagttttgaaagtgagggagataaaaaacgaccccttaaagagagatttgataatttaactcttcttaaacgagcgtcacttcgattatttaatatcttgattcactttcattcactcggatagacccacgtatcatgcttataagtgttaattaaagtaaattgaccataaaaaaagttaaattattaaatttatcctcagagtcatcagaaacgaaactagaccaatttaacggaggcctaacttgggcccaaatcaagcccatagataatgagatgggcctgtggggcccactaagcactaggagcggaggcaagagactctccgcgcacatgacgccttcgtgtgctttggactccttttccccgccgccgctgcctcttgccctctcgtctccggccaccagtccactgcgact

SEQ ID NO: 97086 - DNA, 657 bp, Oryza sativa
tttttctatggatagaccaaactaaacatcatttgaaaatagtaatttagagagatcaaaatacaatatggcatacaaagcgggggatcctaatgggcgatcgattgcccggatactggggtagcgatcgatcccctcccccctccctccctctacccctccacctggttttcttttttggcaccgcattactttcctattttagtaaattatacacataaagtttatacaccttaagtttacacatctaaagttcagagaccaaaagtttataagtcaaaagtttatatatccgattcaaatttgaatttgaattcaaatatttttttatatatagtatttctatacatctaaagtttatacacctaaagtttatagacctaaagtttataagtcaaaagtttacatacccgattcaaatttgaatttgaattcaaatattttctatatatagtatttctatacatctaaagtttatacacctaaagtttatagacccaaagtttataagtcaaaagtttacatacccgattcaaatttgaatttgaattcaaattcaaatttggattcaaaatattttctatatatatagaatttctatacatctaaaagttatacacctaaaagtttatagacccaaagtttataagtcaaaag

SEQ ID NO: 97087 - DNA, 644 bp, Oryza sativa
aatttttagagttcattgttgtgagtaaccatgttttgcaatactcttgcaagtagttgtgatttatgcatgcatgcaactcttgtgtttgttggtaaataatataaggcattttttcaattcagactaatgtgggggcataaagaaagatggtcacaatgattgtattcatttgacaacaattcctgattttcctcctaaggtcaaaactacctagtgtatgcaacacctccatttctctaattaccctaatcatgtgttctgacatggtaaaatccaattttccctttcatgctcaaaccactgttcctctatccctttgaaaaactgcacaacatttgaaaatttagttccatcacgaaacatcgcttcatgtgcttgcacatgatcttttgcagtaagcaagtaactgcatttacttttaaaattagaaatttaagatattacctgcgtggaataccagcctaggagcaggattttactcaaaattgttgttgtttttctataaccctgataataaccatttattacagtttgcgaatacatattagaaaaagtgattttagcagtttactttttgcaaagcttctgatggtttctcaattcagatttcatggtgcaacagagcacaatgcctttaaagt

SEQ ID NO: 97088 - DNA, 581 bp, Oryza sativa
tcctttgcggatattatgcgtgcgaattccttattaacgcggaggatgtaagtctttatactatgtattagacagctcttgatatttatgatactaatatattgattaatttcaatgcatgcagttgccaagattagaatgtcgaacaagctttgacgatacaggtatcacaaatgtgcagcgtgatctgtgccacttcatccaccatgagtgctctcatgtcaaaggagatttcttcgacccagagggtgccctagcggcaagtgacgaattcaaggatctttgggagtagaacactgctatgccataatataactaaatgacgttatttgaagtgacaatgtaaaacaatattgtaatatatatattttggcaacacttttgatttatgcaatataagtagatttctcagtaccaaatgcttgataatctttcaatatatgtacctgcaagaatttctaataaataatttaaaagtaatttacggccaaattataattaaatttcaatattttctacctatcttcgcaggcggaagttttttttttgcaagcggacgattcctattttcgcaggcggac

SEQ ID NO: 97089 - DNA, 560 bp, Oryza sativa
aagtccttttattttccccatttagctctcacactccagttagaagtggtttttaaactctcatatccaattagtgtgtggtaaccttggggtctgctagtatatgtggctgatacccacatgaggtgtttgacaaacataccaaattttaaaaaaattatataggaccctttttgagtaaactgactgtttatctggtgattccttctgttattaaactgctagtctgcataaatgcatccttccttttacctaaaatagttgagactttgtagacgtagggatgtttaatggtttattattgagcatgttgctgggaagtttactaatggatttcatctgtgtcagtttaggtgataaggttcatatttcacttggaacaggtatggcaggagaaatattgtggcttcaacttatccaatacaatacaaaagttggaacgttgttttggtgttttaattaacctaaagctagtgataaataattggcctcaaaggttggttgggaatgcagtaatatcctttatccaatacaatgctcgcttgtttataatatactag

SEQ ID NO: 97090 - DNA, 855 bp, Oryza sativa
ttttatttgtggtattttttttggatctgtgatgtaatgtatatatgattcgagatgttatattttgatttggggatttgggatttgattatggggggatatgcatcgatcccatccgatttgggggaaaatagaatgaaaaacgcatctagcaaagaaacaataaaaaaatggcaaccaggctgccgctttcctcccctttagtctcgattggtgttatcaccggggactaaagatcaacttttatcccggttattttatccgggactaaagatatatctttagtcccggatttgaactcccggttgtatacccgggagaacaggcagttacgaaccggaggtaaagataacttgtgcagtagtggtggcatactagtcagaaaaaaaaaattaaaaaagtacttagggcccacatatcagttacataatctttttcttttcttttcttctccttctcttctcttttatctcttctctctcttcttcagtgagtgaggccagcggcaatgggcgagcagcgggtgagcgctgcggctggtccgcgcagcagccgggcggcggaagcgagcgtggtctgcgggtagaacggaggcgggcagagcggcaccgggatacgggcagagccgcgatgggcggcggcggccgagcggagtggacggcgggagagcacggcggcgggcgagcggacgaggtcgactaaatcaagtgtaagtacggaaagaaaaacgagggcaagagctttaatccggagaaaataacaattactactagtaagcagctgttattgccggaagccaagctcacacagcaaatcgagcctgtcgaatcgaaggaaggagggggaggaagcaag

SEQ ID NO: 97091 - DNA, 564 bp, Oryza sativa
  unsure (1)..(564): unsure at all n locations
tgcagccnctcatgtatatatagcacaaagatcactgagtaaaatctggatatgccttggaatatgctacctaagctgacaatgcttgaccagctaataaactgtcacttttgcgtttgcatcttataactgactgacccccgtacccttctggtttctgttgctaatacaaaaggaaccagtcttgaacatgagcttgaattcgatgggccatgtctggatcatattcttttccatttcgtggatcctgctgatagcctgatattatgctctgttctgggacattcttatggatcttccccctgggtgctcttgaagctgtatatgaagaatccgttactgcatctgattctttcacagcaaaggacaacttttataaagtaatactttgtacatgcagcctgaggagctcgccatatggttttgatcagatcaaatcactgccgaaatctgaaacaatgttattatgatattatcaagcagtgacatgaaagagaacttgttagttatgaaatggaacataaatataacttgtatattcaacagtggtaaaaacatcatacc

SEQ ID NO: 97092 - DNA, 3319 bp, Oryza sativa
aaggacttcgccgttttttttcttttcatcttttgtttggtcttttatgtttagatctagacctatgtgtaatttgccttttctcaaggggttgtcatgtaaacctgccattgtaatttgccctttcttaaagggctgccattgtatctgtttcaaatttttttactctttgttaggtatataaatcgacatctatttttcgatccaaccgtaattttcaggtttttactgtttgcaccacttttttttcccacattatccatgctttaccactaaatgtacacccgtacccatgtaggcatgtactatctcctgaaattaaatcacagaaaaatgcgaacgttcggtgttagatacaagagaatcgagtggataagttccccgcacaaagagccatgaccaaagtgtagcttagttcgccatacatcaatatcttcttcattcctaacaactaacagcgggtggaagacgttataaatggtccaagtcatcaaaagcgtgatagactgcccacgtgaacctctccagtctccactgattgtggcagagaagaaacacctcaagtcttcattcttctacaatacgtgaacacctcactcctcacttcctcaggtcaggcataattgacaatttgacaccatgcacttcgtttctggtgtatctttgaacaggagagaagattttgagtgtattttttcttcaaaatctcagacatggaatttagaaagaaagagtaaatttcacaaaattacatgttttggatacaaagatgaatttagcgcaaaaaaaactattaacccatggttatttaagttctaattatgacaaacttgaaaaatgatttatttgatattttattgccatttctacaatatctatatcataaccctcctcacccccaccctggttttacaaaaatagaaaaaaatgggaaacatagtacaaacgtaggcgctcactatatgcgcacacttatctctatgaatatgcacacacaccctatctctatgagcacctccgaaagactgggccgatatatcttgagattgacaaagtcatcacgagcgtatttctgttgacgggtacgatgcctatcactaaaagaataattagcgcacccgtgtcagatctacaattttttttaagtaatcctggattctggggcaaactgtttcataaaacctcatttttatgcaaaatagttatatttcactataaaacatagtatttctagatatatacttacttttttaaaaaagacgatatatacttgcattagagaccgaaaatatacatttctatactgtttattatatttccttcctaactttcccaattcataatggaaaagatggagatgcaaatgctagtacatcatcatgtgagtggattacaaagacccaaacttacggtaattttaccgttcttaagaaaatatcataaggtaccttattttttattataaaattcagtacttccaagtgctagcctgctaggtactttggggtatcaaattttttagtgtaaaatcttggtactttcaagtattttttaagaaccgtaaaatttcttcgaaacataacataattggtaaccgatatttgttgagaaagtagctaatgtgtgtatctacttagaaaatatgacattatttttttatacatgtattatgcatataatagccaaacaaaatacataggaatgaatgtgggattttatgaaatattttgccctaaaatctggggtgggggattgaaacaagttgcaaaacctaaattttgtgttatgaatgtctgaaaacatgtagttttgtgaaatttattcaaaaataaatgcactttggaccttggtaacaaaatgtacagatagggcttacaacttcgcaagttcgcatggatgttaactggccacccaagcacagtgtttcacagccgcctcttcttatatttttcccccacatacgcatagtagcgaagacctaacacacttatgtattgtgacaggtgccaaataatttgtcactacatagtattgtcgcttactgtatgtgtggagtcaagagaaaacttgaggcacgttcctgaaggaaaagaaaattaagaattgctcgtttttccagctagctgctcagttaggaacaacttggtggaaaagttattatccgcagttttatgcacgaaatagatttgcacatgtccatctattgatgaggtcatacttaatgagcttatattggttgcttattaatatatctaaaaaatcttgatgcatttagattttttttccagaaaagtatcgttatatagaaagcgtacaagagttttacagcattatacgtatatttttatatattttcattatctactataaaaaatatatatttttctgtataaaaaatacacacatacacacgtataaaaagtttgtatgtgtgtattttttttgttgcttattttcactatctactataaatataaatatatatatatatatatgtatatttttttgatgtataaaaaaatacgcacatacaaactttgtatacgatgtgtacaaactttgtatactacgtgtataaactttgtatacgatatatacaaactttatatacaacatgtacaaactttgtatacgtacatattaaaaaatcaaaaaaatcacgtatacaaactttgtatacacgtatacaaactttttatacgtatacttatatgctaaaaaaccaaaaagaaaaaaaccggaaagaaaaaaacgaatggaaaaccgcaaaaaacaaaaaaaaacaacggaaaaaaccggcgggccccacccctacgcacgcgctcaccgctcggccccctccgcgcgcgccacgtgcctcaccgcgcggctaatcgcgttttagctttctcgtgagatgcggacgatatggtccagctcgatcgtacaaaggaataagttcatttggcatcccttaactttacgttgagtttgtttgacatccctcatcctcaataccggaaatctttatccttaaactatacaaaaccgtgcaatttagatcccataacagtatcaacagctggtttcactgatgtgatatcctagtcagcaaagagaaaataaaaaaaagtacgggacccacatgtaagtgaaaaaaatcaatgcttctcctttttttttcccaccatgcatgcgaggtcaacatatgaggaggcaacagcagatagggcaactaggacgcagcatcacctagggcggcgaggaggcgacggcgacgcgacaccgactgtggggtggcgacgaggcgaactcaactgggggtgttcaacctgtgggg

SEQ ID NO: 97093 - DNA, 539 bp, Oryza sativa
tcctgcagcccaaattactttggatttctatcaatcaaatcgattaaatttctataatggaatcttaggaaatcaatgtgagggttgttggtcgtttttctccaacttgtagagtagggttccaaattgggtcaaaattaaagaagattaaaacacacaataattaaggcataagatgccaggtaagtcttgattttggatgtgtattttttttctaagaaacatagtacaacacatacacactcgtctctataaacacgggcgcacactcactctctttttttatgattttgtcccaacgacctacactaaatacaagaaaaattaaggtaatttgaggcaactggtcaggagcaccactacaccatgtcgaaaaatatagtatgttgtagtgtatggtgcgtctatatcaaatgggaagatttggccataccttttttttccgtcctccgccactgttaattgcagctccattgccctttcattctcgccctgcgtatatgtacagcgtgcccatagcttccccgtgcccccccccc

SEQ ID NO: 97094 - DNA, 1777 bp, Oryza sativa
cttatacacatgggattagtggaaacataaaattgatatatttggcttgttcctgattgccaaagtatattatatactacatattaagtgttttagtacgtaaggttaacttctaaagtgcttatctgattgccgactttgttatttaagatgagcatgtttcccgcactacaaaagtttcgtgaactaaccgatgcgtgttttctaaatactttggatacaaaagtatttttaaaaaatcaaataaacctattttcaattttgtaatacttaatacttgattaatattttttatgacatgtatcattttgtgagccctagataaagtcagccagatcgattgaaggcctatgtagtagataaaaggcatcgacacggtatcaaaagaatatatttcatcattaattttctagcaatatatgaagaagaaaatattcaagataaatttagtagtgtcattttacaacatcaatatttttttctagtaggtattgagtaaattttgagaatgctacacacagtcgaagttgttttatttttaaaaataaaaatctaatataattatatatgttgttaagtgatatatctataattttaatttatttatatttttcatggatgttttcatgagatatattttttatttgaacataacttgaaataacatatatttttatttttacaacttaaattatagttaagatgtgctgattattagattggtttttcgactagccgagaaataaaaaaaaggaaagagaagttcaagtacaatttttttttgtcgggtgtgggtttcgggatacaaatgtacgtactcacatacagatatggaacgatgtaaatctttggagatatcctatcttactataatgttatcctccactaacttcttaagtttgacatgcaaagatgtcacatcatcatctactaacaagatgccacatcatcatccactaattaacaagatgtcatatcatcatccactaacactcatcacatttaaatatcatgcaaacatgctatatatttatagtttttataatttaagagcttttaaaatacaaacatgttaattatcattcaacataattcacataatgtttcaatgtatatctttattatgttttatgatataaagtatatagttcatcctcacttagttagtgcttaaatgattaatctatggtccaaattatctttctctttttttctctaattaagtcatatcacatcaattgtttttagtcttttgatgattagtatatctccctacttttcttcttccataaaggcataccagcttactttttaagtttgaatcaccattctacatactatttaaatttaaattatcataaaccacattaatttacttaatctgatgttatctagctatcttatatgttatttttttttattgttatcatactaaatttccgcagcaatgcgtggggtttcacctagtaatataaatttgattgttaatttagaagatagatctaatggttaaaaataatggtcccaccacattaaatgaaaatcaatggctagatgttttctttttttcttagattttctatgatttttaaagggccacatgatggcttgagagcctttgtaggaagattaatggaccttttagtatataataattatacatgttggtaagtaatatatctataattttaattcatttatatttttcatggatgttttcatgagatatattttttatttgaacattactcggaataactatatgtttatttttaca

SEQ ID NO: 97095 - DNA, 586 bp, Oryza sativa
catgtctactttgactttggattcgctttacactaaactaaaaactcatgagatgaatattctttctcttaaaggtgattctaagtctagtgctttggtttcgtctacaacttctttggatgttggtgcttcttcatcgaagtcttctgttcttgctttatttaatgccatgtccgatgatcaactcgaacagttcgaggaggaggacttggttttggttgctaacaaagtttttcgagctatgaatagtgtcaggaacaggaaaagaggcggtcctaaacgttgcttttagtgtggtgcacttgatcatcttcgttcacattgtcctaagcttgggagaggcaagaaggaataaaatagtagagtcaaagaggttgaagtggacaagaagaagaacacgaatgagaagaagaagaattgcatgcagtggttaatctaagaactcatagcagcttttgatgaatcggaaaatgaagacgagagcaaaggtaagcaaggtggtgatctagcttttattgctcgaatgcaagttctgatgtgatgaatctgataggatagtgaagaaaagtttagttatgatcaatta

SEQ ID NO: 97096 - DNA, 522 bp, Oryza sativa
  unsure (1)..(522): unsure at all n locations
aaactttgggtttataaactattatttgaattcaaattcaaatttaaatcggattataaacttttgacttataaactttaggtgtataaactttggatgtatagaaatactatatataaaaaatatttgaattcaaattcaaatttgaatcggatatataaacttttgacttataaactttgggtctctgaactttagatgtgtaaacttgatgtgtataaactttagtgcataaatttactaaaatagaaaagtaatacggtgccaaaaaaaccaggtggagggagggagggggagggggggagggggaggggnnnnnnnncnnntngntngntnnncattgnncgacgagcaatcgctcattagccgtttcgcgttaaaccgaccaaaattctctattgatggaacaaaattctcaggctttggcccattttagcagcagtagagaagtactccctccgtctaaaaaaaagacaaatcctgagtttccatgtccaacgtttgactgttcgtcttatatga

SEQ ID NO: 97097 - DNA, 603 bp, Oryza sativa
cccgcgccgcccgtcgccacccctccattcccgcaatccaccggcgtagcaccactccccccaccaaaccgagccggcactgcaatccgccgtgttccggccgccgcttctcgccgctctagccaccgccgtgctgtgccgccacgacctccggcctcgccgcaccgagggctacctcggccgtccctcgctcgccgcgaaacaccgccgtagtgccgattccgccgccaacccgaggctgccgccgcattcgtcgcctccgatcgacgattgccatcgaccgcgaccaccccggaccgcgccgcttgctccgttggcgtcgcaacgtcgtgccgcgccccgtccacccctccgcccttggaaatcactgctggaactccgccagtgccgtcgacccacgggtgccgcctccaacccctcaacgccgacgctctcctttgccacacagccgccacctccgctcgatgcgtccccttcctccctccccgcctcaaccgccttctctcggccccgctcatgccgccgctgctcgccgccggcgctattgggccaggtcgccgctagccggcggcaggctggccgctttccgtgtgcgcctgcccg

SEQ ID NO: 97098 - DNA, 641 bp, Oryza sativa
taagaatgccatttagggtttgttgttggcgccattgcttttgggaacctttgggagtttattagtggttttttcccaccctccccggcgttaggaggtttacttcttattagctaactttttgtttattttcttgtgttttgatttttttttcttgtccccggtaacggctttctgtttgttgtgttgtgtaactaaacattttctttttttctaatatatcgacgtgtaattgttttgtacattcgccgaaaaaaaacatacgtgagaatgttcactgaaaagaaaaacagatcatgtacgtattgcaagtaccggtttttctcctctaggaacattctcgtcctctcactcccttttaacgtggcatacacgaatgcctctcaaaaataaatcaaaaccaacgatttattttcataaaagaaactaaattaaaaaatcgatcgcagggctccattacttttctcgatcgtcaggcattcgtgtatacgccgtcaattaatagatctccatatatcttcaagaaacaatgcctataaataactagttctacataccacagctcactcaactcgatcgaccatatacatatagaaacactttcttcttcgtcttcctcgatagccaaaatacactgtgct

SEQ ID NO: 97099 - DNA, 698 bp, Oryza sativa
actaacaattgcagagatttatgacatttcatgtgtttggtcgttaaaatttcgcaaagcatattacatgtggcacgtggtttcttgcagataatgcaacatgcacatcaagcacatgggatgtatgaccctgatttcagcccaacaaacaaataacaagtagcaggaaaaaaggaatgcaaaaaagaaagacaactttgttaaatatcacactttcagatcctacatccttagatggctggtgccttccaaactatacaaaaatcatactcaaaacattccaatgcgagttgcttaaattccacaatctgtaattagttcgaacgttgcgagttgcaacaacattaggacaagcagagagaacaaatccatgagcatgttcatgatcaaagattcacctagagacctgaccccttaactcatactccccctgaccataaatatttgacgtttagtctagtgtcataattgcaatgcaatgtttacttagactaggccccaggatgttcatgtcttaatgataccaccacttacagttaccttgggacagaaatcaattgcaaatagtactacactgttagttcaaggttagtaagtttacaaacctcagttagacagccttaattactacttagccattaggacaggttaaaactatgacccctttgcacctgaaagctagctcatcagctacatga

SEQ ID NO: 97100 - DNA, 581 bp, Oryza sativa
aaggataggatagcgagaagcacaaccgaatggccattgaagttttcagttcctaattaacctgaagttttgtttggctgaatttgggggcggaaattggaaattgatagtttcatacaccaccatttgtccatttcatattccagcttcaaatgggcactgaacttgtccagatttctaatttgctatgtttagcttttgaattggacagtgcatgcttgatatagatttgaattattgaacctgaacaaggttttaatctgcctacatccaattgaaacatataagctgatttcaagattccaatatttgaacctgacaaggcttgcatttgccttcaatcaatttgaaaaacagtacctaagggtctgtttggtgagcttaagattctgagaagcagctggctggtaaccagcagccagcttatgagaatatgaaaaaggtgggtttcccagtttctgtcttctatttattttctggattccacaactacagcttcaatctgaaccaaaagctggactgtttaggggagtttctgattctggtagaagctgcattagcttaaaaactcccccaaacat

SEQ ID NO: 97101 - DNA, 525 bp, Oryza sativa
atcgccacatggccgttggcatcggcgagaaaaagcttcaagcttctcatcgccgaggccgagcacggcagccagcaacggcggtggaggctggcttaccgagcaagttacctcccgtctatttaagacgggccccttgctctctctgagaccttctctcccccaccaccaaaccacgcctcgcccctttcaaatcacgcctcgcgacgatggctgatcccaacggcccccgccacctccccaccccgttcgagccacggcccatcgatggcctaatcggcggcgacaccgccgactccgacagcgggggcaccgccattgtcggcaacatgatgaccaccggtcccggcgcggcgctggtgctggcggcggcggggacgacgacgacctccacctccctcgccgagagcagcgggatcggtggccgcctcgtccaggatcaggaggaggccggctccaggtcgaaatgcattttgttctttgtattaaaaaaagtattgcatgaccgaataattcaaggagggg

SEQ ID NO: 97102 - DNA, 618 bp, Oryza sativa
tctttctcttaaaaaaaactagtcagataccttttataaatacaatatcattaacaaaaataatagttattattcctcatgtaaaaacataggtaatatatattacggagcatacacacatgagctagctgcttagtattcatgtgcaagtaatagtgttttctgtagcaatattattatcaaaaataaataagaataagaaaaaaagaagaagatggaacaacagaagaatataaaaggttaaagtttttagtttcacaccattcactacaaagaacaattttaataatactagtgtattatcgattaatgtgagtatataccataccatagttgtgagcagcaaccaccctcatgtgtttgggctagtgactaacctcctctttttcttacttctttcgaagttctctgaacatatttaggtaaaagatgttttgttttggataaaaaagaaacaatttaactatattagttttagagagaatccattgtgtgccgctgactttgtccttgttctataatatgccactgagtttgttaagttctacagcatgtcattgtattttgcttaaattctataatataccatcgccgtccatttagattctgttagtactg

SEQ ID NO: 97103 - DNA, 695 bp, Oryza sativa
aaattagagagagaataaggaggtttagaaaatttagaataattagaatttaattatagattaattatagtcgtagaatgcaaaacttaatataattatagattatttttggtaatctctataagtaatcaattcgcggtaggagtttagatttattaagagctaaataatatgttgaatcctcaggagtgtacttctaaatcacgaaataacttaggttgaatgacactaaaattggaataacgtggtttcgcaaactttgtagtcgatataggcagatcgattcgcgttcgacttttatttgagtttattggattttatttgaattctaattgaattcaaatcatttcttcgcacgtaattttagagcccgagggggttgcggatccgagcaaggatcaagacccgcaggactacgagcaaggcaagtcatcactattccttgaacatgtcgatcccaattcgaaattattttgtttacaaataaaattgcatgcaattatgaacatcctacttgtgattatgccatgccttgattattgtttacccttatgccttcgtaaccatgtttacgtatgagtccctagtcaattatgacaattgcttagaaatgctattttagaatcatgcatactcatatttatcaaatgctatatgcttgggcaattacctttgggaaggtaattgagatgcgg

SEQ ID NO: 97104 - DNA, 610 bp, Oryza sativa
aagctccaaaagaatatacagctgccataatccgatgaaagaattgccctgcagcaggaggtgccgaggaagagagcttggtcacctagttccttcaccttcaaccacctgcgcttgtccagatctgccttgaacacgtccagcttgatctccttcctcagctcgtcgacgccccaaaggcgtacattgtaaaatatggggagatgccaccgccatcgaaccatcatcagccttccagtagcgcacgatatgacgaggtaaaaagtgctccgccaactgtagccttgacaactctaggcttgaggagctatgccgatcacgatatctgcactgatgctatcgctgaactcgtgaacgaaaagctccccgtcactgctaatggagtagagcttgccattgtagtaggctatgtcgcgcgcgaagcaggggccgccggaggcaaacagccaggttgagtgcattcccggccggtagaagaaaacgccagagccggcgatgacggcggcgacgagatcaggcgagcacacggcgatcttccgccggcgttctcgccgaagcacatggttcgttgtccctctttctcctccccgtagtcggggaggatggcgtc

SEQ ID NO: 97105 - DNA, 770 bp, Oryza sativa
atatatatagccctagatctttagtcccggttgatgagaacaaccgggactaaagaaagttctttagtcccggttgttctcaacaaccgggagtaaagatatctttactcccggttgttcgcatcaaccgggactaaagatattttcctgctatttccaaattctttttaaacccagttagggttaagaatcgggactactgataagcgcactgaatattattttccattacatatgtgtttctaaaatagaagataatgcattacaattatttaaagtacaaagattaatgacaattactttgaaaaattattgttgtctgtaataaattaagtcgataaaacgtaataagcaaatatatgatttaaaattaataaaaattctagtaatcatatatacttagcatatgaatgatattattaaatcggtgaaaactctaattaacatatgtatatacatacggcatgatttaaaattaataaaaattgtaatcatcatatatacttagcataggaattatattaaattaaattgtgaaaaactctaattaacatatgtaaatgccacatgcatgatttaaaaattttaaaaattcgaatagtcatatataattagcatttgaatgatagtaaattaaattgtgaaaaactctaattaacatatgtaaatgccacatgcatgatttgaaacttttaaaaattctctagtcaattataattagcatatgaatgatagtaaaataaatgttaaaaactctaattaacatatga

SEQ ID NO: 97106 - DNA, 1034 bp, Oryza sativa
cttgcatttactctgcacttatgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcaccgcccatgtaataaagtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctatttttttaatcttacaaagagcatttcagtgattaatttaattggaaaagtatttaaaatcacctttaccttttcgggccgaattaggaaaagtcctctcactctcggcccagtctcctctcagcctgcagcccttttcctctctttcccgaagtctgcttttgtccctcctttaatcagtctttggaagtagaagcccagcagaaagtctactttccctccctggcactgttcatcttccagctctggacagagccgagccgcccgtgctgtgccctgtgccgccgcctcttccttccaaatctcgcctccccgttgctcctttttccaatttagttgaggggaaatattcctcttatcctcctctatctttaccccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcggttgccacctctcccgtggtctcccgtgcctcgtagcgccggcggcacgtgcttcacc

SEQ ID NO: 97107 - DNA, 666 bp, Oryza sativa
gtcggagttgtccctcaagccagagtggtagagctagccctcgaaggaattcgcccaggcaagtgacataattatatatatgattgttataattgtaatgcaattaagattattagatttgtaattagacttaattagaatataagattgtgtagtgttctaatatacgacagttacacttagaatacatgattatttgagttttagtataagattattggagttttaatataagattattatatttgtaattagacttagtatataattattgactagctagggtcctataatatacgtcacctagacttagcatatatatcactatttgagttttagtataagattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggccctataatatacgtcacctagacttagcatatgtcactatttgagttttagtataagattattagatttgtaattagacttaacatgtaagattgtgtagggttctaatatatgacaattacacttagcatacatgggctatttt

SEQ ID NO: 97108 - DNA, 592 bp, Oryza sativa
aatagccatgtatgctaagtgtaattgtcatatattagaaccctacacaatcttacatgctaagtctaattacaaatctaataatcttatactaaaactcaaatagtgacatatgctaagtctaggtgacgtatattataggcccctagctagtcaataattatatactaagtctaattacaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatatgctaagtctaggtgacgtatattataggaccctagctagtcaataattatatactaagtctaattacaaatataataatcttatattaaaactccaataatcttatactaaaactcaaataatcatgtattctaagtgtaactgtcgtatattagaacactacacaatcttatattctaattaagtctaattacaaatctaataatcttaattgcattacaattataacaatcatatatataa

SEQ ID NO: 97109 - DNA, 533 bp, Oryza sativa
gcataacctgttttgcttcatatgtcgtctcgggcaatgtgttctcctgagaaagcatgtccttcagtattcccaaaagttctataaaactcttgtctgtccatccactactagccttcaacttcattaggtctaatgtggctgacaatttggtgtgctttggcttgcatccggcgtatagaggagtctccaagtcactgaccaacctgctgaacttcatggaatctctctcgttcatagctgggtcatcagcgtcacgtaacatgtcttgcagcagatcagggtccacatcaaccatttcaccgcccaatagagatgggacaaacatgccatgctcttcttcatctccttcttcatgattgtctgcaccatttccatctacagttgcaccatcagtatccgaatcttgctctccatacttcacccaacatgtgtaactctccatgaatccccggcatatcaagtgagcgtgtacttcctttcatcttcccaccaaatctcattcctgcaatcactacatggacaacacatgc

SEQ ID NO: 97110 - DNA, 2075 bp, Oryza sativa
caatttgaaaaactttcaacttttcatgtcaaattggaaaaattttcaactcaaatttaaaacttttaacccagatttgaaaactttcaacccagatttaaaaactttcaactcaaatttgaaaactttcaagtcaagattaaaaacttacaaatctacatttgtaaagaggtgtgcgaaagattgaaaaaaaaatcagaaagaaacggaaaaaaaaaaagagtccgaaggcgccaaaatcggaaaaaaaagtatgaaaaaaaaggcgcgcggggatgggctgggccgatccgtacatgcaaccgtcccggtccagctttgcgagccaagaccaccattgtcgacaactaccatctgggccgcagtggactaggcccaaaccgggcccacctacgaatcgccgagcttacccggagcgctgcctcctgccgccgcacgccacgctggtgcaccgtcgtgctccgccgaggccgcgagctctcctccctccgcgcgccatggatgggtcgatggggtatgagaggaagaacatcgcgcgggttattagttattactccgcttctgtaagaaccctagcccccaaatttttacccccccccccccccccatttcttaattttaacccgtccccgatgtgctgcattgctttcgcattggatttgatttgatgttacttcttactcctgtgttgggttagagatgatgtagattagtttacgggcaggccaacttgcgtcattggtttgtatccatggattgtagtggttagccttggagatatgagattggagattcttctgttattactgatgcattgtgacgattagagcgtgttaatttttttaaaagataatcgtatatgttatctcttgtttattgctaccagaagacgttagaggatttgtttacctctagggaccggttaattcatgctcaaccattttttgtgagggttcttgatgtagcttaggctattgtttttgttcaagaaaagaatttgatgaatcttttatgtgcttttgataaattgactatggaatgtggagtagcaagctttcattgctcaagaaaatggtaaacagtctacatctcaccacgctataatatatttttctagcagtattgtattttataatttgtcaagtctattttgcattgtctcaaagggtgccaattgctgtcaagtgttgtacgacttcatgcatgctgtattctctgcacataggaagccagagcattaaacctggcagataaactatttgaaggaaaattgagtttattggagaaagagttacataacacaatagatctgcttcaatagctagtagccttctggcctccataggtacaaaagaagtcgtcaggggtccaattgcttttataccatcctgttttggcagatcgcatccaccttccatgttgtttgatcaaacattcagcatccatatttcctcattttccctattttccccttccaaattgtggggatgttggcgtcataaaccctctggaatattttgatatcagttagatcagaagaattgcattttggaccacttaatttccatctttctttggatttagctattgaagtgtttttttttttcaaattcttctgcaaattgagaagtaataatactcggattggagtctatgatgttgcctagagctgcagcattatcatgcatgggtttgatgaaaaattaaaggggtattgatctgattcaaatgtaaagggtgactagccttaatcaattgttagtaaatcagctatttttacacaacgtcagcgaacaaccaagaaaaccgggaggttggcttgctacggttattagtggtggagaggtgaatggaccacaaccaacactctgttgtttattaatagtaaagataaaaggttgagaaaatggcaaatgaacaaaatgccccttgcgctttccatctctctctttcatcatccctcgcctctactctctccatcttcatctcttttttttctggtctgcagatctggcggtacaacagccttctccccagcctatgctcctcaccggaggaggctaaatatattgtat

SEQ ID NO: 97111 - DNA, 521 bp, Oryza sativa
gcatggccagatggccaggtccagtccacgaacatagtaggaactagttgataccccgcactttgttgtaaaatatgtagataaaatgcatgttatacattataaaaagagataatccattctatgccgtagacaaagcacggattctacaatataccactgacaaagctcagttctataatataccatcgaacaactatttttcttccttacataccatcaccgctagtcaacagctagtcaaattccgttaagaggaagaaaatgtccattttaccccctagggtatcatgcgtactcagatttcattggtcaagatccactaattcttctcattgatgaaaaatagaaatcacttgtctttttatcctccaagattatttaatgagtcatgacattgtgcaaaatctcaattttatcctaagggtaaaattgtcatttttttcttccttaacggtgtatgactaacgactgactaacaccgatggcatataaggaagaaaatgagtcgttcaatggta

SEQ ID NO: 97112 - DNA, 554 bp, Oryza sativa
cacgagagcccttgtgggagaaatccaaacacacggcacaaactttttgaaggatggaaaaagctataaaaaccatcagttttacattccaccatgtaatttatgccttgtttagttacaaactttttcttcaaacttccaacttttatatcacatcaaaacttttctacacatataaacttctaactttttcatcacatcgttccaatttcaaccaaacttctaattttggcgtgaactaaacacacccttactttgttataaatacccaccactctacttggtttgaacacacggttcaaaattttcaatgatggaaagttataaagaccatcagtttggcattccatcctgtaatttatttatttttcaaatgcccaccactccacttagttttgatgtaacaaccacccagtgcgcactggcttaaccaaatcagctattattgctactgtagaggtacccccagactaagctagctgagtcaatcttatcgaggtacttgtatttgatttattctttatatttcatcgatttttttaccgtacatagca

SEQ ID NO: 97113 - DNA, 567 bp, Oryza sativa
tatagggcgaattcgagctcggtaccctgtgggctcacgagggtgggtcccacgtgacagtgacacatgtccatctttactctacgtcggaggaactgcttcccaatacggccatgcattttggttggtctcttcaggaaatggagcattgctatatgtttgtaagttgcctgctggtcctgctattggcattgtgaagacactgttttagacatttcctttttcttgctcatagatctgatctggggtttatggtgagttggtgacagtacatacaaaccaaaaaaaaacaagaagaagaaatacatggataaaggttttaacattatcaaatttcggtagggtaaaagaactacccgacctcgacgaagtgtaacacattgtgaggcgctaactgttgccgacatgtgctcgaaatcttcactgatctaagttcaattatttgctttgatattgacctttttggcggaaaacaaaaaggttagaggcagagggtacaaatctataaaagcgagtactactgattagcgacgaaattcagaaaaacaagagtcttagagcacccac

SEQ ID NO: 97114 - DNA, 609 bp, Oryza sativa
caccacccacttcagaaggggatggagaagagagatgtgggcggggattccaacgagtgggccctagcaatttttttttaaaaaaaactgatgtctggactgccacgtgtgctatttgaatcctaaaccgcttgcaacagtgctcggggggagggggtgttttgtccggtattaaaagttcaaggtgagcgatatctggttttcgagttcagggggtaattcagtcgaccacgatatttcagggagtaatttgtatttttttcctaaaaaaaatgcttcaccgacttctagcttgtagagagtacctgaccattgaccaagtataaaccatcccttctatagatccagagatgagaaacgaactatcttgagagaaggctaaacaacttatagcatttttatgtccgcaccatcttttcaataatgctccacttgctatctgaaatgaacaatattttcaagtgaaaaagagttcatattaaacagaaatttgtcactaagtgtgtgatgcaaaatttaaattattactctttttagatatttgtactatttgcaagaatatttcccatagaagatgcaatctttatttatgatgatgaactacttgca

SEQ ID NO: 97115 - DNA, 560 bp, Oryza sativa
tacagtagttcatcaccttgctggatcaactgaatatgagacaacttgctaaaggggttgtagcctagtggttacagtgctcaagtagcacctctaggtccttcattcgactttccaagggagcaaatttcatgcttgaataaaagaaaaagatgccgtgagggcctccctcgctatttccaataaaaaaataaacaactctaattgcaatccaaggattgtctcaaatagtctacaagcctgatgagactgttgcgcttatatagtttgcaagctatttgggacatttttctctttgtcataagtagttctttagctacctattcttgctagttggttctggtagtgctgaataatgtagtggcgctttgttcctatgcttgaatggcaagcctgcgtgtaatactagtaaacccaacaggaaaagttgggccttaaaaaaaaggaaaaaagtacaaattaccccctgaactatcacggtcgaccgaattaccccccccccccgaactcgaaaaccagatatcgctcaccctaaacttttaataccggacaaaacaccc

SEQ ID NO: 97116 - DNA, 584 bp, Oryza sativa
ctttggaacatcatccgtgtgtgatcggcttctaagtcctttggctttttaaaatatagatatgtatttgagtcggattttaaattcattcgtttttggaaataatgaggaatcttataagaaatctctttaaaaaaacttgcctactaacttaaaagatgatcggacttattattgcaactcatgattttctagaaaaatatatatgcaagtgaattctcacaacgaaactattatatatatctctactggtataaaaatcaaaattgaagatacttttgcatacgttatctttctttgaggggggttttaagctcattcgattttagaaatacagatccatgttcgaggtgattttaagattatctgctttggaaatataaaaagagacgtataaaaacctctttaaaaaaacccgcatactaacctgagatgaaacatatactcctaattgcagcctatgattttcaaagaaaaaaatatcaaacccgattccacggggaattttaccatagctcaaccttattacaataataaaactaaaacaagatttaccggtgcaacgcacgggcattttttctagt

SEQ ID NO: 97117 - DNA, 566 bp, Oryza sativa
ttttaaaatggcaagatttttatatggcatttgattaattcagctgtttgggataatttcacaatgaaatactgtcagagcttctaaatgtgactattctcaggtcattccgagatgtatctattttactgtttttttatcctttgattatatacacaaacataatatgcttactagaattaccttgtgcaggttttcacttaccatagacatgagataatgtacacccaggaaggaaggaagtctaccgtttcttctaggtaatccatgtaaatatcaaaatatggtataacagccacatactgatttttgtatgtaagcaaccatatttgttttgggcaatcatgtgtaccagtcaactactaactcgggtcagtaagtaatagtaattattttagactggaaaacacattatgaacttaccaaggcaagggtggatagtcctgaccaaagggagggaggggactaatcaagtcaagggactgtagagtcgcatgcatgaccaggctcaggatcctctctgtgtatagtggcatggtacctctgttgtgtgccttggtaggaca

SEQ ID NO: 97118 - DNA, 589 bp, Oryza sativa
atcaagagcatccgaaaacatttgtttttaacttccatttgtttcttcgacaacaagtttccacactttccagtcagttgccaataatttgactatagcatatgcatccctgaaaaatcaaggggtggcccataagctcacttctatcacctctttacttattatagatgaaatattaaaatacgtctagtcaaactttcaaatcttaaatcaccaacagataaaattaatttatgaagatttgttatgtgaaaataattaatttgaagtatatgcttcaatggaaaaatacattcatatgattataattcccatatgaataatgtaaggctatgtacaacgttgtgtaataacaacctctcttcattaccatgtaagtaaaattgatgacgtggaaaagagatagaggaaaaagaaacatgggtgctacgcatcacagcggatcagagtcgacttttaatgtttattaaagagaattttgttgcagggtggagaaaaggaaagaagggtagtaaaaaaatattttggtaccttccttttccaacctccctcccttgattgggtaccgagctcgaattcgccctatagt

SEQ ID NO: 97119 - DNA, 519 bp, Oryza sativa
caaatgcataaccgaataaaaagcgaataaaaattcacaacacaaattaatagaacaaaatattaaaatttatagcacaaattcatgaaactcgtagcagttgaagacgtggttcgatcatgttgctgcatgaagggttccccttcatgacctcatccacctccgccgctgtggacggcctctcccctcttctggatccgcacgccaccgccatggacgacacctcctaatctggattcgctaagtcctcctcatagcctttatcatatgcatttacaacccactagtttgctataaaattccatgtacattgaaacatattatcttatgtttggtatataagcatattatcttatgtttggtatataagcatccaagtatcatatagaattacaatttcatattaaccactatagaacgcattatcaaataagataatatgagtacacgagatgattatcgagtacacgagatgaactggtgtctagagccgtgctaactaaaagactgctagcacgg

SEQ ID NO: 97120 - DNA, 513 bp, Oryza sativa
atgctagagctatcgttgtttggcatatgctgattataagccgtaacggcttatcagcgatcaaaaaatattccgttcgtaaaactttatatatgtgaactagttagcgatttaaaagccaatgctggaaacataaactacaatgaaaaaaacctcataatcaattcaaaaattaagtttccaaattaaattttggcagtggcttataagctgaaaggcaaacgctggggctctaacttgtgcgcctatcaaaaaaaaatgtgaaaatgagtattttggtaacaccacactggatatctaccaccaaaatggcttcggaaaatgaacatataaggaacacaacatcaatgtaccgtgaatgattgtttggttgcaatgcccactaaatttcctgccctgttgtgggtaacaaaatgccatccattattgcaagtagtactacttctttttccaccacatcatgctactagtaacacaaaatcaattaagagaagctgcttaagcttaattcgt

SEQ ID NO: 97121 - DNA, 649 bp, Oryza sativa
ggtactaaactccacatgcatgccatcccatgaggggggcttttgtgattttccaaaaaattaatcttcgagtgggctagggcccatccattaattccaacgggggcaggccggttcgggtgttgcctttgattaatggatttggattggtttggtttgtgaagtatagtgtatatacagatgaatggagcgggtcctactaatgcgcgggtgatcgctgggcgcactcccctcctcctatgccgattcctctctccccctttctccttcccatcttctcttcctactacagtacaccacaaatattttttaaaaaaacaaaaagttagaaaaaattatggatagaaatactatatataaaaaatttgaattcaaattcaaatttgaatttgaatacaaatttaaatttgaattcaaatttgaatcaaattcgaaatcgaattcaaattcgaattcaaattcaaattcgaatttgaatcgggtatgtaaatttttgacttataaactttgtatctataaactttagatgtatagaactactatatatagaaaatatttgaattcaaattcaaatttgaatcagatataattcaaattcaaatttaaaacgggtatataaactttaggtctataaactttaggtctataa

SEQ ID NO: 97122 - DNA, 761 bp, Oryza sativa
tcatccaaccttgatctacaccctaccaattaagaattaataagaacaagaacaccaacttgatgcgggtagaatattggtgccatatgctgttatgcgcagcatcagtacactcctagagaagttaatttccagagtaaaaagaagaattaatttgataaaataccactcatttatagatgaatatatatataaggccttgcctaccatacatttcctttatatatagtttgctaattagttcatagaggattacataactctttacatatgaaactgaatatatactcgcataaatattatcatattcaattttgtttctccatcactaaaaaaacataacagacaaaaaaacatgatcttatcacatataaagtgcaataataatgaagatagaaattattaaatcacaagggccctaataggaagcagagtaaagaggggagcattatcatctctaatgccaataggaatttttttaaagaagttgatgtgatgtccctcccctggtagccctcctgtctgtgatggaccactgaattttctccctttaactttctgagtgcatgcagcacaattctgcttttcccatgcacacacatgatttcccattgatccttaagcaaagcaccctttgatatgcacacaaaaatatatatttgcaggaactttaaaaatccctttttctaacatcacatctggtgacaagtaatataatgcagatctccccactcaaccagagacacaatcactgatgttac

SEQ ID NO: 97123 - DNA, 560 bp, Oryza sativa
actactatagggcgaattcgagctcggtaccccaatagtacatccactatactgacatgacaatatggatggctctctccaaaaaccacttttttgaatcagtacttgcttaccaacgaaggtcaaagtttttagtgggacaaacacaatttatactgggatgctgataccttgcgtgatcaaacaattaatgatcgaactctggacaatacatagagatagcagtgttttcataaaactgaaagcaatatcatctagctgcagcaattattaactctaacaccaatcttctaacctttttggaatatgacaagttctgtataaagaagcaatggcaatcattaaacctacatataacatgaaacttaatgcatacacctgaatcaaaaatactaaccaaatacttgaattcctaatcgcatagattcgtcgtgtgggcttaaacatgcatatgttcacaccgatcgatttcatgaggttggtgcaggatcaataaagaacatgttgctctggcggaattattttgcaataacttaagaattgagtcaccaacatcaagt

SEQ ID NO: 97124 - DNA, 501 bp, Oryza sativa
tgtctatttactccaatgtacaaataacgaatagacttaataaatgaacacaaatatgtagatcatttaggaataacttcaaaaaaactatatgtagatcaatttggaatggagggagtacttctcttcagaaaatgtagccttttggtcttttagaaaagaaaaaggttagccttttgtatttatcgaaggtcagaaaagttactgctagacaatggcaacttcaatctaatggttaatggaggaaaatgcaaagaattacaatagtccttaattatgagttttgttttttgctctatttgagttatacatcacaagtaaaaaagtataattgatgtaggtgagtgggaccacttttaactgtcatttagcactctctcatgcaacttatctctggctttttgagagctcaaggccctatttcaaatgtcgagacttcaaatattcaccaaatgtaagaccactttctcatagtatttggcaaccagccgaataatatat

SEQ ID NO: 97125 - DNA, 681 bp, Oryza sativa
attcctgcagccccgagataagagacattgtcaaacagataaaatttcctggccactcaaagcaggggtgggcattcgggctagaccgaaatttcggtccggttagttcggtcttttaaaaattcggtctttggaaacaggaaaccgaagttgttaagcaaaaattactaaccgctacttcggttaaccgaaaattcggttcggtcttcggtctaaaccgaggtgcccgaaccagaacgtgcgtcctcttcaatcttctcgtcttcttgctcctgaaaacctccatggctccacctcagtcacatgggacggatatccactagcatggtgacaagtgctggcgggacggaaggcgacgacgcggcagaaatcagccgcgcgacgcagacggcacgcgatggcgcagcggccggcatgcggctgtgcagcaggatcagcaagccagcagcctgtggcctccttatggcttccacgtgaccacacgattgcatgcgacactgcggcgacgccggcgagcagcagcatgcggcagcactgcagaagatggcggcgtggaaggaaggggacatgcgatgcgacgagataagtggtgcgccggcggcgcgtggcctaactagggttaggagtgcttcggtcaatggaatggtggggtcatggggattgggtcattgacgtggattt

SEQ ID NO: 97126 - DNA, 705 bp, Oryza sativa
gccggtggtgtcctccaaggaggtgaagggaacgcctcccgtgccaatcccaacgcggggcatggtctggataagctcgctcgccgggcacctcgggaatggtggccattgcaacctgcagaagtgcccagtgtagtgtagtggagaggagcacaatgaggtttttctctgtgggtagctatatataggaaaagaatggatctcctccttgaggtttcgtgctgcaagacttaaacaacacaagtgacgatgaaggtaacatttttctaggtgaagcatgggcagggatagagctagagcgaaacagaatgtggtgttactctcttaatttactttactttagattaaagtttaacctaatacaaatgtctaagtttgtattaagggggtacatatacggtgaaaatagataaggtatagtttaaaaaattttctttatcgggttcctgagcaccccctaatatatactagctccgcccctgcatgggtaagttagtaagagatcaatatgcggtacaaagttcatttgcaatataaacctgaaatatcatgggataaacaaatgagcatctgagatttgttcttgttatcatgagtaattttttttgccacaagattaaccataagtaacttttttttttggaataaactatttagtggcatggataaatcttaagcaatgggtaccgagctcgggttcgccca

SEQ ID NO: 97127 - DNA, 665 bp, Oryza sativa
taagattttcagacaagaactgaacacataataggaaggtaatgcagaaacacaatattatcaactaaaggtctgtttggcagtgctccagttccaaatattcttggagatggggctggcgatggactgggaattatatggtaagtccctgaaagaactatatggcaagcatctttcttaacgtatttaatatgtaagatagaagactaaacgttagcctacaaactccatagtccattctacgagaatccagaagcttccgtaaacagagcctaaataatatagttgaaaaagagaagaattcaacaaacagacaatcttgctccaatgatgttcgtctccagtatgaataattataaatgggtataaaaatataaaaggatttcatagactaatgattcagtgcaatggaatttcttcctgatacaactagcactaaacaggaatcaaattaaacaagatttaataaacaaaaataacgccgcacaatgatgatccatttcaatgtaaagtacagataccatggaaatggaatgtctggattgaccgtattttcctttccagcaggagcattttttccagtatgatctgaagcatcagaaaatagtatgtgaaatacaagaataacccattttttcacttaagagctactttgaagtggacac

SEQ ID NO: 97128 - DNA, 717 bp, Oryza sativa
gataatgctcgagtcgcttcgttcattttagccaccattagtactgtattagcaccggtggctagtcatggtgtatagtgataagactgatggttacagcttcagcaatcagcatacgtatgcagacatggcatgtttatggcactgtacgattataccgtgttgacgtgaaccgtagtagagactttgtaagccgcgagtacgtggtagggtccatggatcatcacgacagccatgccatggagagggagtattctgttcggttttcagctgagcattatcatcagattcattttttttttgtttttgatagaggattatagtcagaaattggttggttaatttgtttttataatttaattgtacatggatgtctattaattaaatgtacacgacttggtggattttctagattccattaccccacttgctctctttgacaaaaatagcaaagaaatagtacaatggtgctcagcctagtacagatatgtacatagaacttgctctttccctgtaaaatagggcagagattcagtaaattctccgcggaagttttgacttggaaatcaaattagcgcgaaatctttgacatggtgtcagccatgtgcctaaaacaatcatatacatggaactaaagagagattcagaatcaatcaatcagagtatgaaatcgtgaagcagtaaacaaacctgcacaactgaagactctgcactcta

SEQ ID NO: 97129 - DNA, 684 bp, Oryza sativa
tcgaattggtaccaaaaattacattaccaattttttttagtaagttaaacagtaagagttcctttgaaacacctcactgaaaaaaaagtacggatagaaaaaggaaacacacgatttttatctattccataataatttcaaagataaggatagggtttcctataaattttcccctataataaattgaaagtatctcaaattctttttttttttacaaatcaatgggtgttaaatgtggtaggcttggatgaaggttaaacaggcgtaattggtagtgcctacgtttaatttggtcatattctagaagttcagtaccaattcaaacaataaccagataacattaccaaacaattgatgaggtagagaaccaaacttaatcgatctcaactaggagagttacttctctatctctacttctctactattataaaaattgaatatgtttttgccggtattttggtacgtcatccgtgtatgaatcggtttttaagttcgtttgcttttggagatacatatatgtatttgatttggtttttaagatcgttcactttttgtaatacagaaggaatcatataagaattctgtttaaaaaaactcgtatagtaacttgagacgattagacgtctaactgcagcttatgaatttctatatatatatatatatatatatatatatatatatata

SEQ ID NO: 97130 - DNA, 690 bp, Oryza sativa
tgcgtgtgatatgagaatgcataaatttgtatgaattttctgttggtccactcaccaccctttccacatgaagcaagaaaaaactgatccgttattacattttaaacactacaacattatcaccatcagaaagaagagcaaatagggatagaatggctaatatatgtgactggaaattggatattatttaatttggtttgtgtttaacgactttagcctgtccctttcttagagcacaataaagccacagtttgagtgagacaaatttctgtctggtctcccacttttgggctgttcttccattctgtctttgttcatctctgagctacctaactttcctcctttgttcttccatactactttctcaaattctgatcatcaattcttagctatacattttttagggcaaatcttgatattggtaagtgttaagttagaacctagtcaggtgggtcgatgtgttctcagtcaggaaaaggaacttgtcacctgttgctccaaaaagggagaatatcctctttaactaatatatgttcacatttatggtaattgatgtttcacttagcttctttgtaggggaatatatctaaagttgttttctctttggcttaacatatattcccctttatggtaattgatgtgctatatatagctttttcttgctcttgtagcatgacgtttttatgtatt

SEQ ID NO: 97131 - DNA, 533 bp, Oryza sativa
agttaagggagtcaaagtgtagttattgctctaacaaccccgaaactaattgggccatacttgtaggctgtgtatgaacgtgcaactactcattgtctacccctcattctccgtgcgtaccttgttcgagcggttaaacgatgtgtttttaaaatatatatatataaaagttgctttaaaaattatattttttttaaaaaaagctaaaacctaattaactatgtggtaataagttgctccattttacgtgcacgggaagagagttcccaaacctagctaccgaacatagcctaaagaatccgataacattttgatagttgggaacattgttttctagtttttcttttagaactcatgcactttatttgtttgaaagttttaaaaacacaaggcaagagtgattcttacatctccttttcttgatcggacatacactttgttggcaaatatgagtactattactacagtcaaaggccatctgattttgctctgaagtttgtctagttgctctcgcaggaccatcagcaaccttg

SEQ ID NO: 97132 - DNA, 556 bp, Oryza sativa
tcggtacccctatcattagcaaaaactaacgatgtacacctttacggtaaagtaggaaccgatatctattctcacttttcaacttttcaatttggaacattaacaccaattaaaaatattaatccctcaatagcattatcgttagaagccacgcgtaatatcgaccgaataccgaactagggctaggtattggttttataaaacgtaaaggctttaactttgctaaaagttggttggcagaatcttatcaaaaccaaaaacctagacctaatggttttggtttttggttaggtaatgaacaatataaagtaaatcgttattcttcattaccgatctacttaacattaaaacaaaactttaagcttaatgggcataaaaagataaacctttatgttaaaggtgatcttggctattcctttaataaaattaagaacacacattattcattagacacaaaatttacgaataatgctggaatacctgaattaacctctttccctgtcgagataaaagctaaaaatggcttatattatggtttagcggtaggtgctgaata

SEQ ID NO: 97133 - DNA, 582 bp, Oryza sativa
aagttcataaaacatcggcagctggggattgggattcggcagcgtacttgccaaatgcaactggattttgttcttcaggacatttaatactccctccgttctaaaaaaaactcaattcctgggtttctgttaggtccgtatctaacgtgttcgtcttatttgaaaaagttatgaaaaaaattaaaaagataagttatgcataaagtattattaatgttttatcatctaacaataatgaaaatactaatcataaaaaaagcattattaagtctttttaggacagagggagtaagtttgatgatgtcgattggcgaatccgctactgtttatttgccgctacacttcgtagtggcaggttcatttatactcggaataagatcactttgactccctcaactgaccaccgaatctaaatcgtatccctcaatcgcaatactagaaatctcgaccccctgaacttgcaaaaccggtgcaatttgactccctcaccggttttgggaggtggtttcgccgatgtagcgccatgtggcgcctatgtggtgatattgaccgagtcttcggtccacgtggcattgacgtggc

SEQ ID NO: 97134 - DNA, 605 bp, Oryza sativa
ttatcggattctttaggctatgttcggtagctaggtttgggaactctcttcccgtgcacgtaaaatggagcaacttattaccacatagttaattaggttttagctttttttaaaaaaaatataatttttaaagcaacttttatatatatatattttaaaaacacatcgtttaaccgctcgaacaaggtacgcacggagaatgaggggtagacaatgagtagttgcacgttcatacacagcctacaagtatggcccaattagtttcgggtttgttagagcaataactacactttgactcccttaactaggggccaaatctgattcgtatccctaaaccacaattccggatatctcaaccccctaactattaaaaccggtggaatttgactcccacgatggttttgaagggtagtttcgctaacatggcgcttacgtggcggtgttgactcggtcttcattccacgtggcattgatgtggcagtataattaaaattatatgtgggaccaatttgtcatccacacaaaaatatatggttaattggatctatgccacttggaaatgtgattaattagaaaaatgtcactactattcgcgataacggcta

SEQ ID NO: 97135 - DNA, 1560 bp, Oryza sativa
tttttttaatatgcgtaggaaatataaatagcattgtattttaaatcaatgaaggatcattatgggttgttttgagtagttatatatagtttttatgtacttcctatatcctataaaaaagcaaattgacaggaggaatttgcacatagttctacagatttattttcatgtgacggagggagtacacttcatacacattaagaaacattagccaaaagggtggagcaatttcaatttgttctcccttgtgatttgggttgtaaaatttggcgatatatatggatttttagttctaccctcacaactaaaaggatttatattaggtagatgaaactaattttgctacttgtgttttcatatgatctttttttaaacactgtataaacacatacgctcacaatacttaaaaaaactatataaacactcacaatacttacgcacttactcatatgtattcacacacgtacaaaatattcctattcgcatctctgaattcgctcacaagattgtgaatttgagatggggctaagggggaagagttgatcaactgtttgcattggcgagattattcggaatagtttagctttgtactactctcttttttagactggtctttgtactcttgtcttcgttagggtcaatctagcatggaattgctccattactttggaagccctggagtgccaagaaaggctatgcattttgtgttgaatggatttgtctacctattactgttgcgtcctattacgagctgacaataaaagcttacaatcttgcaggtgatcggttgcctaaacatttcaaagatgtttcgtggagcaacctaaactagtctcatctctatatttatttgtttagagcgctcgatctagttttacttctatttttaatggacattaaactgtttggctaacattcagctccacgagagatggagttagagctagaattgtgtcaaacaaaccctgagataattgaaattagaggattaatgaataatctatttttatactatctgaggacataaataaataaattaactactacagagttaaaaagtcatatttagaaaagtattcaaataaaattttataaatatttgcttttaagcacacgccgtttagaagcataagaagcgtgcaaatgaaaattcggaatcagaaatgaacagtgccttgatatatcaccttgacccttcgtgggaaaaaaaaacaactccctttgcttctgaataaattatacgacactatttattttcatactttgaccacttgtctctcgtgtaacatatttgcaaatacttagtaaaatgtcatgatgttgaagtgtttagtgtccataaatataagcaaaatttaattatttaagagtagctagtggtcaaaggcgaagaaactgaaacatattgtcagttagtcgaaaacagtatccttattgtgaaattcgcagtatatatctcacgcaatactatttaaacattaaactcagaaactacagtaagcccaaatctgtggtttaagtaatcttacacccaaaagcaaaacctcatatcttcccgat

SEQ ID NO: 97136 - DNA, 553 bp, Oryza sativa
ttgtttaaaacaatttatccaagcaatacaattgaagaaaattttacgagaaaatgtatttgtagaggcatatggagcaaataacatgagcaagttagttaggtagatgaaaagaatgcggctcccgtttcctacattttagaacagcaattttgtgacaaggtagttattttcacccaacatacaagtgcattatatgcgagacatactgtgttctttccggggaaaaaaatattgtggcgcattttttataatttaaataaatccaggctatatatatgtatctggctaggctcgctatctactactccctccgtcccaaaataagtacagttttagcactgttcatgtccaatgtttgaccgttcgtcttatttgaaatttttttatgattactacttttatcattattagatgataaaacatgaatagtactttatgtgtgacttatgtttttaatatttttcataaatttttcaaataagacgaatgatcaaaatgatgaacacggatatatatggccgcacttattctgggacggaggtagtattat

SEQ ID NO: 97137 - DNA, 702 bp, Oryza sativa
aataatctatttgtttgtttcagcttactcctaataattcagattataataatcctaagctgaatcaagcggggtcttagtttgttgaaaaaccacccattacgtatatgcttaactgaatcaacatgtattttaaagtgtcagcgttaatgtggtctttaccaaaattaaatacctatagtcttgatacttttttgggtaagattccacaaacaaaattactgacaagagcttaaacgttctctcattgagttttgctatatgcacaaaaaaaagttcaattaaatatgaaaataagtctaatgtaagcacttggataaggttgaataggcttagcttagcctgtggtaactctacatcagtgctaacaggttaattcagttaagcacgtacgtagtgagatggttttgcaacaaaattaagtaggggtagatatttgcataaaatgatttattatgggggtagaatgtcatatgagatgattttggaatttttctctattatattttagagcggagggacatgagatttaattaaacacatccactataaaactcataggcaacaatgagatttaattaaacacattcactaaacacatccactatcaaaagcaaaacacccaccttgtgacacaaacccaggggctactgtaaaccgatggagtagaatgtacaaccgcacaaggcagcaactgaaaat

SEQ ID NO: 97138 - DNA, 833 bp, Oryza sativa
ccggttttttaaattaatctactaatttcatagatacatccgacatgtatttacaaaggtacgcaatattttatatgcaatttaccgtacctattttcagatattttcaatcaataatttattatgtttatctagagcatgttttttatacaatatctgtcgtgcgagtgttcccgatgttaggccgactacagtctaacgctgggagctcgccctattttcttccgtataaatcatgcttgtttacggtttacataatgcctgatatttacatctgctcgctatatcctgataatactagaagatccatacagtttttcaaatacatactcgatattctctgctatatgtcttaccttctagaaaatatttttcaggaaccattgagcactcgagtaggttgtggtcaagtacaccgtattgtcgagaacgatctcgacaaatgcagagtcgtcgcacctaacctaccaacgaagaccgatgacctatctcatagcaccggccatggctggactactcgagaaaaggttgttaacggataactcctcgcgaacgccgtcggcttgatcacccgacatgattgcgaacggacatctggatatgctataagttgggtgcgtgagtcatgctggctacatgagatgcacatgtaataaaccaactctagcacttcaattggtgtccgagagataactctacacgttcactggtcctcgaaccagtacgtagcaatctctcgcaccgcaacttccattggtgttcgagagataattctactcgttcgctggttttcgaaccagtacgtagcaatctctcgcaccgcaaacttccat

SEQ ID NO: 97139 - DNA, 830 bp, Oryza sativa
gattaaggtccatcaccaaagaatgcatatctaccacatctcattatcgggaaataaccttgttgaaaacttatgtaaaagagaggttaatcccataaacatttgtttatcatctatcaccaaagtaacaattacacaaattgtttaatccaagatctttcaatcttttctctcttttgtgatagataataatccgatataaacaatacaaagagatgatatgaaagataatttcaaatcaaggtagagatcttataatgaacaaaatatagaataagctcccctcaagatgtgcatacatatggatatgaaggaatgcatatgcacataatcaatcaatatcaatgagggagctcacactatattttggatccacaagagataccaagttagaatatgtgaagtttaatacatacctcccatcatttttactttcatatccaaataagactagtcaaagaaaggctcataaaaacgttagtctcatataattagatttgtcattaatcaccaaaaccaaattaaggcacttaaacttacatagggtcgatccatttatctactaaaactatccgtaaatttgtcctaatggatttttttgtcgctccaaaaatataaatggatcaaaccattagaacctaggtttaaggggttcaacccaaaataactttacatgtataaaatgattcaaaaaattgtacaaaggtgcttctctatataataatccattcctacaaaattcaactaaatttaccaagttttcatagtgtgaacgtgagtttaaaaatttttggtccgagttttacacacattaaaactagaatttttgg

SEQ ID NO: 97140 - DNA, 699 bp, Oryza sativa
catcgtgctccacgccgtcgcctactggccgttgcgaagaacgacactagcagtctagcagtacgcctcgagtcctcgacacgccgcagccgacacaggtgcgcatgccgctagacggcattatcagcacgattcagcagtttcgtctgcttggtgtcacacctgaacggaagctgtgcttcatcgacgcagcgaattcctcaggatatgtcggtttggcatcaatggtctttgagaccaccggagatgacatgtgtggtggtgccggagaatgggtgaggaaaggtggcatcggacaattgagccgccagttcaagattaagagtgcggatgccagtaaactgcggtggttctgcgagaagagttgcaccctcttgttcaccctcggcaaaggaagcagtccctggacctttgcgcttaacctcggaacaaagaaaatcgagaagttgactaccggtgtcgactgcaattggtggagaaactttgtgggatatgagatggatgctgcagcttacctcatgtccatagcaagacgctgatcattccctttcatgctttggcgcggttctgaaaatgtgagcacaagcgaatgagtgatctactgatctagttgtggcatttgtgggcgcattactctgcctgtgtttagttccatgccaaaatggaagtttgaaaagaatagaacgatgcgatggaaaa

SEQ ID NO: 97141 - DNA, 791 bp, Oryza sativa
ttcatgagaaagcaaaaaattgacaatacaaggttcatggcatatgttatctcatagaaatcgttaaatcatgaccatcatcttccccctttttgtttcaccctaacatctctaatgcaatcctctcaaacgtcgcgtggtaaaccaatgcataacactgaacttatacaggtttggtcctcaagatgagaccttactatttctgatgcaccccaccaacgatttgtggttagatacctcaagtgcaaccgttgtggcaagtgctacaagacatgttacagcttagaactgagctaaaggcagtactagtatgtcttttgcctatacaacgacaaggagtgcacaaaccaggtgtatgaagaaagggaaacaaagtcttctacagtaatgaaaaacactcttcccttgccccttcatgatttggaagactgttattaggccccattggatgcttgttggcatagaaagaccctaactcagactggggagcaatatgtgggttacgtgatcaccttccatgtaccctatcaccatggtgaagtgagcaaaagtaaaaggaaaagtgtaaaacccaaacctcattgaggggtagggcttatctccaataagtccatacatggagaagccttttcgcataataccactttgagcaaaagaacaatctcttatcacactgagattgcaagcatagatcgccatcaataataaatcatatggtgttcataccaatcaatcgggggcgccatatggtcatccaatcaactggataatgtgcataaccacgaaaaaga

SEQ ID NO: 97142 - DNA, 687 bp, Oryza sativa
ctaacatatattctggtttcaagcattttcaattattgatgcacttatgttgatgtatcaaaatccaaatgtgttacatgcacatataaaagcataaatttagattatgtttattgaaatacaaaattataacatgtgtacaatactatatactttctccatctcaaaatgttactacctaagatgagatatgatctatcctaggataacaaatctggacggagataataattgattgttactgaaggaggtccgttaaaattcgttgtcataggatgagttacgtcccattctagatagcaatattttgggacggaggtagtaattgttttttgctggtcaagggttttgacttgacggcaaattgatggcaatttcacaataagatgaatatgaacggtataatttggaattagagggtttgactagtggcatgtatatatagagcaaattccatcaaatacattttaaatgtgtggatacttatatacttgtaacatatgtcaataataaccatgagaatcccctttcatgaccacaaccttgcattttttaatacatatatgccatatatggattaaaatcttataaggtgaagttagagggacgtggtcacttacatgtaaacccacatgtcaatgatcacataaacaattcttcctgtatcttccttgcatggagtttcat

SEQ ID NO: 97143 - DNA, 597 bp, Oryza sativa
tgtgctgctactgagccgtggggtccccaccgccaaagctgctggtatccgtcgagatgagatcgaacggcgcaggagcaggatccggtgtgcggttttgaactgttgaccaaaccgtaacggcaggagttgtactggatgaatttattgggattacattttcaaaagagtatttcaaagttgtttttagatgattcactgatatggacagaaacggaatcttaacccaatcagaatcgatcggtcgtgcttagcaacttgtcctttttaaaaaaatgatgatccctcgttacggataagttgctctgatgaggcgatggtactagcaaattgcattacatggatttttgtttccgtctatcaagtggcagtctttctccctcttattgctcccaggtcttcatcgttgtgtgattgggctcgaaacaattatataaaaaccacgtcattttctcgccgaggattattagagcaaatagcccactagtagctataaatcatctattgtaatattatactagctaattcatataataattggatcctatactattaatatcttagcctatttattatacacacattacgtcttagaga

SEQ ID NO: 97144 - DNA, 686 bp, Oryza sativa
acaaattcagaaattctttgcttccacatcctgctgctaccagagcagagtctttacctgcaaatcacttgctgaactattaacccaatgaatttaatctgatctccaaataacaagcttagctgttccacacacacacaaaacaatcttcatataaaccagtttaattccctctaacaaatcagagagaattcagaccaactctgaatttctgacagagagttttcagagcattttcgctcactgaatccaaagatgaggcaagtggtgttctaggcttctgccatactactcctaagctgcagggttcaatcattgacggtttcttgtagcatcacactcacaaccgatggaggagaagaaagaatccaatgattgatgttttcttgtggtgagcccctgctgctgtgcctacgcatccaaaaatcgatcgatcgaatcgaccagtgtgtgtgtgcgcgtgctgggcccacatgaacgggtgccttgtcagtgtcaggggcccaggggttttggcaaacggttgcagctaagctaaccctctgtggataagccaaaagcagtgtgggtctcatgccttttctgcttcagtgaccagcttggccgggttgggttggccgtctgatcggtctggtccaattttgtctctgtgcctctagtgttttaggctttcagtttcttcgctg

SEQ ID NO: 97145 - DNA, 616 bp, Oryza sativa
aaaaatcgatcgggtttcgttgatgaagtaaacccaaccttcttgcccataaccaagaatgatacgcatatgtaagtgtgctttagatggaaattaagtaagatcgaatatttgcctctagtctgataacgggaaaaaaaaagaagattctttatgtgaattattgataaactcactgctgtaataccaagggactcaacatttttttcttatacttattataagcaaaataacttatcaacaattaaaaaaataatttattgctaaaacttttatataattgttcctaactatttaaaaaaagtaaatactggaaaataaatcatagtgaaaaacctttaaactatattttaaaaactaaatgttatgcttataagttaccatgttggtcgtaaggcgcatgatatatatattgatgcaaaagatgcaaaacgaaggaaacatgattgcacagctaagatacattagtttcatcatgtttgaactttgaaggacattgatagcaaccagagacaacaagtccaattgtggcacatgtcatattgtcattagtggccaaacaaatcacgtttatttcgagtagccggcggaagaaagagcactgaacctgccgtgg

SEQ ID NO: 97146 - DNA, 560 bp, Oryza sativa
atattacatgacctaaaaaaataaataacttattgtagccataaatataggagtcaataaaaaacaattttatttcaaggtggtatcaatatctttcttataatcataaatcgagcggatccggtagtgggaatgcgcggcagcaacggatccggtaatgaagaagcatgggggcagcggattcaactccccctccctcgcgtcgatggtgaagggagctggtggacccagccacccctagcccactaccccccacgacaaggacgaggacgaggacagcaacgacgacgatgacgaggaggacggcgggcatacatgatatggacaatattacatgacctaaaaaaataaataatttattgtagccataaatataggagtcagtaaaaaaacaattttattttaaggtggtatcaatatctttcttataatcataaatcgagtagatttaaaacaacaaacaattaggtatgagtgtagtgagtgtcaattcgttgcacaacaatagaaggttcgatttagtggagtcactttcggttgatatgtcatcgctttcgatt

SEQ ID NO: 97147 - DNA, 549 bp, Oryza sativa
attgaagatcgaaaccgatgcagctcaacccgaaagcaagaactcgttgaaataaaactaaagcaaaaaaggtggcgatgcgtggagattgtattgaacgtgtgtgttaaaagttacatagggctcgggtctatttatacccaaaaattacaagatatggccataacagacacgacaactatttttaacaaactccaagataccataagtctttgcggcggacttttgcccaagaatatctctaaggaaattacataaaacatcctaattaatagatacaattgccttcttaggactctatccatgtgcgggaatcaccttgaagcacctcaattcaacctgatgtcatacatcgaggtgcattgtcagaatcggctgcatcggcttacctagcccgactcagacccagccgattctaatcgtagccgatctggactctagccgattcctgctctgtttccgaactcgatcttcgcctccgactttgcttcgatctaatcctttttcctaatgccgatattaccaaaattggttgttaacacatgcccc

SEQ ID NO: 97148 - DNA, 536 bp, Oryza sativa
gttcaacgcgtacgtgcgagatcactgcgcttgcccaaactggcagcccaactgaaaagcttaccaatgctgtagcttcgtagctgttccgtctttttggatggttgcgctgaggcgggaccgaggggtacatgatagccgtgcggctcatccgaattgcgcgcggttggcaacgtgaggttgaaggctagtagaaaattgcagtccgactcgaaaggtccaagcagaaagggagcagaaaatggactttcctcttcatcagatgacagcatttacacctcacgcaatgaacacggccacccaacaacgcaccccctgtgtgtttgtgccacaatcaaatgcaaggaaggaaatactggcctgatctctaatctctttgcacagccggatcaactggtgctcgaacatgcagtacacgctatacagacaggaactgatctctcattcagtgctcagtactagccaaaaggaccagtaacatcactccggcctggttcacgggtgtttagatggtgctaaaactttttagtccatat

SEQ ID NO: 97149 - DNA, 612 bp, Oryza sativa
attttttttcctttttctctcccttttgtttcctccttttctcccacgcgcctcctcgctatctcgtcttcctcgacgacgcgctcttccttcccctctgtctttctctctctgtttggtttgtaatttgtgtgtgtactgtgcgatttggtgggtgatttggttgcttagcttccttgtccatttttgtgtttttttcttttattgtgaaaagaaaatggccttgtgggtaacatcgttaactaggctttactaacctcgtctgactttgtgtgcgttttactttaaaatcttttgtgacttttgcttgacgtcttcgcactaccgtaattgggagaaaaatgttttgcctgttccgactcacctatcttttgttttcctttgtgaaagtggcaagcttgatgtgtgtatttgaaatagattttaaaaaataaaattctagagagcatggtgcctattccatccgtccaaaaaaaaatctaggattggatatgacatattctagtataatgaatttggacagatgtatatccagattctgtaataggatgtgttatatttattactaggttggttttttataagacagggtaccgagctcgaattcgccct

SEQ ID NO: 97150 - DNA, 564 bp, Oryza sativa
atatcattagatgctcggttgcttgaactccattgacctatttggcttttggggtatgcatccatgccaacatataatattttccatcattctttttacactgagcgctgcccaaatgttggtttggttcgtggactgagattctcgggaggcttctatgttttttgatcgaaaggttcgtggtttctttgctggtttgtggttattttatcttcttggagtatatgtttgtcgagataattgttgatgtaaatgcagtcgtaaagctcttaaacgaactctaccaacagctcttattccgaaaaagtagctaaactgaagaatgaagaactctggttgggcaggccgagcacctgcagcatcggccactgccttacgagtactttccgtctgtgaggtcgactagacatcaacccttgtaattccgtctgtgtggtacacaggatttgttatttagtaattgtaaccattcaaattatctactgctattcatttaaagttttcaacttacctaaaagtgttttttgtcgctcgtcaatcgtcatgataacgaatgctcataca

SEQ ID NO: 97151 - DNA, 596 bp, Oryza sativa
cttgtttcatgttggacttcatagtgctcagaagtgagaacaatagaacataagaggcagctagctagcatcccatacctttgaggtagcaatctagctcaacataagagaccatatataatgcgtggtcctatgtaagaactatgtgctgcgctacttgatcccctaaaacctacttttattggtagcaaatactcaaatctggatactacacagagtaaattgtggttgaagtacaaaatttataggaaacccatacaacatccacataatttggtcgctagtcgcaataatccttcaccatgtcatccatagtcaactattgaaatttattttctttcgcatcgcactgtaataatccatacatatataaacatgtatcgtataaatcaagcaaatttgactgaaccaaatttagcggataaatgttgtgtatgatacctcataattgtcttgtccagctgcttttcgcaacaactttcgcagaggaaacactggaacctctttgtcaggttagtcccaaatgttattcaaaccgcttacatccctgcaatcctccaaccaaaatatatctttcttcgcctaatcaaccacac

SEQ ID NO: 97152 - DNA, 598 bp, Oryza sativa
agttatataaaagaaattaaagatattatatgttcaagttgagatggttacaatggttttctaataattggtgcatggggtgacatccaaatacacgatgttttaaaacaatactctagccttattaagtctaatctaacatatatacccagtagtttgaaggaggctataggtacatatgatatgataatggtgcatcagcaaatcgaccgcgtgatcaaatgcaaatatatatactccatatataagcagcaaagattttgaagttgctagcataccatcttttccatagagaacaggctaaattagtttcctagtatgtaaaaaacatgccctttcaaccaaccacgctacattaacatatccaacaaaagaaaatcacaaaatctacctttcttactaacagtaaaaaaatctcattgaaacagtgcaatagaaaacaaaacccagttatagaagtgtatggacaggtatgcaacacaacacatctaataccatgtggcctatggtcacagtttcatctattactttgctgaaaatgttcagtggataactggagtcaatggatcatcagtatgcaagatgttccataagactt

SEQ ID NO: 97153 - DNA, 663 bp, Oryza sativa
cctgctgttcatatttttggcccagcttgatgaagcaggctgtcatcctattctaaagagattatcaagctaatagcatgggcctaaaggaccaaaattattgtgggcctatggcagtgtaaccttgcttttttcttcattcatacacgtccgttttccgggtattgctagtgggcgggtgattgcttccctctcctcctagcgatcacccgtccctccctactaatactcctttttcatctctctttttaacttttctattacatcataaagttcaaaataaaattagtaaaagaaaattaagaaaaaaaatctaatattcattcatgtgcatagactttataccgtaaactttgcagcataaactttgtgtatagaaatattacatacatataatgtttgaatccgaatttgaatttgaatcggatatataaacttttgacttataaacattcgctctacaaactttaggtggataaactttagatgtgtaaactttaggtgtataaacttactaaaagagaaaaatataaagtatttaaattcgaatttgaatttgaattgagtatataaacttttgacttataaacattcgctttacaaactttagatgtgtaaactttaagtgcataaacttattaaaagaggaaaagaaaaaaaaag

SEQ ID NO: 97154 - DNA, 743 bp, Oryza sativa
tgatcaacacttaatcaagatcgtaagatatcaagatcgtaagatgaatctgtgagagctactatgaacaattgtaaataggtgtcaaaatatgtactacttctaatggctatcacataaatcagataattcatcaatgtcagttgtcctaaaccctaagttgtattttttttttcatgtgagtcttggtgatcagtaaattggtgatcaacgcataatcaagagcctaagatgaatctgtaagagctactatgaataattgtaaataggtgtcaaaatatgtactactattaattagacttctaatggcttgctagcattgtatataaacatggacgaagctagaacgaatattaacatatatcccatacatatatattacatggttaatattctaatcacatgtggtaagtccattaaatttttttaaaatgcccccaagctaccacgtgttgctataataaattagagaaaatattagaaattctaatgagaaaaaaaagcaaagtatctattacttgatcttcacttaaatcggtgggtccaatattataaacctgttgacagaaaacacgaggcctggtagatctgcttaactcctgcaggtccaaagctcgccttcgggtgtgttagcgtgctagttgatttgatcctgcaatcaacaagaaatagaaacaaagagaccgcggttaaatctataaatgatagccgatcggctaggtgccgatgacatatcatttatc

SEQ ID NO: 97155 - DNA, 828 bp, Oryza sativa
ttagctccaaacaaaaaggccaaattcaagaaaaactaaaccgactgataagccgactaatgatctgcccgccttggatccatctattgaacaagctctagatgaagaggaaattggtgaagatgttgaccaggctgtagccgaaatgagtgacacagaaagaacaccatcggcttcacccaagcaaacgcctccaactccttctgcccccgttcattttacaagagtaagtatctctctttgacttcttctgaaattacctccctcttcggctaaatactcatagactttgtggttgtagaagaagaaaactgctgtgaagaaaaaaccagcagcaacaattgtcaactcggctccaccagtaagatgtctttaattcttttgcttaatcaatctcaactggctctatataacacttgtctattctacagcctccttatcctgtacaacaaccgtcaagtgaccagactccatcggttgtggggagtcatcacatcgaggaagaagaacaaccaactgctcctgctatcccagtaagttttcctttgtctcaacaattagatcggctacattttacccagctcttactctttccgaaattgtctctacaggttctagccgatcttttctcttttgacatcagaaattatctcgatgaggcagaagaagacacttcaagcaaagctctagctcccctatctgacgatgtgagaagaacacttgaagatatctctcatcggctagaagcctcttctttagatagtttggtagttgactgtggatcaattaggacacggctgcatgaagttcaagctctgattcccgaag

SEQ ID NO: 97156 - DNA, 565 bp, Oryza sativa
catccaggagtccctcatctatacagcagtatattaaaaagttccatggaaatttaaaagcaggaacttgcacttcttcagtatgcaatcatgatttccactaatttagttgtctattcagatttcagaagatgacagatggatctactgcctggttggaggattaaaccatctttgctatcctaatcgatgttaaagagagcttcttcaatcctataaactcataatctctcgctaaggcatgtgaagttgtaacaagaccaatggacgacgattagcccaagcagaagtgtcccacccttttcttccgcctttctctactgcaaaaatagattgaaagatgctagaaaagaagcgttcttggtaatacaggaacatgaggaaaataaatagactataagctgctttgacatgggtgagtacacctgttatttttatgcaggtcctattttttttatcaaataaactttgcctcatattcatatcattaacggtttggaccatcatcaaaatgcatgtaattggacagttttactctatgtggtgctaatatgagctatcacag

SEQ ID NO: 97157 - DNA, 518 bp, Oryza sativa
ctattcccaataatcttccaaaattatcaaccacccctaccgtaccacggggacacatgggacaaatattctgggaactccactcaaagatattgcactggacttattgcttgttcgtggtgaaattaacacactactacagaaagcgtttttgcatacgggcggaatcgatcttcacatgcggttggccagcccgcatgcgcgaaatggtctgcaaagatcaccatttgcgcatgcggccgtcgcagccgcatgcgaagatcgatcttcgcatgcggtcccttaagacggccgcacgcgaagatagatcttcggacgctgtcgctcttgcaggccggccgccagcatgtattgtccgatgcggcccgtctacgaagacgctatgcgaagttgtattttcgcatgccggcgtactagctagacggcatgcgaaatacaattgagtgatggctacagaaatattgattcttgcgtcccggtgatacggaagggatggttgattattgagggatgaatta

SEQ ID NO: 97158 - DNA, 612 bp, Oryza sativa
gattcggtttattccttccatccaattgtctggtgatgagctgagaccattcatgttttagtgttttaccaggaaaaaacaaccgtgcacatagtagtttgtggcgatggaaggttcacgttacaaaatatgtcaagtatcaaagacataagaaattcgcctacaaaatctctagctatatgagtatatataataaaacaatgatggacagctttgcaaatcatacatacataaggttgacacccctaaaagtaacgaattacttgatcgattgctccagaacagcaaaatacctttaattggtatgattctctcacctgcagtaaaattgggcatcaggatttacctttacctcccccacaaccccgataggtagccgaatcagaatgtacatacacagaaaaaagagagaaaatgtttagaaaattgcacatgtaaaggcgtacagcacattgtgaaggaaagtttagagaaagcaagaggcaattctgcaggaaggacaggtgaaggagacaaacaaataagaaagtgtatagcaaggaaggaggatgggtggaacaaaaatggcaccttgctgcaggtcgccaatgcaacggaaaagagactgctgat

SEQ ID NO: 97159 - DNA, 866 bp, Oryza sativa
cccattgactcaccaagaaggaacttcttttttcctttgcactctcctctttctagaataaggtgtacacatagaaatatttacaatagaaatctttgtaaacatccaccaatcacatatactaatatagacaacaatttctataaaggtcatatgcaagtgtttacgcttcacaaatgcacaattaagggaccatcttcattattgcaatatgccaatggcctcaagaagtaaaaatatggaaacatggagtacattttacaagtactaaaagtaggaacaaagaaatgttagggttttttttctgctaaagggcaattgtaattgttagataattctaaagatatatcataaaaaacaatcttacatgggagcatcgttctggaaaaggaggcaaaaaatcatagaggataataatggaattgcttatagttttcagtgactcatatatatttgaaccaaatatattatgtgtacgtggttaaagcatgtggttacaaaaaagaaacaaaatatggtgataccaagtaaaattttattcaatatatatactatttggcagtgacaactgacaagtaatttgagataacattttgttgctaatttatatatatatgtttacattttttttgaaacaacatatgtctaaatttaattaaatccacttttataaatacattaattaaaatatacatgagcattgtagcatggttgattttctttctcaaaatacatattttgagtgaccaagcatttgagaaatcaaatactctctccattttttattataagtcgttttgacttttttcttaatcaaactttgttaagtttgaccaagtttataaagaaatatatcaaccattcca

SEQ ID NO: 97160 - DNA, 639 bp, Oryza sativa
gcttcgagccgatcaatattggatttgatcggaccttcagatagctgatcaagtttggtcttctcttcatgcacaagctgccgattagcttggattgcggcctcaatctctttgcgctcacggtgttcgactagtcttagcttggctttttccagcttgaactgatgttgctcgagataagcggctggagttaggacatcggccaaatcttcgggaatcagagcttgaacttcatgcagccgtgtcctaattgatccacagtcaactaccaaactatctaaagaagaggcttctagccgatgagagatatcttcaagtgttcttctcacatcgtcagataggggagctagagctttgcttgaagtgtcttcttctgcctcatcgagataatttctgatgtcaaaagagaaaagatcggctagaacctgtagagacaatttcggaaagagtaagagctgggtaaaatgtagccgatctaattgttgagacaaaggaaaacttactgggatagcaggagcagttggttgttcttcttcctcgatgtgatgactccccacaccgatggagtctggtcacttgacggttgttgtacaggataaggaggctgtagaatagacaagtgttatatagagccagttg

SEQ ID NO: 97161 - DNA, 606 bp, Oryza sativa
gcaacggctggcgcccccccagaccgcggcgccacggtggctggcgccgccctcctcccccaatcgaagcccttctgcctccgggcctcggctggcgccgccctcatggaccacggcgccagggtagctggcgccgccctccccccagcccgaaacccttctgcctcgcggcactggctggcgccgccctcctcaaccgcggcgccagggtggttggcgccgccctctgcctccctgcaaattgaagatccatattgcacaaatgtaccaattcacagttcgcaattcaaatcacaattccagattcgtacagactaaaactagttccaattgcacaaatcacaatgccaaaagtccatcacatagtcctcacatagtccatcacatattccacacatcaaacaatgccaaaagtccatcacatatcccacacatcaacaatgccaaaagtccatcacatatcccacacatcaaacaatgccaaaagtccatcctatatttcacacatgaaacaatgtcaaaagtccatcacatagtcctcacatagtccatcacattttatatcacatagtgcaccacatatgtcatactaccgggctgcaggaa

SEQ ID NO: 97162 - DNA, 529 bp, Oryza sativa
ttctttgaacttcactcattttaagtgtgaggttgtaataatggctgtacctttttgaccaaaggccggaatactctatttcattatctaaaaaaaataaaaatggggtggtagatatggccacaattgaataggtggcggcaaaggtggtggtgtttgtaacgctccgcttttcgcgagacgttaaaaactaattcgacaaaatcttatatgcgaaaatttagttctttgtgtgagagtctaagttgtgccaaggatctcaatttaatcccgttgttcctcctcatcgaaatcaaaatcctccacctcaaaaattcctcttccgattcgagtctccgaaatcaaattccgaaagtcaatcccttcccttgaatcctctccaaataattgttcccattcccgaaagtatcaaactcccactttgtttccttactcgtctccttgaacccttgtgtacaagtatcaaatttagattcaaatccccttttttgaatccccttggcgactcctccctctcattcaaatccca

SEQ ID NO: 97163 - DNA, 506 bp, Oryza sativa
  unsure (1)..(506): unsure at all n locations
tcgctcgtctaactaggattcggtgttgtactattttaaacaacccttccccgtttttntaactnncgntgctcttggcgcgttaaaaaactctnctnttctcnncnccncccccccccccccgagcggccttttgatgctgctcgnactggaccaaacgnanagctagaagaactntacaaggtccaaatcatggcttgataacatgccacccatgttaagtgaaatatgttcagttaatatacacatcaaaccaatgaagtggagataacttcaatgcgcaaggataaccgaacataaaagagaattttcattaccttatctacctgtcaccctttctcttacaatgttccccccacttgtggtagggattggacgcattcacacaatcaggattgatttctcctgtttgctctgctttcacaaaagttttgcccttccttgagtctgtaacagagagatagtaggcattaaaatgtctgccaaagctctcgtatatatacaca

SEQ ID NO: 97164 - DNA, 531 bp, Oryza sativa
  unsure (1)..(531): unsure at all n locations
gggaagggatttcagnacnnncnnannnnncntagagatcccaagatgcaggtgtggtgatcgttgtcaggttcttctttccataaatcctacaacattgggtcgaaggttctttgtttgtccaaatattcttgacgacgatttcatggtaagaatattttgattacatgaatccttattttctcacaacatttactaactttgcttgctttacatctattctttcctccccggaaccaccaaggagatgtcaatacagagaatggatagacaccagaagggttctaactccacctagccgtgttgtgcagcttgaactaccagagcaatacagggttactaaagcgcggtttgagagaggaaagggatcctcacataggggttagctattatcatataactttaagagcatggatcattatggccatgcttttataatcaagatagcagttgatataactttaagagcatggatcattatggccatgcttttataatcaagatagcagttgatacagagtaggtgctaaa

SEQ ID NO: 97165 - DNA, 521 bp, Oryza sativa
gcaagtggaaaggtaatgtatctgggagatctctcagttccttcggtgaattacctggatatggaatttacctctcgtcactgcacaatcttgaaactaccgcctgaggacaccagttccagaatgcaatagcttgtcaggcttgccgacagaagtgtgtcgttccatgcatcatctaactgcaagtctgcaactgatactccctccgtcccaaaataagtgcagttttgcactattcacgttcaacgtttgatcgttcgtcttatttaaatttttttatgattagtatttttattgctattagatgataaaatatgaatagtactttatgtgtgactaaatattttcaattttttcacaaaattttcaaataagacggacggtcaaacgttgggcacggatatccatagttgcacttattttgggacgaaggtagtagtttgattggacagctccatccatccagtagaactcttggttgcacaatcaagaaaagaacatagcccgatagatccaacaga

SEQ ID NO: 97166 - DNA, 681 bp, Oryza sativa
cctgatcaaacataattttgattagaaaagattaaaataatctactatattattaaaggaatagaaaaagaagcctccatgtgtgctctcatggtatagaaattctcacattaatcagaaaaaagaaaaaacagagtccatatagaaatacaattaggaaatagctgaaatttgaaattaaaaacaaggaatattagaagaggagactagagtccatatagaaatataattagaaaataactgaaattcgaaattaaaaacaaggaatattagaagaggagactagagcccatatagaaatataattagaaaataactgaaattcggaattaaaaacaaggaatattagaagaggagactagaatccatatagaaatacaattaggaaataactgaaattcggaatcaaaaacaaggaatattagaagaggagactagagtccatatagaaatacaattaagaaataactgaaattcggaattaaaaacaaggaatattagaagaggagtatagagtccatatagaaatacaattagaaaataactgaaattcggaatcaaaaacaaggaatattagaagaggagactagagtccatatagaaatacaattaggaaataactgaaattcagaattaaaaacaaggaatattagaagaggagtatagagtccatatagaaat

SEQ ID NO: 97167 - DNA, 524 bp, Oryza sativa
tatgtggagggttggactgccctaaagctacaaccaactaaatcctaaaactcaacatgccaaagtgccacattatcattcattagcaattattacattttaaacctcatgtaaacctgctatatcatctatattttggtatatttaaaagttttaaaatacaagcatgttcaatcatcatcccatataatttacataatatttcaatatatatctccctatcgttttctacaatattctatatacatgtaccgttcatctccactagttaatgccttttatcttctctcattaaaccttatcacttcaattgttcctaacctttagattattaatctatagtccaaattatttccctcatttttttctctcatgaagccacatcaccttacttttttacttttggataatcattctatatactatttaaaatatcataaaccacatcaacttaagggccctttttaatgatggatcaaaaaataaaaaaaaattctaagcttatgacatctagctatgttaca

SEQ ID NO: 97168 - DNA, 624 bp, Oryza sativa
attcctgcagccctttctagaggagttctcaactgtcatcgagatcgacagtcgagagggggagatagttgaggttgatgcacataagcaaggtgatgaggatgtggttattgggtcaattccgagttttgttggtgatactattgagaaggttgtggacattggtgagaaggtagtagacattagttgtgacaaggatgagggggtagttgtcgggacaatcccatgtcctctggagcgtgtggaagtacaacaaactaaaatgagagtatatcaaagaaggaacaagaaccaagttgataaggtgacagggaaggagcaagtgcaccagaggagccaaattcagaatcagggggagagaagtggtgagcctatgcaagagcaagacaaggagtcacaacagctgcagcagtttgagtacccagtcccagattcctcctctagcctctctccaacaagttcctccctccttgagacaagtggtaacatttctcctacctttaaacaagtagagttacctcttgcacaacgtagagaaactagatctaatgctggaagacctcctatacgccttggttttgaacaccttagttctagacatgacattgcaaactatatctcata

SEQ ID NO: 97169 - DNA, 849 bp, Oryza sativa
caccaacataaggttccaccactctaccaccgtagtaaacacgaacaagtctatccatctacaccaaaaaatcaaatgtaactttgcaacaaaaattaaatcttcattactaaacgtattccaaaccgacatattataaccaatgcataacttaaattgggccaaagctaactactccaaaaaaatatctaatccacctgcaactatcaacaagtttactagggcattacacatcgaaatattacaaatactccgtcatacaacccaacctagttctagttaactataatcaatttatataatgcaaccaaaattttctcaccttcatataattaatgggtaaaagtttaacctatagactatagcatcaattccatcaaattaaaattactttcatacctcaaccataatttttcatccatccatccatccaaaccatccaaaaatcaacattaccacatatatggttaaaaaaatcgtgacaccaatgagtacattgcaaacatgtagcactacaacaaaccaatcctaagaacaaatgctaaaaatcacaaattcgggtaaaaaaggggttctagggttacccaccgatctacaaattcaaccaataaaaacaaaaaaaaagaggggtgaatgaaggagtctacctttctcttcgatttccacaaaaaaatcccgcgaaaaacgagttcaaatggagtggatttgaggtggggaggtgagagggagagagagggggagagctgctgctgctcagctcgggttggtgcttgggcgaaaatgggagtggggaggagataggtggtagggcccacggggtttaaggggtcggcccacagaggaggggcg

SEQ ID NO: 97170 - DNA, 540 bp, Oryza sativa
caacggcaaagcggtttgcaatgatcgccatgggctgcctgcttgtgttctttctttgcgagtgcaaaaaggaaaagttgctgctttgggcgctgattgattcagcaaagcgacgtcgcgtgtacatgcctgcctgcctgcctgctcgtgccagcgtttgcgtcgcctgcgctgcactgcactgcactgcaacttcgttggattcggtcacttttgctgctgctggtggtggtggtcagtggtcactcccatttcagaattcagaattcagatatctctcggtgtctctctgctaatgtgggcgtcaacaacgacgaggagatgtggtgtggcttttgctttctgaatgattgttctgaagataaacgtactacgttcagttagttgcattgcatccagaattcagacatcatgcggatatctaacgtaaaagagccatcctttctttctctgatggtgtgtatcatcacagcgagtgatggtgatttctgctggaattaatcattaatcccaccattgcctgatcatgtgctggtaatt

SEQ ID NO: 97171 - DNA, 529 bp, Oryza sativa
ttaacttgacatagtgaacttgtgtagttcaggtggtatggttgggcctattcaacatggtatagcattgtttagaggatatttaatcttgccttaattaattagtagttttattgttttcaactataaatgtttacaaccgcctttatgcaaccgccttgtctccccttgcatgtatgcatcgttggtgtggcttgctgagtatggtggttgtactcagtcttgctatattccccattttcagaagtgtagtgcttatgtgttgaagatgaatgtagaggacgaaggcttatacctcagttgtgtttttgcctgtggggtggagctgaagtcccgctaggatcgcccgaatttttgttgttattgctttcttttcggtttgaggactaaatgcgtcctttgtaagcatttacaggttatttacgtttggatctatatattaatttgtcattttggggaccttggcttaattatggacagggatttatacacaaaatagtctagaaattggccaaatttcatagcataa

SEQ ID NO: 97172 - DNA, 598 bp, Oryza sativa
aaatttagcttataaagttttctttggcacaacttcggatccaaaattttccgaagcggtattccgaactacacaaatccatgcataggtctagatctataattacgttgataaaattcagataaattatttttgttcatgttttagatgaaatttagtactttaaacaattacaatttaacatacaaactttaaatctaccgtgggtctgagatctaaagcggtaccgaatagaatctaaacataagcataaatcaaacaatgagacctccaccattaaacatatcttcacagagagtagaaggttgtgttcggtatggtagattaggaactaatccctcggcacataaacggagcaagccgttagcatatgaataattaaatacttccaccgtttcatattgtaaatagtttgacattttttttctaatcaaacttcgataagtttgatcaagtttataaaaaaataagcaacatctaaaatatcaaatgacttataatataaaacgaagagtattagcctaaaacttaaaaatgaattaatatgatttttttaaaacataaattcttttaaaataaataccgtttaatcgttcag

SEQ ID NO: 97173 - DNA, 608 bp, Oryza sativa
ccttttttgcaaacatatccccaatcaggcacatcaatttttttcatcaagatgtatgggatatcatggcatagattaaaaatgaggggagtggtgcctgggatctcggactcaagcctagaggagaggtgccttttatttttcgtttttaaggggaatcggatctagagttggatttttttcgtcagagatagagaatcggacatattttttttttatttttttcgtccttctttttacccggagtcggacagatccaatttttttgtccggattttttttctgtaatggacagatccgattttttcctttaatgaacagatccgacttttttcctttttcgcctttttttttatcagacgggtttaggttttttttttcacccggttttttctggattggatagatttggttttttcgcccggtttttcgttttttcgcccttttttatcggacaagtttgttttttttcctttttttcgtccagttttttttacggacagatttggttttttggtctggtttttttttacgaacgatggaagcacctcttatttttttttaagtagtagagataagagaattgttgagttcattttgattgtgtt

SEQ ID NO: 97174 - DNA, 602 bp, Oryza sativa
tcatccggatcttctgtgctcactccgggagactgtatttcattattttgtgctgaacctgtgttgacggtcgttatcaatcagtttcgaccgtcaatattactaaaatagaggagaactagtgatgcttgcaatgcatatgtttgttagaataataatatttcactagtattaggtatactaaccttttatagagaatgacaataaagtggaggagaatcgacatcaacttagacgataaatcaatcggacgatgtcgagaaccagacttatgtatgaatagaccaagaactcagaattgacacgatgaattgggccaaatttcacaagtctgcggagaagagaagtccaggatgccagcagccaaattgtgggctggttgggccggccccaggttcggccgaacccatctctccattgttggatgtggggtttggcagggacgctccagatcttctcctgatggcgggtgcggggtacttcggacaattcccctttcacaaccgtcataactacctctatataaggagctcactctcttcacttcaacacacacctcaagcaataactctctcaattctcttaaggttaagttagtagta

SEQ ID NO: 97175 - DNA, 594 bp, Oryza sativa
atatagtacttactaaatatgaatagttttgatgtaaataaaagactaagcactagtcaataaacactaagttcataaagatttggagatattttatagtaacgagctaaaagggcaggtcttccctgggggccctccttaatactttttgcccgccctacccccttttcctccaaaactggtgatggcggctaaagtggagatggctggtgcgtacgccaggcaaggtggccgacggccggcgatgggttgccggaattattatccttttttttaattggtggaaggctttagggcccggttccaagattacaaccgacaaatggaggcggccccaaaaacgggacctatgagggccttataactgggaccaaagagtatttttgtgggagtgataatatggagcgggaaattaacattgcaccggcgaaataatacaggtgcaaataatatgcatccaaaactggtgctccccataattatcgatcttcttctctcgcgatcggtcagttctattaagacagagacgatcgatactaaaaaaagggacctagcttgcttgtgatcgatattgatggaaaagatccatcgatg

SEQ ID NO: 97176 - DNA, 600 bp, Oryza sativa
gtggggaagattgctacgtactggttcgagaaccagcgagcgagtagaatcatctctcgatcaccaatgaaggttgcggtgcgggagattgctacgtactggttcgagaaccagcgagtgagtagaatcatctctcgaacaccaatggagtttgcggtgcggcagattgctacgtactggttcgagaaccagcgagcgagtagaaacatctcttcgaacaccaatggaagttgcggtgtgagagattgctacgtactggttcgagaaccagcgagctcttcgaacaccaatggaagttgcggtgtgagagatggctacgtactggttcgaggaccagcgaatgaacgtttagaattatctctcgaacaccaatgggggtgctagagttggtttattacatgtgcgtctcatgtggccaacatgactcacgcacccaacttatagcatatccggatgtccgttcgcaatcatgtcgggagatcaagccgacgacgttcgcgagaattgtccgttaacgaccttttctcgagtagtccagccatggccggtgctatgagataggtcgtcggtcttcgttggtaggttgggcgcgacgactct

SEQ ID NO: 97177 - DNA, 2927 bp, Oryza sativa
aatgtcatgaatcagctcaacattgccacgtagacaccacgttagtgaaatagtcctctaaaactgtcaagggagtcaaatttgatcgattttaatagttgagggaggggccgatatatagttaaggaagtcaaagtgggcttattccttagggccaaccgtgtaacttagggccacatcccactagcccactagacatgaaccttacccaacaaaaatattaggggcaatttcattcttgctcctgctcctgttttgatatatacaatattgattttgctcctattttttaggatttcatttttgcccttgtttttttaaacaaatccaaagtttatccctattttgggtggacatgttgacggtgttaaatctttggcaaaaaagacatccatgcccttacatgctattgcacatttgacactattttttttatcatttgtgtatttgcttccatttgtacaagtagcaattttgataaacttccacaagcgtggcaattttgacatactatggataaattttgatttaaaatttgacataattttgctagaaattttgacacattttgacaaaaaaaaaagaaagataaaatggcacaaattagacacattctttacacaacatatagcaagcataagaaactcaagaaaatccaaaccaaagtcaagcaaatccaatctcgcaaacatggtatcgcggccgttgccgctgctgccgtcacttcctccccatgctgcgtcgcgccgtcttccaccttggggacagccgatctggactcgggggctgtttggttgtttgccacactttactacgccacactttagttatgccacaatttcttacgtatgtgtttggttcgctacggcaattgtgtcatgccacactttcatagccttgggacccacatatcacactctcaaatttgaagctaagcttgccacacttgtggccaactatttttaagccacactttgtgccaccatgcctcaactagcctaaacttagttacggcaaggttaggcatcaaccaaacatccccttggtcccctcaatctgcagggtcgctgttaccatcgtcgtctcctgctcacatcccaacaccaacacaaatcctccccacagctcctcccctaccgccgccaagccccttccctgccaccaccttcaagcccccattctgctgccgccttcaaaccccttgcccgtcgccgcctagccccctcccagccgccaccaagtcccctcaacgccgtcgcctagccccctccctgccgccgcctagcccgcgcaaagtgccggtgggaggggtctgttcctgactgacgcacgctcgccgccacttgccgcgccgccggatggggtttctttcgggagtgaacccgtgcacacgagaggctggaaggtttcccctacttggatatttcctaagggtaaaaaggtcaataacaaattaaaaaaaatattttctttttttctctatttctttactgccataaacccggtcccactcaattccgtctaaaccttacccttttggttaaaaaagtggggataaaaacaaaaaccctaaaaaaggtaaaatcaatattagacatggcagaaatgaaattatcccaaaatattatcagctgatagttaaatatttctacttttgagataggattgaatgtgttcatgagccaagtcctgtctttgtatcccactggtctctggcggcttccctagagcctctggttaatggatttgttgatcctatgtcaaaaagaaaatttctgcttttcagatactccctctatcctataagacatggtcaaatttgacatggtctccaaaactaatatttgtcttataatttctcatatattatagggaaaattggaaccatgccattataattttgcaaaatttgagatatgccatcctgaccatatgaaagtaaattcaaatgtgaatccaatgatatattttttagcaattaaatttaattcatattgtacttgaatgttggtcaaaatattttaaaggtagaatctggaaatgtgtggacaccttatattatgggatgggggagtaggatctaaatcaaaatcgaattctcctagattaattcaatagcatcccatttggccatttgcaaaaacttgtactagtacagttgaagccaattttgacatactattttctcttttatggattgtagtatcaaattaaagcaaactgatcatgtttgatgaaccatcattagttcaaattcaaatactcctagcattatgtttcaaatgattagtcccatttaggcccgttcgaatcctctataaatgaaggataaactttgattttcgtggtacgcttttcaaacggttaaacggtgtgtttcgtgcgaaaactttctatataaaagttgttctaaaatatcagattaatccatttttcaagtttgtaataattaaaaattaattaatcacacattattactacctcgttttacgtgaaacacttgatattcatctttatgggtctgtttggttcacagcccaaaccagccatcaagttgtggcgtcgccagagattgtggcgagagaaataatcgccacagctgtggcggaaataagcatgcaaatgaactagcaaaaagtgtggctgccacaactcacgtattaatcaaacatcagtcaaactgttgtggcagccgcatgtttggcgaggcaatgtgtggcggggatccaaacaccccctatatcttcagaaattcaaacaccaccttataagcaactttgagtgtaaaaacaaagaaaataaaaggagagctttaaccccctcctctctgccttttcccacgagtggagtgaagcggaggagaaggaagcatcgcatccgcctccgatccggcgatggcgagggcgccgccgccgctgtcgtcgttg

SEQ ID NO: 97178 - DNA, 712 bp, Oryza sativa
tttagatgtgaagagtaaaatagatatttggacaatagtaatacatgcatgtcacactcacaccaccatatgtacataggcaccaaaataaaaaaatacttagattcataaaacacatgcctgctagtttagtttctagtagctcttaggaaaaacttgcattcacattatatgccattatagcataacagatgtaaccgtggtacgaggaaatgaagaatctaggttcatgcatagtcggacgcatgtattgataatatcatcacaatgcattttgaagtgtgtcttgtaatagaatggggtgtcaattgtccttccatcatccattatcattgccgacatcaccatttctatgaacacaatcggttagtataaaattaatcaaggattcgaaagagaataaaatactaatatatagaactcatgtggttacctgatgatagcaacataaggacaagactaaatattactattataatgcacgtcctcgtccttgtcatatcttgaaactgcatgttgtttatgttaagaatattgatgtcttatgtttcagattgatgatgcctactgattgatgtttcagattgatgatgcctacatatggacaagactaaatattactataatgatgcacatcctcatccttgtcatatcttaaaactgcctgttgtttatgtcaagaatattgatgtcttatgtttcagattgatga

SEQ ID NO: 97179 - DNA, 630 bp, Oryza sativa
aattcgagctcggtacccaaaactatatgtatagataaaagtatatttaacaataaatcaaatgataggaaaagaattaataattacttaattttttaaaataagacgaacggtcaaacatattttaaaaaattaacagcgtcaaacattttggatggagggagtattattttaatattagttttacacaaaacaagtttgataccggcggaaatttccgtacattttttttacccctacaaccgaacatgcacgtacgcgtgcgggttgttccacaccctgtcctttttgatcgatcgatccggacaagcaacaagcagctagcaagctttcgatcgagccacaaaatttcaaaggaaaataagctaaaaccccccccgggggggtgctcaactacttcagcccgaacaaacttgcatccggccggtgtgcaagccgcgcggcgcgcgcttcggtttacgtacccggtagcgaaaaaccggaaaccacggcgcgcggtttacgtgcgtgcgtgccggggatgcttcccactcgcgcgcggcgtgggggtttcgtgggggtggacatggactggtcgtcgactcaacttgtgcaggtgagacggcacttcccctgactggctgggtgacg

SEQ ID NO: 97180 - DNA, 516 bp, Oryza sativa
gcgaattcaagctcggtaccctgtgaatttgcccaaaatttaatattgtccaatatttaaggtttattaaagattctataattttctaatgagaccgttattaacacaataccacattagctcaatttatttatatgttagtttattttatatggaggggtttaatatatcaaatttcaatccctaaatgcaattaggaacttggtgcaaaatcgatctacatatcgaattaaatactcccgtaattctattatatatatagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaatcatatctattgcttaaatgtagttcttttctttactttcttggtgatcatttacggtttggcaagcaatagcaatcataa

SEQ ID NO: 97181 - DNA, 599 bp, Oryza sativa
atctaagactaaagtatgttctcattatttattaattgatggattaggatggttcgagactatgttaaatacacaagcttgtagagtccaaatctattgcgcagtatataggagacaacctatataggattattttttgcaagtgtgcaaagcttcacatagcctagcaagaacacgattggatggtaaaatataactacgtacgaaggcatcattttttttggaataattaatattaggaattatgtactcgaagccaacctctctacaaataatttgtttagctagactgcactggagcataaattaagtacaccgagattatgtaatcatgcatatgatgcttacaatatgtctatccacttgccacaattttcattgttttcatgctatattatttagattataaaccatagtttatgataatcttttaaaataaatagctaatttttataagcttacgacattggattatttataactaatttgcagttaaagactcatattaactatattccaatacttctaaaagaaatatgttattttgaattatagtatgacattataatatgttatgtgctgatggttatatattggat

SEQ ID NO: 97182 - DNA, 597 bp, Oryza sativa
tgttctggttagtttgttcaatcaatacaatggaatatatgaacaaaccagccaaatgactcattatttagagattatctagagagagaaatcaagtactagcagagtgatctggtattgttgaacgtatacgcttagctagctggtcgacagcgaccaatattaaaattaatggataaatcgatcaaccttgagcgaagcaacaatatgtgtattgatcgaaagttcacaaggaatatatgcttttatactctcttcaacaaaaaaaaatgtatttgcccccaaaaaaacaaaaaaaaagtattttatttttcaaagtcaagatgaatgctgtgcgtgatcagaaattttctcatcataacactaaaactagccgaaatatgattgtcgtttatttgaaactaaatttgtttggatggacaactctggtaattccttctatctctagaaactactccctcttggcctcttgtacaaaatataaggattattacgtgatttccaaaatttttctcgacgttccgatgcatttttttcagaaatacacaaaaccttcatatatattttaggaaacactaaaaatccttatatatttta

SEQ ID NO: 97183 - DNA, 536 bp, Oryza sativa
gtcttttgggatggagtgaagcaatggattttcaaaactccaactccacccctgtagttcattttctaggggtagctctgctagatctactccaaaagacgaggatctgtaccgtttggcaattggcacagctctggctcgaagtaagttagagttgggagctcgaaacgggcaacggtggatacagtggtcccgggaccacctgaaaaaagggcgatcgactcactattaaaaaaaatagcgactattgaaaagaaaaaaaagcgatataatcccccttcccgactcccgacgccctaactatggctcacaggtcccacacgtgagtcgcgacgtgcgtgtatcgaatcgatcgacacaactctctctgtctctctcctcatcgccctaacccggagcccccggccataacccatagcgaggacgccgcgacgcgagcagccgatcaccgaagcagaggcacaccgccggcagtccgccaatccatgcgcgatccagagcccgggccccacgctggctccggcggaaacggggcc

SEQ ID NO: 97184 - DNA, 1109 bp, Oryza sativa
ccccctaattttatatgcatatgcgtgatgaaaaatactcagtgacactacctatagctatgtttctatctctctatatggaagcgtgtgtttgttcctccttgacaatgcctatacttagtgtatataatttttttctaaaaaaatcatattgatttattttttaagtttattttatctaatgcttaattaattatgcgaaaaagatcgctttgttttatgtgtggagaggtgaacatcttaaccttcacctccgaacgagattcttctgagcagttggatatggtcccaaaccatattcttatgattatctctatagaagcacttttgtttggcatggatttagcgtctcgcagacgcaagattaaacatgaacaagctagtacaacctgtgtacctttttaattgatgttcttgactagaggtgtacctttttaattgatgttcttgactagaggcgcgcccttcctttgaggtgtgactttcaccattaagtttttgacaaatttcgttacataggctgtgtttagtttcacgttaaaattggaagttttaaaaaattgaaacgatgtgacggaaaagttgaaagttcgtgtatgtaggaaagtttgatgtaatggaaaagttggaatctaatcagggccataacacacaaattttgttttcggctgtgtttagttcataccaaaattggaagtttgcttgaaattgaaacgatgtgacggaaaagttgaaagtttgtgtgtgtaggagaaagttttgatgcgattgaaaagttgtaagtttgaagaaaaactttagaactaaacacggcgttcgtaatttattggtaacatcatgaaaatgtgtgaggactcaaagacattgtaaaaactggcaaattgctagaagacactctcatcttaattgggagagaatttctttaaaaagataagagaatggccaaaagcatctagcttaaggatgtcgtgaatatgaaatattatgtatgatgatgatgtacttgggggtaataacagacttagagttaaataatttagaaagcttaattccaaggactacagccccagatggcatatatttagatagtgttgggaggtaatcttccg

SEQ ID NO: 97185 - DNA, 547 bp, Oryza sativa
gcgaattcgagctcggtacccaactgatgttgagagcaaaaggggtggatcattttttactagagagttgtgaagaaccttctgataaggagagccaagcatggaggacgtggaatactacaaattccactgtggtatcttggttgatgaaccggtggctccttctattggcaggatgatagaagctatccagaatgctgcagttgtatggaagacgctgagcaacatgtattcaggagagggaaatgtaatgatgatggttgaggctcagaacaaagtggagaatttgaagcaagagaggagaacagtcaaagagtacgctagcgagctgcaacagttatgggcaaatcttgaccactatgatcccttacaattgaaacatgaggatgacattgtgattggaaataaatggctgcagaggcgaagagtcattcatttcttgaaggggttgaacaaggagtttgaggataggagtgtcacgcccggaaattcactagtaatttccgaacttatttgtgcataaaatcctcgtccaggaatcagccga

SEQ ID NO: 97186 - DNA, 717 bp, Oryza sativa
aaaaaataattatacccaacaattaggtacaaataaattagtacaattacacctaaccattaggtacaaataagttagtacagggacaagtgctctcagttaaagtacaccaacccaaccattaggtacaaataaattagtacagggtggattacattccttcagatactaatattcaatatacaaatacagtggcagccactaggccgcaaataaataaggagattgaaacgccactttattagttggaagcaatacaaatctcagcacacacaagtacaacgccgaaactcctaatgggtgatcaatcactgggtgacaggagcagcgatcgatttccctttccgccacttgccgccaccacttgccttttctggcttttctcagcctctttcctattgggcttggcccacgagagcccatccacagcacgcaatatcagttttttttgccaggcacatgcacttgctctcgtcttttccaccgcttttttcttttctgtttttttctgtttcctcacgtggtttttttttggcactgcattatttttctattttagtaaatttttgcacctaaagtttgtacatcttaaatttacacatctaaagtttatacacctagagtttatagacccaaagtttataagttaaaagtttatatactcgatttaaattgaatttaaatttaaatattttttatatatagtacacgtaaaag

SEQ ID NO: 97187 - DNA, 614 bp, Oryza sativa
ccaagtcataaagtaaacaatgtttttctaatactaagttttacgccttcctcccctgtgttgcggaaattggtctcgacacatctttacaggtatcaccaaatgagctctgtgggttcattcataatcatattatagacccagctggcgaggacaacgtcaacaaagaaccaccagtatcacaatcactaggtgaaaccccgcgtgttgctgcaggagtttactataacactaagtaaaactaatgcgtaagatagctagacaatataaacttacataagttgatgtggtttacgataatttaaatttaaataatgtatagaatgataattcaaatgtaaaagtaaggtgatgcggctttaagagagaaaaaggagggagatagtttggaccatagattaatcatcttagacgacttaatgagagaggagagaaaaataacgctaagtgaggataaactatataggaatgtttagatttagtaacctttgacttaggatatactagaaaatgggcgcgtcgttggcacgccaactaatataacccgcggatattataatctatttatttagaatgtatgaataatatcatgttaagttatcatattacttttt

SEQ ID NO: 97188 - DNA, 598 bp, Oryza sativa
cctctcgactccatgccggaatgactgggttcgtcgcgggttgaagttaccttaatgaactcgaagcgaagcccggtagcctcccaactccatgccgggatggctggggtcgtgctggggtcgagagtgagtaatgtaaggacctgtgccaggctcttagatgcgcacccagcacctgcggagccgggctctgaggcaggagatcacaagcctcctacgtggcaataccaaggaaacaaggaccgtgaagcccatgaacccgaggtcttcgctcaactcctagagggctctgaccagggtcgggtgatggcctaagggtagtgggcccccgggtgtggccgtacttcatgtgacgggggccgtcggacctgaagcctttgctcaacccctaggtggttaccggccacctgcggggccgatggtataaggaacacctagcttagccgggaggggcatggccagggcctggcggttgccgggagatttcgagccttcgggcgtggcagaatttcttgtggtcaggcccggcagcgtgtgatcttcacctcgtgccttgacggttgcggtccgctggttggagagggagacgctcctgacc

SEQ ID NO: 97189 - DNA, 583 bp, Oryza sativa
gcattccttgctagttaataaaaaatattcaagctagctaaggtacgactaattaactaattaaatttctctcttgagagaatacaggattgaagatggaagttatgtcaatgtaacattggaatgatcatgtggagatccatgcagcggtaatttttaaaatattgcagacattgctgtactcccttttaaagtacacaaattttactatggtctctactagactgtaggtaaaagatacgacaaacatcttgttattttttcatctgagatggagggagtatttcagaccgacaacatctgaaatactcatttctgactaaagtcctgataaaaataaaaaaaatttgacaacatatatagattaagcaccaaatactttctctgggttttacaagttgtgaaacagtaaaagtattcgaaaaaaaaacactctgttttcagtttcctccaaaattttataggattttcacatgaaaccgttcaataccttaaagttcgtgcgaaattcctccaaaccgaatagcacccttcaaggtttaaaagccaaacaaactctgccagaatgacgtgtctgattgtt

SEQ ID NO: 97190 - DNA, 638 bp, Oryza sativa
cattttcggctggcggcctcctggacttcttctcttcgcggacttgtgaatcttggcccaattgatcgtgtcatttctgagttcttggcccattcgttgataagtttaattctcgacattgtccgattgattgatcgcctgttttgatgtcgattcttctccatcttatatttattctctgcgagaggttagtaatcctagtgctagtgaaatatttattatcaaacataaatatgcattgcaagcatgactagttctcctttattttggtactattgacaatcgaaactgatcgttaacgaccgtcaacaaaatcccccaagcttgaacctttgctcgtcccgagtaaaggacgaaaggaaacaaagtcctgattgttgatcaggagttgctactatgatgtatatctcaaatgtacaggtgcaacgtatgtgtactctttctcaaatcaaataatttttggcacggtgtcttacccttacccctgattctgtcacgaccggaaataacccaacgggcgttccttacgtgtgtgtattattccttgtcccaggaggcaaggtacaccaaaagttgatacaactcagagtttatcaagcggaagcgtaaatagttaattattacatgggcaacgaagg

SEQ ID NO: 97191 - DNA, 591 bp, Oryza sativa
atccaattcaaaggaaacaatatgggataggatacatgataagtccgtatcaggctccgaatttaaaggaaaatatggtttaggatatgggaatgtcatgattcaaccgtacccgtccgttttcacccctgcttatatctcttaaccgatgaccgaaattatcggccccacctactgggtgtcggttacctaaggggttcctaaccggtaccaatgagttttctgtagtagtaatatttggtaatttccaggagtatcgaagcagaaatcatacatagcaagcaaaagtcgttgagcaacatgacaccaattgttccacttgcaacaacacggtttcatcggttctattttctcctgcatgtacgaacactcttaataagtttaataagtgtccgtagtttctattaaagcaaaggctggattttaagtttgtatggaaatcgcgagacgaatattttgagcctaattagtccatgattagccataagtgctacagtaacccgcatgtgctaatgattgattaattaggcttgataatccgtctcatggtttccagacaagttattaaattagttttttcattcatataaa

SEQ ID NO: 97192 - DNA, 507 bp, Oryza sativa
actatagggcgaattcgagctcggtacccacgcggctaccgagcgggcacactaacacggtcaccacacgcacaagcgaacgactaccgacaccgatacacgggtaccggggccgacaaccgcacaacaggcacaggcgacaccgaaaggacgaggacggggcagcgagggagagggatccttaccaccacgcgacgaggcgtgggaacgacaacgacgaacgggcgcggcggaggcggtcgggaacgacggagacgaacggcgaggggacgacttcggcggcgatccttggacgaaggcgagacacggccggcgcagggcttgacgacgcggaggcgaggacgaagacgacgacggggctgcagcggcacacttgacagacgcggacgtattagattgtgtctaatccagtattaagttgctataatttacaagagggagtagtacgatgagtaaatgtaatggtttttctttgaccgaaatactatgggtattgttagaaaggat

SEQ ID NO: 97193 - DNA, 547 bp, Oryza sativa
gtgcgccggaagtattcaggaagattaattgaagaccgattattgcaaggcaagtcacacagatcctaaacacaatcctttgagcatgttgattctatatttaaattctctatttatttcaactgtgcatttattttcgaatgtcaccgggtggtgtgaaccttttcctttgttatggccaatttgcattgaatgccctattccttgataccttgggtaataaattgattagcttgaaccttatgtattggtttggttcagctaaatgttatatatataattgcttagcaatgcttagaaacattagctcactaatgtgatgaatcatatatactacattattatttatggttatatttaatggtagctcacgatggttaatcgggttatgataattaattgataattaaaacttgattaaaggtgggtggtaagcaaatggttttaaaagtcgtgctcatggcaattaaggaccggttcgcgagctactgttgtgagacatttaccgtaccaacaacaagccagcatgggcaacggttttaccttt

SEQ ID NO: 97194 - DNA, 738 bp, Oryza sativa
gtcaaacatgtggggccgggtcgcggcgggagctgattggtgtgcaggcacgcgatcgatgcgcattcaccggcctggacggcctgcagctagcagcacgcgagctaggggtacgtacacacgcaaacactggagctagcttgcaaattgccagcatatgcagcaagcgagagggggatcgatcagccggagcagcaggtcacggtggtggtggtgggcgtccgtccgtccgtcgcgctcccggtgtcgccatccgccttgatcaagcttttgccgcgcatgaatggcgccgctagctgatgcgcagcgcggcgttccgatcgatcagattcgtgtgtgctcccgtgtgcgttctgatctcagtggtgatgacagtcagtactcgtaatcaatcctctgtgatgtctgtgtgtgactgtctctctctcttgatttcgatcaaactgctggccaaagtgcacacatggctgatgagatattgagatctctctcaatcgatcgagctctcgctggtgagcctgagatagatctaggttggaaatgtcgctagctgcatgcatgcggctcgagcagcgagagagcctttgatgatgagggagagatcagctactacagagatctaattgtgatcaatatgctggcatgcatgcttgcatcagtggatggccccagctgcatgctatgctgcgtgtaacacaacccatcgctagcgagagccactagtgttgctctcatgca

SEQ ID NO: 97195 - DNA, 650 bp, Oryza sativa
tcaaatgataggaaaagaattaataattacttaaattttttgaataagacgaacggtcaaacatgtttaaaaaagtcaacggcgtcaaacattttaaaacgttaaaacggaggtagtaagtgataatggcttcatttctagttagcattgctgtaagcgcggtggcaatggatttggtcattaacgcaatactccgtctgtttaagaaactccaaatcttaaggatgaatctggacagttcattgctagatttttttttatttttaacagagggagtaggtcacaaacagtttttgccaaattggtccaattagggtcatgaacagtttccgctcgagataggttaatttagtttgtttcttgtgccatttatacttgtattttatagcaagccaaaagcaaaattacaaacttcaaatatttcaagttatagctaataaaaaattagttttttaaatggatcctggtatagatgaatagcatctgatgtcgtgggcaaatgtggtgcaaccacataaaacagatcgatttgttcatgtgcaaatatgtgtggtgcacctacaaattaaaacatatggatatttgatttatcacttcaatcagctctttacgatggcatttaacattatacctcccctagctactaactg

SEQ ID NO: 97196 - DNA, 689 bp, Oryza sativa
cccaacagcatagctccaaattttctagtcaaaaataatattttatcaaatatcagaggcttaggaaaaaacgatttacctctaataaaagagccaaaatttatggactaattaagttttctgacctaaacaaaaagtaaccatgccacaaaaaggaatccaagaataatcttacaacactgtcactcacaaatcggaagaaccttttactaagcctacttaccaatggttggatcatccttacagtcctactcctaatgctctactggttggtccattttgaaattgctagtaccatatttctcaactaagggtgaatgcaagcatttaagatgcttattgttattgcaatctctatttatataaccagtttttaactttgaagtagcttgaaattaacatagtagtataatgaatcctttagtgcagacatgaccaggaggtactgatatcactactctctgttatctccaagatccttcttttccaagtctaccatccaaattaactatgtgaaagcatatagagtcatatgaataaatcctgaatgctacagcatattcaatgaaccctacctggtttgcaacaaatgctctaatggagctgcctatgtatggaagatttcatcttatgaaacaaaacttatagtggaaaataacaccagaatcagaatgttttgtagctgacta

SEQ ID NO: 97197 - DNA, 1040 bp, Oryza sativa
tgcaccgcagatcgtacagcggtcagttagcctttattagcacctcctccatcagtccaaaaaagacaaatcataagtttccgtatctaacgtttgactgtccgtcttatatgaaattttttataattagtatttttattgttgttagatgataaaacattattaatattttatacgtgacttgtctttttatttttttttatattttttttaaataagatggacggtcaaacgttggatacagaaatccaaggcttgtcttttttttaacggagtgtgtagctattgatttcgtccaaaacaacatcattagctggtgctagtgtggagattatggcgagctgtcaccaccagaatgactctgtagcgaaacaggatgcatgccatgccagggcaagttctgcatggtgcacaactatgcatgtacgtgcacggcactatcagtggatcgactagtaaatgatagtactatgcccgtaatataagcaaagtttatatatacgcagaagaatgctattggaacaagacaacacagcacattcaacttgagaacaatataggtgatgtttgaaaagcagggactaaactcacaaaaacataaattcctatgagagggactaatccctccttcccaaacaccaccgtaacatcattatttgcttgtactatgctactgattagtttggctctgatttgaacctgatgtttgtcgatttaaatgtgtggacgtgtcaatctaaattttcgaactctcaatttatcttaggtgtcatgcagatccaaatagactccaatctactcgtgctaatattcatatcacgataacacctatgtatcaatgggactcatatgttagtcacatagaagaaaataaagatatctcatctctctatcgctaatctattgtaggcgtctctctagcgaaaatatgtttttaattttattttttatatgactaacatatgggtctcactgacacgtatacgtcaccatggcatgtcacgtcagcctacgaagcgggttggtgcctgtttagactt

SEQ ID NO: 97198 - DNA, 539 bp, Oryza sativa
atccatgattgaaggggctcgtatcatgaccattgttatcatatgtctatgttaatctagtcttagaatatcgatttagttctatcggctgcttctcgctttagattttctgctggtatcggctaaatcgacttgctagattagattaatttagacatctaccatcttgaaaatcagtcaacggcttgattgtctagatattgtgtttcttttcatacttagtgctgcatcaatgcattttcgacctagtaagtcgtgtttagaaccatgatccatagcaagcttcttgatcactaataggggtagtatcggggttttagccgatcttacctaatatacatgtttctttcaggtggcaagcaagccatccatattgtattgagcactttgtgcttgactgcttgaagaaagaactgcattacgcatctaccctatccatcctataaaataacatcctactactagatatatcacatcctagtacaatgaatctgaatatgtctttatccagattcgttctattaagatatgtcgcgtcc

SEQ ID NO: 97199 - DNA, 570 bp, Oryza sativa
cttagatataatctgtttttgtccagaacctgcggtttgtacagtctttggttatttaatggttcttatcgttgctatggatgcctcatgccagaaaggcataatcaagtcaacatgcctgtttcatgcagtctattgtgctggtgttgtttagatgtagtttctcatttacttatgcagtaatttcagcactctgcagcattctgttgccacctaattaggctaacatgtttcctctgtttaattatggtgaatattagaaggccccaagataacaggatgaatatgtctagttttacactattgagcttcgagcaatgaaacgaggctgttgacaagcttgaatcttgatgatgttataagtactagtagtttagtagtatgcaaagtaatttttaatagagcgctgtaatttttaatgacatttgtgcttaacaatgtctcttcctgtttccagagttctgcacttggatttttacttgcccaaaagcacttcacgaatccactcgtagctgttccatctgctgtcagtgttgtatgcatggcggtacgtttcattcctattttctc

SEQ ID NO: 97200 - DNA, 605 bp, Oryza sativa
ttcgatgtttaagggaaaattcatcattaccttctatattttgagtatcttctggactatatttgcatgcctcagaacaagatagaaagtgaattgattggaacttctcatagtattatgttctgtctctgtagtcagtcgaagtatttgctgttctgtttagtgcaatcatgacccattcttcaatcccctaatctgattgttttcaccatttttctgttgcaccttatgttttagtgttatggcatttctaatctgtagttcagtagtttatatttgagaaaaaaagcccagtaccttttgcaattaaattttctactaattagaccaaaaatttcaaggcgtgatagctagcatacttgctttccttacaggccacatagttatatttttaaatagtgcaatttcatccacatgattaatgatcctacagatcagcaaaactatattgctggcctttcttgaataatctcattattaaacacttgttgctctgattttaattacttatggtaatgatgaaatgatctgttgtttcctcagaagctgtcaactattgtgcaaggctgaagctaacatatccagtaatctgccagagagcattc

SEQ ID NO: 97201 - DNA, 549 bp, Oryza sativa
aagtatcagcgaaaaacaacttcaatttttataatagtagagttagagatgaataaattgatgacggaattaatttctttagtaaataataattatattgaaatttgtgaattgaagactaaaaatcaatctagctccgccacttactgcatgctactgtgttttatcacagtgttaatccatggtatactgttccaccactttaaaatttgataatggtacgaactggtttctaaatatgtaaagcactggccagctccaataacaacttgtcaaattaagaaacccacaaacgaaaggcaataatagccttcatcactgcaggagaacactactggtcctcctccctgaactggatagggcaaaattaaaccatggtgaggactgcggaccatatgccacacggccaggccactacttttagtgatgcgtactacgcatatatatatgcatcgatctgagatattctggatttctggctactggttagagtgtgaggaccatcttttgacccactttatagagtgatccgtattggacacagatata

SEQ ID NO: 97202 - DNA, 864 bp, Oryza sativa
caattgctaaatctggtatacatgtcttgctgactcacatattcgttcctcctaattaaagcactcatttatttattttacacggttttcaatgatatactttaaatattaatttgtttgatgttatatttctatgaatatgaaattagcatcatatgaaaatactttaaaacaaatatagtgatataacatgcataatacttagcatatacttgtatgattagcatggtcattaatcaaaagttgccgagcttgaattttctaaaggacagggtgccttgtaatttgggacaaagaaccattggaaaacgaacacaaagaaactttcattacattaattatctgaaaaagaaagaaactttcattaacctcgtacagtaaatagaaaagaggaactatgcatgtataacgaaatagctaggatcacagcaattaattagttgttctctggctttacttttcttttggagtaactttaatttttctttggaggatgaagtagttaattatacaggtttccaattcttgtttggtagatccttttttatgttcctggaagagctactatatttttgtacttgagatggagctgaggtaccgttatctagctatgtcgcatctcaaggagttacgaattaacatatatcaccaatatcacaaaaatgctccatacaaaaagatcataaaaattcttgaatttgcttgctgtgtttttttactatatatgcttggaattaaaaaaatgactgaattaatcgtttgcaatctttaacggtgcgtgcagtaccaaattggaaaggtatccacttgttcaaacttaaaaatattttttttactgatattactctctaaaaaggtgcatgg

SEQ ID NO: 97203 - DNA, 601 bp, Oryza sativa
gctcggaagggctcggccgagaaaggaaaagagagaggaaggtgcgggcgtgcttaaataggaggggggcggcgagtcgtggccgggaacggcgcaattttgccggagtagtggaggaggtggaggaggagagagagagtggggaaaagagcaaatcccccgccgtttgcgggcgcgcgagctagcgggaggtgagcggcgacgtgggcgtgcggcacgggcggagtgggcgcgggagcagcgggatacgcggcggcgtgggcggtggtttcgacggcggttggcgcgggcgtgggcggccggaggttagggaaagggctgacaggtgggccccacctgtcagcgcccgagagggagagggaggccgggtgaacttcgggagtgggagggaggagcgggccggcgcgggaggaaatgggccggcggcccaagaaaaggaaaaaggagggaaaagaaaagataaaaggaaaaaggattttcccagggatttaatattgcactttgcttattttaattgattaaaattatttccaaggctctgaaaattccactaaaaatcctgttagcatattttgacatgtagaatccaagaaaaattcca

SEQ ID NO: 97204 - DNA, 1062 bp, Oryza sativa
aaaagtgatgtaactaacatatggtgcccaccacatgtgtttgccacatttcactaacattagggggccacatgctgaatcggcaaaaaccacttcctaagccaccgaaggagtatatttgcaccgctttccgaagtgggggagggagggcgtcatacccgcttttgtggttgatagatgcaatttgactagagtaagaaacaagggaagcaaaatagacttatttcataacctttcaccgatgagttttgcggcttcgagccttgcctttgaacaaggccaataataagttgccttaaagtttcaatgttctgaaatgagccaatatgcaagggcaaaaggccacgctatataccttgtttagttagcccatgttttccggtccactccacgttagtgggccacaattttgaactagattttgggcccatcgacgggaacgggttgggatcatggactaccaaactaatgaagatgaggtcacagatggaatttgctaggaataagaacagactaccgactactagttgccaaaatcaaagaagcatcaagcatccatgctacggtagtaagggtttgtttggttcacggttaaggttggatgggatacagcggtacatttttttttcatatggcaatccagtttttttggtagaatgaatatggcgatccagttttttgtttgatgtagggatgaaggtggatttggtgatctaattttttgtttggttgaagggagtatgatggatttgtaggtgtggtcacctcttacttgagatggtgaatataccccccctaatcaaattaatgcataatgcattttataaattctgtagcaattttacaccactacccctccatattataaacacacatataaaaagaaaaaaagaaaaaagaaaaaagcaatagatctagggctcactgccaccgccgcctctttccgccggcggccggcttccgccggctataggcttcgctgccgcctcccgccgacgcggctatcgccacccgcaccgtcgtcgtcgtcatcgtcaggttcgcatcgtcgtcgtcgccatt

SEQ ID NO: 97205 - DNA, 1215 bp, Oryza sativa
ctgccaaaaaaaaaagttccttttgtccatcagtaccaactaacgagaagcttgtagggcacgatgagcaaagtcatgttctaaaattactctagcaatattgaccgattgccatgcttctggaaccttaatcaagctgactagaacgcaaaaaccacattcaagaatacaaacaccagaaaataccgagataaagtacagctcatacgcgccacaaataaaatattggtgtaaaacctcaccagcacgacataccccgaaaaaagaaaaaaaaatctttacagggtcccgttcaagctatgatcatactaccgatatccgatcaaattgccgtggttcatgaacctgattttctggaggtataaacctccaatccacacagacagcatcagccaagaaacatgatgtaatcactaacactgcacaaaaaaaaagagaagatttccctttccccttctatgttgtaacatcccaaagcccccaaagccctgcgctcctctacatgcaaagcaacacaaacaccagagaagttgaccaggctcttcttgttccccagccaatttccgatcgcccaatctcaaagaacacataaacgacaccaccaacaccacccatcatgctatatactaacacaagaattaaagaaaaaaaaggcatccaaaatccaagaaaaacaagagcacgacgagcaagaaccaagaagacaaccagcaaaaaaggaacaaatctttgcagttgctgggagaaggaggccgaagaggaagcaaaatcacttacaggaggagggggtagcttgcttccggtagcacacacaggagagcggcaggagaggaggaggaggaggagcggagaaggcgaggtggggaagcggagaacggaaatgggaaggagagggagcaggagggaaggaaggaaaaggggaagaagagaagagaggagaagagatggttggttggtttggtttggttggttggggatagcgagtgggcagccaagtccgagatgtcatgcggtggagggacggacgcggtcagggcgaccggcggctggctgcggctgcctctgcctctgctcgcgtcgccactgccgccgggatcctctgcggctgcgccaccgcccacgggaaccaccaggccccgctcctccagttttgcttctctcctttgatgacttcttgttgccgactgctatacgtatacgtatggagtatcgaat

SEQ ID NO: 97206 - DNA, 661 bp, Oryza sativa
gcagtttttttcttgcaggcttccgatttttcggttttcttttcgtcactgttttttttcttcccaggctaatcctacctccgtcgccacgtcgatctgtctctccatgcatttccttctccaattgattgcaaaaaattgattccccactcatccatcatcatttttcttatgatttcccatcaattcggctttaaatggctggatttaatatccgtttaattgtgtgttttacttcctatgttcacaaatatataatatgagcacgtttataatagtgttaacaagtcaagcatttctcttttaactttgatcgtcaatagaaaaaaaacaattataaagattagtgacttaagaatgatatgttactaaatttgttgtgaaacaatccatcgttatatacaactcttttcatttaaagtattttatttcctcataggtattattattggtcaaagattgcattgatatcttaaaatgcttatctttgtggatggatagagagtaacgaactattaggaaaatgtgtcttcatatttttcttcctcttacattatgaacatagaattatgcatgcaatgttgaacagaaaacacgcatgtgaacgaccccgtattgatgcgtccatgcatgcactaccaccagtatttcgttaaaaagg

SEQ ID NO: 97207 - DNA, 588 bp, Oryza sativa
aatttgtgaaggtagaggataaatatattgggagtatataaagaaagaaataattgaactgttatttgataaaatatgtatattttagttttttgttttgtattggtatgcaaggaatgagtcaaaaaatgaatttattttgataggaggacatactaggcatgggatgtacatcttagaaatataaatgcccaatcgtgtggcttcaaggtggtacgattattaggtggccgttggggaatgggaatatatattttgcggtggtcatcctgtgtggtggcttcattcgagtattagttacctccgtcccagaatataagcatttctaactataaatatggataaatgtttatctagattcatagttataagttttgttatattttgggacggaagtaatattaatttttggttcttttcgtagtgtcttagcttgtgattcaatgacgatgccaatctaaacttccttcttgaatgcatctcggagaaatatgtgagatattggagcaaattaaaccattatagcttgatccgaccttaataggtgtggtatatcatcacaatggcgtctttgtatgagactgaata

SEQ ID NO: 97208 - DNA, 933 bp, Oryza sativa
ctttcggaggaggatgtaataggcctgcactgcgaatgacttgaccgtttactctgctggttttgtgttaagggaaccacttcgatgatgaaggcgcccataatgacagcagcgcatcacacaacggataaagctgtgcaagggcatctttttttccttcagagaggacatggaaataattgtgtgggtacgtgtttgttctccaaagtttatgcgagtagtgaccgtatgtctgtgtcaagtaaaaaggacactaaggttagcacgtccttaaagttaatcattagtactagtatgcttcaattctggcaaagaaagtagtacgtcgtatatactgcacgttttaaatacagaatatgcagatagcatttttagtcgtctacagtccacgaaaatgctactcgaaatttcatctgctcgagacatgctctccctgtgtagaaagcaacgatccaaaaggttgttcttcaattatgcagttccgactcttcgtcgatacgtaatgtcaccctccgtgtacgtacgtacgtgcgagctagcgcagcgcagatcaggaccacatacgtcgtacgacgaacagcattcttgctgtgcatcccaggagatgatgcaagaacgcagcgcacctgccgcgccaccgtaacagtgcatgtcgcgctgccagtacaggaccaacgtacacgtacagtacgccgctagcgctgaaacgatcgatacgatacggctgatctgaattcctgtagtgtagtacggatctttccagccggccggcgcccgtaagctagcggtactaggccagtaccgtcacatcgccatatatacggtggcacagccggaccggccttcgtctccgatcgcctcctcatcgcgcgcgcagctcgcgtcccacgccgaatcgacggatccgggggaaagcaacggtgggtaggcgca

SEQ ID NO: 97209 - DNA, 1169 bp, Oryza sativa
agctcctcgtcgtgatgttgcaggggatcggcgattgcttaaagtaggcgatcaatagagctaccagcctgatggcatgcctgatgccactagcacctctgcaacagcatgttaccaacgcccagatttggcctcctctacaaaatcgccactctacccgggcgcacgtcttcatcgtgttctgacacctagcctcgtagatctgggccctgccacccctccaatctctggtcaggggatgtttccaccacaccgcaaggccacgattgctgacaagactccaacgcaccatccaacacagccactgcctcacctccaccaccacaccgcctcaacttcatttgatgaccgtcgtcgatacctcctctccgccagtttccttgcttgtgcgtcagacctgtcgtccatgtcccatcctccacctttgtcgcaccctctagccgaagattgtggagacaagcacccatcgccagcatcctctccaacctttgctccttacgactagggcgttgccgacctctcgccatgctctacctgggagagaaaggagagagagagaagaggagtggaaagaaagaagggatgacacatgggtcccactacaaatttattagttttttctgctaagagactcgccgactaagcgaataaaccgtggtcaacctgtcatatcagcaaaaaaaaagcttctcaatccactgaatgagttaatttacatatttttgaaagatgggggaggtgttatacttatacctggtttggtgattgagggaggtgattcaatcatgagcaagagatgtaggaggcaaaatagacttaatacaatggttaatcccggtcctggtcgagcctatgaaaaacgattttacctttcattcatttctgtaatgaaaataaattagtttattattttaacgtcatgtatgaatataacatatttagtgataattacgcctttgagcttgtatttagctataggcctgaaacaaaggtgccgtacatgtaaaccacaatggagcgacttattagatatgagtagagaatgttgcaattacactggaggggaagcagcattggagaacagcaccagagcgtggacatggtgagtcgagctgatggggaagatgattaggcacttgagcaattgggctggtagaactgtagaagta

SEQ ID NO: 97210 - DNA, 541 bp, Oryza sativa
catggctacattgtgaatatgtgacaacctgacaacaggtggtttagttttccatgattaacgtatgctgatgtacaaaaactgtgcatgtttgcccggcatcgtgatggactgatggcttcgtgttcgctgggaccggcagatggcatggctaaacgaactctttagattcacccggacggggatgcaacccaagaggaaagtgtctgccgtgcacggttgggcaatttcaagtatccttagcgtagcttcaaaagatgtctatcatgtcggcttcacgaggcaaaccagggcagagcatgtagaggtgaggaatgctatcaaactccaaatcgtgcgatgatcatgacagtgtttcgtggggaagggaatgcagtggaatgaaattatctgcattatattactttctgccagtaaaaacgaagactgtggtttgcggagagacattgtatcaccggtcttgcactagcggaacttccgcaggtgagatctgattccgttccatcttgggggtgcaatgcttagaaatggaacacacaat

SEQ ID NO: 97211 - DNA, 587 bp, Oryza sativa
actatagggcgaattcgagctcggtacccccgagtgcggatgcagacaagcggataggttcggcgtgccgcgtgcgctatccgcaattagcatgactgaggcgtcgccagaacattatcatctcgcctcactcgtagtggtggtccatcaggccatcactcgcagcaaccttttttccgccgtagcgtccaccgaccaccgccctcttcaccgccccatatgcagatgtgcgcaaccggccctacgacccaacgagcagaagtactgaaccaagaccaaccaacttcggagttgtgctctgcgcctccgcctacccacttcggaagtgcactggacaacgaatgcgccgtgacgcaccagtcaatgtcaagtaaacagaagcgccaagatgtttgtggatcgtcgatgctaatccacttcgaacctggcaaacgaccatctattcgactgtaggattgtagtaaggaacatggacaaagggtgttgactgccttttgaatgagattatcaaatgcgacacagaatttacgggcccagcccaacttgttcagagaggccttctttggacccttgagttcgaccttcaa

SEQ ID NO: 97212 - DNA, 501 bp, Oryza sativa
ttagtttaggtactagtgacatctgagagacctaacggaatagaatacaatagccgtgaccgtttcaaacttcaaaccctcgtggattgggttctggagtcgggacgcatgcagattcgtataggtcaaaagtttgtcatcgtacagtagtataactcaactaggaacatgaagacatgagcttaatactaattaagtacgagtagctataaccctccatctggtcttcaactaaaagttctgggcaacttgaaggccttggagtatgagacttggcgagtttatcctatccgctactaggggctactagtactctgtctgactcggcttacgtagtaatttcgatcatcaccatgctaggtgcactttattctagctgaacatgcgtgtatacggcatagtactgtggtaggtttctatcggtgatcagccaatctgctgttgacctagcaaaggtcaagttaatatactccgtacagaagattagtacattgtgcaatg

SEQ ID NO: 97213 - DNA, 606 bp, Oryza sativa
gggctcatattattaatttgctaatgatatgaacaacgattactcaggtacgagattatgtgcaactagtatatccaagaaaaaatttagcaacattgacgaacacaaaaaaaattataaaagataaatacatgtaacaagaaaataacacaagaaactttacactggaggcggtagacagaaaaacatgaaactgagaagatttaccagttcttgtttagatagctctgtactcgtaaaggatcagatacatgaagccattcaagcggaacctacagagagtagataattaagtgtctagggaacaatatttgcatggtccacatcaagtatagcaattacataataaatattaggcaaagtgtggcaggatacaattctaacatcataaacaaacattaggaagatgccgtttttttttttgtgaatacgccaaatatgtgtatgtttgcattaaaatagaaatcaaagtgtagcagctgcagcatgacatttttttagttgtagcagcaagggctaatacaaagtttcatgacttgaaagaaatgaaatatacaatgcaaggtaccagttcaaagaaactcaatataatgtactgctacaaac

SEQ ID NO: 97214 - DNA, 573 bp, Oryza sativa
tcaatcacttttgaggatcacaaggggaacttattcctaaaagttactactagtttgagggacaaatgatgaactttttcccgtttggctcaagcccacgcgaccatccaaatccagttggaacgttatcgcgagtaacgtgcggtgcggcccatctgtgtgggccgtggagcgagtagattgggcgcggattacgtgcaggccgtgcggcctgctaatgcgtgggctatcgccaatccggagagcttcgtgccatcgtaggatggccccggagtgattacctgcgctggcccgcgcggtgcggagaggatcggagtaggatatggcgtcaaacgccgtcgtgcgtcgcggactcgcggtcggcaggcggctggcgcgtgttccgtgtgggaggcctgcctgcgtgccaaccagcgcaacgtgtcagcacagcccctaactttaaatgagctccaccgacgacgaccaccagtgtgttgcacctgtgcgtcacctcctgttgatgtcagtaacagtctcttgcgtggtaggcccccgagaagtacttgccttcagagcattgcatcatcagtt

SEQ ID NO: 97215 - DNA, 599 bp, Oryza sativa
cgtggctccgtgtctcccggagagggcgcgacggtttttttcgtggagtttggcgcgatgcggctttggcgcggcgtgcggggcggcgctacgtggccctggcacgttgcggggcgcacgggagggtggtatggtgcaacgcggcacgggaacgagggcggaacggtgcggcacttggcccagacattttgtcgaacacctggcgtgcatgcttgtggctggtctggggaagaagacgatgagcagtcaggggctgggatgggctggcgcagaaataagactgtgggccggcctgcttagggggagctaaagagaggaggtatgcagggtagttgggcctgggatagaaaatagagaaggaggcccaattcgaacagtgagctttcacaattttcaagagatttgtagagtttgaattttgagaagatttcaatggatttgaatttgaatttgacttagggtatcacaggtatttgaaggaaatttctagtagagtatttgagatccatttggcacaaaatcaactaagaaccaaattaactcctatttttaaatgacaaactttttaaataaaagcacataaaatacggatgctacag

SEQ ID NO: 97216 - DNA, 569 bp, Oryza sativa
ctcgtctatgaaatatgaattaaatgcttagcaaagctacatttctgatttgctttgcaacgttaccacgcctttttttttttttgtaagaatctaatccctggcaaagatgtggaaattatggagtagaatcaagttcgagatgacttctctatgaagtttgggttaaacaacccaattttttttggcgcgaaaatacacatatccacagaatttaaattctctaaacagaaaaaaagaacccgagaaaattcattgcatgccctgaattctacctcaatcctttccaggccctgaattataccgcaagcctacatgccctggggttttgtttaggtcttatctatatgcttatatccatcttgtatacatatttcgacagttaactggcaatatttattctaaaatgaccgtattatctatttctcatactaatgatccaacgtaaatcttaatgtgagaaaaatataataaaatcaaatgtgattgaattatttaataccaaatttcttgcgaataaacacaagacaaaaattggcttggaaactcatcttcccgcgcaagtaaaa

SEQ ID NO: 97217 - DNA, 591 bp, Oryza sativa
cattctatataatctctacaaaggagtggctaaggataactggtgatgacacgctaaaatacgtccactatgctctcagctacgctccacaaataattggagtagaaatctttctccaaacagaagcgcacgacacggcgaattttatccccttttattttttttaaataatttattttaaaaataaacaccagtaaaacttattttcacaattcaaagttccaaaatttctggtcacacgagccccacctaatatggtaaaataacattgttaccccacccacagcggacgtgataattttgttatgctacagtggcatgacagtactacgctgttacaacgttgttacagtcagatcgatgtgatcaaataatgttatcacgttatttagacgggcgtgaccttgttattttactacgacggtctatttagactagccaaaagtttcatatcttaaaaattaaatagtcgaaatgtttatttttaaaattaaaaaggttaaaagagaaagagaaacgtctctatcttgcattgcatgcccctagtggccttcgctccaaccattcggcgtgagccgagccacaaagccg

SEQ ID NO: 97218 - DNA, 508 bp, Oryza sativa
ttgtacaaactccacatgtcagttatccctatacaagtgcagtaactcacgttttgcacaatgttgtagttggtaattccttcctacagatataattcaattgagatttatacagaatcaaatgactgcaacggttttgtgtttccctttccaattgtcatatacctttatgtagattattaagaactatgatctgaaagagtcttgctagacaagcaaaacaatataggagcatatatcaatggaagcatcgaaagtaatgggaaccaaatgttcaaggggtaatactaatagagtaatattaactctgtcagcacaacatcaacaacattactatgcacgtttttaaggccctgtttgattcagcttaggattattataatctagcttattaagagtaagctgaaacaaacaagtagattattatagcagattattataatctataagccagattattataatctaataagttgctctagaggagctttttttcagattattgagt

SEQ ID NO: 97219 - DNA, 654 bp, Oryza sativa
ttttgacttacattgaccaaaggatgtaggaatcgataccgttaacttttgacatacattaaccattcgtcttcttaaaatatagaaaacaatataaaccatgctcaaagtatctttaataataaaataaatcatacaaaaataaattataattacataaatctattatatactaaaagtcatttaagcttcctacaaatactcttaggatgcgctctaaaaaattagagaaaatccaagcaattctgagaaaaaaaaagcaaaacatcttgcctttaattttaatttaatacagtggacccattttttaaaccattggattacatctattaaaaataaaccacctaatctctcgtctgtacatacaacagaaaaaatatgtaattattcaacagagagaaaaatctcttgtgttatgtacatacgaaaaaagaatcaccgaagaaaaactacgtacgtatgattgggaaaaaaaacacgattaatccttcacccctaatcctcacattaaatatattttgattaaaaacatgtcacatagaactaaaggctatccttttttcatttcattctcatcctaatagtgttacaatattagtggccaaatgaattaaaaaataatagattattccataatatattaacccatgcatg

SEQ ID NO: 97220 - DNA, 1241 bp, Oryza sativa
accatgcgcgccaggtgcatgatggtagcgtcatcctccgagctagcatcccggaaggtggcgtagtcgcgggctcctcccgggcaagggtggtaacgtagggcgagtgctgcaactcgtccgggtagcgctggtgaagagtgccgatggcgaggagagcggtgttctggcaagtggcggagaaagaatctccacccgcggtgactgccaacgaagtcctctcgggtgagccagtgaggatcactgcggtaacctcccaagcagcgtggggctctgcatcgtcaccctcctgctccgggagctgcttgccctggtagtccactccatgcggataccccaggacaacgcacatgccccgcagctccaaaacgaatccagtcaggtccagaccacaacggttgatgctgccggccatctacaaacaaaaacaaaagagaaaagcaacattttaaaggtcagattttgacgataaatgaagcagcaggacagagagagactaaaggattttcacaaataagaaaggatttttattttgaaaatattgctaaggcttgggatctacggctcgtcctagggtcaaggggggctctgataccaacttgtcacgaccggaattaacccaacgggcgttccttacgtgcgtgtattaatccttgtcccaggaggcaaggtacaccaaaagttgatacaattcagagtttaacaagcggaagcgtaaatagttaattattacatgggcggcgaaggcccagcacacacaaaaacaaactggaaagagtggaagactagggcgacgaccacaggcgcttgacggcaggcacgagctagacaccaaagccttcatcttccaggggctcctcttctaggtttgggaaaaaattgagcaagactgagtacaaccaccgtactcaacaagacacacccacaagtgcaggataaatgcaagggagtacaaggggattataacataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcctagctcgtcccaagccaacctaggccaaccattccacattttagttgttaagcaggttttaagaattaaaacactaacttgggtacattgctcg

SEQ ID NO: 97221 - DNA, 867 bp, Oryza sativa
caggtgggccccacccgtcagcgagggtggcgggcgggcctgcccgtcagcggcgcgcgcgcggggaggggccgatgggccgcgggggagaggagagagagggagggagttgggccgagccggcccaagagggaaaaaggggggggaaagaagacttttagggattttctttttataaaatcattttaactttgtttatttcttctcaattattatttgtgctctgaaaattgcactaaaatttgagggctctttttagaccaaggagaatttaacaaaaattctccgggccacatttgaatttttcttgtacgtattttagtgtttgccaatttctttccgaattttaattaattctattattccttttagaaaatgatttttatttcgggatgaatttatcaggacgtgacaaatccaccccccttacaagaatctcgtccccgagattcgaggatgctagcaagaagataggttgggcggtcttctcttcttgtctgacttcttgcgtcgcgtcttctaatacaaacttgcctagcaaaacttctccactctggactgcttggctcgatctcctgttatagatggaatcttctcttcacctgacttttccctggttgtacctctagctgacttcgattgggctgcggcattggaagatgaggcttcagttccagaacttcttataactcatatccttggagtcaacctcatacaagttaccacttcatgtcatgcgtcaacaccagcttgtcattactaggataccatgtttgtcatcataagaatatcatgcttgtcatttacttctaacttgccaccaactgcctcatattatctttcctggtctccgggtgccagctattt

SEQ ID NO: 97222 - DNA, 691 bp, Oryza sativa
ggtcaaactatgctatgattggcccatatgacgcagatggtaaccgtattacgtacccttttcttgggggactaaactacaactctactacccctgttaaatttacaaaactagcaaaaccacttaaagtcggggatacacaggtttttggagaagaagttagtctatggaacggacaggtaccgaaagactaccaacgtagtattatcatgcggggttataaaaactcgttcggctatacttatccccatggaacctataatcagcttatgcagatgaggacatatgatattggtgcaaatgacaccacaacttacaagattacgttaaacaagccatgggcagttgccaacccaaataattcaaatgggaatttcccactagggcatacacttaacccaacttatgacgggtccacatatttgtatttgaatggtcacgtaaatataccagtacctactacgtacaccaagaacagccatttggattagtggctcttttgagtttgctaatacaacgattatcccagtagaaacaaggttttattcaacttggattcttggtgaaacgggagacaacaaggtggaaaaatctcggctactggtttacgtctacggaactatacagatacggtttaaaactaaacgaaggacctttgagaaaacacaagaaaactgttgacaaagctcaa

SEQ ID NO: 97223 - DNA, 1284 bp, Oryza sativa
agtcctgtcaaacgcttcaattatactcctctatgaccatccactgcatcttctctttattgtcattactccctccgtcccattttaattgcaaccataagttttcgcgcccaactttgatcgtccgtcttatttgaattttttataattagtatttttgttgttatgtgatgataaaatatgaatagtactttactcgtgactaatgtttttaattgttttttaaaaaattgtcaaataagatagacggtcaaaattaggtgcgaaaaactatggctgcatttaaaatgggatggaggaagtattattttaaaaatcgaacataattatcctttaggtttatttttttacattctagaattccgccaaaacgtcagcaactttgtcactatactcctccgcagctcgcccgctgccgcccttctttattgtcattgagattataaaatcaaacatgattatcattggggttttttttttaactttttagaagccctaacctttaaaaattgaacttatactttttagagtttattgtctcgttgggtttcattttttcttataattaggtgaaaccccgcgcattgttgtgggaatttagtatgataacaataaaaaaaaataatgtgtaagatagctagataacatcagattaagtaaattaatgtggtttatgataatttaaatttaaatagcatgtagaatggtgattcaaatgtaaaaagtaaggtggtatgactttatggaagaagaaaagtagggagatagtttggaccgtagattattcatctcaaggctaaaaacaattgatgtgatatgacttaattagagaaaaaaaaggagaaagataatttggaccatagattaatcatttaagcactaactaagtatataggatgaactatataagtatataggatatcaaaaaacataataaagatattcattgaaacattatgtgaattatgttggatgataatttaacatatttgtatttgaaaagctcttaaattataaagactataaagatataacatatttgcatgatatttaaatatggtcattgttagtggatgatgatgtggcatcttgttaattagtggatgatgatgtggcatcttgttagtgaatgatgatgtagcatctttgcatgttaagcttaaagagttagtgggggataactttataataagataggatttatagaaatcccgtcaaacggtgtcactatattcctctatgacccgtccgccgcatactctttgttctcattgggattgtaaa

SEQ ID NO: 97224 - DNA, 577 bp, Oryza sativa
tctgtccattttaactcgattttttttaatatttctagttgacagacagtgaacccatttttggtaccagtcgagaaattgtggtggtgacaacattgccatatgaattatccagctcaaaaggaatttgaagtgtatacaataataacctgacaaaattattttgaggggatcaattccattgcctccttgagcaatctatgaccatgaattttcagttgcaaagttggtttatcagccacatgggatgggactgaaccctaaccataaactaggtggcaaacgcactgatgcagctgtctcctcctcctccactgtgtgaaccattttttatagtgcagcttttgagcctgaagagagagggcatcagcaagcaatcaagcactgaatcatcactgcacaacacaacaactctggcttacaaactctggactttttaggttggataacgctgttgggtttaagcgtttcagatgacaagaattacaaagaaatattttcttcaatttgcagtgaaaacgaaaggggaagttgacagccacattaaagcattgacactgcacatacatggaccact

SEQ ID NO: 97225 - DNA, 609 bp, Oryza sativa
ttaagttgacaatcaactacttctgaattaacaaagagagaaattggacctttttttttcattaattaacgagctttctgaactttgcatctacatggcgttttagttcttttcttttcgaagtttttgacattgtcaattaagttgacaatcaactacttctgaattaactaagagagaaattggacgtttttttttcattaattaacgagcagtcagttatatgaggtaccatcaacaaatgcaagttaattttatgaaatgcgatgtgagccgagtccgataggggtgattgccggcatgaagctggacaatggacctcaatttgcaggaatggtgggagtcgatttttttttctttgagaattacacagtacaacacagacactcactcaaatcctacccctatgaggatcttcgaatacggccagcaaatcatctttgagattgacgaagtcaccacaggcgcctcgctatcgacgggcacgtcgtctaccactgaaagcacaatgcgttatcgacgggcacatcgtctaccactaaaagcataatgccgttaaatcctggaaaattcactcccgtagggagtcgaacccaggaccaaaggtgc

SEQ ID NO: 97226 - DNA, 591 bp, Oryza sativa
ttaccaattatcattggtagtgattttaatattttatgtagtcctatgaaaaagaataatgacaattttgataatagatagccctttccatttaatgctattatagatgatcttaatcttagagaacttttaatatctggaagaaattttacttgagccaataatctagcactgacaacttatgagaagttagatagaatgttaatgtcgatggagtgggaaaaaattcttcagagaagttagatagagcgttaatgtcgacagagtgggaacaaattcttcatctacttccaatcggcatcaaaaattttaagtttgagttgggctgtctataaagagatgtttttgtggatatggataacggaaatttggttaagtgttgttgatggtaatactcttctagagagttggcaggctaagattcgtagattaagacaatatttaagaggttgggccaaacatactaaattttattataaaaaggcataatcaactttgttaactcaagaagagcttgattctagactttatttgaggaatagattatcttgtcttctaagggaagagaaaattaaatggtatcagcgagct

SEQ ID NO: 97227 - DNA, 580 bp, Oryza sativa
cccctccacaccgacgaacgaacgaagcatggggacacctcgttcgaacgaacgagcgaacaactcaacaacggctgcgactaaaccgatgggctagacacgattcacggtaaagccccggtacggcaacgataggccggtaggaatttagggatgcacctacggccagacaacttgactaccgagcaacggctaaagcggcggctagattaaagcggcacacagctgcgacacggcagcactagggcgacttggctcggctaggcggcagcgactcggcagaggcacgcggctagggttagggtgacggcatagcgatgacgacacacagctacggcagatggtggctacggtagtgggacagcagcgacttggcacgcacgagcagcagcagcacggctgtagcagggagtggcacagcgacggctaggcggctagtgcagcggcgacgctagggcagcagctaagcgtggcacggcgacggctactcgacgacaaaaacaagagattaaaaactaatccgagggaacacggatagaagtttctccgaaccaaagcgatcggagaggaagggtcgacg

SEQ ID NO: 97228 - DNA, 564 bp, Oryza sativa
agattatttcatggactaattcttgcctaacctagtcaataacttgacccttgtacacacgcacagtactaaggtactactagtacaaagtacttcgtgcgatttagatcgtatctaagaaagagaaaaatattactactcccattgatctggcattcaatttttttaatgaaaatagtgctccattcatttcatattataaatcgttttgaatttttctctagtgaaatttctttaagtttaatcaaatattaaaaaattagtaatatctgcaacataaaattagttttatcgaatgtaacattaaatatatttttataaaatatttattttgtgtttgaaatattgctatattttctttataaatttggtcaacagggaaaaagtcaaaacgacttataataaaaaaatgagggagtacttattagtctcatattctaaaacaattttaaagatgacattccctttctatcgttcattaatacacatttacaactcttatgggctcatctcaacaaatcacagttaatacggctgctttggaaaaacaataggatgtattta

SEQ ID NO: 97229 - DNA, 718 bp, Oryza sativa
tccagtggtcggctcctcagtcgaagagacgtagattggcgcactcgaagagaccagcggaacctatcgagggccggccccagcacgggcagctggcggaggggagctaggtagtgaaagtggaacacacttgagaggaagccatcgaacatgcgtctccgtgctattgcgtgatagaagtcgtgaggcacactggcagaggatggaaagacacacttggtgtgtcgtgttaacacacctgaaaatttgaccaataaaaacaaaactctaaaaatgcggaccttccaaaactttttaaataaattgcatcatgccgactttatttgcctattccattgaattttgatttcgaagtttgttgatcgcgaataaagaataactaattaggaataaaccctaaaaattaattgggctaaataaataatcggaatacaatttaaaataaaggttgaggtgaggatagaaatgaataaaatattatcgcgatcatatttggttcaattaaatctaaatagacggaatgagaattaactctaattaaaatcaagtgaattatataaaaataaaatatgggtacaattaatctttaatctggagtggatccattggtttggataatacacatattgagtaaacttcatttatgcaagatttagaaattatagaatcaaatttatatgggaaataaactaaaatcgggataaataggaaaatatac

SEQ ID NO: 97230 - DNA, 549 bp, Oryza sativa
taagtatttctaatagcaaatgtaatgatattttttttaatctccattctatatattcataacatatggaggatcaattttagaaagtttagtttcatggatttagattttaggatgcaagtaaaaataaatgaagggaatatattgcaagtaaagaggaaagtgcacaactgtttagtccttctgaattctgtattgagcgatgcgaaaacatttatgttttctcgcctatgtgtttgatatgcactgaacatttatgttctgtatagtctagatgttaattattaaacatggttttctggcatggcagccacaagatttcatttgttctttttcttatattctgataaatgtaaatttacaggaatcagaaatcctggaacagatagatcgagatgtgaaaagaacacatcctgaaatgccgtttttctctgccaaggctaaccaggtttcacttcagtgccttggaattccttatttccatttaaactacaagtaattgtcatttggactaaatttttcaaacacatttcaggaatctctaaggcg

SEQ ID NO: 97231 - DNA, 509 bp, Oryza sativa
aaggatattttggtcttggtttttagatcatgtaccaacccctgctctcactataagggaacaaagcttggtaggtacattttaccctagtgccaagtatgcatgctgtaagatctgcacaggcctatggatggtcaagattgctggtgcatatgcacctaggttcataaaatctgtaactacacttttctgaaaaatcatccgcaaagaatggtagcactgttgattcttcatagcgtcagatgaaggcattttgtggtgtaaactatggaacacacatgggatgatatagtttgcattgcaagtagcaacgtgcagaataatgtcttcaagatggactccaacacaaacgaaagtcttcatgaccccgtagtttttgttcaccctaaaaaggtgctcttaaaattatgggctacaatagtgtgtgtgtgtgtgtgtgtgaattccagatctgcctatcatcattcttattttaaccaacagagctttcataaattgcatatttttcc

SEQ ID NO: 97232 - DNA, 579 bp, Oryza sativa
gagtggttttgataatcgtaatcaaccaagtgacttgatatcaatatatagcatatgcggtgtgaatcctccaaataacatgatccgagtgatataccaaccgctttgtaaaatatgatgagtgatatagcaaaatagctataaagaagcttgtatattgtgaataaagaaatttccaaagtattgggcatacgccatgcgcacactgctttaacagatgtacttaagtccctagaagacacatggtttcaccacacctggaaatatatggcatatgtggtgtaaaatccgagtaaataaactcataaaggatttaccaaccgcctagaaaatgaccgcaatatataatcagcttaagccataatattggtcaataaaaatgcacacttacgtggcaaaaagcaatgatattgtatccaatcaattgcttaaaaacccaaacagcaccatgactatataaaaagtcagcgggccagctatataaagctttactgtttgacaccttttaagatgcattgtaccagactcctaaaaaggttaataactaacggtatgaaaggattttaaggtattgggcac

SEQ ID NO: 97233 - DNA, 618 bp, Oryza sativa
caatatttgcggtgtagcgtaaccttaaggtgggccctatgaatagtgagccattgttaaagccataccctcattgctatggttagaatttagccacaagataggcccacatagaatagaaaaataattgtttcatctcttgttcatgaagtgaatgagagagaaaaaatattttctttttcttgtggtagaccttaagcataaggtgcacccctaaactaatgctactttccacaatgtatatagctcactttacaagtgcaatcattaccttaaggtcacctttttcatacattgtggttgccctaaggtagtaactcaggatttgattttgagtttagggcatgtttgaggaagcttctgacagatgcagtttttcgtccaaaacagtcagtttttttttccagattttaagaagatgtagttgtagaatccaaaaaaatgaattaaaaaccccaatcagacccttagacatgccacaaatcaacataacagaaaacgccatggaatacaaccgacttcacagcttctaaccaaaggctccaaagctctttccatacaccctgcattttcaggctaacaaaattcctgaacaaatgaaaccgaaaacttctccca

SEQ ID NO: 97234 - DNA, 648 bp, Oryza sativa
gcccttacgttgtgcacatgtaccaacgacaagtaatactgctattgtgtcagtttcagacaatcacgatattattgctaatttgccgaatcaaacgtatgccaaattatctaattatgatgaagtaagggaaatgaatcgccaaaatgtcgatgttgaatctgtagaaattaattttcaatcagctaaatttgaaaatgggtttacgttgcaagatacaccaggtgttgattcaaatgttgcatcacatcagtcaataacagaacaatatatgtatacaagtaatatgatattttatacggttgactataaccacgttcaatctgaacttaactttaagtttatgaagcatataaatgatgttggaatacctgttgtgtttatcattaatcaaattgacaagcatcaagacgatgaattgtcattctctacgtttaaatcacgagttgaaaaatcaattgcagattggggcattaaattagaacgcaccttttatgtatctaaatttgatcaccctgaaaatgaacttgaagtattatcaagttatctaatttcattagatcaacatagagagacaatagaggattatacatcaagaacggttgaatatattaccgaagctcagctagattacattcagtctgaaat

SEQ ID NO: 97235 - DNA, 691 bp, Oryza sativa
tcctgcaccccgtgatttcactacaattcaaatgttctggaaatacgagtactcggtagtaaaattgtgctacgacggcttgctacaattcaaagttctggattctctctctaaaaaaaaaatcaaatgttctggaatattacgtagcggtgcttctttatatcttggccgtgagcccgtgactcatcagcatgcgttatgtactcattttgggtgtactgtatcatatacttattttggatgtgttcttttctctatgttctcgacttctcctcactcgttttttacgtgcatgtttcttaaatcactaaaaaaatatgtattttgtaaaattttctagaagaaagttgttttaaataatcatactaatatattttttaaagttttttcagttgattcataattaattaggcaccactacattccatcattttacatgcctatctccgaccatagccggaaggctgatcaaacagcttactatagaaggccatgcatcctggtgaagcaacccaataactgggctggagcagggttagcctctggaggtaaaggtccactttacttttttttttaaccgtaaaaccagatattgttcgcgcaccagccatcgaccatgcatctgcgacattggcaacacagttcatggtgttgtcggtgggtaggcatggttctggtaggagtgggggtg

SEQ ID NO: 97236 - DNA, 531 bp, Oryza sativa
attcctgcagccctgcaaatgtacatatgtgttactgttaacgttattgacgtgtggtgttgccatgttggcaatggtactttgggtttgggagtctcatggttttgtatttgcttttgcgttatcattttttgatgtggtacgagtggcacatctttggctgtgtgatattttcaatttgttactgtaatggaatttatcaggagctgtacatcagtgtgtgcaacatgattactttttccgaaacagaccgtaagttcaatatgatggtattaatattagcaagagactaactagcattttccccatggaagtccagaaaaatggctaggtcgactgcttgattgataggcacatggatattgactggtgtactataacaatttaatgtagaattaatcatttgaaataattttttatttcatgataggaaatcactaattcttaattccctcaatctccagtaaaattaagcatttcaactgtaacggatgcagacagtagcttaagaaaaagaaaagcaagggctgg

SEQ ID NO: 97237 - DNA, 583 bp, Oryza sativa
atatgtatatgtgtgtgtgtgtgtgtgtgtgtatatatatatatatatatatagtaaaactcactggggcaccatggagcccgtctccaagattgaaattgtatatatacctaatataaatgagtatgaattttttataaatgagcatgaatgaacattaacttgttcactaacacgcacccaatcacaattagccatcataccaccgcagggtacttcaacaccaacaaaatacactgctcctgctgcaacaaatgacacaccaactagcaaatcaagctccttagtatttaccaaaaaaaaaagcgttattgactctagctctctctatgctgtctgacactgtacagacctctaccgatagtaaggtatccttatcaatgcctactcttgcacttcctctgctataacctaattttcctaaatatatggagatacactctgacctattgactaactgggcaaggcacacattgtcacacatcatgaagagaagatctctctgagtgcatctttgattgcaatggtaccccatgatacttcggataacgcattcctgctctttcttttcataacctaatcc

SEQ ID NO: 97238 - DNA, 562 bp, Oryza sativa
catacatacatatatatatatatatatatatatatatatatatatatatatatatgtacacatatatgtatgtatacatatatatgtatacatatatatatagtaaatttgtttggtgctccatggtgcccgggcaccatgattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtacgtaataatggattgtgaaataaagttaaatttgagttgttttgttgctaggtataggtatgaatcgaatacttataactaggtatatactcacaatttgaaaattttgaaaaatttaggcgaatttgtgtatttcataccatggtgcccgggcaccatggtgccccatatgagtgtcctatatatatatatatgtatacatatatatatatgtatacatatctatatatgtgtatatatgtgtat

SEQ ID NO: 97239 - DNA, 507 bp, Oryza sativa
ccggccagatcgatcaaattccaagatatcgtcgccgcggagtcaacccaatattaagttgctgatcaagccctccgcctgcgacatcagctagtacggctggtgtacaagcgtcagggattcatctgtacctgtgccccttgtgttgccgtgttctgctcggagttggtcaactggagtgtgcttgcttaatcatgtctcgtgcacaattatgggcacacacggccatactactacaggtcagcacgctcccagtcatatgtggactcacgtcctaatccactaaatgcatgggacttctaccagagatgttcggcataaaaaacaaagtaattagtagattaatttaaaaaattgatctactaattttgtagatatatacagcatatatctacacaggtacgcaataatctatatacaatttaccgtacctattttttctaatctatacaatattggcagatcattaatttattatgtttagctagagcgtgtttttatacaata

SEQ ID NO: 97240 - DNA, 620 bp, Oryza sativa
atatcccccaacgagatcggaatcatcgccatcaactagtcgatccggccagatcgatcaaattccaagatatcgtcgccgcggagtcaacccaatattaagttgctgatcaagccctccgcctgcgacatcagctagtacggctggtgtacaagcgtcagggattcatctgtacctgtgccccttgtgttgccgtgttctgctcggagttggtcaactggagtgtgcttgcttaatcatgtctcgtgcacaattatgggcacacacggccatactactacaggtcagcacgctcccagtcatatgtggactcacgtcctaatccactaaatgcatgggacttctaccagagatgttcggcataaaaaacaaagtaattagtagattaatttaaaaaattgatctactaattttgtagatatatacagcatatacttacacaggtacgcaataatctatatacaatttcccgtccctattttttctaatctatacaatattggcagatcattgttttattatgtttagctagagcgtgtttttatacaatatctattgtgcgagtgcttctgatgttaggccaactacggtctaacgctgggggctcgctctgttctctt

SEQ ID NO: 97241 - DNA, 698 bp, Oryza sativa
taataacacatattggtaaagccaacccttagagttgggaataaccacacacatattataagtttatggggcatttttagtgggcttaactctaacatatttttatcaagtttcacgctaaaagtggtgcctaaacatgatagctcgatagaaaaaaaatataataattttgttggaacattggcccgttttagtcacccactctatttgtggttaagtgacatgattaaaatgttacacaaatttatataagtaggtataattcaactagttaggttcctgtggtagaacccgatccacttaggttcaagttctagatagacttgacacgagtgtttatattttgggctaattattctttcattaagtggtagacgacttactatgtgaggctgtattcgggagcgccacagaaaactatatatatgcattaacacatgattaattaaatattagctaattccttttttaaaaaatagattaatatgattttttgaaacaactttcgtatagaaaattaataaaaatgtatcgtttagttgtttgaaaaacgtgcacacggataacgagtgtaagcgcgcggtgaatccatacgcttgcgctgtgtttcttacaaagaaaaataactagaaaaaatgcccgtgcgttgtaacaggtgaagtctattttaatcttattattgttatatggtttagtta

SEQ ID NO: 97242 - DNA, 569 bp, Oryza sativa
tacatcgttagctcaatcgaccccgtgtctgtgttttattatactattgtcaaaaacatatgaacattgttagctcactattcgcagcgaaaatgcggatcaaacataaagtagcggtttctagtatgttttaataaatagttatgcacacttgaacaggttggcacatgttaccaatgaaaaacacaaaacgttgctgtagatgctgaaattctaagcaacagtcgctgttggctgtttgccatcgaagttcagagtctttagatagacgtcgacacaaactgctctctatttagtcaaagcatcaacagcacagaatacacaattggccaaaatataggggcacaagttgctgtagtacatcaatagactcctaacacaaaccaaaccaatgtaatcttagtgttgtatcaacaaaaaagaaaaaaggacaagaaaataagcactgcccaagcacccaaaatctcaactttcatcatcattcttgcaactatacccatgcaagatcacaaaagcacaccagaaaggactttacaagacgccatccttcgacagatttttccttatat

SEQ ID NO: 97243 - DNA, 625 bp, Oryza sativa
tttgggaagagggaaaaaaaaaaaaaaggggggggccccattttatttttaacataaaagccaaattttgttgtacaatcaatcttcatcatgtatggcctttccaccaactgaatcatgcattcttcacttcgtggattactgcattggtatcctacatcatttgtgtcattgatctgagcaatggtcaatgaaatcaccatggaaagttgtttccatttcatttctttataatgagtttcctatgaaaacatggtcacagacttattgtgctgaaaacaacttttctcccttcctcacgttattgccttttgctcttgcaatctgtatttcttttagtctcaaacaatggaactcacaaatggatcatcttttatttcaaaaaattcatagaactatagcttgttatgacaggccgtcctagtaaactaatagtagttcaacttgtaactgcgcatatatctcacactgaagttaggatccaaattatagctagcagagcagaagaatgttgggctagctgtttatgggcaatcagctagcagagcagaagaatgttgggctagctgtttatgggcaatcaacacaatatgccgtatacatgttaactctcatatgttccctt

SEQ ID NO: 97244 - DNA, 716 bp, Oryza sativa
  unsure (1)..(716): unsure at all n locations
ttttacagctctcgagacgctggtgcaacacaagatctctggtttccctgttgttgatgacaccggaaagttggttagtgcccatcaaaacttcactctattcaatctttttctacttactctctgcaatttttattctcaaaacagttatgcttacaagtcaacaacgttgggcttttctcaaggggaaatgatttattgctaaatagttatctcagtaacatgattctaggatattttctttctcaaacacggtttcaaactttatacctttttacatgctaaattcgaactagtatggtgattctacctaaaggatttagagatcttggaatgctcacatctagaatgtagtgctgattcataaaacggtgtccttgtccccatgacatgcgggccttttgatctcctctattatgttgtgtcttaagaaacattacattgacattatggttgaattgatctgattttcattctgcactaatctacttccactggnnggggggtnttgnnnnnnnnnncggttaggccacacttcgaccttccaattattccagggtatttttcctttctctgggaacccttcaaaatcacctttgcttacaacccaaattcatanttacttagtaccaatattgcattcctcttaaactgcataaagcctagtatttgtcattaacacaccattgcactaccatctaaccatctgcttgcag

SEQ ID NO: 97245 - DNA, 1107 bp, Oryza sativa
  unsure (1)..(1107): unsure at all n locations
aatttgatttgtagctctaaactgaaaagtgtgtgtttggtgttttctgttccctatctatccagtcaactaagaacgtgcanntatttntgtaatgcagcaattntggaatggagccaatggaaaggacacacnccaatcaaaaanntagcatgcnnccaatcgtaaagagaaatgcaatgaagggtacccttgcttgagggctttaacccacaacagatttaaggtcattatgcaggaagttcgctcttccagaagcagaagaaagaacagctccagctgcagctgtttcaacaggaagaggaactggaagaccaacagcctcaggtggttcgctctctttcatttaatttgatgcattcatttcttgatgatcatccaattctcatgcttcatcttaccatcaactggttgctgggggtctaatcgtgttatctctttttttagtaaaagctctctatatgttgaaatgatcacaactatcataataaacattttggttttttagttctaatatattgtgcatatttgtagttctagtaactatttttggtatcagagagtttcttttataatacattgtgatgtgtagttagtaaatacatatgtaatattgcataatcatcaaaattttatatttccattgcaccaaaattgacccctcttaaggtctgaaagttttcaaaacgaaaatcaaatgatccgaatcgaattgcctcaacttgataatctgcttccacccacccaactctgtgtgtgtcacacacacacacacaaaaacaaacaaacaaatgtgcccacacaacaccgaacggcaacacgtgtcaacaacatacaaacaatcaaacgcaaacttatatctccactgtaccaaaattgacccctcttaaggtctaaaagttttcaaaacgaaaatcaaatgatccgaatcgaattgcctcaacttgataatctgcttccacccacccaactgtgtgtgtgtgtgtcacacacacaaacaaacaaacaaatgtgaccacaaaacaccgaacggcaacacatgtcactaacaagcaaacacaaactaaatgccgggggtaagcaacctacagagaagctcatagctcc

SEQ ID NO: 97246 - DNA, 621 bp, Oryza sativa
agggtttttaacaacccccaaaaaagtttttttttttaatataatccacaaattaaaattgtagttaaccgggttattttttttacgtgaaaccaactcaccagggtttaagttttaaattttaactcacaaactaattttatatttgtggtagagtgagtattggaacccatggtgattttgttaaaaattaattcgtggacagtaaagacttttccccttctctatctaatagagcagaaaacccagcgaggccataatccgttgtagtctagctggttagatactcggctctcacccgagagacccgggtttgagtcccggcaacggaaattccttttttttttttgaaattttcattagctttgacgttatatctttacttttgaagcatacaaacgaaagacatggaaaagggtcctaattcaaaccgaatgtacgttttcaggttctatctatgcaaagcacagatcaactaaatcccacatttgacatttcctgttgcatagagcttatgtactctaatactacctccctttttcccttttttaatagataacgccgttaactttttatcacacgttggaccattcgtcttattcgaaacatttacgtaactat

SEQ ID NO: 97247 - DNA, 1502 bp, Oryza sativa
tcacttccaaacttgtgacatgccacagttttttaattcaaaggcccacatgtcatacaaccattttttagccaaaccatgtctaagttgtggccatcaatttataagccacatatttggctaggtttggcaagaaagtttggcaatgtttgggagggaaccaaacaacccctagtcttgcatggtaggcataatacgcatggaagtctatatacagttaggcaccagcaatagaacttttttttttcatctaatcagtgcatatattatattaaacaaaagaaaagatgattataacccgactattacaagaaagaggcatataagagataccgaaacaaaacaaataaatgaactctaaatcttaaaacgtttgtaagagacgtgagcagacaggcaaaaccacataatgtacatgcatgcaaaaagtatatgaatgagcatgaacaaataaattaagccactcggttgtctgcccgttctcaagaatccgaacatatacaaaatacatataagtgtaatatgattggatctccaaatgtgtctactccaagatgccggatttcatttataggcacatttgaaaagaaattatgggaaaatgtgtacaagctagtatagtgagagaagaatcgatgcaacaaagaaaaattaccccacctctagaatatgagtcctttctcaaatcaatcttttattaaactaaatcattcctcttaacatagacatgtctataggatactttatattcgttcactgccttacctaagctacctcaatatatttaaatggagtggacatcagttaagcagatcagattaatccataccatgtttaaattgaaatcctaatttatgaatcctctatctaacactccaccctgtaaaataggttagaccaatattttaacattgttacgtatatcacctcaccattgcttatctcgaattgtttataattaattatactcgcttcatctcgatttgttcctaattcattcctccttgttataaggaataaatgacatcatgataatatcttcaaactaagcatatagtaagtactatttatcatatgcaacatttatatgaggcaagattctatgtgaggtagagctcatattgcttcacgcgttctcatgcgaaactataacaaataataataataaaaatggtggcttttatgaacttatgatatcctaccattgcacgtatggtacgcatgaggtccatctatccatgccggtgttctggcgccccggtcaggatgaaactactggcgataggtagttataacatggaccgtagattaatccattggggtttgcagaacaatgagaatcagttaaccagttctcaacaatcgcttacgattcagcaaagatatatatacaaaaaaaaaaagcaaatgcttatcaattgtatcatcatgtatatatgttgctgggagttcttggtagcatcgcaatcacgctaagcagaccatgtgttgatgaaaacagt

SEQ ID NO: 97248 - DNA, 731 bp, Oryza sativa
tatactctgatcagaggtgtacatctttacccacaagacacatctttctcacgtgtaaccacgtgccacataccaccacggtatacggacggaagacgtgacatagtttccaacccatcatagccatagacaagagtaccgacctaaccccgcctacggccggaacccccgggacaggtaggcaggattgatgtcacgaccggaaatcacccaacaggcgttcctgacgtgcgtgtattattccttgtcccaggaggcaaggtacaccaaaagttgatacaattcagagtttaacaagcggaagcgtaaatataatcattacacgggcagcgaaggcccagcacacaaagacaacgaaaaacagcggaagactagggcgacgaccacaggcgcttgacggcaggcacgagctagacaccaaagccttcatcttcaaggagctcctcttctgtgcttgggaaaaattgagcaagactgagtacaaccaccgtactcaacaagacacacccacaaatgcagaataaatgcaagggagtacaaagggaattataatataaggggttagggttgcagtaaacagcatttaaagacatttagttgctcaaagctatttggtaaacacgaatctagaactatacaacgttattaatcaaggccgtgaacccacacgaacctgcttaacccaaggcctacgatgatccggaccgaactggcaacccgaccctgggtcc

SEQ ID NO: 97249 - DNA, 622 bp, Oryza sativa
tgcataaaatttcctccatgttgccacacctgactatccttcctagcaatcgcattattaggcatatataaaatgtagagtcaggtatagtcttagttaatacatatcacttagaaactatactcctataataattgagataacaaaaactcttaaccattaatgcaccaaaatattttttctacacttctttctttttctccacgcccatacaacaaaattttctttaacaaatgttaggagtcaacttcgaaccattgtcatgtgtagcaaccacccccctatctctcttccatgtcatatattttacttacgtggcaacgaatagagaccgttattacacaccgttatacgtgcccttagttagccaattttaattctgaaatcccatgagatccaacaccctaaatacttgggacgttcaactttcacatgagacgaagttttcaaaattttgaactatcgaatcaatactgaaaagaaccaacagatcgataatccgttggagcatggtgacaaacacccttgatcacggacacgttgcttttgttgtgaaaaaaatgcgccgccccacatggagagggattatattccaggagtcatggaaagaaggttgtgactt

SEQ ID NO: 97250 - DNA, 703 bp, Oryza sativa
ttcaggatttgggagcatacacaactacacaaacacaactacacaagtactcactctggattcagtgtaattggtggttactactactccgtagttggttagtttggttttcacggccagcatatatccacatcgatcccatccctcttccgttgaacacgtacgtcatacttatgatgtttcattaacctaaaccttagtgcatttgctagggtttaaatcttactgcttaacggatcagtgaccggtctatgtgtaaatataagcatgtcttaggctacgttcggttcggctcaacggctgagatgctttcccctttttttatgagaatgtttcctaaaatgttaaatggtgttttttttaaaaaaaaagatctagataaaagttactaaaaagatgaaataaataaaattttcaattaattatatgtttatggcttgttttatttcacgtgttgctgaatctcatattatcctctcattgtcttgtatatgctctaagcggttgcgagggagagggacggtaaaggacggacggtatcttggtgtggttaattggtgagtcgatgatggtaccactaaaacaacattaagggagatggtttgcggcgtggttaatcagtaggatgggtaggttgaaatattacaaagggaaccttgttgagaatatagacatataatgatttaatatgggctgcaggaat

SEQ ID NO: 97251 - DNA, 509 bp, Oryza sativa
ccgccatcgtccaaaggatttggcccatgcgtaggggccgggccgagtagtagcaccactagtctagcgcaagctctctggtggacaagcgacctctccaacatcaacattaagcgcaaggtgatcgcacatcagtggccccactaatttgaggacgaagctgctaactctagtgattgttcagaatagaaggataagcaaggtagaaaagacaagagagatgtccctatcaaccatgagtcgacgaggagccggtattgatggtgccatagaggtcaagtgcacgaggagcacgatgtttcagggcataaacacgaacagaaggccatgaaggactaaggtaggaggagatagagataatatgtagttctaagacaagtgaaaaaccggaagagattaaagcaagaagaagaaatcaaaatcctttcttgtggatgaacgactctggaatactagtagccaatgcagaggatctgaatccaacaaatattatttgttcagaacttcag

SEQ ID NO: 97252 - DNA, 5223 bp, Oryza sativa
atgaaggtcgaaaatataaaatgagaaaaagagcaggacctcagctctctaaagtcagtaaaatcacttagcttgaaaaacaactctaaaattctggatccaaataaaaccacaacaaggtaatacccatgctaaaataagttcattttgcacacataccgatacaaagttaaaaggactagggtgtctttactttagcaaatctcaatacaaccatttctcaattcatttacttctaatacattattctctatttctacaaactcagatataatgattactctaaaaataaatttattttgagacaaatgaaagaagctgaaagtaaacttattacgggacaatggaagtattttggtttgatgctttgatcctctttcagacttcgagcatgagtattgtacgtgtcttctctgtattctctccaccataaaaaaaattaatttagtattgaatttaacacatgctatacatatttatagtactagcatgttttaatccgatactaggttaagcttttatgaaacggagcgaggacatgtcttttggacacgcatacttcctccgtctcaaaaaaaaatcaacctatgagggatgtgatctgtgctaggacaatgtgtttgaacgtagggatgtctctatgtctagatacattgttcatatcctctcctcctagttgtttttttttttggatggggggagtaccagctagtcgtaggctgcgacagtgcgaggcgtagaggagacaaccaagtggatcccacatggccacttcacagcatcgatgatcggtcgcttgtgtgttacgagtagttctagatagggctgtcaacgagccgagctcgagcgagtttggctatataggcttgagtttgacatgaactcgagctgagcctgcataccgatcgagcttgggactaagctcgagttcgagctcgagcgagcttcgagcctactcgagcttgacagcttgacttggtgaaactccaaagaacttactcttgtataagagatattaatacaaattatcggtagtcaaaattaatgggtgctacttgtcttgaatgaagcctctgcagcttttctcatgaattcatggctttgaaacattacaattaacaaagctagctactacatctaataggaatagtagtactaattctaaaaaagaaaaggaatagtagtactattactagcagccagttaattactttattgagaagcattgatgagatcttgagacttgagcaggtcaagcacgatgataagtatacattgacccatcaagaatatcttcctacgtgcaatgcatcttatgctaattaagccctaccgagctattcgagctcgaacttgctaggattgcgagcctcagcctaggcttaagcttggcttgtctagtatttgagccgagctcaaatcaagcctgtaacgaatcaagctcgagcagcttgcaagctccgagcttttttgacagtcatagttctagatcagctgcaatagtaagatagactgcaacttaagttattgtagctgctaagttggatctaactctaacggcaaggattagtttggtcactgtagtaaaatatattgtatcataaaacagtgctcagggtactgtagggtgaacactgttgcaattaatttggaccattatcatataaatgaaatgactaaaaaatatatgcagtcctatggtgcggccgcagttaagactacacccaatttcaatccttaattagtggctagacggtcctatcttttcgcttatgtatataattttccaagctactcattactaacttaaaaaaaattataagtaatttttttgcatacgtgtttttaattatttaaaagcaaaaagtatgataagaaataaaattaatttaaaaattatctcgtaagcataagaaaaagaaggtgttgtcaatctcttcagtattgaccaccaccaacgcacgcacagtcgcacagtcccccatcggcccatcccatgcgtacgtggtttgcctgccttgctctggttggagagccggaggcactttggtgtaccacgcggctctctctctctctctctcacagagaaattcagatcccagtttaacctgtttcaaaaaaaaaaaaacctagtgtatgtaagacagtaagagcaaggtcaatagtatagccagctgatggctccactcgtatccatgtcattctatagttgattttaaagctaacttgtacaacagagtggctattgtgttggctgtatctcatccatcaaaaaatgtattttacacgcatatattgatatacatgatcgaaagtgaactcaatccctgtggtcgttgttgtgcaatactcaggagtgctctatacataaaagaaaaataaaagtcacagacagcaaatagatgagaagaacaaaagaattaggaagagattagatgacaataactcaaattagaaagctattttctgctccatcaacgatgagatccgtttgttctgtttgtagatgcatcggccccttcttgacgcgatggccagcagcagcgccagcccgcggttgtcgtcggcgcccgttgctgccaccacgttcgcgatctgctgcgccgcgagcgctgcgttcgtcgatgccagcggccgagtcgccgagaggaacgcccttgtcatcgccgccaccacgggcgccgacgacatcaacagacccttcttggtcaggcttttgagcgagattgggctaggcgtcggggtggaagacaattgcaaacggcggtcggcgaagacacgccaggaagactgggggggaatcgacgcggaagacaactgcgaggcggtggccggcagagatcgatctgcgacactcccgtgaggagagaaacaagatgggctgcggagggggagggaatacgctgcatgtcacacgggatcggatggctcgtcgtgagacccacaaagcacacacgaacccgtgctattgcccggctatagattagtcgctcgctttcttctctctcctgttcctctctcttccacataggaatttaatgagctggatatttttagagcctgctcagtcaacttattgtacctgcttacgtacaatcacagcgtggtccagactccagacgtaatcacataccctgtacacctagcacacattagtgatcagtcaatggaaatggttaagtggattttagtttgacgagacgcagtccctcacgaacgagctagagacaatttttgaaaagaaacggtgcgtgcagcgctgcttacgtacgtgctccgatccacccggcccctgatccggccggctaacttttgcttttacttttgtggcgctgatggggatgcacagtctccggaatgcaagaacacgggtgcgccagctgctgcgtgcgttgcatgcaaatgcgtccaagcaaagcggtcgtcccagcagcttgactgaaacttgaagacttgaggtgctgatttgaaattttcattaggctcaattggccagaaaaagaaacctaaaacgattgatcaaaacaaaaagaaaggtggtttagccttgatctaatcagctaaggtcgatgaattaatccctagttagctgctcatctcttcagttcaaactagtagtatagctatagcccagcttgtgttgatattcagatactgtgtgcaaatgcgtgcaacgcgggcaggcgaccagatgatcctgaagctgggctgtacagtgcctggtgcagaggagatgatagccaagtggacccggccctctacatggcgcagggcaggggtacgtggagtgcccagatttgttgtcactcgatcgatcgtgtgatctgcgacgccatacgtgagacagacatgcatatgcactcgccgtgttcctgtgtgttggccctggactagtactacagtaaatgtaccgcaggaagtggattttatgggtacatccccttgttttatgtatggtgtttaaaaaattataaaaaaatttgaaaaaaattatcaagatagattcatacatgatatatcttttcgcaaacatgtaagttaaaattcgatttatacaattcgaaacaaaaataacaacattaaccgtgaattacgcgttctattcatagtcaaatttgttatttttggttctacatgtataagttgaatttgaatatgcatgtttatgaagtgacatatcacatattgatctatcgtactaaattttttaaaattttttgatgattttttaagtgacataaaaaatgagagaatatccccttaagggatgaatacagttttccatataccgcgttgcatgttttatttaccacacacggacatacacctggtactccagttcaaacctgagttagttttgcaaactacggttaataatactcgtacttaccacgcatgcacggttaataataagctcttgcaaaccctgtgctagctagctagctaggagtaacatacatcaaccttttttttcaaaaaaagaaaaaaaaaagctttcttgatactttctctcgcggagggcaagctgggccaggcggaaacggccgccacggctacgcgaccgagcagcgtcgttgcggtagagtcgtagagaccgagccattgaagagctcttcccccccttgaccaccaccaccaacgcacccatgcgtacacgtggtttgtcaccgatcgagcgctcacagagagagagagggggagatactccctccgtccaaaaaaaaaaaaaaagacaaaccctaggttttcgtgtccaattttaactgtcagtcttatatgaaatttgtttataattcgtattttcattgttgttagatgataaaacatgactaatattttatgcgtgacttatctttttaatttttttaataattttttcaaataagacgaacggttaaatattggacacggaaaccagagtttgtttttttttggacggagggagtatgtgtgtgtgtgtgaggtgggcgccccatgtcccgatgcgcgggcgtgtcgggggttgggcccgatggggatttctgttgttggttggaggcagaggcacgcagatcgcgcgtgggtgggttggggacgtactggggtaaccggtggtaacctgaccaacccacgcagctcaattcccgtgctggcggaagacaagggcatgcatgtaaggcggctggttgggatggaggagatgggaatcaatctcctgtgcacggaaaacggagtgatctatta

SEQ ID NO: 97253 - DNA, 705 bp, Oryza sativa
cagtagttcatcacatacaaatcggcctctaattaagtaggaagtttggttatccgcacttcaagcttatatacattgatattgatctacttccttgaaaataattaatatataactaaatatataaacgtagccgaattgacatttgtttactagtaactggcgatcaaagtgcgtcatttggaactgcacccactatttaattaagctgacattggtcaaactagcaccgagcaatgcaacgaccaagtgacgttgtggttcatgcacccaacagtattgtcccttatctggtccacgaagtttcttcatttggtattggagattgcaaaatttcgtcgtcctgacccgaatttggctacatttattctcggccgggctaatcgaaaattcatcaatcgttttttccacgacggatagaactagtccttcgaaggcacgcggtctcataccttcttgaaactaacagtgcttagaattttagttccgagatgaattgtccgatgcacgcgagaagtagaacatattgggttcaagttagtttggattgaaaccaaaccagtcaaccaaaggtttacaaaataacttgaatcgaatatgaatctatatccccgtaaacaaaaaagaatttatatcaatactatcttctctggcaaggtatatgttgctaaatatatatatggtcaaaaggaaaaagtgacagat

SEQ ID NO: 97254 - DNA, 646 bp, Oryza sativa
taaatttacccttataaagcttatactatgatctatttaagtggaagatcaaatgaatcttcaccattgaattgtttatatagcagtatatactaccagcgtattgtacctaaaattctcaaattatattattgttctagactttatatgagaatggtattgttttggattgttttagccatctaagataacaccttagagatttggttcacctcctaacagtattgtgcacgagttactagcttatgtttttttagtgtgttagtctatgcgtcccaaattatatttttttacatggtcataaataacacattaatttatttcatgttatgttcctaacaaatataaaattagcatcaaatgaaagtattttacaatacaaaccttataatataacatgtataatactgtgtgtatggttagtacgattattagttaaaagttactgagtttgattatcctaaaaaaacagaacaccctataatttaagatgaagggaatacataaaaatttctttgcatctggcatgtgccatcttgcggaaggacaggcaattcgtcgttttcacacgagtgcgtacttacgttcagggaataatcacgtactgtacggccgatgatcactgagacggtcgtgccaaacagtg

SEQ ID NO: 97255 - DNA, 1250 bp, Oryza sativa
caatactgttaggaggtgaaccaaatctctaaggtgttatcttagatggctaaaacaatccaaaacaataccattctcatataaagtctagaacaataatataatttgagaacttttaggtacaatacgctggtagtatatactgctatataaacaattcaatggtgaagattgatttgatcttccacttaaatagatcatagtataaaatttataagggtaaatttatcttttactttgttattccacaggtttatttatgctaaaaacaaaatagttgatctagataaaaaaatttggtaccatcatcgggattgtataaatatgtgtaaacctagctagcaagatttggaatgtgtaaggcttttcacgtatatctgctatggtacaacctaattatttgatctgtaaatggtcatttataactgacgtatgtatgtagatttttaatgatgatcagaattgatcaggaatcgtgccgttgtggcgtgtgtcattgtctctcaaaggcacacaaacgagatcgaacggaggttaactctcaaccatgaaattcatagaaacccctttcgcattttctataaaattcctgatttacccatctatatgccggcagtatattgtacagtaaaagttctctataattaattttccgttgtatatgaataaaataacccacaaggaagaagtgagggagagagatccccatctaattcatccaagcacagccaaccctgtagggatcaagtagtagtatcaataattaataagcagcaggtgaccagtggaattgatccatcgatgtgtgatgatgatgagcatgaggaggcggcatataattagcagtagctgagcagcagaggtagcgggaacaaagggaggcatcagctgctcgtgcagtttcctctcggccggccggggacaaccggaatctcgcaacatatatccgtgcacccatgcatcgcctgcacacgcatccatcgttttcaccaacaattcaagcacatacatgcatatgcaaggatcgatcgatcgactctctgatcaaccctgcacgctgcaatatatatgcttagctgctgttgcgtgattccggccgatttcggcggtcaatccgtgcatgattcagcgtgcagactacagtaggagttggtactatgcgcacgttgctttggacccactcgtacgtgcatagtatatgtgcaatgtacgtagtaacgcacggcatgtttcgctattgcccgacacgg

SEQ ID NO: 97256 - DNA, 899 bp, Oryza sativa
gactcttctctgtgtggcttcgttgaaagtgtatatagtactatccccaccatttcttatcgtacatgtggtctcgaacatttacatttaattcgttttgagcggtaaacaatatgttaattttaacaataaattaccagttagttttttttactgggaactgtatagtactccctccgtcccataatataatggattttgagtttttagttgtattgtttgaccactcgtattattcaaaaaatttgtgcaaatataaaaaacgagaatttgtgctaaggataataaagtaaataaaaaaaataaataataatttcaattttttttgaataaaacgagtggtcaaacagtgcaagtaaaaacttaaaataacttatattatgggacggagggagtatgtcaattaggaactttgtttgctctcggtcgtaccgagctagctagggcagaagttacatgaattaattaatcctaaaaataaggtaagtacgtctagactaattagttataaccattatcatcaactcttaattaagcaagtcatgtactccagctttattatctactaatttattaattgcatgactataaccctgtttagatgggactaaaatattttagtccctatcacacactggtggagaaaccatctttggtcggtccggcaaaatccacaatagtctcggatccaaaaagaaccgggactaaatattgtttttaatcccggttataaaaattttgatctttagtctcggttggtgttaccatccgggactaaagatgatctttagtcccggttcatcccttgtcagatgtatgtcaaggggccgaggatctttagtctcggttggtgttaataaccgggactaaagatcaagatgatctttagtcccgcttgg

SEQ ID NO: 97257 - DNA, 520 bp, Oryza sativa
agtggattttgatccttgagaggatatcccctcattgtgtgcatattaatcagtttgttttaaaaaaattaaaaaaaattgagaagatgtattaacatgtgatatatcactccacaaacatacaagttcaaattcagcttctacatctcgcaacgaaaaaaataaatttgtctgtgaatatacattaactagttgtatagtttaatttattttttttccttgcgagatgtaaaaattgaattttaacttgaatgtttgtggcgtgatatatcacacgttaatacatcttctcaaattttttcacattttttaataaccatttgagtaacatgcaaacgacaaagatattgatatcccctcgagggatcaaaatagtttcccctatcactactttgaattaggtttactatcatattcatcacaaggtttccccaaaagaaaaggcaaaagtagaaaaaaaaaacaaggctaggaattaatcaatcacctgcagctgctgtagtgaaatactgggagatgg

SEQ ID NO: 97258 - DNA, 527 bp, Oryza sativa
ggatcaaaatccactcccgttgaccgttgtgatagctgatatattggtgtggctgctgctttagtgctagctagacaagttgaggccgtaattagtgtgaacctcgccaaactctttattacccatctaatcatggaagccgtcggtgagcttccaaacaagttatagagtacagttccagaaaagttgtaaatttcatgagaattaatgcaagtcatgtgggacacaaacccactcaaatacaactgcggcatattggattgaaaaaagtacgaattacctctctaactatcaaggtcgaccgaaatacacctacaaaatcgaagaccagatattctacacccccaactattgaaaccggataaataccccgtgtctcaatccggagcggtcccacatgtcagcctccaccttatcctccctctcttaagaagctagttggccccgcatgtaagctgctcccttttccttcgtctcctggccgcaaagatgcctgtgccggcttcaggcttcagggacccggaccg

SEQ ID NO: 97259 - DNA, 612 bp, Oryza sativa
actacgtgtttaattttagtcccgattcatattaccaagcgggactaaagatcatcttgatctttagtcccggttattaacaccaaccgagactaaagatcctcggccccttgacatacatctgacaagggatgaaccgggactaaagatcatctttagtcccggatggtaacaccaaccgagactaaagatcaaaatttttataaccgggattaaaaacaatatttagtcccggttctttttggatccgagactattgtggattttgccggaccgaccaaagatggtttctccaccagtgtgtgatagggactaaaatattttagtcccatctaaacagggttatagtcatgcaattaataaattagtagataataaagctggagtacatgacttgcttaattaagagttgatgataatggttataactaattagtctagacgtacttaccttatttttaggattaattaattcatgtaacttctgccctagctagctcggtacgaccgagagcaaacaaagttcctaattgacatactccctccgtcccataatataagttattttaagtttttacttgcactgtttgaccactcgttttattcaaaaaa

SEQ ID NO: 97260 - DNA, 603 bp, Oryza sativa
tgtgttggcaacaaaacaagctgaaggcacaacggaaaccaaccgtagaggggtgccgggtgcaaatgcaatgcagggtgggtgaggcatccctatccgcgggattttttacattttggttcttttaaaaaacttatttcacaaatagacccctaaaaaaacttatcctagaaatggtccttttaggggcaccagagtggctggcgccgtcatcaacgggaccgtcctcctgccaccgtggcgcacgcgaaccgaagtggcaggaggaggcgctagccatgctggcgccgccccagggaggagggtgccagcatggctggcgccgccgcctccattcctgtttctctgtatggagttgcaacggtgtcatttttattttattttttcggattttttttcacactcaggatcacgatacaaccaaccacaaaaaaaaaatttaaactcgaactaccacttagctaagtctgaaaatagctagcataccacttagtatactttgcaccttcactaaaattagaccataattccattagtaaaaccctttgatcaggatgttaaacataatgcactctaccactatatgaaattacttaatctaat

SEQ ID NO: 97261 - DNA, 738 bp, Oryza sativa
atatccaaaacaaaaacatgcatgcctacctgaacctcaccactacaacaagctcacacacgtttacattggacaaggtaggtttacctggcaatttttatatagcaggatatatcgcacatatatacatttcagtgaattaatggaactgaaatcaacaacacgctggctagatcgacaagcctctcaacttctgctcttgctcgggtaattgcaaaagagaatgaataccatacagagattatcattttcgtaagtacgtaaaacaaccgcaagacatgattacgacacgatacgcttatacacactaattataatagtatactcattgcgtggaagaattagaggagctatctagggcaattgtcaacctattcattcatactacttccgtctcaaaataagtgcagccgtgaatatccgtacccaacgtttaaccgtccgtcttatttgaaaaatttatgaaaaatttaaatatatttagtcacacataaagtattattcatgttttatcatctaatagcaataaaaatattaatcataaaaaaattcaaataagacgaacggtcaaacgttgaacgtgaataatgcaaaactgcacttattttgggacggagggagtatatgctatagatctggggcccaccggaaatcccacctgatgtgatcctacttggaccaatggcctctgcccaccgtgcatctgatcctatccacaattcgtacgggctgcaggaa

SEQ ID NO: 97262 - DNA, 668 bp, Oryza sativa
ttgaactaaaacacacccttcccttcacccgattccatgtcatagggtgtgtttagttcacatcaaaattggaagttttgttgaaattggaacgatgtgacggaaaaattgaaagtttgtacgtggatgtgtttagttcacgccaaaattgaaagtttgattggaattagaacgatggaacggaaaaattataagttagtgtgtaagaaagttttaacataatggaaaagttagaagtttgaagaaaaagtttaaaactaaactcggccatagtataagagagagagagaggtgttgcttcgaccaatctctacaaacccagccataaaatcacacattcaaaacacatagatcacaaactccttctattgcttgcttccattgtgtacacagtatatcttcgctagttactcatttacatgtcccctccgtgataaataatcaccatggtttacagcatttttaataatcagacaaaacaagatgaaatattttcactatgcgtgtgtaccatattacgtgtatatatattgatgattgatgttactgtaaaaaaaatacaaaatgcacgtaaacagaagcaagagatatacatttttttagagggaaaagatcaagcttaaacgactgtacattttaaataaggtgaattaactgtacattgaaca

SEQ ID NO: 97263 - DNA, 522 bp, Oryza sativa
gtcgatgtgaaaatcatgggacaacataacctgccattctagcatcgtttgggatcggagctaaggaattgaactctagttttggcaggtcaatatgatcaggtcaatgatagatgctgactacatctccactgcaaacccaactttttttttgacacgctgcaaacccaacattgactgactgaaagctagctagcggatcccttgactgatgcacatgcatgcatatattagattttgttcatctctcctgctccctccgtttcacaatgtaagattttctagcattgcccatatttataaagatatgaatgaatctaaatattcatatgtgtctagattcattaatatccatataaatatgagcaatgctagaaagtcttacattatgaaacgggggaagtagcttggacctgccgatttgttatacaagcgataaatgcttaatcatgcttatccattaatcgatcactagcttgcatgcgtgggtgacatttatacatgcgtgttactgggtaatta

SEQ ID NO: 97264 - DNA, 1672 bp, Oryza sativa
gggtccacatgggggggacatttgggcccatgggtcatgtaaagcttactttggaaaggaaagaagaaaagttttttttttagctagctatttcctgaaaaaatttctcagaatttagatagtacgttgaagaccgaaacattagagaccaatattaggcggatccctaggcggaggggttaggtggttcacataggtatattgtgagattattagacccacatatcatgcatacatggcttcctcataataataattttttttttgtttttattaaactagccatttcccaaaattattttagaatttatataataccgtagaaatcaaaacatcacacaccgacatccgattctcccgtagtagcttcaatctcaacttccacgaggcaacatgaaagtttcttgatatggcactggtatggctaactggaactaagcgtataatttatggaaattagagtgcatttgattggattcatagtttggaacctatccacacgggtttggatggcttgtttcgggcctattctgaggatggagcaagcgaggatatacacataaatattatgaccaaatttaattagcattgagctagctagcaaatatgtgagcacgggacaaaccacaaaaccaaacccctcgtgtgtgtgcgtgtaaaagaacaattaacgcaagagggagatgataagtgtgtacattaatagattgaatgcgatttacatttttttataggaatgatttttacacttggttattactaagtgtaagaaagaatcaaggcaaatctagaaaataaattatataattcacttaatgcatattatattgaaacttgtttgcatgtatccaatcaattaattacctatacgcacacacatccaacattgccatcacattgtgtgttcaagacattctctgtcttgtacaggttcgtttggcatatgttactgagccatgcataaaaataatgtactatacacattttactgtttgattaaattcctttctgacctattttaacgcatgaatacatgcatgcatgtggaggcctgcatgcaagaactcgacaagtgaaacagggaaggccgtttgcatgtgatgatctgaccttaatattctcgccccaaacaagctagctgttgtcctaagattaattaattggtacactagatgaaatcaataatacaactatatgtgtgcacaagtttagattcgcaaaggacaaaccatgtactgtgcatgttaaaaaagatgatcagccagctgtgatttatgcctgcaatgtcacgaggctatagtgaacagtactgaaaactgctgcactgcgcctggctccaaagccatacatgcatgctcatcacaggatcaattcagtgaacaaacactgcaggcattatttcaaaaccgatgcttaaactggaataatgtgtattacacaattgatctccccgtcaaatttatcaccatttcgtcgcaagaaagaattaatcttttttttagggacaagaaagaattaattggttgaccatgactaacagggcaacggtatagattatatgagagaaggaaccagatatggccaaccaaaaaaatatagtcaaaatttgactatgtacatgcatggtcgtagtgtacattccattctctcatttttggtaggataagatatg

SEQ ID NO: 97265 - DNA, 673 bp, Oryza sativa
tttttgtacgaaatacaccgtttaataatttgaaaaacgtgctaacgggaatagctaagctgcattagctgtttagaacgcggagaggggataagttcacatctactgtgggcttagggcatactccctccatcccataaaaaaccaacctaaaaccggatgtgacatatctactacgaatctggacatacatctgttcagattcatcgtactagaatatatcacatatggtcatagatttgttgtttatgggatggatggagtactcttaacaggtccctgccatgtggaccctacctgcagcagcctgagggaaataaaaaaatatccaaagacaaaaacaattcgatccagtagcttgacacccccacccactagtcgacgccctcctctccccgtgcacgaatcacgagactcacgaccaccaccctcgtttcggtttttgaatcgtcctccaccattggaggaacgtcaccattggaggaaccccttccggtaggccccacatggcagtgtgacgcacataaaaccctaacgcacgaggaaagctatcgaaccaagccaggccgcgcgccaaacaaacacggagcccaaaacactaaccgcccatatattaatagcctccgcgtgatgagaccaatacaccagcaagaccgagagacgacccgagcgc

SEQ ID NO: 97266 - DNA, 599 bp, Oryza sativa
ccccccaccccaccccacatgtgtgtacccttcctagctagcatctctctacacatgcgccgctcagtgatggcgcggtgtaagtccctgtttagaagagtttctacggtttctctctgaatctctaacttattcaaatagtctatctatagattctcgttccgattctaagaactcataactgtagagaattaaaaaaatataaattaattggaagtcaaaaattctaaagatatgaaactcaactttgtaaattttgatttttgactagatgattggttttacttctgttgtttcttagaatctcgagctttccaaatagaacctcgcggccgcctccaaaccgcatacggcattgtgcagtcgagcggggggcggcactgtacaagctagccggttggcatcaatgtggcacacaggaacacacggaattcccttttttcagagaggcatgcattatatatgcaggacgcgcgcgtttatgctatgtagggatctggagtttgaatgaagtcgatcgatcggattgggatgcaatcatgcaggtgtgtgcaataattcccacaaaaaaggcagttctttttgtcccagggctttta

SEQ ID NO: 97267 - DNA, 649 bp, Oryza sativa
acggtttggcatttcaaatggaagtaaagcaaatgtataagctattcggagcaaaatgttttcaccatcatttttctccatcgtgtgtttctgttcatacttgttaaagattcatccagtattgaaaggtatgcttgtgcttgagaactctgcttctgttgctggatctattgcttatttactggtatcggtcgtaatctatacgtaaattttccagccaattgccaccgaggttggctgacgtggcgaggacgggcccacaaatcagcgtctcgcggcctccgcttcttcgcccacctcgcgttcgaaaaaaaggaaagttcaaagcgagaaaacgaaaacagttgcacacacttgctcctctccccgtgtccgctcgtttgctccggcgtcgcgtgtccgcgtgctcctctcctcttcacgaaaaactctccgcaacaccaccacgccggaaaattcccaagtccacactcctcatctctctctctcgctcgctcgattagctcggttccaagccgagcaggagcgacgcgagcgagcatggcggcgtcggcgtcggcgtcggcgctgcaggccgagcggtgcctcctcgtcggggtcggggcggggccccggcggcaccggctccccctccgcatgcccccgccac

SEQ ID NO: 97268 - DNA, 1320 bp, Oryza sativa
aggaagtagtatttttgttctacctttatgcactgtgagaagagaaagcaagaaatattgcttaaggctaaaccataagaaataaaaaattagtttatatcttttacaacatgcatgatactctttcatttatattgaatagagtttttccatgaatggttcccagcttaacatcaaaaagatgcagcatgtgttatatacacaaatgaacataagggtgtgtgtctcatcttggaccatatctaggcgctcgtgccaaagcgatgacggtttccttctcacatctgctttctctcttccacgttagatcgagacaacatatacgggctaatcgtttgcttattagacttgctcttaaaagttgtattctaagtccccaacttatatatatctgcctcgtttttcacacgcatgtttcctaaactgttaaacgatacgttttattaaaaagtttttatagaaaagttgctttaaaagattatatcaaaatattgcatgatccaaataaatcattagcaggcgccccacatgtattgcatatactcgaatttgccatgtttagtcaagctcggacttcagcaagcctcgtgcaaagaccctgatttttttggtacctttaacttccgcagtctttcattctctcttcattaagtccactttagagctgcctggtctatcatttagccaatactctctactcctttttatgtgcaccgacattctataaagcagagagcactgaaaaaactccatttctttcatgaaactaagcccgagtatcttgttgtttgacaaaactcagagaaatctacaaactagcctctttatcccaactacaaaataatgaatctaacatctcagtattccaagtcatcgacattttattaactagtcaatactccacactttgttacgagatatgtggatgaatgcatgttatacattatagaaatgatatatgtgtatatttaaataatatgaaaacgatatgaagataatgattggacattgtttacatatctattacaagtccattaaacttcctataaacgctctcaagctgtcacgtggtttcttacaaacgctcataaagctccatatggcgttctaataaattagtaaaaatcacaaataaatcaaataaatatctaatcattgatttttctttaaatcggtggattcattagttttaaccattagatctccatctaaaaggaaaatgaaaaaaagtggtacccacctccactgccgaacgtatgtacatccgtgctccttcccaccctccgatccttctttcatctctctcctatttttagctaa

SEQ ID NO: 97269 - DNA, 514 bp, Oryza sativa
acaatattattaatagcgtttcctctcacatttaatattttagggtgctcttgtccatggtgaatgccaaaaccacgacgaccatggatgattgtatttttcctttaccattttcagaagtacgatcatcatgcttagaatggagatgcacttaagcatctatgtttgcattgtgtttatttttaaaaaaaatgtacgctcctgctagaagtgaattaattgtttgtcatcatttttctttcttttttttaaaaaaaagtagagttcacgcattccaaacaatgtaatgggccgtgtaaggcctggcgtgttgataagcccaatccaattaggcagggctggattttggtgtcttaggacctattcggctggtattttctgcagctgcagccgcacaacacaagcactgcagcgtaaaggaatgattaccgaacacgcccctaatttgtcccgttcaaactccagacataaaatgaaaaaaaactattagcacataattaattaagtattaata

SEQ ID NO: 97270 - DNA, 513 bp, Oryza sativa
ctataataattagtaataaatctattctacaccctgaataattcctaataactaatagctctcgtccaaccaatcgagcccatgactggcacgtctaattaataggatctttttttttggaaaaatacctaaagtcggtttggcttttctggggtttcggtttttaccgaaacaaatggagcgttctattcgtgaaaagctgaaacccgtgtgtaatgtgttaattgtgtgttactagttctcaaaaaaaaagaaaaagaaaaagaaaaaaaagaatgtgttgtgtggggaactgggggatcaactattccaatttaccaggtggttatttacgtcggttggatgggccaactgatgggctcgagcgggcgagatatatagggccgggctccaaggccctaattaattaaatagcaaaataattaagcttgaatatcatatcgacccaattatattaaccctagattgagaaatatttgagagaggaggagcaccaccgcgtgcgccatggcc

SEQ ID NO: 97271 - DNA, 658 bp, Oryza sativa
aaaaaatccagggtctttgcacgaggctttgctgaagcccagctttgactaaacatggcaaattcaagtatatgcaatacatgtggggcgcctgctaataatttatttggatcatgcaatattttgatataatcttttaagcaacttttctataaaaactttttaataaaacgtatcgtttaacagtttaggaaacatgcgtgtgaaaaacgaggcagatatatataagttggggacttagaatacaacttttaagagcaagtctaataagcaaacgattagcccgtatatgttgtctcgatctaacgtggaagagagaaagcagatgtgagaaggaaaccgtcatcgctttggcacgagcgcctagatatggtccaagatgagacacacacccttatgttcatttgtgtatataacacatgctgcatctttttgatgttaagctgggaaccattcatggaaaaactctattcaatataaatgaaagagtatcatgcatgttgtaaaagatataaactaattttttatttcttatggtttagccttaagcaatatttcttgctttctcttctcacagtgcataaaggtagaacaaaaatactacttcctctgtttcacgatgtaagtcattctagcatttcccacattcatattgatg

SEQ ID NO: 97272 - DNA, 542 bp, Oryza sativa
aactcttaaggttatgggagttaggaactatctttgacacaatattagaaacatttcaaaataaagaaaaagagagtatcataataattagaaactctcgatgatccaaattatccgactgaatataacctcaccacatagaagcaaaattacacagctatatgcatcacatgatgtagaggctgagatttttatttgactatcttaaatatattgagtacaaaattgcaactatatatggactaacgaagctagtccaacataacaatatatataggtactacatcgtcatttggtcggttaatattctaatcaagcaggtctcactccctataattctatattatatccgagcatatcctcatcgctcgtagagaaagaaaacacatcgatacttttaatgttaccgttgcccatcaaataggaacggataataattaagaggaacaattaaaaaagcaacgatgaggacgacgacgaggaccggcagctaaagcgaaacaagacattcggtcaatcggctgctaatttcctcctgtagg

SEQ ID NO: 97273 - DNA, 564 bp, Oryza sativa
ctatagggcgaattcgagctcggtacccattccggtagttgaacacgttattttgagagtaattaagctccaatggattgtaatatataattaatggcaatgtggatgttgttaatcggtcaaagggtcagactttcttctgtcggtcaagagcgactccaactactgtactatactaactaaactacactagtggatcatcaattttccaaacagttaattactcgctggcgatcgaatcatacctactgtactatactatactcggataagcagaggaagaggaaggaccagcccctgatgaaacatcagtcttgagatgcaacttgtgagtcaactgggtgactttcttaatcatcctcgtgagacgaggagcatgcacaagccctttccagtagttgaaggaccttccacacaaagttgaacacatggaagtgaaagggaggaggatcaatgaaaggatcttgatgttgtttaaaggagggtgaataggcgtttaaaacttttaagtaagtatggaagctgaacttttcggatatttccaaatatttttcaaatattttt

SEQ ID NO: 97274 - DNA, 516 bp, Oryza sativa
ctcactataggcgaattcgagctcggtaccctatatgattattagagttttaatattagaaacttagacttagcatatacggttattacactcagcatatatgattattatagttttcatataagatttattagagttttaatatatgatgaattattagacttagcatatatgattattcgacttagcatatatgattattagagttttcacataagattattagagttttaatatatgattaattattcgacttagcatatatgattattcgacttagcatatatgattattagagttagcatatatgaatattagacttagcatatatgattattagacttagcatgtattaatatttatcgttttaatataagattatcagagttagcatatatgattattagagtattaatatatgattatcagagttagcatatatgattattatagttttaatatatgattattagagttagcatatatgattattagggggatcctctagagtcgacc

SEQ ID NO: 97275 - DNA, 599 bp, Oryza sativa
gacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacacgcgcgcgctcgctcgcctagcctcgcctggcaaggcagggcacggcaaggcagggcaagcggcgcgcgtgcacgtcgaatggtccgaaaaattggctcctcacccttgcgcagatgcagcctccttttgcagttttgttttgt

SEQ ID NO: 97276 - DNA, 582 bp, Oryza sativa
atagtcattagctcatgcatatatgcatcattgcaatacataattaatccatcacattcttcaaatctacatgtcaatacatgtatgcatatatgcagtaagctgacagctatgggggtgcccaaggggaagttcagagaggaggtagtaggggaaatcaacattgccgccatgttctgtgtcggcttcttgcttgcctcctcctctactgaacgaatcatggacaagtacatcactcctcaacgccaatcacctgctcaggagaccaagaattaagacgagtccagatcgatcgatcgaaaagcttctgaatttctctctttaattaatctgtgctatagattcactaagtcgtcgtttaattggtctctctccttcagtactgattgattataatatattgtcatgtaattctttattactaacaatgctgatcaagataataataactgtaacttgacaaattaaatggttatgtgcagaacttgttatattttaggattgaggtttttttttcataagacagtaaacgacaacatttaaaaagacgttggatataaaagaaagggctttcatatcgat

SEQ ID NO: 97277 - DNA, 558 bp, Oryza sativa
atggaagaaatagaatgggggacagagagtggatgacaatgtgaggcacgcagtcacactgctactattcagtgcataaacattcacagaatgcatgatgcatgctggctgtaactttacatcatcatgtgcatggataattctgcatgagacagacagtgaagatactctggtaaagcatgagcataagattccttcccatacataggatcatgaattgtgaaactgtatggattgggaaaacaggatagcatgcgctgtctgcacttgaatactgtacaatgcatattcacatccaaagctaaatggagtctatatgtgagaccacttattatcaactatgcgcatatgcttgaaatttcaaataatcgtatatcgcattacaccgctgataatgaatcttgattgaaaaggccgtgcactatcacattcttttgtttactgagaatactatgtgcaagctcataccatgcaatgcactgacacactgatgcaaatggaacatttgtattgggtattcacagttactatgggatacttaaatggaaaagaaaacaa

SEQ ID NO: 97278 - DNA, 543 bp, Oryza sativa
ttcctgcagccccctagtcgaacatatgaaaacatagtactactatatatagtctagcattcgcacgactctaatcaagctattataagctatgtatatgaagacatatgaattatattaggtgcatgaattatttttaatcattatagttatggtaacatttctctaaattaaaccaaaagctctacgtattattatgaaaatcgtccaaaaatttagctctttctcgtgcatagtttttttaagtacaagtggccgaacttatagaattaattgttgtatccaatgctaatttaatctagggacttaaaagtacaatacacactaatttttggaatatatcaaaattaggaggtggttttgccttttgttttctgaactttgcaaacctttctactgtcatgtgtcgtatgggaccatggattgcttggaaaaagccttttatttctatagttctattgctagttctattccctatgattttttttgttttctttgctctctcacacatgtgaggcaggcgttgaaaagctccagaaaaac

SEQ ID NO: 97279 - DNA, 682 bp, Oryza sativa
attcctgcagcccgtatcagatggtccctttttcttttcttttttcctttttattttctcccgaatcaagtgacatgcaaatccccaaatccccaaatcaaagtaacatcccaaattcacatcacaaaatccacatcacaaatcttaaagttacttatacacacaaatcaaatacatcacaaatcctaaataattatacacaaatcaaatatatcacaaatccataaaataaatcacaaatttatacatctcagtgtatcacaaattaaaaaaaaacaaagccgctaccgcccctcgtcacggccgccgcctgcggccccgccggccgccggcccaccggatgggaaggggaggaggaagaggagaggaggaaggggaggaggtggaggagaggggatgaggaagagaggatagatctgatctgtaggagaggagagggggagagatttgatctgtgtgagttgcgattgtggaggagaggataagtgatagggattatatactacgcgttcaattttagtgccggttagtaataggactaaagatccagatgatctttagtgggactaaagtggtgatctttagtcccggttggtgacaccaaccgggactaacgatcctcggcccgctgacatacatgtgagcggggatgaacctggactaaagatgagctctagtaccg

SEQ ID NO: 97280 - DNA, 776 bp, Oryza sativa
aatttgaaatgtaaacttaattttaagcttgtgaggatgagtgaaaccaagatacgtggagtgaactttctgcttgtttgaagttgttgggttgggcaggtgacaaatcacaatgtaagtgtcgggcgattcctaagtatttgtcctttgcatgcactgaaatgagatcattggtagagtgagctgatgtgactatctggtctcgtggcttaattatcagtaactcaataatagacttacaaatttagtacaaaccaggaagatgaacacaaattgtgtagattgtattgcgtgacttaatttttcatgtttaatgtcctgagcaagttgtgtcagttactcctacctttgctccgctgttagtttttgggtaagtcacactaggtagtagccgttgtttatttttctgatcagtgagcatctgacaacaaaatacagtcaatcattatttctttggttagcttctcctgtgcttttttgttcgagatgtaaacttttatgatcatttaggagctctggacagtaatttcgatattgtgtttaacttcactacatttacatataggcagtacatttacaactagccccctacagcaacgaagagtggtaaaagaattgcaatttgccccttcgtgttacgtaccaccctaaaacccacaaaatctccaaattcctcgcctccctcatcgctattccgtacttcaccaccacccaccgctccctcatcgctaccccgtacttcaccgcctgagtcactaacccaagccatcggggga

SEQ ID NO: 97281 - DNA, 605 bp, Oryza sativa
ttagggacaaatttgggctttaatgaaaagtggggatgtaaggacttttctccttagtcattgaaaaaacaacacgttcaagacaacaaatatgtgatcatatttactgttcaacatgtagcaatataagataggataagaccaatcttagaactacggatttggatggagtatgatccattcccaccaagataatttattataattagactatcccaccaaattattttaggtacacgatgctaccattgaggagcaaacttcaataagaacagggaaaccgcaaatcacaagtcagttgcaggaagttgggtcaaacggaatcgatgacaacaacactaactccagagaggcaaaaataaataaatatattacattgcaatagttaattctcctttattaatactacccccattctagaaaaaacacagttttgcggtttttctatctaacatttgactgttcgtcttatttgaaaaaaaattattggtatgtttattgttattactccatccgtcccataatatatgagattttgactttttcatgcactgtttgaccactcgtcttatttaaaaaaattgtgcaaatatagaaaatgaaaa

SEQ ID NO: 97282 - DNA, 940 bp, Oryza sativa
agagctatttaatagcccggaggatccaaataagaccatagtggtattttataaagtaagcggtgatacctaccgaaattttataccctctccgttccaaaatgattatcatatagtttttttttagttatttctaaatgatcatcatttgtgttcactagatgataccccgcgcgttgcggcgggccattgtgggggcatagacatacttgcatggaagaggagttatcgccacctcctgcgaccaagaagcgcgttgtccccaccaccacctgtgcgcgaccacgccacgctagggtccgccgcactacgccaccgctgctccgctcaggaagtcaggaggagataagacacaccgaatcctaaatccctcattgggctgctttagattgacttgggcctactgggctgcggtatattcacatgggcctcacgtgttgtgtttgaccccgagttttgttcatccaacggtgcagatgcaatctaatctaccgatccaagggctgtaaattagtgatgatgtggatcattgaggattgagctttcgaatcttaattgcacttagtgggagataactttataggaagaagggattcattaagtctatttgttatttgtgcattggagtaaatggacattgatgcatgtatccatgcacacaagtatttataatccacatgcaatatcttgatttgctattggctagaaaatagtggggattgtgcatacatcgagtttgttgctagagtaaatatagtatgagagagttattagcttttattagtcttggtgtatctatgtgatatgtagatcaatttagaatggagtaagtactccatccgtttcgaaatgtttgacgccgttgacttttttaaatatgtttgaccgttcgtcttattcaaaaaatttatgtaattattaattcttttcctatcatttg

SEQ ID NO: 97283 - DNA, 919 bp, Oryza sativa
aagcacttgcgtcaccagccactgtggcctagggccctaggcgtcgtcgttgtggagatctacccatggacaacgacgctacttcgcccgatcgatgcgatggagcacccctccgtggccatcgcgttccgccggtgccgtccagcctcgacacgctccggctcgctgccctccgtcgatgccctcgtgcccgacatgtcctccacctcccgtgttagttcctcaagatgctgtcgttgaagaagatgcgaaaggtgctcgatgagggaagaggaacgttgtgagggttctttgtaaaatgtgagtggaggaggcgggcgtttatttggaaaagtgctacgcttgtgatttggccccaggatcttgatcgaatggctatgaactctcgtgtgcattagtgcagctacatatctgtgtataggatacattatatatatatatatatatatatatatatatatatatatatatatgggagcgtattctatgcacacaggccctcgcgtgtacataccgtgtacaccaactaaaaattatcacaaaaaattttaggaaaattcatacatgtactttcaatagtattacatctacgtgcaaagtcgcatcttcaaattcattctacatagagaataacaaaaaaaagataaaattttgacaaaattgcaaccttaaaactgtcagattttttgtttttttgttacggctaaaatataatgaatttgacgttaagattttaaccctatgtgtaatacaattgaaagtatgtgtatgattttttctagattttttggtgacattttttagttggtgtgcacgtgtgtacacgtgagggcttgtgtgaatatatatatatatatatatatatatatatatatatatatatatatatatatatataacttttcagcctcagattacc

SEQ ID NO: 97284 - DNA, 506 bp, Oryza sativa
gctcgctgccccctacgtccttgccgactgggccgccaggagagtccccgccctcgccgccgcccgcggccgcccggagtcgccgcccgtctcccactccgccctcgagcccgcctggtgcgccgccggaaggtgagtacagaggagggaggagagctctagggttttggcacggtgagaagagaggcaaaaaaaagggggggaagggatggagtctggagacgactatgccgatcgggtgggatgagtctcctctgataacgtcattaggactttgtcactgacacgtgggacccacaaaggttgggcccacacgtcagtgtctcacgtctctctgactggaaaaatcggatgcccatgtcagcacgatgttatcaagcaagcatgcatgtaaaactactttaaactattttttctcttaaattatttatccaaattacgatctaattacaccattaaatccgttacaattaaatctttaaaataaaaccacacattaatatatt

SEQ ID NO: 97285 - DNA, 1528 bp, Oryza sativa
attacccagtccaatatcttagcctagaccaaatgcccacccctagtgctgggtggggtttgggggcatgccgtatagtagtcaaactaaaaacatgaaaagtatgagccaaaatttaacatttatagcatgtatatatgagttattgactaatgatccataaaagctgagctttcaaatgtacatgcctttacaaaactttaaaagaaactgatggtggtgacagtgtgatcgactcaactcaaactaggactgatgggaagcaatgctgcagcaaattaaacgaaagcaaatgatacatgtgcggatatgcaagcagggtgcatccccacaaagcagtacgcaattacacatgcatcgatccccttaggtggactttggagcattccttggaacgcatctcctggatacgttcccagacctcctggatgcgcttcttgatggccttctgtaggtcgtcaacaaaatctagggacaggtcgtccaggttcttgcgacggccggacatgaggtcccagatgacgagcttgatttccatctcacgggtggtgcgctgcagcttctccatcttcaccttggcggcagcgatcttcttctcgaggatggccttctcgtcgaccggcatcgttgcctacacaaagctagtaataggatcaatcaatctctggctagctctatgcttggtgtactagatgcggtgatgctgtgagaaaagaaagcaactgaagtgctccttttataaccacatttggataacgaagaaggaagttattaagtgcaaagatatgatatcatatccaaatcaattgcaaataaagtataatgaatatatacttaaaatactatatactctcgttgttttgtaatatttgtcaatttggactggcatgatattactttcgcaagtatcaaaaaggatcaactctttctagtctgaagtgcctattgtgctcaggagccacaacttcaatctaaggatgatcaaaaggagaagttgatggtatccgccttcagagggggtgagaaacgtgccaaggaaagagaagatgacccgaagaaggccactgaacttgccggaccaaaattctttgcaactgatgactgcccaaaaaagttccaacttggcaaagcatttttgctggatcatgcacttgatgatggtccatgggagatgagaagttacacaaagggtaaatggacgccagcaagaaaggcctaactaatttaacaattagatcaccgcctgacttcttcaccggcgaaggtttcttctggctagatttcgctgatctgcacgccatctatcatcacgaaaagatggacataaactttctcagtgcattgtgcctgtgagtatgaatgcatatttattacacaaataaattgataaatcatgtgattaatatcaacaaactgattttataggatgcaatacatggatgctgagaagacaaagcaatctatcggatatctagatccaacaaggatctgtcaaacatagcataccatgacgctatcagggctgcag

SEQ ID NO: 97286 - DNA, 623 bp, Oryza sativa
tggttataaaaatttacaataaatccgcagggggccaatgtccaaaacatcacttttttttactcctagttgactaggagctagctacccacatatacacaggacatgcatatgagctagccacaaataagctgcatacgtacgttttaatataagtaataaaacaatatgcctggtcaagtagtcaacttatagtcgtgcatatatagtacctttcttcttgtagtctacacatcggcaagaccatatagtttttttttttctgaacttgatgtgatgggccacatattaaccctttttttttgcgggaatattaatcctttttattattaatattttttgtgcgcctgagtcactgtcaatgagtgagtgtgcatgatctcgtcagtatcttgttcatgtggtcatttttctggaatctgcgatacaacataaggtcactgtcttaatggatgagctcaaactagctaagctctcactacacgattaatttacataaattaaattgcatgtgtccggttgattgaagcaaattgttttagatgacattaacgcaagagtatatttattacgtactgatcatgacatgcatgtatgattttgacttacatatactaatctgg

SEQ ID NO: 97287 - DNA, 749 bp, Oryza sativa
aatttaaaaggtgcttatcacatataaaaatgatctgagaggactgtgaacacaaacaacattgaacttaactgaaaatgaacgttcttgccaagagattttactacgaacatatatcataatctgtgactcgtgtcaagcatctcttaatcagaagagaaggaatcagttaccaacaaattacttgggatatattgtctgaaaaactaaaatgtaaattgtgggtaagtgatgccttcattatttcaaaacagcctatagccagcattgaagcggtgggttagtggccggtaccccatggccatctccagcactgtgctgccgcagcatgataccttctgctgtaactcaatataatgtgtagtgagcagtgatacttttgaacagatcgttttcagtttttgacgtaattcattttgcatattgttatctttcatcttgaaaacttacttgaagggttgacatatacacagcattacgtaatttttaatattccctcagaaattaataggtgtaattgagtgtgaaaaagaattaaggtcgaaaaataggagggtggacatgatatcctgctcaaatacctttgaaagaagagataatagttactagggaagttacttagacatgcaagggagagtgtgatgcaataaaccagagcaaacaaggaaaaccatcgacaaattcactcacgagaaaaaatatatacctcacgaaaaggtgagtaaactataaatcacttcactgcaggg

SEQ ID NO: 97288 - DNA, 1168 bp, Oryza sativa
aacagatgattcttgatgtgtcattaaatccaaattcatcttccaattacttcaaaattatgttctggatgatgttcgttggcaatctcatcagaaggtactgtcaaccccatcatattatatttgcaatttgagtgtcaaactaatttacttgcattcactttacttcagaagtttggtagatctgcatttcagatcactgctatattcaaatcacctactcacaagaaaaagtatttacaatggtgatatctatatgatgcatggtgcatggatggtttccttttcctttcactgcagcagacaataattgtccattgacaagcaatctattgataatagaccatagtaatctttgttgattctggactactctttccatgaattattagtgttgcttgtgctgggaaaatactgtctcaattctaaagcttagagttttgcatatgaagcatcatttggattattagaattttgcatatggattctttaagcaggatgctttatcgatgcagaacttgaatctgataacccttgctttttatatgacaaatgaatactattcctaccttagatcatatgagcaggtatgttgacttccatttagtgttggccttgcatcaaccccaagatgtagcttgtaatattcaatgaaccacccgagtatttgccttctcaagtttcagcaaagaaccggctgaagcaaaagatttgaagtcgttttgtgtctggcaccgacagttacactgccttccttttttttctaagggaaaaattttaacagaatactagctaacaaaagatccacaagaagataattgaatttatttcactgaaaatgaaaaggcaatattcattattcatgtcaaaacatttttgttctgttttccttaaaaaaaatgggtacttaatttgagcaaccattacaccgagagcgtgtcaggtagtaagacacacacaatttaaccattgcagaagctggagaacagcagaaccgaatcaacttatagccttttatcatgtacagagggacgttctacaataatacatgttagatatttagtctcagatctggttgtgacacatttgacttactgtgtatgtacggcttaatcaaagtacttagggaggctattagatgctctgtccatcggataatataagggat

SEQ ID NO: 97289 - DNA, 700 bp, Oryza sativa
ctcgctctcgtatgcatttggtaaacttgtctggttggcctttgttgattgattttattgattttggaaatggactgcaatcttccgagttttacacgcggaagtttgtgcagagtactgaatagtgacgtggttgctgcaaataagtactataagcaaggcatacaagttccttaacaaatataatgatatattttagccattctgatcattttgaagaaggtgatggtaaactaaatctcaagttctgattgtgcatttggtaatcagggcaagtactataagcccctatttattgcccataaatttgccacataggattagatgatgagttggaggagagaagttaggagagagagaatgagccatccctcatgcaaggggcaacctccacacaatctccaagaaaaatgtaagatgacgtgagagtaaactaatattggggtttgtgtactagatgtgacatgttgtatttgttacctcttaagtaatgagaagatgacatggtttaaattagatgtggcactcacctccactataaaacttgccctcaggaagctagttgtaatgtcatagggattgctggtatgtaaagagtacttttgatatctagaattacgtagctcagtactgttatgatttttttctgcttacgttggatttatagctgtttatacataaaggtagttctacagttcta

SEQ ID NO: 97290 - DNA, 634 bp, Oryza sativa
ttcagctttgtggttggtagaattttgcttggcattacgaggtttaagaacagtataggcatatttttgtgtatgtaatagcgatatggcacatgtagaaacactgaatcggagaaagcaggcattgtatgcattgaactctcaggtgcttcttggagtcaatccggttgattagtagtgctttgtggttgtacagattttgtacatgtttggtaggattttgtacctctgtttgatggagatggcatgggcataagttgtatttattgctaatatttgttgtttcttactggtccaaatccttctgataccatgccctcgtttttgtgctatcctcatcgttccaagatggtacaggcaattccttgggatcagtcatataactttattatgatattgtctgctacaaatgggttatcacagattattttaatgaccactcctaaatcctttgggagttttcattgcttttaagaaaattgttgtatttattttgtgatgagtagctgatgtttttgctaacacatttcctgaactccataggtatgaaatgaaacagcatcagaccccaataaacaagggttataatacattgtaaaattttgtaattcaaatagatctgctactgaacatc

SEQ ID NO: 97291 - DNA, 602 bp, Oryza sativa
cccctatattgctccaattgattaaacttctgcaggcctttcagtgtcctggccattagctttcaagtgtgtgaagcaaagtgacatggttcatgtttatatgatttatatatgtgggctcgatgggccccgagagttcagaattgccctatggcccatgaagttctgggctgctcatcgagtaacgaacaatggtaagtggatgcggaggtaggttggcacacacctcggaccggatcactctgagcaacatcccgagcatccttttaacttactaggcagaagggagagagatatatggagcaatattacaccttgttacttttcagcctggccagctgtgggtatcgtgtgggtaaagctgggtagacgctgcagagtcgttgagtattcgaatacaccgtgctcccggttaatggagatgtgtctatgggtgattccagattatgggcacaagttaaacaaaatggctattaattaatatggttaacttatttattacttgatgttctattcaagttatttataagtaacatatatatttttatgctcattattattgtttaaattaaatgttcaatagtgttgtttatatcaaatgt

SEQ ID NO: 97292 - DNA, 697 bp, Oryza sativa
tgcagcccacattgtacaatacgtcaatacctcacagttgcaagaaaaaaatgtaaaaagtgtaaattagggcaggtgtaaattgaaagaacgtggtaattgtgattaaatttaacctacccattaagatgtggacccttcttgtgtcacaaaaaacatggaccgccgttgccgaatttggatataaaacatatgaaatgattaactggccattgcttttttaacttttggccaaccttaaccaaatttcatcttattcttgaaatatccacccctggaacttttccaacctggatagatttcaaggtggttaccggaacttatttgctcagaaatttaacttcggtgtgcaaagaggcagtgctaattatttggcatatacaatagtagcacaacaaattgcttctacttaaaaaaaacagtaatggaaattcaccacagtccacagtaaccaaggacattatgtttgtaaacaaaacttgaagcgaaactccggaaatttggcgaggtttgtctcaccaaacaaacaccgattaccggtgatttgaacccaggagtcacagattcgatcggacatagtttttttttttcagcattttaaactatcaaacacgaccaatcatgctgcaaaaatgacagcatttcgcaaggctatcgacaggggaacagattagcgcatgatcgagcacgcaaagct

SEQ ID NO: 97293 - DNA, 673 bp, Oryza sativa
agacatttattttcaggactatattgaccattcctctctccaatttataccgcatttgaggcctaaaggacctcaatttccaggactttacactgtccactcctttctctagtatataccacatttgatgcgtaaaggacctccacacaagcggacatatacgcatctaaccaaatctattgtgtttctaagccgccacatgtcaactctcgtaaattagaaaaatcttaaaaattctgagaaacaaaagcatagccgccacatgtcaactctcgtaaattagaaaaatcttaaaaattctgacaaacaaaagcatagcatatctagtcatttattttcacttcaaccgatgggtccactattttagtccacactactatgggactaatcttgaaaataaatcagcatatcattacaacatatcatttttactcgcatttgagaaagttcaatgtttggtctcttatagtattagcacaagtatgaattgccgttgagccgcttcttattatcaaagtttcactttattactttcaactagttaacttttatgcttattgtactttggaccaccttaattctctattttctagcaatgtttagccttacttttaggtcaaaactaatttaattataaaacttttatgtgttcgtagtgatttaaaaatcaatg

SEQ ID NO: 97294 - DNA, 599 bp, Oryza sativa
acttgatggctggtttgggctgtgaaccctgagcgtttcgtgcgacgagatatactaaaccggccgggcggcccggtgcgcgcgcgcgtgctgctcgatcgatcacgtcgcacttgttggtcctcgatcgtgatgcgttacaggtgcaaaagtgtacgtggttttgactggttttccacgggggaaaaagagcaggcgcgcgtcgagcggtggctggccgggtttgcgcgtggccgccgctgccctcgtcgcggccggagggtttcagggacgacgacggccgcgtgtatatgccatatagatatattatcttgatcatcgagagagattgcgagtcggggatagcaccgacaggcgagtcttggagtgcacacactgtgtgtacacatactcctacaggcgatggtgaagcacatgtttcatccaatctatctcgtagaatggcgtgtattcacgtgatacctgtggtcgccgtatgtacggtaggtcccctctgcgtacgatcgaacctgcccgttgggccccggccgcgccttctaacgacgagtttctgacacagccgtgttgaactggaaccacacagccgcggcgaactgggc

SEQ ID NO: 97295 - DNA, 527 bp, Oryza sativa
aaaatttttataaatgggttcttagcaatttaaaaaattaatttcgaaaaataaagtaaacaacttaagtgcgattataaatttgaatccaatttaagctttaaaaattaaattttatgtgcgatttacaagctgaataaattttgggtgcagtagctaatttaaacgggttcgacgaccgcccttctagagtgaaaagaatgtacggagcagtaaaagtttctgggcactgtagtcgtgcctctgaccaaacggcccttctagaagccgtacaaagaccaacaaaatccgcgcaagacgaggcccccaaccgcagtcccaggtagacctgacgaaatccacccgatttcccccaatttcctccccttttctattgcaaacatcacaaacccctgtactacttcgcatcgcaccagacgatgattccggtccacgcgacacagcgccctcaatggcctcaaaaccgtaacaccaccactaaaaaatccaagtaaaacgcggccattcaaaaattttctcaaccacac

SEQ ID NO: 97296 - DNA, 573 bp, Oryza sativa
agggtgatcctgctgattaccaagcaatgctagctgaaaggtaacctttttaattgataataatgtgatatattttatgtttaccctcattgtaaattctgttatacaacctactactcgtttgcaggggacctccaaaaaaaaggcaaaagtctagtaatgcacatgctgaaactagcattgtacatgttcctagtgcatcttctgctcaaaatgcaatattgtctgcaacaatgacatatccaccaagcaaaagttgtcaaaccgggaaaaaaggacaggacctcagtaatacttcatcagggtcagttaggtatattagttccatctaccattgcaataatgacttcctcatatgcttacattttcctttaccatttatgtcaatgtcagatcaaggtgcagtgacaggatccaaccaacctgaacctttgagtgtgttgatgccactagcagcgcctggagagaactctaaggccaaggctaagacagaccaaaactaaagccaagatagctccttaggaagaatacaaaggatagcgctgctacttacgccttggcacaagtcaaaca

SEQ ID NO: 97297 - DNA, 663 bp, Oryza sativa
ttcctgcagcccgtgccaatttctcataatcttcataaattccggccggcagcgcccagtggaaaagaaaaaaaaaacaatccagtccatttccttgtactatggcccgtttggcaattgctagacccaagtgccttcttgaacgccacagctagcctacacagacgcaaagaagaatatacacaaatacatagaaacaaattacagcttaaagctgttaaactgaaaaccactaaggagaccataaattttattatgagaaattttaccgtccttaaaaaaatatttgaggtacctaaattctacttaaaatttttggtaatacctagtatctaaaggtactaaattttacactagacaatacaatatggtacctctggtatcttctcaagaatgataaaattactcttttattataggtaccgtaaaattttgcaactcatgttgttagtactcctggttaacttcaacgtagaacaacaatcacgtaaatactagagattaactatataatcttaaagatgaaaaagccttaggaataacaagtttatatgttatatagttccaatagaaattcggcagaatatttgaacaatttaaacatgaacataaatgttattaacaaagacaatatagttacatcgcgggaatggaaaacatagg

SEQ ID NO: 97298 - DNA, 644 bp, Oryza sativa
acatcgctggagatcgaggaaatgggaagccaaggaaagctagaaccggatgcgaaatgggattatgggagtacgaggcacaggtcaggtggattcaaggctgggaatttaaagagtttgagatttgaaagctgaaagtgatttggtactaggtggacgcatttaatgaaggagtaaaagcctatcgtatgtggcaatgtatagcaataccttgccatatgacacctgatagaataaatttcttagctaagagcacaaatttatcagactgtcttctcttcttttcttttttttttttggcaaaagtatacagtacagtaattctgtgaagttacacacactcgaagattttgctagaaattaataagaatgatgcaagcattgatttcatcccgctgctaaaattaatatctatctttatgcagtactgtagagatcatagcacgaactcaacaaaataagtccactattcataaatctcatttcagacttccacttcaaactttgtttgtttgtatcaatgatatctaaccataggcttcctgaacatactgtcaaatatcaaattggaccaaacaccatctgaatgtttcatcatatgaaaatgaagtaacccaacaagtccaaagcaaccaaaaacatgg

SEQ ID NO: 97299 - DNA, 627 bp, Oryza sativa
ttctcattgattaatgaaatactctgttatctaaaagaaaaggaaaggtgatagtacgagacgttgaaaatggaggatgggtaagttctcatgacttaggagggtgtgcatgctcaaagcatcaaagatgagtaagagagagactaaaaatgcataattggcaaaaggggcaaagaagggcatgttcaatttgatgcatttttaaccataccatttttttggtaaagttgttaaaattttggctacgtttagtttgttgccaaattttagtaagtacatataaaatcttgccaaaatttgataaccttaccaaaattttagcaactttaccaagttttagcaatgctaaaaatgatagcaaagtgaacaagcccgaagtcatcggaggatatgaggatgctactaacgatgtcgaaggatgtaatagatatgaaaatggttaagggatgacttgtgacactcgagatattcttatcatttaagatattaatgtttatagtcaattcacggtataaaaatttctttcttttattattataagataatttacggtcgttataataaatatggagagatatgacttcttttaatatttttttatgaataataaataagtttcatgtgtat

SEQ ID NO: 97300 - DNA, 567 bp, Oryza sativa
gctcaaaattcgaatattttgatccaggcagattatgaatgtggcaagacaagcgaatgaacagtctatctgaaattccaattcgagagcattctcccgacagaagcaagtggcgaggagagacaccacttcttcgacggcgagcagcagcaggacaggacgaggaacacgcggatgcagccgtagaagcgcgttcgcagcgccgtgttctcccccggcgcggcgtcggagtcgttcctccccgccgccaccctccttcgcgcgacggaggcgacgacgagcgcggcagacgcggcacccgtcagttgccccgcggcgcggcgtccgcacgagcaccggcatcgccgcttcaccctccgctcgcgagattcacaccagccaccatgtgattcaacatgtgacccaggggtagaacggtccaagaaaatatgtaattgaggaaaaataatttcgaaatgcaagaaatcacaaaaatagcattgcagtgaacacccatggtttgagagtggtatttcagtgaagcctattttaatgatggtattctagcgaagcaattcgggctgcagg

SEQ ID NO: 97301 - DNA, 586 bp, Oryza sativa
aaagctggcagtgagaaagcagatgatctttacggctttgcgcgtactgtggataggttggcattggacatgccatgtttcaacttcttggtggacctttgcccgtggaactaacttgatgcccttgtgtagtgttgtgcaactataaagggacaaaataatggcgatggaacttatatgccttgagtgagttcttaggcccttagctgatgtgaagtagctccatttttttaaaaaaaatgcagggctggcccatttccgccattaaaaatataaatggagggtcggccttatgatgacaccaactatgtctatggcacgcctagtttgtgtcaccaagtccctattaaatccttcaggcggtatggccataagaaacaatctagggttctactgtttttttctgttctggctcgggtattctatctagccgagccattcattcctttctatgaaagaaagataaggggacaaaacaaaaaaaacaaataaagaaacaaacgtattcaatacgcaaaagaaaagagagagaggaaagcaaaaggagagagagggattcgaaccctcgatagttcctagaactata

SEQ ID NO: 97302 - DNA, 722 bp, Oryza sativa
  unsure (1)..(722): unsure at all n locations
tagtagttgttgagtagtggagtttaaggtaagcattttttttttttttccccccaaaaaaaaaaaatttcccgggggggtttttaaggaaaaggggtacctttgggaagtagaacaaatgcatcatataccaaattactcgaatttaaaaaatgagatgattgtatcacgaaggtttaatattcgtatttagtcatgatcaagcaagatcggttcagagtgtgcaacatgatttaccgtactaacaaggttttggtaacgttaatagctcagaaacagattagattaaaaaaaacttaaaacaaaaactccatatttgatagtttttgtctagttttaccagtttattacggtatccgatcttacaattgggattacagtatccccacacaaaatagtgaggcatattatgtagttataccctctcacccatcaacatgtacgaatttgatgctatacgctaaattcttacacacaaaagaatctcaaccgtcagatttaattagtggatagttataaaaatcaagattgaatcacaatgtgccacatcagtttttctaagattaaactgtcataatttttaggatatttttctccctaaattccttttgaacaattggatagaccattctttttttaaaaaaaactcataaacttttattaataaagacagagttcaaggggaatgaatnctaatacatcgcttaatagatgttctgtag

SEQ ID NO: 97303 - DNA, 2341 bp, Oryza sativa
cacccccgggggagatgggccgagagggaatcggcccatcgaccccgggggaggccaaatagacttttgcggaggaaaatgatttggaaggatttggattcggaaatgaactcgacgatagatcggggattgagatcttgagatggcacggacactagacgacaagcgaagaaacaaatttcgcaattagggtttttaagagataattttcccgctaggcgccacgacggaacgggcgctacacttgcctacgtacacgcgccaactatgggaaactattctaatctctcgaggggatgctccctcgtttactcaaaaaccatctaaatggttatgaaaaattctggaaaaatttgacaacattcatacaacacatatatacaacttcacaaaatcttaagtccaaactcaactcacacatcgagatataaaaaagacaaatttagcgtatgaatagtagcgtactgtttatatctaaatttgtcttttttgtttctcgatgtgtagatcgaatttgaacatgaattttggtggactagtaggtatcattatactctacactgtcaatttttttcagattttttcacaactatttgcatcgaatttgtaaaaaaaggtatacgaggggatatcccctcgagggattagaatccactcccaccaactattgaatgacagtccatttagtccgttatgctccctccgtcccataatatatggggttttgagtttttcttgcaacatttgaccactcgtcttatttaaatttttttaaaattattatttattttatttgtgatttactttattatctaccgtactttaagcacaacttttcattttttgtatttgcaaaaagaatttgaataagacgagtggtcaaatgttacaagtcaaaactcaaaatccacgatccttatatcgtgggacggagggagtaataattaggaaaaaaccaaatcatttggtcctaatcaaactagctcaatttgtttatgcaagctcgcctcctccttggacataattaatgtgcgtgcccaacatgcgtacgttgccggcctgcccaactacttctagtaataattatcattgttctgctgacatcgatcacaaggattaaccgtgctaagcactcaaccgcacgtacgtagcggtacttggatcaatttaaccacacacatgaaaatatactccatgatccatgatccatgatccatgaaaatactaacatggagtatactaaataataccgtaccgcatgatttggtttttactgcactgattgctcgtttccgatgtcctttagtactgtacttatcaatatgttcaattttaactccacactatccaatagtaccatgttaaatactatatgtcatctaacaatttttttccgaccaccttccacgacgacccggcacgattttgataatcggatgctagttgatacttgcattgcacgaccgccgttgcttcagatagcccaaatattacaccacaatggtgcaaatccagcacatacacactactagtactaacattgacgctgacaagctatagttcgcacacaagattatacattaaatctcagctgtaaaacacattagtatctcgtttattacagcgacgcggtctctaaaatacaaatttgactttttttatctataaaaatatttattaaaatattatatatatatatatactttcatgaaagctttttcaagacaaatctattcatataatttttacatttttaaactcaacaactttagagttatttgtgatttatattctcaagaattaatttaaatatttttctaaacgattttttttacgagtaagagggagggagtactaatttatttcttgtttatttcgcgccggaccaaccaatacattgcttgttcagttaagcgcgtacacacacattaataattatccgtttaagtgaacacgtatcacaagttttaattcagtcaatatatcggtcaaacagcacacttcttcgccaaaaatattcaaatatacgcggccataatataaataaaagtacgaaactactatacgcatctttctgagaacagacagaaacatgcgaaaataaataaataaaacgaaactgaaacgcaagtgcaattccacggaggcagcgcaagcaagcagccaagaaggcaggcaggcagggtggtgggttgaaaaggcaggcgccgaatcccacgcggccgttgccgcgcagcgcaagcgccgccaccgaacgcgcccccccgcctcctcgcgccgaggcgacgcgacgcgacgcccgcgccgctctcgccgccgccgatccagcccccctgcccgc

SEQ ID NO: 97304 - DNA, 891 bp, Oryza sativa
ctagtcagacgcgctacccccgcgccaccgacgcgcggacgcgctacagtcgtcgccgccgacggagctctcctagtcagacgcgctacccccgccgccaccgacgcgcggacgcgctacagtcgtcgccgccgacggagctctcttagtcagacgcgctaccgccaccgccggcgccgccgatgctccgccgggccgccgccggggtctccgtcctcgacctcgcccgcacggcaacgccctctccttctcccacgtcgccgtcgtcaccgccgccgatgccgacgccctcccttctctcctgtcaccgcccccgccgctgccgccgccgccaaccgtcgccgctgcgccgccttcctcctctctcgcctcgcgcccactgaccagcctagtcagaggcagagaagggtgagaaagaggaggaaccgaggaggggagagagagagaggaggggaagagagaggaggctgacgtggattgtctgatatgtggggtccacgtggggcccacgctgactcagccaccacgtcggacaaaaccaggatcaaaaccaccgagggacctaaaacgaatggttttgttagttagggaacgcccagtatctggttttgtgattgagggacgattttgtatctcgataacaagttgagggaccttgggtgtactttttccttttaaaaaacactcgtctccgtcgataaaaaaagagagcaaattttctatattataaagagagtcagagggcaactcaatgataacactaagggcctgtttggcacagctctagctccagctccatccctcgctcagccaaacagttttagctccactaaaattaggaatggagctgggtggagctctctcacaaaataaactagagttgtggagctg

SEQ ID NO: 97305 - DNA, 1141 bp, Oryza sativa
ccaattaaaatctcagttcacgaacgaagccgctagcaggaatcgatattgtgactcttaacaacctcaaaagacatccctttcaaatatactttctccatctaaaaaacttaatctacaagggttaaccctctcttaatacaacgaatttagataaatggttatctagatttgttatgttaggagggatcacatcctcgtctaagttgagtttttttatttgacgaaaggagtattttgtttaatcttcagcaagtcagtccacacacgcaagattaaattttcaatagtacacaacctcactcctctccctttccgggtggggatggatgattctttagtttcctagttgtcattttcataactacaaatcgctgcaatccacgagcttaacttttggtctcatgcatgcatgtgtggtaggccaagaggcgacctatgtcgccaagtttgactccgtatatctgacaatgtttgtctgataccacatgggtgatgggtgtgcattggtacaatggacacgcaaatctaaagtcatgtcattttagtcatatgaatcaattagaaaaaaaagaatcaattgaaaagacgactgatttcgcgccttataattgttcatggtatagctggacatgacccggtcgtagactcggtagtactccccaagtgatattaatttatatggctctcccatgcttgatcccagcataaattgcgcccaaaaatccaagatcgccacttcctttctacacttgcttcaccatagaaggttagttgatcctagttcagctcctgcttaccttttctctctctctctctctctctcgctagtgacgcttactaattttatgcggcaaacattccctacatctgagaaagcttttctcagattttatacgacacacaacttctcttctgcaaattagaaaatgccaagcaatatttaatattttctttaattttcttcactttgtgaatgccacctatttttgttttgtattcatctcggctgttataccatgtgataatttggctcccatgtcgtctatcattaatttgagtttttctgcgtttgttcgtgtgttcttgcatgtcgttcagttaatgatcgagcaaccctctagcctccaggcttgttcct

SEQ ID NO: 97306 - DNA, 718 bp, Oryza sativa
attcctgcacccctggtttttccggagctagcttgattgatagtagtatatatataatctttgccagtaaaaatatgattgtctcagcatgattaatagtaccaattatctgggcatgattagggagctcgctatcccgaaaatttcggaacgggatatgttgccagtacgatgtggagtgggccaatatgaggcccaattgcatttgtgcgatctagtagcaggcccacaggtatcatctgtgtgggtgggccaatatgaggcccaattgcatttgtgcggcctagtatgaggcccacaggtatcagctgtgtgggtagggccaaaattcggctcatatctctagaggtgggccggggtcattgagcaagatgactactcccctgtttcatatcgattttgctatatatttgtcgacaaatgtttcccccaaaatttgacagatgtaattacagtacaatcgtagtgaaattacactgataacggcatgctaaaacactggaactattatgataccatttttaacacataacaaacatattattaaaatatattcaatgctatatgggagactattgaggagtttcaaatatagctaattgtggctataaactaagttaaacttgataaagcttgactagaaaaaactcaaagcgacttataatataaaacacatggagtaataaatataatgtaaaagccacctcctatctagaat

SEQ ID NO: 97307 - DNA, 3068 bp, Oryza sativa
tatggagtttaaaagacatatacaatatttagcagtttggaaaacgtatacatatagaaaacaaaggagtgaaagttggaaaaggagagaaaacacacccttaagaatttaggataatgtatccatcgatcttaatatatttctccactgacacacgtaagtttaaattcaagccaagttgaaaaatatattaacaaacctttatttctacttgtacatgtcaaactaaatttaattttatatgttctctggagtgatatatcacacgttaatgtatgtatttaaaagaaatctcacaaatatttaaatagcacacataaaatgagaagacgtccctcttggggtagaatgacttttgtcctgggcatactattcttcgcgaggagaccttctagctggtcattgtgcacatgcatatcattgtcatctgctgcctctctgtctttatttaattatttgtacaagtagtagagatctagaccttctaattaagctggtcatcgtgcatgcatggggtcatctatcttctgtctctatctttaattggttgtaagtaagtactatatttttcttagataaaaatggctttacattatttccggtctctatcatgggcacacacccgacaggtctcaaaagtaaaaaaagaaagaaattaaaaaacaacgtgataggacaaacccccaacttctgctggatcaactgaaatattagctatcacgtgtccaattttccccaaaatattgcgttgcaatttgctgcaaaattaagctgatcactgacgatgattgaaagatcagagatcgctaacaaatggaacgatgaaattggatgcttcctctataagtagcaatcgaacttgtgaaccgaggatagatccatgctaggaattgtaatataaaaaagacaagaatttgtcttttttttttcaatcggtaggtcaaatttaaaagttgatttttggtgaagtgctagatatcactttactttacattgtcaattattttaaaagtttttaataactgtttgcatttaattaatgaaagaggaaggtataaagggaatatcccatcgagaaattagaattcattccctcctcatcggaaagaaatattatcttctaggaagcagagaaaattagatctgtatatacaataagtctataaacctagctagtgcgcacaaggaagaagttatatatgtacaaagtagagaaagcagtgcatgagaaagaatttccgtagaattagtgcgcctggcctaacgactgcgacaccattatacatatcgtctagtacgtccaataatatatgtatactaatatgatactgatccatctgtttctaaatattttataccgttgacttttatgaaatatgtaaaactttatgtatacatataagtatatttaacaatgaattaaatgataggaaagaattaataattacttaatttttttgaataagataaacggtcaaacatatttaggaaaatcaacggcgtcaaacatttaaaaaaacggagggagtatgatctggccggctagacgatctcatatctctatatatgcatgtagaagtcaagtttagctccattatttctcggtccataaatatctcatacggagtatctatcttttgcttaacgtgctagacacggccggccacaaactaattaacgtgcttaccggccgtcttaattatatatcatgtgtaaacatatgacatcctgttcgatcgatctaattacctactatatattaggctgtaattaatattagtcttaacttggggaagttaattatattctcaagttaattaaaacacctgcatgcatatataaagggcctacttcaaatatgaactaacaaaattggaaaatctcaggggttttctccgatcaatttgagaagcaactagtagtagccagttggtgagaatataaaaagaaaactgagttttgtagcttttggttatttcttaataattttctgtattctatatatagctatatattcttagaatctaggtgggaatcaatctggattgttcaacgtaattagtgattttagaagaagttgcggctactaaaagttaacttctataaacatgaccttaatatacaactctatctatttaaaagaatagctatttttaactttgaatataaacaagaaatagctttacattcttgtacatagggagtactatacagcaaaaagcaccgctcacaaataatctcctcactggtttgttcgccatataggcttctcttcagaaagcctatataacatgataaaggcccatcaatccggacaaggcccaagctagggattttcataggcattttcatatgacatcatcagtttgcaaaaacgtactacgtactactgagcgtttgtatgcgtgtacgtacgtataattaaacgcgcgcgacagctagggacgtggaaaatcgctgtggaaacctgctacacacgcaactcaagtactgcatcactctctctgctgctataagctaagctagctagtgtctatccattagtattgtggtgttgctaagaataatccaacacctataagagattgtgtagtgaagtagtactgtaagttagctttgctaagctatcccaatatatatacttcctccgttttaaaatgtatgacaccattgaatttcacataacgtttggcggtgagcaccataaaatattaaacttcaagtgatttatgggatggttttacaattttccatttattaatagattacatatgcaatcatgcatatatataatcaggggttgtctatatatcttgtgacagaaaatcgcacctcctatcattcgaattttcgaccattggatatactctaacatacgtgcaagcacttaatcgtacctcttcttctcccgttcccctcgctgcctcgaggattccgtcctcgattcaccgccgccaccgccccaccgcactatcgctcgatccatcgacgcaactgtcccaccgcactgctgcccgcctcgccagctggccagaaggagtcaatggtgcctgcgagcccccccctcc

SEQ ID NO: 97308 - DNA, 520 bp, Oryza sativa
tacatttgtgcgctgtattacaagatagttatgttgggatacgtataggctacgatagtataaaaattaaaattttctatcacgtaaaccaggaaccatgcaagtattagatcatagattgttaccactcgacacgctgcgcagcggaagaagacgctgagaagtcgaaggaactctcgcgaagtagcgcgcgtcgatgtagaggaagtagtcgatcgcaccggctcgaccttctcctcctcgtgcgttctcctcaccgtactcccacgccgatcagcaccgcaaaccagcggcgcctttaccggtatccgcacgtacgtacagggacagaacgccacgcgcagatgtgctagcacccgcgcgcagctagggttttgctcggggaggaaagtgacggctagggtttctcacgtgatgcaatgctccgccagtcagacccctcacgaatatataggatccatcactcgggccttcaaggcccgtaggactcctattcggatccctatccgattaagctcat

SEQ ID NO: 97309 - DNA, 984 bp, Oryza sativa
  unsure (1)..(984): unsure at all n locations
ctgttaatgattgacagatcgacagnaccncatcattatagtgatttaaatatgtattttatttaaagtagaaataaaatgattgatacaaatgttatcaagtgattgcaaattttatattcatgaatttgtgaagcgaggaatatctagctttggaaattcttagatgtgaacaggacattaattagtgcctcgtttttttttattttagtattttcgattgctttgtctgtttatttaagctgccccggtctttgtttggtcaaagagagagcaatcggtggacaaaaggaaagcggttggttttggttatgccttgcttgcacacattcctgctcggtttggtagtacaaataataatatttctaatcctttttatatataataatagggatgatttggctttggtatttgcactttaatcttttttctaattggactgttcttttctttgctgctttattaatgtcttttctttctttagttgttgcttgttgcagtccatggtccagtcaaagggagagatttggaaaaaagggccaaaaaagatgagatagtacatcaggaacatcagatcgatcaccagttgctagctaccaccagctaccattattcagctgtcatttctgcagcagtcagattaactttagtccaaaatttttctctgcctcctctagctcccaacaaaagcctgtcaactctctgtttgaagaaaaaacgcatgtatacactgttttagatcagctgaaaattaacttctctacagaaatgaaatcatatatctgtgtaccaaaaggtgtgtttagttcacgctaaaattgaaagtttaattgaaattggaacgatgtgacggaaaagttggaagtatatgtagaaattttttttttgatgtgatggaaaagttggaagtttgaagaaaaagttgggaactaaaccaaaccaaaatggtcaaatgcctgatgaactactacagagagacacccc

SEQ ID NO: 97310 - DNA, 721 bp, Oryza sativa
acttatattgtgttatgtagtagtacaagatctcttgcgtacatctaatatagtgttagtagtaatgcttatacctatacacttatattgtgttatgtagtagtacaagataccataatataattcaaggtttaaaatatactatatatttatgacagtgcaatattgctagctcttactatccagcaacttacctaggccttattttttaactcagggttgtgaccatagcatttgtttgtgtctaagaacaaacacccagaaaaaaaagagagagactgctcatagtctaaatttcaattttcaagttactaaagtttgtctacctacacataaaaatactctaaataaacatattcaaaataggagtattaatttttaacatggcgtgccaacggcgcgcccacttttctagtttgacctaatattaagctttcgttagctaaatcataattgattatctttaatttatatcaatatatgacttattaagcctagtactcccttagaacaaaatttaatgaaaaaattttctttagtatctaacaacaatatgcactgcttgcgaatatcaacatagagtactggtgaatgaattttcccacctttagttttcatgtagttttccacctcaacctcacttgaattgtttgaaatttccattagagtctagcttcaattttatctacccatcaaatggccaactattttgactcatcta

SEQ ID NO: 97311 - DNA, 837 bp, Oryza sativa
acttcagttaactcgatcgtgccccatatatacttatatacacatcgaattgcatctgcttttgcccttatgggtccatgtatgcattgacatctagctcattgctttttccctttcttctttttttaagagcacatctaacacatctccttgctggaaatgtatgcaatatgccatctagaattgatgtactttgcatcgagtggcatatgactcttaaaaaaatattaagttatatgcagcaaacagttcaacctaaaacttaggatgatgaaaaaatataggcaattcacttgtatttgcataaaatagaaatgtgatgcattttttttaataattatgtgctaatcaagatttaaattcaaggtctctgtctttaataacatattgagttatatatatcaatcaacataaaacttaagctggcgagagaagacaggaaattctcttgcatcccaaccctttgctggccaggcatgatgtattacagtggtggagccaaaaatttttaaagcccaggactcaattaatgtaattactatagggtttatattttttcttctcatattttaaaattcggagtgattttaataggtatttagagtgaggagtaaggttttagccctaactatcctattcctggtttcgccctatattgtttcagttcgtatatatatatgtaggtgaactacttattgggtgtgttattttctcttctttcctaatttttatactcattcttttcaaaaaacttttacacttgtttttcgtgtgcacattttttttaataaaaataattttatatggaagttgctttaaaaattatatcaatctatt

SEQ ID NO: 97312 - DNA, 3215 bp, Oryza sativa
tttgtttgcatcgatacccagttctgggattttgtcgcggctggatcaagaaactgtggttagttggaaacttggaatgtgtgtagcttctgaagtggcaacgtacatccttgccttcttaagtaaaaagaacaaattacaaagttataccgtttctattttcttacctttgtgaatttacaatacacacgagtgtgtaactaggaattattactccctccgtcctaaatgatatcatttttgattatgtatcgggacgtacatttttaggacagggtagtatatatatcctactatcgcacatagtattcatattttaggtgttggaattatatatatttcaatatcttgtgttacttaaactgttgcctttataaaatgaaaggattaataattataaaaagtttcaaaatgttgaaactcaaccgaacgcagagcaccatatgtgcttttcttttactccacgccaatgtgcttttaatgggagtgaagctagctagggatgtggtgttggttttcatgtctttgagcgcatgtttaggaacacacacttgtggtgtatgaatgtggtgtgcggttgtcttccacataatcaataaaaagagtactatttgatgttgggctaactaacccaaagaaattttggttgtatacatcttagctatatatgtagacgccgagagtcacatgtcataatcccttaagatgtattacctcgacataattaactaagttaacttaaaaaaattattgtcttaaagccataccttttacattgtgtgtgtgtgtgtgtgtgactgtgcatgcttcgggcccataagccatgcccacaacttccagggcacagtcgagcgacactgtcccgtgtcaagtggttatgcaagcaacgagagatgtatatgtgtttacaggggcatgacttcattgaacatgaagcggaatatcctgcatgatagtttagagttgtacgtcacctaggtgcattgtgaatagcctgatagctaaagcacaaaattctgaagtcctaacatcgagagagggaaacacacaagcttaaaacgagatgggtaagctcacctggggtgtcacgaccagcagcatctatcgatcgtgagcaagcgcgacagtaatcatggcacgaacactgcaagagcttttaatttaaattcttttggttccaatgtactaaagaaacataacagcgagtacgtactagcaggctagcagtcagattttagtttatttaattctatacatgtttcttagtaagcattactcctatatttgaactaattgaatataaaatcgccgaaaagaagaagaatattaatttaacagagatggaattaattagacgctctctcatatggtcatgggtgggccgcaaacgctggtttttggctttattggatgccgctcctgccgggcccacaatcacctcaaaattgctacatacctgatgttttgcactttggtttttttggttgtttgcatttgtgcctatcttagaaatggctggttttaaatagctattagtgtcttaatgttagcaacaatatggacatcggccaaaagcttggatcagatatgcacaatttgtagcctacaagggacaaagtgtgcaactactctgtagccccctgattgtttgcacttgtttctacaaaaaaaaatatatatagtgtttgtactgaccaatgtttaccatattaaacaatcaaaagacatattttccaaaaaagcatgtgagataataatgcttaacaaaacagttaacgctaatagttcctttcgaagaatgtacttcgtccattttaaatatataataccgttcactcttagatatgtcatttgaccactcattttattaaaaaacctatataagtattatttattttattgtggcttgttttaccattaaagaaaatctaaacatggcttatatattttttatgcaggtacttttaaataaggcgggcgatcaaataccatgtctaagagtaaataacgtcatatatttaaaaaggaggtaataatagtttggagattaagaatttcattaacacaagatatgtaggaaacagattaagtaatcccctcgaaagttaataacttgatatggtcgtttgtgcgaatggatcttactcctgtcatacggataatttgtttttacaaaatatattcgggctaaagaattgctttttaaaatacctctacattaaaggagtaattgtatatgtagccctttccacaatgactgctggcacgatcattgtgttcctttgctaaactcttgtttattgtctgtcactctgtcttggcctagcttttactagtttcttgtcaaaagctccagtgctaaatcgccgtttatacatctgtttaaagctcaaaactcaaaagtgttcccaatacgggggtgttaacaattagtcaatatgcttgttatttgcgcatgattaagccatttctatccagttttagcttataactaaaagctaacctttgaatttgccaattacatcatatggacaacttttcacaacaattttattcttcatacagaaaaaagagtcaaagcaactaggaaacacccatgcatattatcaattggcatataacccaatttaatactcccaaagatcttcaatttaataaagcttttatgcatactaaagagaggaaccaaccatgcatgatgcatgtgtacctttacaaaggtagtaacagccttttgtggtccatatataatctatttagattgaagtttttttttaatatctgctcactgctcactactagtactacaaccttgttaactaggcttaatgctatcttcggtagagcatttggagtgggattttcagcggaacgcgaaacaaaataactcattagcacataattgattgagtcttaattattacaaaccttaaaatgagtttattttattttttgaaaaaatatgtaaaaagtttttgtcaaaaagttgtactccctccatttcaaaatatagggcacaactattttttaaaggtgtttcataatataaggcatgcatgcatggtaattaattagtatctcttatcttctaaattattagtttttaaatcatacaactcacaagatgtttaattctattgggtgcatgtattgtattaattggatagattcaaacaaaaaggtgataataattttttcttggtctttgagtcaag

SEQ ID NO: 97313 - DNA, 1400 bp, Oryza sativa
caatcaaggaagcaagttagtccaaaggcaaccgatgaagcaggcagatggagaggagccatggaggtagaaagaagaagaaaagaagaagaagaaagcaagaaagaagatagacaagatagaagcactgtgcactgcagctgcacatgcctgatggcaccaccaacaatcaattgcattaaagttacccaactgcactacgctagggaagtgtcctcttctcagcccagcccagcgtggtagtaccaatctcagcacctctctctttttcgttttgctttttcaaccacctactggtttcaaactgatttttcttttctttccccccattgaaaccgtttcaattccagtagaagtagggaaagggttcatatgcgttccaaagcacccccaaaaaattatcatctgcacggtgcagtttttaagaccttggaaaacaattatcatttgcatagaggagtatttctctactattatgtcatccatatttaagttggtttttaagttttttcgtttttggaaatacatatccgtgtttgagttgtattttaagtttgttttctttaattgaagatgttttttgtggtattttggtatgccatctgtatttgagccggtttttaagcttgtttccttttggaagcataaaaggtgtcgtataacaaatcttttaaaaaaacttgcatgctaacttgagatgaaatatggactaataattgcaactcatgattttctgaaaaaatatcaagagaattcctaaagtaaattttatcctaactaaaacgtatagcaataataaaattttaaaaaaatatttacatgttgtaatgcacggacattttttctagtcaaacatatataaaagaattactgacaactccctattcttttaaaattatttaccggattatgaaataaattattcgctgcacacttcaatttttctataaacttttttctactgcattatttagaccacttattactaaacggaggagtattttgttaagtttatttattacaatatttcatccatccaaataataagtaaataatgtgcgataattaattaatccactcactaatctatatcaaatggggcctttaagatgatgccatgtctagtagatcttataataccattttgcaaataataatttgtaaataaaaaaagagaaaagtacgaattacccctgaactattggatgagtatgaataacaccactaaactcgaaaatcaaacatcgctcaccccgaactttcaataccggacaagaaaccccctagcactattgcgagcagtttagagttcgtatagcacacgtggcagtccagttagtaatttttttctaaaaaaaatagcgggcccacttgtcagaatcccacatctatttatctct

SEQ ID NO: 97314 - DNA, 825 bp, Oryza sativa
atacactgctagctttgaatgagagaatgtagcagattgtttttagtcttctcaactgttcattaggaccagtactccttccgttttaaaataagtgtaattttacacggttaatgtgcaacgtttaaccgttcgtcttatttaaaatttttttataattagtatttttattgttattagatgataaaatatgaatattattttatgtgtgactaatttttttagtttttctacaaattatttaaataaaacgaacggtcaaacgttagatacggatacccactgtacttattttaaattattttaggacggaggtagaatctatctatctattatctatcttctattattatatactaaaagtccattaaacttcctacaaacgctctcaagttaccacatggcgctctaataaattagagaaaatcctgtaaattctaagaaaaaagcaaaacatctaccccttgattttcacttaaattggtgggtccaatattatacaccgttagataaaattgatcctaaaataaaccaaatactatgggtcccacctaactcacgtacgtacatgggtatgcagtacgtacgcctccttccaattattttggtatgtagtatgtacgcctccctccaattatttcttcctttttctctcttcttttttccatttatataattgatatatatattctaaataaacataatttacaaacaaagaatataccatcatataattctttataaacacagttaactaaattagctctacaatctttgaaaataaaatttacaccattatatgtttacccattaaatgggctgcag

SEQ ID NO: 97315 - DNA, 736 bp, Oryza sativa
tcctgcagcccttaataaaaaatcttaagccaccacatatatgtcaactgttaaagatttttagaatgagaaaacaacgagttctcacctacattatttagaaacattagaaaaacaatgtcccctccacctccctctccaatcacatgtgcataacactgttacactgccaacccatctctggctcgagttgtatgctattcattcctctccaatctcctccctattttcagcataatattaacacatattaatagaattcgtactaggataagagtaataagggagttttaaggccctattttttttattgattccatcttttgcattttcatttgcacgctccacgcttttccaagtttataaatggtgcttttcttaaacgactttttaactatttagaagttaattcatttgtttataatctcaaatagctatcacataaatcagataattcatcaatttctgttgtcctaaaccctaagtatacatatttttttcgtgcgaatcatggtgatcaacgaataatcaaagtggtaacatgaatcttaagagctactatgaacaattgcaaatatgtgtcaaaattatttgctattaattagacatctaatggtttgctagcaacatatttaatttctctctacatgtatataaacatggacaaagctagaatgaatattaacatatatcccatacatatatattacatgttaatattctcattacatgtggt

SEQ ID NO: 97316 - DNA, 709 bp, Oryza sativa
tattttttggtgctataaaaaaaacgtgaacttttaatgttatataaccaattttaccaaaaccatatgagccgaatagaaagtttgtgtaaacaatactgagcatttctcgcaaaagaaattactgatagttggataaaagggtatatagataataaaaaatcataaataggctgaacatgtatctctagaggtttctgctgtctactggacagatgatataaagagagaggagacgaagataatgaaaaaaaaagaggtttatagtgatttctctcatatatctataagtataacttagctaaatttataatttgctagactaattgatactgtgctaatgttataactttcttaaaagctgagataaactaatagatcagatacagaacttgttaaacgggattaaaagtcacgcaaaacataactacgtggctagtaataaatggaagttattgtcgctatctatcgagctaaatcctttaagacgaaataacactggtggagaaatcgtttttagtcccggttcgtaacctcattgagtatcaacggtaattgggcagtaggctttaaaggctagcagccttggcacacttaatatttagctgaacaattttagtacaagtattttaccaaaggccaactaagatatcagtgaatatcgctagctcactgccagtgactatctgcttgtaagtgtttcgtcatg

SEQ ID NO: 97317 - DNA, 740 bp, Oryza sativa
ctcttcttcctcctcactctcacgcgttccacggcaagccaatagcccaatactacgtacaatcgccttcctattttatgttaacaagaaaaatgttactaactcactttataggaaaaaaccggaaaataattctaaagcgaggagaaccataaaaacaactatatggagagaaaacagagaaaaaaaactctgatggcatcaagtccaccactactgcaagcagatatttccaatggcttttcgtagacctgccacaaacgccaacagccaatctatctatctattatattattaaagaaatagaaaaaagagcctccacgttcgctctcatggcctagaaattctcacattaatcggagaaaaagaaaaagcagagtctatatagaaatacaatttaaaaataacgaaaattcggaattaaaaaaataaggaatattagaagaggagactagagtagttattacacattagtagtttcgtaaagttattgcaaaatttaaaattatgttgtcattgtaatatattttaataatataatgagaaaacatatatgctattatatgagagaaaatataatgatgttagccgagcaatctgcgcgggccaccatgctagttatctttggatatcacaattttttacaagcgtgcaccttaaccacgcgtataaaaaatgatttttcatacgacctccttataaggcgaaaaaatcgatttttttcaagcatgtacttaaag

SEQ ID NO: 97318 - DNA, 728 bp, Oryza sativa
cgataggagtagctacatctcacgcataaacaaatataaaaaatacctttattttattaaatcataatgcaaatatcccctattttctctacttccaatacattcatcctatatttttcataaacaccgatgcgatgattactcaaagataaacttattttgttataaatataagagggagtaaaaataatcttattttgggatagagagtattaaggtttaacaatagaagttatctctctctagactagagttttaagttttttttttaattgagatgcgatttgtaatttgcggacgggctctataagtaattgtatgcaacgttttttaagataaaggccaaaacattatcttcaaaaagtacatacatggttgttataaaagagagatacctcatggcaagagtatgttaaaaacaagggcaagatatagagaaaaatgacaatgctttctcatgtttttttttcattttgatatgtaaattgagttgctaatgaagggttttcattactgataggaacgggttgattttcatgaaaactgaccttgccaacctaggtcccaaatctattttcactagaaattttggtgaaaccactcaaatttcaaggtgctctaaatttgatttcaaattttggtttttaaaattgggggggaaactatcaatttttgcttgattttcgcgaaaacggtgctacggccggtcccttgtcatcactcgcact

SEQ ID NO: 97319 - DNA, 511 bp, Oryza sativa
actaaaaagaaattacattgaaaatgcttcaaaatcaagtttgaaagttcatattttgcccttttgctttggcttattaggcataccgatgaggctctaaaattacataatgagatagaaaagagaaaaaaagaaagaaagagaggagttgccaccccttatgtaaagggtagtctctatacaaactcctagatagataagggaaaaaaatcaatggattgaattaaaaaaaataaggtatgagtagtatattgggacaagtgcattagaggcaatatgttgtatgggtaattttatcatccttaataatgtacctagaggtaccatattttctagtgtaatatttggtgcctctaggcactgagtaccttaaagtaccaaaaaaatttagagtaaaatttagttacctcgaggttgttaataaaatagatacacaacggagacacgaattttatgtggaaaacctttgcaggaaaaaaccacgggcgccgaccggcaatgatcactacag

SEQ ID NO: 97320 - DNA, 609 bp, Oryza sativa
actagctgcgtacgctagcttagctagtatagaagctacgggtaccactgatgtttatatagtgtacgggtaggtgatttttgtgttgctactagtcatgtttcagatgatgtagctaggtcgatccggagtatatatttgcttggttggatctattcagctgctgaccttgctcccattgtcagctaaggaaaaagaaaaaagctagccctccgttcttaaagataaatatagtatttctaggttatttagtaaaattcaaagttaaaagagaactataggctaaatttaaaattacatgatttttctcttttaagcacttgattggctgaaaatgttttggatatccggaatcagcgtaaataaaatactccatatacttatttgtaactaaaaagccaaagcactagcaaactactaagtaacttctaaattagaagcctaattggtcccatgctggcttttgccgcctaaaataacctcggcaacaatatttaatgagaacgcacattttcaattttcgactaataaaatacttaagtaattatattgtaagctccttggagacttcggagtctgactctgatactgtagtagtagcattcacct

SEQ ID NO: 97321 - DNA, 668 bp, Oryza sativa
aaacccaagcaactagtactcatggtacaacaattttcaaaaagcgggagaactctgaaacaaaagatacattaagagcatattttgaaacgaagtacaccattttttttgttgaagaaatcattactacgcaatactctgcaatttgaatgtactttgggagatcatattttttattacatttctgaatgtttgtatgcactactatgttaaaatgattttttttgtgatataaatgtatctgagagttcatttggtatcagcataatatatactgttcatggaaatgtatttcacttccacattatcattttttaacttctgtgaaaagggcgtatggaaaatgtatatatgtgcaccttggctctaccaattgggtcattgagcatttgttttttaacattattttaaatcatgcatcatgcacaaatacttgtactccatttttgcacagtggtttgtatacgcatgcaccgtggtgcagtttaaatttgaaatggccccgtcccaaagacatgggtcccaagcctaacaattgaatctaatcgcacagtttctggaattacatgccactctacaacactttaactgctcattggtataaacaagcacgtatctcaaagcgggctaaatggtcaggataacaggtgcaactgcagttgggtgct

SEQ ID NO: 97322 - DNA, 677 bp, Oryza sativa
  unsure (1)..(677): unsure at all n locations
aaatgtttggagagatgtttcttccttcaagtcttcttttttcttatccagctggaaacggagtagtacagtagtttttcatttatcatatgtgtgcatgccaaataatcttgcagtgcacaccgctttcgacgccgtccgagaaatgtccggttaaatccgcacaaatatacagtgtctgcatcaaatgtaaagtagcagctatagttggtgatgcagtaccattggcgatcgagatacttaattaattaactagttggcaaattgtctaaacaaatgctttatgcgcttcatttgtcagtcttgttctcctgcttggaggtgatcaaaccctagctaacttttccatttttattgtgcaatttggcctcccattccgcatacttttgccatatacactgaacctctccctgtgggggcgccgcatgcaccaagaaaatttaaagttgtccatctctctctctctctcaatttgtttctctctcttagcaagctactagacacacaccaatgctagaaaaaggcttgtctttctttctcagctgcttgtgcatctactgttaactgtacacacacattaacgtggacaaagaacaactagataaggtcatgtgcatcanagagagagagagagagagagagagagagctagctagggacagtcagatcgaaatctt

SEQ ID NO: 97323 - DNA, 635 bp, Oryza sativa
attacgtggcattggacacccacaactctagcaacatactccatgtgttgtttttatatgtggaaactttttgtaaactagtacttcatccatcacaatttattcatcacataagattttagagatattctcaaaaaaattattattttaacaaaataccttatgtttatttataaatgtgcatcgtggaataccatgcatgcgtgcaactatatgcgtgtagccaatcaatattaacttgaattggttcaactcatgcaacatgtagcgcccgttccgtcatggcgcctagcgggaaaactatctcttaaaaaccctatttgcgaaagctgtttctttgcttgtgatctagtgtccgtgccatctcagatctcaaatccccgatctatcgtcgaattcaatcccgaatccaaatccttccaaatcaatccctccgcaaaagtctatttcgcctccctcgggttcgatgggccgaatccctctcggcccatctcccatctcctctctctatctccctctctctctccgctcgcgcgggcgtgcgcgtgagccgcgccgagcgcctcctccctcccctcgctcccccctccccgcctccatccctggcgagcaccccgcccgcgaaatcggccccc

SEQ ID NO: 97324 - DNA, 680 bp, Oryza sativa
attcctgcagccctgtaataaaaatttatgtgacattttttttttcgaaactaaactcggcccaagccaacacaaggaggtctagggtcggagaaaagtcatcgggttctgttctgttctgaccttggcccacgcctccttggggagcttgtcggccttgatgcctgaaatgtactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgcggcctaaat

SEQ ID NO: 97325 - DNA, 506 bp, Oryza sativa
tttgagatgataaatgttagattatataaacttctctaccttacctctatttggtattgccaatttttttataagactagagaaaatgcatgtgcgacgcaacgggtgaaggctattctaatcttataattattataaggtttagttcaggtaaaactcaccgttagaattcgcttggatatattattttagaaaatcatgagttgttattaggagtccaatcgtctcaagttagcatgcgagttttttttaagagatttctatgcgactcctttggtatttctaaaatcaaacgaacttaaaaaccgactcatatacggatgacgtaccaaagttctggcaaaaacatgttcagtttttataatagcagagatataaatgggagaagttgttctgatatcgggctaaaaataattgggtgaattaatgtgccatttggaaaattgagcccatggggaattaatatatgtgtatatatgggtattacccaaattttggtaaaattg

SEQ ID NO: 97326 - DNA, 524 bp, Oryza sativa
gcaaccaatcaggatgaatattcacctatagttcccgataaaaaccgatgttttatgccgtgttctcttgtgatagcttagttagaccgcaacttacaaaagggacactatcgaccaaacgctgacgtctcttgaaagagatgttgaaagagctcaacaattgaagctaatggaagatttgttatgaataaactctagcaaatgggaatatcctagattccatggatgacgtacatacagagttctttttcccttttggaagttatgggatataggtagctatagtactagtattgcatcggaaatgcttgcttgcaacgacctagagtatccaattagagtggaactataacccaactatttgcgctcttgtacaaacaattgctcttttgaagctcttttcttttccttttatgtgtaatggaaggaacaaccttttgcactacttttgttgtctagcattgtgctgaattcactagttaaaatggttagggtactcaatgtaccaagaaaacaaggtcgac

SEQ ID NO: 97327 - DNA, 608 bp, Oryza sativa
tagaatgacttacattatgaaacggatgaagtattcttttagcaatattgtataactttaagttaaattaatctttgtaagtacttgtacagcaccaatattgaaaggaaacaaaagtggatgggcactggatcctggataaaaggaaagctccaaatgaaccctgctatatgtacgacttctccatccaatcggcgtatgaccgaaacggcagagcaacacactacatgacggcgtgaagcttggtatgacgtatagcatgttgctaacactgcgtacgccgtagtcgtccaaaagtcatcacatccactaaaacatagaacacatcatcatccactaacaataattacatatcaaatctcgtgcaagcatacaacatcatcatctacaatttgttgaattctacaaatcaaaatacaagcatatttaatcatcacccccacatcatttccataatattttaacatatctatttattatttttataatatttagaatatattcatacatatattccgtagcaagacacctcagtatctcacttagtggttgaaaaaaacaaggcaaaatgaataatttaacctcatgtttcccatcatataactaaa

SEQ ID NO: 97328 - DNA, 613 bp, Oryza sativa
accaaatcaaccattttttaactttgactattaatagcaaaaaaaaataaaaaagatcaatatgtcaaattgatgttactagatttatcattaatcaaattattataatatgcaactctttttatttaaaacattttatttttatagatattgtttatcaaagtagtatctcgaacactgtgtcgagatttaaaaatatttatattttaggacagatgaattacatagcaagtcttatgtttgcattgtccaggggaaatatggctttgtttcaatagccacaattatactccctatattaggggttcaatcccatctcttatgaaagaatggacttcgaccttgagtatcaaactgaatttaaaaattgatagctcagtctgcttcgtcgcatattgctgactcaaagtcaaaaactctattatatctagctccttaccatttaaaaatcacataaataattcttacattctggaccgctctcatatagtacagatccatcagcacgaataaacatagactttttaactcccggccaggcggctagcccacgaggatataggaatagtagtctggaccacattccagccgtgtgcccctaccatcgcccccc

SEQ ID NO: 97329 - DNA, 663 bp, Oryza sativa
tagaggatccccactggaataaatttttgaacgagaaccattaaaacagattatgaagtgcttgtgctattagtttggtttaattaaaagagaaagggaggagaacagttctatttttccaacatttttagagggcttttatgggtaaccatttggcataacctagggtcaaggaagctctgataccaacttggcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacaggcagcttgaccaaggctacacctaatcctccacaccatcagccttattggagaactcttcctctgatgaatgattgcaaggggagtatatgacatactcaacaagtcacgcagcaaatatgcaagtgcacaaggataccaaaagaaggcataatagggttttattttgcaaaagcaggatttagtaaacatttgagaatttaataaaacagtgaagttttaaacaataattaaccaacgctttacaa

SEQ ID NO: 97330 - DNA, 557 bp, Oryza sativa
aatgcaaaggttagtgcagtggcaggcgtgcacgtttgacgttacagctcccgggtttaactcaagaggaagaaatctctctctaaccgcttgcattatttgaaatggagtagtaggtaggacctactcccttcatcccaaaatataagctattgtcaaacttagtacaatcttcaaaactaatttttaacttaaaatttctcatatataaggtttgttgcaacaaaattataatcatcttaaagtaaatttaaatgttaatccaataatttaattttaacaaataaaatttaatttatattataataattattggtcaaatgtttttaaagttgaatattgaaatgtgtgcacgtcttatattataagatagagagaataaaagttaattaagcctaatttgatttatacttattagctgtgcatgagtgtaccatcttacagtttagatcctctctagacaaaataagatctgcagtttttttttttgttggcacaagatatgcaactgtatttatttcaatacaagcctagagctcgtgcgttacaacggaaaa

SEQ ID NO: 97331 - DNA, 569 bp, Oryza sativa
tggaatacatggaaaaatggattaaccgcaagaagggcctgcgccaagccggatttttcacaatttgttccttttgaaaaacttatttcataaataaactcctgaaaaaacttattctagaaatgcctttttggaatgccaaaggcactggcgtcgtcgtccaacgagaagcgccgtcctcctgccaccgtagcagggcggcgctaaggtggcagggggagcacgccaatgtggctggagctgccccccccccccctccacgccatttttaattttgggataatttttttaggggtctatctgcgaaataagttttttaaaaggatcaaattgtaaaaaattcagttgcgccaaaaggactccatctctccctgcttgttcattttagtttctaatgtgctgcaacaactcatgagacaaaatgaagaattcaagcaatctaccacagcagtcctgtgccaccatacagtatgctgatgacacccttatcatttatcatctgccgtgcaacggaaagagatgctagcgtcctaaagaaaggactggagcttttcgcatatgctacagga

SEQ ID NO: 97332 - DNA, 647 bp, Oryza sativa
cgaatagaagtagatgagtgcatagaaatggacttattcagagacaaataaacctataagatttaaaaatttattatagaatatatcagcttacatctactttttttatcacaaccaataataatcaatcaaatttatccaccacttcctctctcaacttatcctaattgcaatgattttttttcatttaattattgttttctcttatttaatttcacatgctttcttaataacccataattaactctagaaattgttataccatattttatcacccaacgaatagtaacaattaatctctccgtctcaaaataagtttttttcacccatttcacacaaaccaatacaaaaccaaatagactaaaatattcccattttatcaaatcccaatacaattatttttctttttatctactcctaatgtattatccacactactttcataaactttgagatataatgtttacttaaaaataaatttatcttagaacatataggaagaaataaagggcttatttggtctggtaccctaccaaaattttggcagtgccaaaacctggtaagttttggcactaccaaaattttggtatggtagcacagtaaatacgagtgtttgggattagtgccaatgttgtgccaaattttta

SEQ ID NO: 97333 - DNA, 570 bp, Oryza sativa
ttaatattgcttaatttttttgaataagacaaacggtcaaacatatttaaaaaagtcaccgccgtcggatatttagggccgtagggagtaattaatcaataatcttctatagatatcagccaatttgatacgggctctatatgagtaaatcagattttttttaataatgaaaatatatcacacaagcaaataaataaattagatctaaagatattctctccatcccaatttgatcatcacctggcgattttgaggtcttcctaaaataattatcatataataataagtgtctctttatttatttattatgcaaagggtaattgggcatcgctgaatggaatgcatgcatgaagccatatgcatgctacgactgttagtgcaattccatgcaacatttaaagtgtgatgcaatatccactggatatatggagcaccttgattggtgataattaatttaaaaacatgaaaattttattgtccttgtctttgcaccttttatttaggggatgatcaaattgggatgaaggatatactattaaactaataataaatagaaatattagttgtttc

SEQ ID NO: 97334 - DNA, 663 bp, Oryza sativa
tcgtagttgttttatcacatgctttttcgctttgtcttctatgtgggtttttgccggtttccccgtagtaaacagtgcagttgtatggtttttgggcctggttttccttataaacagggtcaattctcttatgcttataaattcgatagatctcctaccgtcgtttcttaaaaaaaaacttcttattggaattatttgataaacaaaacaaccctaaccagaatttccgagttatggattggaattctttttcaggactggggtttttagaaagatttaggtcgattttgaaacagatttgaacccgattttaaaggaaaaggaagagaaataatatattagttttattgatgggctattgtttcaatcggcattggcttaattagaaggtgtggtcttgtcttaatagatcttatagttaaattaaaacatcgtccaattgacaaaatcaatttattagttttaccttttcttttttctccttggccctttaccctttgaatctcgttctctcttttatttctactacctaggtgtgaagatcagagatactgtatacgcgcatggatagcatatccaactaaagataggaggtgggctatatatgtatattatgtaaatatagactagacttgtttatccaggcatattccataagtctta

SEQ ID NO: 97335 - DNA, 1290 bp, Oryza sativa
gcagaggacagcgattaattggcacaaagaaaattcttctatactcaagtttgaaaagaaaacaccgcatagctaactgttcgtattgaggaacagttccctttcatttccagtacatgttcccaaaacaaaaaatatttttgcagcacagactttcatggcttcctattgacacctaacctgtcttataaaaaaaaaatcaatttctaactatgaagttggacgtagtttataggtgacttataaatcaatttctagctacgaagttggatattttatgggacgaggggagtagtactattcatccgtcccaaagtaagtgcaaccatggttttccgcgcccaactttgaccgttcatcttatttgaaaattttttgaaaaaaattaaaaacataagtcacgagtaaagtactattcatgctttatcatctcatagcaacaaaaatgctaattatatataaaaaaattaaataagacggacgatcaaagttaagcgcgaaaacccatggctatatttattttcggacggaggtagtacaaaataactcgaggaagcatgtcagacagtggagcagtgacacagtgacaagcggtgatattgatccataattttgccctgattgtgtcaggaaatcaagcatcatcaaacagaacttaagtgcttacacaaagttgttcttactaccatctttctgtacacacaaagttgtaccaatatctacaacatcaaattagtttcattaaaattagcatttaatatatttgataatatgtttgttttttaaatattgttatatttttatataaagctaaagtaaaaaattcaaaatgacttataatacggaacgggagaactagtagttgtatgatgattagagatgtactccctccgtctcatttcaagtacaaccatgagttctgtgctcaaccttgatcatccttcttatttgaaaattttttataattaatatttttgttgctatgagatgataaaacataaatagtactttactcgtgacttatgtttttaatttttttaaaaaaattttcaaataagacagacgattaaaattggacgcggaaacgtatggttgcacttaaaatgaaatgaaaggagtaatgtacatataaatgttatagatttcatcattatattaaactcctgagcaatactctcgtataggtgtcaatacattcagggacaccttgccggtcaaacaaggacgggtggtcacagcatcgcactccaaacaattaattgaaaacttgaaggatgcaacaaaagagca

SEQ ID NO: 97336 - DNA, 856 bp, Oryza sativa
tcagcacaacagtaacagttgatggccattcatgaaaatgacagtaacagttgatatgcactcatatgtggatgtgtcagtgtcaatggccataaggaaatgcgcagtgagttatggacttcacatagtattaatctggccagtcatcggatgtgatttctgaaatagtaatgttaatatgtttttttttcatggagaagtgcaaatgttcttgtccaagcattttctgcaccttgaatattagagaatctttcatctagtcccgttatttgcttatttacgtacaaaaacaaactaagaacaactttgtgtataatttcgtgatgatcatccttttttatgcgaatgtttcaccgtgcagaaggtgagaaggaaatacttaatgagttggagacttcacataagcaataacgtcaatagctttgtgatggagaagtgtatactgtaaaccctcttgtccaagcattttctataccgtgaataatcctcctctaatcccattatttgcttatttatgtgcatagaaagatgcacacaaattaagaaccttatgtgttcacttaattgtctggttatgcttgattgcctgacataatcagcgcaaaattgtggatcaatagcacctctttgtaatcctttcttttttaaaatatattttaactgtggggcttcccctgcagtatttcccctaaaaaaatcaatactccatcaaaagagagaaatacttttatcacggggttctgctataagattcagttgtataacgtatgtacaactaaagacatgcaaccatatatcaatcaaaggacaatatgttcatatgcattgcagccatttacaactattgatcaaattt

SEQ ID NO: 97337 - DNA, 670 bp, Oryza sativa
cattcctgtattctttttgccctttattgttaagtgcaatgacacctaaatggctaaatcgatcatacaacattgtttcctttatcttctctttgcatttttcttgtgggttatgaaacctaacatcaaactaaatttattgcaagagcagatcttctgcataaaaaaataacaatagcaaatcttttagggcttctttaaaacaatgcgttgaaaaaagagaggaataggaaaaacacatatttttaacaagaatacaagtgtaaaacagataattgcaaaacacaaaaaaaaatagaaatagaaacattgcaatgggataagagagatagactcgtagggaattttctaagaggtttgagctcttgttaactttccatcaaattctataggattgtcaatttcataggaatttcaaaggaaagaataggatagtttcaaatgtattcataggattttttttctacaagattaaaatccttcaattttcctatattttttctacaaatgaaagggcattagtttcttttttaaatcaatagccataccattgaagaaagagatggattactgtgtcaccggtagtatctcttctaaactacagtatggaatacttcttttcaaaaaaaaaacagtatggaatacaaatatatgcatttaaagtggttct

SEQ ID NO: 97338 - DNA, 1066 bp, Oryza sativa
aaaacacctcatcaactaactcgtcgaacttgcaagaaacccaagtccaggaagcctcagcccaccaaatctgcccgtgcttgtgtttgttcctgtgcttgtgttccttcctgtgcttgctccagttgaggatgaggctccatttgaagattcaggagatccttccctcatagacgacgttctggtcacaacactccgctgctgctgcaaacgccctaatccttccctactagatgatgctttgctcacaaaaccccactgttcctcctgcaaaagtccagcaatagctcgtttcaatcatggaaagcgcaagaggaaactgaaattgcatgcaacaaagtgcaacatcaaactgaaaccacacctgtggcacctctgccctaggtgatggttcagctgcaggtgcggttgtcggcagagctggaagagcagtagattgaggcaacgaagaaacctgcaaccagaaacacatgaacccaagtcaacaaactggggccatgttccgaccatgacaaagctgggaaaagtgcaagcctttaccctcctaacaactcgctctgaagatccaatagctggaggaacggatgctgctgggacctgaaaataaaaacatctcttcagaataagcatataggaaaagaatatgcttatagttgaggtgcaactggttttgttaaataaagcatagaagaagcatggcattaaggaatcactagaccattcaaacttgcccggcgaatagtggctttctgggtgaactcaaccaagtcagatattccattagccgtatgatcctaaaaggattttaagaagatagcattaggagcatgtcgatgagtttgttggtaatatgtagtggtaacatgagcttctactttcctaaaaaaaaaaacatgagctttctactcacctgggtgtattccagactcacaagctttgattcctgcatgatacaagatacaaaaaatgtacacgagtaatattcagtaaataaggtagaaatctggatattcagtaaataaggtagaatctgttccggtacgaggcacataccagactccgaact

SEQ ID NO: 97339 - DNA, 847 bp, Oryza sativa
  unsure (1)..(847): unsure at all n locations
cggaggataagaacaattataagaattaagcccctcccccgattgatagggccatttaancactccctntnantcncttaaccttcncccccnnnncnccagtgnttttgtgatcgactggcacatagcncannacannacanaaaaaacncngaaccgggacacaaacaanaacaaaaancaacagggcagaagacaaacggaaggaaactaagagacaagaaagccagcaagggaggggaggggcgccggaccagagggaggcacgcaaggcnncggacccaagagnaccncaaccggacccncgnnaaaaaaaaaacatttatgcaacatttacaacctttggtccagagacacactgcacactgcacaggcagctaaggaactacctgtttggttctatcaccttccgaaacttttggcagtggttaagaacagctacccgaaagcacatgacaagcacacacagctttaaattcctcagttatcacttatcagttaaccaaaacagtcagcttgccgactggtcgcgatccctgttgctcggccgtcaaacaatcgaacaaaagcaaaaggtaaatctaattacctcgtcggggggggtagccacgatgagccaaggggacgcggtcgtatgtgtcgatggggtgccacagattgggtgctgaatggtggtcttaataaatggcggcaagggcgcgggggacatggaggacaaagggccaggtcacggtgtgggacaaaaacgtcggggggaaatcgtcgcaagcgcgggggccaacgggcctgaacaaaaggggagggaaacgggaaaaaaagagaataaatggcttgaccaaagtcaaag

SEQ ID NO: 97340 - DNA, 751 bp, Oryza sativa
  unsure (1)..(751): unsure at all n locations
acgacacgaaacaatattaatctaaaanccncnnnnnnnnnnnngngngannnnagggggcgcatatgattgaccgcttaaacattaaagcatttctctagctcacacctactttttatgctggtaaaaacatgctaaatctagatttgatttacaacgttattctctctaccttggatccgcatatgccactcccttctgacatagatctctgcaaaagttcaatgcctgagattgatcaaatatctctgatagttccaaactgtccaccgcactcctgcagtgctgaagatgctgatgggcgtgatacatctgaaacaactcccagggcagatattcttgaacagtgcaattctttatttgctccagaagaattagagcaatctgagttgacaaagactttggaagaaaaaaagcatgagaaaataagtacagatttggaccagaacttcccagaggacacaaaaagtaatggaaaattaccagctggcctttttcagttagataatatttttgctactgattactatgatgcacatgctgattatctgcagctggtgaactatcaggactgtgaattaagagctctagaatttcagcgcttagcactgaatctatgcacacaacaagaacctacagttgaggggcataatgctggaatagatgcttttctgttagctgctgaatgctatgataatccactctttctcttggatttccattctaaatcggagtcttcggatgaaattga

SEQ ID NO: 97341 - DNA, 594 bp, Oryza sativa
ttagtctgaatacagtggattctcatccacaatgtcacataaaggcgataaagttcaatctgcaatcaactttctgtacattaagctcttgtatcttcacaagtttattaatgagaaggggaaatcatttatgcaggagtaaagaaacatattatcccgtcataggtggggtcatactcatgcatctcaatataccaagagaacctaacagaatgatcctaactaaaaggatggatatggaagaactagaatgaagagagcaggtgcggtcctggtatatactgtaatgatgatggctgattatggttcttctgccatggtcccaggcaatcagattcaactaatttgcactaaccataaaaatacagtagttgtaatatacagttttaaaaacattttatttgaagaaaaataaagcatgcacactagaaatacaacacaaaattgtaaacaaatgaggtggaagaaaatgtttggagatatatgttcattctagtataataatcacccagtgtagccacttccaatagtgagctagcaacctatcttcttcaaaaatgcattcacatttatgctacataaaaattgatgaga

SEQ ID NO: 97342 - DNA, 703 bp, Oryza sativa
  unsure (1)..(703): unsure at all n locations
cggcggnnaattggactacaagttgagacagtcacacaacaacatgcgaattgttgcacgggccgtacaggcacatgagactcggtggtgcgatgcactaaagcgagtggcacaacaagggtgccgactggaaagcgatcagtcggcagctccccactgacttcaagacaccacactgagatacgcaccccaggcacaacaattctgcttcagggtcgcatgttgagagagagaaaagagcggccaacacaccgcacacaagagaacaggtatgggctaaaaaaataataaagcttttggttgtttaacgtgactattatactctccaactattaggttgcttttagatgacatggtacacaattatcgctagcaatcgacgataatattaaacctgccctaatgccgacgtagtctgtcttcacggaacaaaggtcgcagccatgtccccgaggtcagtttttggctcaaatttcggaatcatgataaacatgctgccccttctggtggtttttttcgcgaactgtcctttcttgtggttccaaggagatgatgataagatactctttttacatgagctgagacataagcgtgctctttgtgttggcgcttaaatgggtgcagatgatttcaacttatatatacaggagaaacttgtgttgcccataagatatagccaggtatttcaactatactagaattg

SEQ ID NO: 97343 - DNA, 900 bp, Oryza sativa
  unsure (1)..(900): unsure at all n locations
cggggncntttgccttgcatgcacttcccgnncatcacaataggaccagccagcgagtaacgggggaagagccctcccccccggggcgaactcatgaaaagggggtgttacgactccctggtatttgaggtcttgcctgaacacaatcaaaggatgaataggggctggtgccccaatattatttttggattatatattttttaaccatataaagttaaaagggctgaatttgccttaatttttcaagagcccaaaatattcccctttatttatttcctcttaacatattaacttggggtgaattttgccacttaaccatttcacggatggttgcttttaaaaactttttggaaaaaggataccaccaaaacttaaattagaggatttattatattccttataatacattttgttacgataaaaggcttttattttcttaaaacatgtactaaaaaagatatcatgatcaaaatattgaaatgtgaggcgagaaaaacaagaagaaatgtgaggggggaggaaaaaagagagaaaaataggcataattaggaagaataggaaatacatgagaaaatggaaaaaaaagaagaaaatatgaaaaaaatatgtgaaattttaaaaaaaatatagggggaaatacggaaacagatgggtcggttgggcaatgctcatgcttgggtcctaccttgtcggaatatcggcaaccatgccctggggtgcccaaaatttatataaaatactttgtgtatgtgtgaacttttttgcttgtaaatatataacaagaaagttattagtttttgcaataatttccaaaatctgaatttaatagttacaaagttatttatagaaacaactgcgtattcctaccgttaccttttatgttattagcctaatagtcct

SEQ ID NO: 97344 - DNA, 553 bp, Oryza sativa
gacttttttttccctaatcaaactttgttaagtttgaccaagtttataaaaaaacagtaacatctaaaatatcaaattagttccatttaatctaacattgaatatattttaacaatatgtttgttttgggttgaaaatactataatattttttctataatcttgatcaaacttagagatatttgactggttaaaaaaaatcaaatggcttatgatataaaacagaaggaatatttttcaagtccaaaagaaaaattctactatactattggtatttattattagtatctttcaaacctaaaaaaagtgtgcaacacgaggaactggccattacgtaccttgaacatatatatgccttgaattaatacacgttatatgatttgtgccggcccccatcggtgcacttatttaacgaacaagagaaacgacatatttgtaaaaaaaaattgtgaaaacaaaaaaaaaaaatttttgtgttttttttaaaaatattaaaaccatgttttagcgatctaaaattattaaaggataaaaaataaacttcgataaaaaaa

SEQ ID NO: 97345 - DNA, 577 bp, Oryza sativa
gaagcaaaaggcagatgcatcaacgtgatgtgtttttggaatggcttagacctatacaaggaggaatcactgaatctgtaccactagattagtattagtttggcttggccaagaaacggagcagctgaaatctgaacacctttttgatgttgctacaaatttattatattagtatcaattactatcagattgaattctgtttgtgtcgtggctggatctagattcgagtggctaaactgtacccatgttcttcagcatttctttaatctacggcattgagaaaatcatatcttcctcatcataggatgattgattacctaaggagctcccgcgtgcctctgaactcttggcatgtcaagagacaatggaattgatggcatcacgcatggcattaatcaaagaaaatatcatgagtgaatacacagtactatgacgacgataaggttggggggggggaaatgtttttagagaaaaaaaaactccataacaaagatgttggaaggaagaaaaaaaaatgttgggaggaagaaaagaaaaaggctcagccatatatatatatatatatatatatctatat

SEQ ID NO: 97346 - DNA, 549 bp, Oryza sativa
acattatcatgttgcccatgtggtggattatctacctaagtgtaaggccctggttgtgtgtagacccaaggtggttggaaaggagcatactgtgggaaaaagtatggggaattgtgataattcatcatgtgagcatttggatggtagtactgagttccaaaactagtatgaggtggagtggtatgagttgggaagaacactgatgtattgatctcaggggcagtaaaagtgggaacttggggtatgtggctaccaatactagtagtgtgagcagtagtaaatagatcgggttgagtcatgggacaagtgactccccttaagtccaccctccctggagtggatggaaacatcatcataccttcacttctttgaggattttgtgttgaggactgagtagcccccggcatctttaccacctctgcttcaccttagctttcttccgagagcaactgggcgtagaactcaacatctcctgaatcatcttcatggattgcattatctcatctcgatgaacttgagcctgcatagcttgattttgaatctgctcat

SEQ ID NO: 97347 - DNA, 664 bp, Oryza sativa
agatgggccgagcaggccacggcccactataaaaaacgtactcaggcctctcacagtgctcctagctggatcagtgctacaccatgccagctaggcttttcgtgtgcgtggcagatgaatgcgcgccctagctgagctgctcgcccccaagcagagccgcgcggaacctggtccaagcgagggagcgcgcgacgccgaaattcccgggcatgcgcactgtgggcagcatcgcctcgcacacgcgtgccctagcaccgcgaaataccacaatcgtgcttccaaaattcacttccagcccagcgaagttcctactcccgacacaacactagcgctcccgccacagccactctgtcttcagacaccaagttaggcacgaaaattttcgggattggaagagaataactcaaataagacggattcaacaaaacaaatcgagacgtatgtacaccacatgatgaaaaaacaaatccgccgtgtccgccaaatccgacgccgaccgccgcatcggagtcatctcgccgccagggggagctcggggagaaggagggaggcctggagcggcagcgtccccatggcagcgctagaggaggcggaggagttcaggtgcgcggcgacatccaccatggcggcggcgtctcaccgacggatctacgcccccaccacc

SEQ ID NO: 97348 - DNA, 580 bp, Oryza sativa
gagaaagtaccgcactgttgtttcattgtggaactgtcaaatctcaaatcgcacgtcgctgctcgctgctctctgttgatcttgcgaagtgatttttattttatatactctgatgtaaagtgaaacaagatacattctacccccgtgtaaaatgcaatttattctaatcagaatttaaattttaagttgattttaacttttcattgtgatttatatattcagcattgactcttaaatcgctaaaaacaaacgtaaaaacatcttcgtacattattttgttatagcatgcgaaacgatgcgactaaattctcttggtacgcaaatccaaacggatagataccctgatgacacgattagttttctgcacgtttggaacaaacacaaatggatggtctttgacgtgcccgtgcaaattccgctaccactagcatctatgcttaaagaaaaacaccaaaataattagggaataccagcgtattaataagcatcttcttctacttctactccgtggtatctgttgcacgccacggcaccacaaaaccaacagacacaccaacccgtcgcccaccgggtcactgac

SEQ ID NO: 97349 - DNA, 594 bp, Oryza sativa
ctttcgatccaacttaaatagagctacaaatagtacaaaatccaaacacgacataacacaatacattataattattctgtaattaactctcgatttcaacttaaatagagctaagtgttagaaaaaacgcaacccatattgcttaattctgctcttgctgcatcacacctctaattttcttttcatgttattaataaattaatcttctccatgtatgaatttatatgtggcaaaacgttagtgctgcggcagtcataatcaccttagatgcctcagacacgatgctttgtcacgcgtgcaaaaggtaaaggtacagacgtgcattgtgtagcgggccaaaaagagaacttcggacgctttatttattagcaaataatatatcagatgatttaaatgatgagtccaccggttctttataagtgtacattagttattatagattttaaatttttaatttaatgggtacacaatataatgatgtagactttagtgcattatttgagaataatagtccaatgtaataaaaaatagttccgatgatttaaataatgggtccatcggtttaagtgcacatataaatcagttaatatagat

SEQ ID NO: 97350 - DNA, 675 bp, Oryza sativa
tcaagttaaggatgtatgatattacaagacactatcctaagtttgaaaaaccagagtttgtcatattcatttataataaacaagctgaactacacacatactcatctgtgcgtgctcgcacacccggacacaccaaaaacatataacgaacaaacagaaaatgcagacggtctgaatcaggatacagtgcaggaaaatagttggtatgtttcccctatttgtatcttcacaataatctctagttagcatgacaatgtctcgcagatccatgctgaatagccatatgtctgcctgcaactacaaaaccaaaaaagtttttttgagttttttggtgcagggtacacagtatagagtcggaagttgtaggaatcagatgaagatgaattttgctgtccaaagcaaacaactaccacatacgggatacagtgagctgaaaagtaatgcaaatctgcagaaagaaaaacaagtggcctaaactagagcttgaacacagaaacatgtgcttgtgttgcttgggcgcaatgggtgcctctgaattggctgcagaaagagaaacatgtggcccaaactatatattgaacacatgacatgctacttgctaagccccaaatatctcttactacaaaacaaaagtatgatgccattcctctaaaaaaaagacttatgccatttaat

SEQ ID NO: 97351 - DNA, 515 bp, Oryza sativa
cagttaattagcagtagctcaccaatacaccaaagatgcagaaggttgtactactactctaaaaggtatacctaactcacacatactactgttctgcaagtcagcatccaaggtaccccataattgattgctagtatgtacaaatcaagcttttcccatcagccaactttctcttatgatgaccgcaaccaacaaagacaatcaagtagcagcacagagaggctgtcctggcccttcttaatgatgggatggaattgcattgtatggcatccttttcaggttgcttagaaggcatgcaaggctatgtgtacatgaccattcaactttcaggagggacttggaagttgtgaaaaaaaaaatcagctttttttggagtacatagaaggcacatactccacatcacggatacaaatcatctgcggtactgcatgtgtcactgacatgtgggtcccacctgctccgggcccacatgtcaaaggcaccaactgcatgtgcattacagccgaggatcccca

SEQ ID NO: 97352 - DNA, 674 bp, Oryza sativa
tgtttttaagtataagatggtgcaacatgccgaaataaaaaattacacctgatgaaccaagtttattggctcattctgaatctctctgagtgttcattaaccaaatcaaaatttacatggagaaaagaagcaaatcctaatatttctgtcaattgacagaaacatgagaagcaagcatgagaaatgaacccttgtttttgtttctatcctgaagtcttctcgaatcaaatatgaatgattccccaaaacaattcgactaaaatcaaacaacaaaaggcaataaaccggaagccaagaatcagctcaaatcttacagaactgacagggctcaagcttcagacttccttcctataaccttagccaagaaaccaagaacacccagagagtcaaccccatggctcatccatccctctgctcatcatccatggcagatgaacaagtattatcttctccctccaaaacccagagcacaagaacaccagaggagccaagccaagaactctgaagaaacacacagataaacatgatgcagctgagcagtgactaagtacctgagcttcagaaggttgcagtgttggcaatctgaatctgatcagaagttgctctcagaaagagaacgggagacagcagctcaggaaaggaagacatccattggaagcaatggatctctctct

SEQ ID NO: 97353 - DNA, 901 bp, Oryza sativa
cacgtggcgccaaacccacagggggtcggggacgccccagccctcggggccgaaacaggagcggccccgacccctcggggagacagagggaggggcggccacatcaccctcgggcccgaccccccgagggggtcaggccacgtgggtgaccgcggctgccccaaaacctctagtcaagatacccccggtcccatgtcaccgacacgaacggtcaaacatgtttaaaaaagtcaacggcgtcaaacatttagggaatgagtaagtatattatattgttacaataagtaattttgtgatattttagttattcatttgtgatagttgtacatggtgttttttcttcagcaatatctcgtgatgttgcagtttatatacctgcttgttttcttttatttttgaaaaagctttgataatttcatcccactacatattagagaatgttccatgtttagtcaactgttatattttgaccagcatatggatttttacgctcggatcagacatccgacgtctactcttgtcataatatatactccctcgttttaatgtaggacgtcgttgactttttaattaacgtttgaccactcgtcttatttaaaatttttatacaaatataaaaatacttatgtcatgcttaaagaacatttgatgataaatcaaatcaaaataaaataaattataattatataatttttttgaataagacgaaaggttaaacgtttgtcaaaaagtcaacgacgtcatacattaaaatacggaggaagtacttaatttctaaacattcggagcgtaacgaatataaacacagaaagtccccgtaaggtagcgagataataaaatacacaatgatcttttcataatactactaactcaaaaaaaaaaagatgcaatgtaatggagt

SEQ ID NO: 97354 - DNA, 553 bp, Oryza sativa
agcgccagccatgcgttaaagcaatcaagtggcggcgagcggtggattccgacatacgttgaagcaggccgaggcggcggcatcgaactcgtccttcccagcgacagcggcgttgaagcaagcggtggcggtagcgaactcgtcgttcccggtggcggcggcgtcgatgtcgtccttcccggcggcagcggcgtcgatgtcgtccttcccgcggcggtagcggcggcgacgttgaagcaggcgacgccagcagcaaactcgttgttcccggcggcggtggcggcgtcgatgtcctcgttcccggcggcggcggcggcggcggcgatcgatcgagaatcccagcgcttctagggttcgagatgcccgtccatccctcccgatccggttattgcacgtgaagttacgtttttgcccttccacctcagttctccacgtggtactgcacagggacagaattggtaccgccggtaccaaactctaccagccgttggatcgggccagatccaacggccaggattttggtaccgggcagtaccggtaccgaccgctgtac

SEQ ID NO: 97355 - DNA, 653 bp, Oryza sativa
gcagggccccaagcagtttgctatcttgcctgaaccatgtgatttgcaattcagactcagacagactcaccatgtcctaatgcttccagttctaacaggtggctggccactaacatctcctgggcacttgatatgtgtcttactgaacttctttaattctcccaacagctattttcatttcctacccttatcctaccatttttggtcccattttacaggtgggacaactgagtcatgtcactagtaagtggaggagatgggacatgaagccaggctgtctggcttcatggtccactctggtcacctctctatcacagctgctgtgatggggccctggcccctccctgcttggtaccacaccctatctcttccctgatggatctcttccagctgtgcttctctttggtggcctctctctccccaaccagaagaggacacagtgtggaattgcctgttggggtcataaggacaccaccgctttatattaatgatacatcagcttttcatcgcattacatggagggtgaattattgcagccttggaaaccctgactgtacaccttctcgttattcttttttgctgacgtgctctacaactggtagaggcaaaggcctgcattgattaattttcatagcaatttttgcctctaatga

SEQ ID NO: 97356 - DNA, 738 bp, Oryza sativa
ctttataggcatgttacttaatttatctcttcaggtgttttagacggtcttttctttcaatagtttttattttatatcatcatttttagttatttacaaattgtattcctaattgaaatctttttttctttttataatttcagaatttatattttttttcaaatttttatttaatttatctcgtcatgtgttttagacggtcttttctttcaatagtctttctttttatcaccaattttagttatttacaaattttattcctaattgaaatcttttttatttttctaatttcagaatttattttttttcaaattttaattaatatcatatagtgtaattttaatattttttttttgaatttaagttgtttcaaaattatattcctatttgaactctcttttagtttttataatttttgatattattttatttttattctgaattttaattaatctcgtattgggtttttatatggatttttcttccaatattgcttatttttaattctgaatttcggttaattttaaattgtatttctactcttcttttctttttgctaatttcagattttatttttatttttattacgaatattaattaatctcgtgtttggttcttatatggactattctctcaatatttcttattttcaattccgaatttcagttatttttaaattgtattcctacttggactctccttttcttttctaattttggattttattttatttttatt

SEQ ID NO: 97357 - DNA, 659 bp, Oryza sativa
  unsure (1)..(659): unsure at all n locations
tgggaagaagagcttaggaatacactttagaagtaactgaaattcgaaactaaaaattaaagaatattgaaagatgagtttagagtccacataaaaatacaattagaaataataaaaattcagaaataaaaataaataatattggaagaagagcatagagtctatatagaaatacaatttatagaaaattcggaattaaaaaaacaatattaaaagacgagtctagagtctatataggaatatatataatttaaataaggaatagtagaagtagagtatagagtccatatagaaatacaattaggaagtaatagaaatttggaattaaaaataaggaatattagaagtagagtatagagtccatatagaaatacaattaagaaaaaaaaaatagaaattcggaattaaaaaataaggaatattagaagtagagtataaagtacatataggaatttaaaactaactaaaatttggaataaacataatacaattaaaagtagagtttagagtccgtaaaaaatacaatttacaaataaataaaatttgaaattaagaaaaacatgggaagaagagtttaaagtcaatataggaatacaatttagaagtaactgaaattcgaaattaaaaattaaagaatattgaaagatgagtntagagtc

SEQ ID NO: 97358 - DNA, 547 bp, Oryza sativa
ctgcagccctattccttatttttaatttcgaatttcagctatttctaaattgtatttctatttggactctgccttttctttttcttcgattaatgtgagaatttctaggccataagagcgaacgtggaggctcctttttctattcctttaataatataatagatcatttagatattagatatatgaacataagcgaaagagcctgtagcctagtggttacacgagcctcagtggaaccataggtcacagtgggttcaactccccatgagagcgaattttttaggatttaatggctttgtgctttcaatggtaggtgatgcaaccgtcgacagcgaggtgttctgtggtgtgtttgcgttgtagtgttgtactgtgtattttttttttaaaaaaagaagatatatgaacagtcaacctgctcgcgacttctaagggccttgaaacagcagcctgggccacaaacggcccgtccgatagtgtgacgatgtggcccaagctgagcaccacagctcgggctcattttcgcccatgcgcctgcagagctcgg

SEQ ID NO: 97359 - DNA, 532 bp, Oryza sativa
ttttgcataagatgttttctgagttctgacaatttgctgcctgatcaattgctaacagtttgattagtccctgtgtaatttagtagtactgctttagtggacgcggcaatgtggcttatattttcgtcgtcttttcattatatgcgtaataaaaactgaatgattgaatgtgtgtacaatacatctgagttggaccagcatcgctggtgctactctaggacagtatgtttcataattgaaagtttgaaaagaggcacctaatcatgtattccactgacttattttaacacttggaatagccttttggattgattatttggcaagtacaaatatactaatgcctgcagaacaattttcattttttgtcgaacttggaagtgagtgattagtaaattaagtaggagtactaatgcaacctgaggctgtcgactctgatgaagtatccatgcattctggatgtcactacatgtctacatgatgtctgcttttgcttctcagtagagaaattcatgccattactgtttgagaactg

SEQ ID NO: 97360 - DNA, 525 bp, Oryza sativa
gtcagtttcagcacttctatcgacatgaagaagatagaaagggccatgcgagagagagtgtgtgagaaagagaagattctaccgggcacaacaaagtgtgtaaatgcataaagaaaagattctactgggcacatcatagtaaggctattctcagctcaataactaggatggtgtccatagcattaaataagctgctacctaatatgaaaaatgatgtggcaagtgagtaaatgaggaaagagaagaaaacaaggtcttgcatgagacatggtttctacacaacattgaagacatcatgtgagataaatttaatttaagcatgaaaaagtggtgtttgtattgaaaaagtagtgtctaatactagtttattgatgatgtgaagtttatgaaaactaccgtgtagtgtcttgggttggtactgcctaaaggggccggctagctatataaactgtacagatgcagagaagcttgcacaactagtgcatccctgtcactgtttggctagcttaaccttcctgacatcta

SEQ ID NO: 97361 - DNA, 671 bp, Oryza sativa
aaccgttcatcttattcaaaaacttttgtaaaagatgtaaaactatatgtatacataaaagtatatttaacaataaatcaaatgatatgaaaagaattaataattacttaaattttttgaataagacgaacggttaaacatgtttgaaaaagtcaacggagtcaaatatttaaggacggagggggtaatggagtatattgatatatatacttgatctttattactctcttcatgcccatttgtcaacgtataaattatacaagttcctccacgtacaaatccactttcaaggagtacctgcagtacacaaaaaaggccttgttaaaagccaaataaaggcataactaaccaacctatgtggccatatataggtgaacatgcatgtaggtgatagatcagagagtacaatatgcagtacacacacattcagttacctagttggcctcttcttccttaatttttccctttaaattttcagagacccatatatgcatctccgtgtcattttccactggtcacaaacggaagcaatgggcgtacgcgaggccgccattaatcgcgtgtgtgttctagctatatttcttcttttgctcaaccaccgggctgctccaatggcggccggcccaggaggaccccatggctctgtggccacgaacttcacctgccattgg

SEQ ID NO: 97362 - DNA, 576 bp, Oryza sativa
aaatattagttgcctggagttttcttgatctggtgtaagactgccacttagtctccaaaatgtccttttgcactcttagatctatcaagctacaggtgaaccttcactaactcagatgtgacgggtgtcatcttgtcaattcaggaatacaaaccaaactctatattacgaggcatggtctcaatgcttatactgaaggctggattcaaaagatatgcaccagtgtgtaaaggcctatagaaagctgtgattcccatctttcatcaatgattttcaatataggcatgtagtttctcttcacattattgttaaaattttatttaattctttctttgcatggaccatatgctcataaatgtatggcatggcaggcttttcatctgaatcaactaagcgcagaactttgaccaaaggcatatgttagacgattaggccaaaatccattagtatctagcacgatttgtcctactgtcttccctcttcagtttttggaaatcttcatgaatagaagtaaacaagtagtctttagtttacagcaagaatgctaaatacaaagtggttaaagactaaaactat

SEQ ID NO: 97363 - DNA, 781 bp, Oryza sativa
cgtgaaacatatactgtaattgtctagatcaatagtcaattcctatacacagattatggtatagtgcttcgcacacggattatggaagagtacttcgcacgactaaggctatgtttgtttcagcttaagattattataatctagattattaaattagattactctaagctggattataataagctgacataaaataagctgcgagttgttgctgacataaaatagctacgagttatttgtttctcaggattattagaggcatataaggtagtgggtctttagccactcaataatctggaaaaagctcatctagaggagattattggattatactaatctggcttatagattataataatctaacataataatctacttgtttgtttcagcttacttctaataattcagattataatactcctaagctgaatcaaacagggcctaagtggctgctaaaatttaaaattgaaaagaaagaagtaaaaggacctgaccttgaattagacctctatccactactctgaaattgtgtggattttttagttaaacacggtaggataaaatgattaatttagaagggataaagattttcctaactatgtcaatctttaatgggaatcttgatggagtcgaaccatcactcccagcaattgctcgctgggatgctctttccaattcagagctataagatccacgatgtcggagagttcattataaaactaggtaataccccgcgctttgctgcggaatttatagatgaatatatgttaaatattgccga

SEQ ID NO: 97364 - DNA, 548 bp, Oryza sativa
tgtcctgcaatgaaccctgtaaacggttaattaatttgcctagcgagtttacaagatgaaaactttggtcatcgcatattttatcacgagatggtggtacagcaaagggcaaaattatgagagctggtttttagtttgatatgctaaaactctctctcatgatttacgctggtgactctgcgttgccactctcaggtacaatctgatcctgatatttcaatcggattgtacctttcgttttcaaagcatgtccagtttgggcgtttggagttggaccttttggatgtcgaatttgaaaacaaatgacagcatcatttcagaacgtatgtcttcttttttggatccggtaagaaatggactgatttgtatgattgtttgcatactaagggcccctttgaatcgcaggaatgagaaaacataggaataggaaaaacgcgggattttgataggaatgtaagtgtaaaacagaggattgcaaaacacaggaaaaacacaggaatggtcgtttgattggaccgcaggaaaaacacaggaattagaggagagat

SEQ ID NO: 97365 - DNA, 556 bp, Oryza sativa
tggccaggaaggcaggaaggagcccatgcaccaaattgtaagtggcagaggataaaaataataataataattgtacgaggcataatcctcggggtggtatacaagcctcagatttagaaaatgtgctcaacttttcatccaagtagaattgaattcagtgaacttttcccctgtcgctgctagaacaggctgggacaggtacatgctatgttttccctaggatggtgaaatacggttatttgatgtcatggtccttggaaacctttagtatgagaatgccatttcattgaattcgtgggtggtatatacctccacatcccttaaagaggcaaaaaaaaaaagagaattaattagctaaacggatgaaaaaaagactggacgattggcaaggtacaagatggaatttttgacataacatttgatcattggtcaaattaaaaatacaaatatatattgatcaggtttaaagtacatttggtaaaaaaaaaatcaaagcaataatacatatcacgaataatgaccaaatatcatgtctaaaagttaatgttgccataca

SEQ ID NO: 97366 - DNA, 3188 bp, Oryza sativa
gggtagcggagggatggtggtgccggcagagcccgagccttggcgggtgaccagcgatgcgcgacacgcatgccaggttgcgccggtagcgatggtggaagagacgacgtggcgacccaacggcctcggcgcggcgtagccttccctgccggctttggatgtggcggttggcacgtgtggtggacgattggcctctccctcagcaagatcaggtcccctccgccggatttgaggcgagagcgtcgtgcttcggcggacgttccagtgccgcaagcactgtgacggagggtgtcatcggcatggcgtagaggatggcaaggcgacggcagagacggtcttgtggcctgaggatgacgcgggcaacaggatcatggcggagtcggcagttgcattgtcaggggggaactgcggttctttgacgggcttcaatccagacttttgtcctcttgcgacagcgcctttgccaacaaaagatggtcacgtcaggcaggctagtgtgcgggagaggggatcaattcttctctctcaccctctcctcatccaacccaattgcatggatggagctggagcgagccggggtcgagctcctcaacgatgattggctggcgatgtggcgccggcgcagtggccgcgtgttgaaggctttcgtcgatgttggcagtggaccgtgcagaagcttgttcttgggagggttgaaaattatgggtgaaagttctgccttcgggttggcaacaacgacgcctgagggcgccattttcctcttgtggtgttgctgcattttctttccctctcaattactttctttaggtgaaaaccttgtcctagctctctgggacgggacacaacggtgctattggtgttgttccctttttggaggcatcatctcgaagatatcatgtttcattcttgctgcgggtgttgttgtagacacgcgttgtggttgttttttttcttttttgactatagtcttccaggactatagaattgtatttttctcctgctatatcaatacttgaaactcgtattgtctcgtgcggtttgttaaaaaaatatatagataaaagtgatatttgggggtagttttttaattttctcattaaattaactgtgggtccaccgtgggccgtggtgcgggcatagctgcacacgcggcagttgcaaagtccgaaaatgggtggttggcacgaacggtacggacccatctcaaatttagtcacgtttcctttgtcgctttcgctgtcgctgctatatgcttcaatgtgatcatcgattaattaagcagcttaattttgttctagattaatcgacgccctttgccgatctaatagtcctacgttaatagtcctagattaattaagcagcttaattttgttctagattaatagtcctacgttactatgtctactgttgttgtacggttttctgaatttctgtcatcttttgaggctgggagaacagaatagtagagaaaatagctccactcaacgaacttggctccaacggcgcaaaaaaatcttctttatctgtttgttatttgacagcctcttgcggtttaagaaaaaagataatcgccacacgtgccaattattaactttcacgtgatcaaaatatcttactgaagcttagatataacaacaaaccaaacaacctacttcactactcgctctgtccaaaaaaaaaaggcaaaccacggatttccgtgccaacatttgattgtccgtcttatatgaaaattttttataattagtatttttattgttgttagatgataaaacatgattaatactttatgcgtgacttatctttttaattttttttataatttttttaaataagacagacggtcaatcgttggacacggcaaccagggtttgtcttttttttaggacggagggagtagccacttgtgactatggctggctgcagtacagtacgtacaagccaatataaattttactgtatttgttgtagatgttgtatttgttgtagatatactacgtccaccaaacacacacactagaactccgacgacacatgactataatgagctagctcaacaaaccattggttgtgtatatcctagatatcaggcttttaatttatttatttatttattaaaaaactcaacaaaccacagtgatcttgtctgatctgttgctaacatgataacctccttgcggccccgattaaaaaacagccaaatttaccaattataaaatataattaagttcataaaactaccaaatttaccaattataaaatatactccgtaattaaattattaagctcatgccatatattccgtacatgaagaacattatctaactttgcacatatacgataataaaccaacaatccactaaaattatgattatatgcgccaaaatgagctagcttaaaaaccaaacaacccactaaacctcaaactatggcccgttattttctccaacaaaagtcggatgaaaatttgaatattcgtggcatgcttttcaaactgctaaatggtgtgttttgtgcggaaaatttctatatgaaagttactctaaaatatcatataaatatatttttcaagtatataataattaaaactcaattaatcgtacattaataccacctcattttacgtaaaaacacttaatctttatttttatcttcatctacctgagtttcaaacaccattaatgtacaagttcactagctccatttgataaatttgggaagtgtggttatggtaaacgagggagttgcaaaagcaaaacgagctttcgaaccagagaaaattccttgtgtacacctcagaactctctcaatcccttctatgcacctgaaaaataccgaatcccttgtgtgccctcgaaaatttgtttggaacccttgcgtacccctcccgtcaagtttctgtcagtttagatgttaattttcttagaaatgtccattatgccctttgagaatggtggatatgaaatttgatcatagttggctgattaaagagctccctatatgttgaatattttttttcatgatgtgtgctttatgatactaaataatcagttgatagaaaatttaaaataaattttgagaaaagttagtacactgcaattttgaaaataaataagtggatatagctagctgaaaatactaagattagtacattgcaattttaaaaataaatatgtggctataactag

SEQ ID NO: 97367 - DNA, 727 bp, Oryza sativa
ttcctgcagccctttcgtcgtcttgtttgagctaatactccaaaaattgagggcagcgcatcatgacagattgacgggacacgtagagacaaaagttgtgatgaaacaggaagtgtttcaaattagtaattgtatacgtaatatttttagtatcaattggaggaaccagcgagtcatccgctacagtgcaaatgcaaccagaaacagacgggttctttttttaaaaaaaaaaagaaaaaaaaagcagaaacagacggagatgctcatctactctacggagtatagtgtactcctacttgccactagtgtggtacgtagttttatactttattgttgaggggaataccacgtgtggtatttgcaatatgctgccaaacgacaacggaagtctgtggactgtgtggcatgtatgctgaccttttgttttgcttcactacactcgcaacaaaaaaatgtcatatttgtttggctggaccgccgtataaaagtaaacgagacagcaaaaaaggattttatatttctactctataagcgtcatgaaagtaaaggccgaaaagaaagataaaatatctactggttaacgaggatcattcttttgcggtgaatgcttaattaagtatttaataactactggcaaaaataacttcttatatatcgcagaatcactcacatcagtgtcagtaatttgccctatgtttttagatcaagatttgagctccatatgttc

SEQ ID NO: 97368 - DNA, 575 bp, Oryza sativa
aagcggcgcgagggagacatgggtcgcctggcgaaaggatcaatcacaatcctatggctgaaggcggcgactggacttagtgactacctggtggttaaagagaataccactgcaaatgctgagtcactgcttcaaacaaaatgactacacaggaaacctcctaactcaggtggatattataaattaaactttatagcatgggacacatgcatatatatatgaatagagcgaaatatatatgtacctagactctgtgacatatatatgaatataaacaatgctaacaaatctgataacaatattaaataaaatcattgaatcgaacatgtgagttgatcgatcatgtacctgggagaaacaggctcatgtgacgaagaacacacgaggcgtagcactcggccaacaccttcgtcaccttgagtgagctgagctcaatatgctggacaacctgagcaccatcatacagggtgtccacgaacaccatgtcggtgccctatgctaagcccaacagacgaggtaacatggcgtcctctggaatcacgaggtcgaggacgatcaccctgaactgaacccac

SEQ ID NO: 97369 - DNA, 517 bp, Oryza sativa
tgataagagaagtaaaataagttatgtcacataataaagtgctatttcactatttatcatctaataacggtaaaaatattaatcgtaaaaaaaattcacatgagacgaacggtcaaaagtgagacataaacagtgcataaactgcacttattttgggacagaaggaatactgtgttattattttgagggaaacgggataggtacgggcagaaaatttttgatatttgcgtaaattaactacgaagctagagactccctccgtcccataatagatgacgttgtatgactgtctattggcaacgtctgaccattcgcacttttgaaaaattagtgcaaatataaaaaaggataagtcatatgtaaagtatttgagatgataaagaaaatgacaaataaaataaatagataattttaaatttttttgaataagacgaatgatcaaacattgacaacaaaaactcaaaaagacaagtgatatgggacggaggtagtactatttagcagcaattgtaatacg

SEQ ID NO: 97370 - DNA, 1259 bp, Oryza sativa
accacgatgcaaccacccgatcaccagctagaccgttggactggtgaaccaacaggttagctaatgttgatattttcttttacattgcatggaagaaacactcacaactatgcacgctcgccacactcgtcactcgttaaggtgccctataacacatgtttgaagagaaagaagtcagcggcaaaattaatccctaatcttattaaaatcttattgaaaatacgtcgagcgtacatgatttttggtgtgcaccaagacttaaactcttgtgtgtacatgatctttaatttcttccgtaaatccgtctatgttcttttggaattggggatgtttgatttgaacagatcacaatgagaatgcaaagaggtgtttcaccctactttcaatcaccgatcgatttcacacactagctaaatactgactgatcaggaagaatgggatgatcctaatctgctagctttgcgtggcgcctgatctttagactcagtttgcactcatcttatcagcttcttattaatatccacacaaaatgcttattattacctcatctgaaccgtgggtttggaaatccctgttctaaactttgtgggggcatgttcaattatagactctagtataaacctacagtacgaggttatttaaaaaccatgtctatacaacagtcaaaaggaaaaaagactctaaccattaactaaaaaaaaaatttgttgttatctttttttcactcatataaccttgtttccattttatggaggctaagtagatgttgagttcgctgttaacccaacaatgatgttttgtctctcatgtttctctcttctaaatctaaataaatattcttaataattagtaaaactaaaagtcatctattaatgatgattgtacataccctgataaataagtagcgaccaactttccatcagataagtctagcgaaagacgaccttttcactctcagtactccagctaattaaattcatacatacatggtataaacacagctttccttctgcaaaagccaagttggcacagatcgaaaagatgaacctgtttccttctctagttcacactcgttttcacgaatatggtgacgctgccatccagacaaacggccatcgtcggcttgacaagctgatgaacacccaacatcgccatctcctgcacaattgccacacagctatagcctgtttgagagggagtaagaataggagatgaagagtttgagaggataagtcatacggattatatacggtacatca

SEQ ID NO: 97371 - DNA, 739 bp, Oryza sativa
gagatagctcatctgtttagtttttctagaacctatgtacccggatttgagttctaaactgggtctttttataattctatggagagtaataatctgcaattccctttctcagagatttgaatgttgaaattacctttcaaaattaaggtggtctcatatatggttgctccttagaaatggtatccttaccaaagataatttccttagatggggctggaaaggggataatttccttattggtataataatctaattgtgaaactattggacacttatttatgaaatgtgctcaggcttgatttgtggagaacgtaattaatatcactttcaatttgggtgcaatttagaatatcccacacatatttgagggatgaaacaattttggaaaagaaatgaggaagctaatagaggtaggtgtataaccgttgttccgtgagcaatttggacaaaaagagaaatggtgcttttttttaaaaaaaaattactgctaatagaggtaggcttgattactcgcccgttggagcgaatcagacatgtctatttttgagtttcattccaaactattttaaataaatcacaggaagagacataagaaatataattttatgagtgagagatgtgggtaggtcagacgctaaataggatggcaagtgacatatatataatgcgagatatggccaacgaccttggagaagaagactaagatgaattctctaagtcttggcatgaaggttttatt

SEQ ID NO: 97372 - DNA, 785 bp, Oryza sativa
attgtgtgagtgatatgtgtctgaacataccattaaatttcttcaaaactgtgaaaaaaaatgaatttgttgaacttctacataggaaaaaaaatcaaacatttgatctatccttaatttggttgtcaatatatcatgtgccttaatgagacgattcaatccaaagaactttgatttccttactctcacaagtttagcttagacatatttcacactgtcacactatgtgtataaatgatagagatgataattacctagcagcattttattattcagttgattcaaatgtcatgtgaccttaatctattctctattaaaatttcgatgaatgattttttagatacgtgtgaccttgagttgcccttaatttataagatatatcttacgaacaaaatataatcttatatttaaataatatggatgcccgcgcgttgcgcgggccacctttctagttattattagttattatgttttaaaggacaaaatgtatgtagtatatccatccaaatatataaagatttttggatggatataacacatttagtactacaatacaaatttagacagacttttggagcggagggagtatgtaaggatacggcatttaaaagtggatcagtatactcgatccatgacctttgatagtgaagtgacctctagccatgttgcccctgactgtgatggtgataaaaagggagccatatctttgactgacaatcaaagctagctatatcttctaacaagatcgatatatatgctcatgcatgatctgtttatctgggagt

SEQ ID NO: 97373 - DNA, 722 bp, Oryza sativa
tcatagtttaagctagagaggaaatattaattagttgtttccatatatgacgtgacatgtatatgcatatatatgacttccaggtgcaccgttaccgtttgtttatgacactgaagttaaaccttagatcggaaattcggaaaggaaaacatttgacctgtacgcataaaattctcaagggtccggtgtagttatatttatagcgccgtattttttacttaaaaaataggcaacacgtatttatattgtaagtctctaaattacatatgtaaatttagtgtatttataatataagtttcaaaattacatatgtaagtctcaaaattatatagtttttacatgtgtaaatggtgtgtaagtgggatgtaagtggggtgtaaatttgtattaaggaatagcatgcatgcatgcatataacacgaaattaattaggagccgtttcactcggatttgcatgactttagaggttagctagcatgctttcaggtctcttggcaaggaaaaagtatggaagcacggatcttaaacacagatccaacggccagagaactaattgtaatcaactaaaaaatttgtcgacacaattatagcaaatacgaattctcaatggctacgcgttgaaatggaaggcgacgatcaatttgtttcgctggtcggtcaatttgttcgtcttacaaccttaaaacatgcgtgtacgactcgatctatatatgtgtcacgtt

SEQ ID NO: 97374 - DNA, 575 bp, Oryza sativa
tatcatcaacttgcatgctctgcgtgtgcaagaagattccagaaaagaagaaaaaatgtgctagagtggttgtattaaggtagcagatttggtagtcctagctttgcttgatccattgctttaggccatgaaggcatataacggagggataagcccagattagcaccacatgacatggaagtgaaaggcgtgtgctcaccaaccatgtaaccactcaaaatctcacccttttcttttgtccacaaagctttttctatatgcaactatagtcttaattaattaattcaacaggaggcatcttattaccatttgaaagctagatatatgaccaggaggcatgcatgtacacatatatagctagctagctatttgatttgaacaatataaaggccttgataagtgctactaatccataacaacactagtagtatccgggttctcaatcacattgtggaccattttggcatatcattttgtgcgctcaatcttgataagtactcccttaagtttttgtttgcaacgtttgaccactcgtcttattcatttttttttgaaattattatttattttatttg

SEQ ID NO: 97375 - DNA, 1069 bp, Oryza sativa
ctagcgggcaccaagcctcttgtctctcgagccgtcagatgatcgatcagctgcgaggatccatcacaatcttccattcttcctgcatgtagtggagattgcaactgatacatctcacgtttgtcaagagttagatttgttactgtattttggtgataaatataatgaaataatgaggcgaagaattatactgttatgtacacacagctatacatgcaaaccacatcaatgttcacaccagctacagttgacaaccatttacaactgctgcaaccacagcagctgtggctggaggcctgaacacactctatgagtgtgcctctaaaacaagcataaatagattgtttttccctattaagtttatgttcaaaaaaaatagagatatctctccaaaatgacaatggtttgttatgcttaaggctatcactggatttagtggagctacatgcacaggtgtaaatattttatgtttaaggtaaaggtttggtgcaacttgtaaaacttttaaaccatcaattttgtattagaataaattaattatatcatgatagttctttcaagacaaatatacccataccattccttttattctttttaaagctaattaaacatttgataacattgagtagttaaagttttagaagtttgaccaaatatatcctaatcatcaaatgtttataattggagagagaggaagggggaggagaaagaaacatggatgttaagcttaatatcaaccatgattgctatttcacgcgtacgcgccagcttgccagctgtgcccgcctcctagcgctctttctttttttctgattttctttcctatttttctgttacacgtttatcccatatcacggaaaaaagtttctttttttatttttcttttcttttctggaaactatcatgtgtgtttctttttcctttttttctgactaaaacaaacttttaagtaagatttgaaatcttctcaacttatattcgaaaattttcaattcaagatttaaaagcttaaacatatatttaaaatcattccatatagatttgaaaattttcaagtttgaaaactttt

SEQ ID NO: 97376 - DNA, 766 bp, Oryza sativa
ctaggttgagtactgaacacaacaacatgtactagatcaaaaacattagttagagcaggtacatagcaagctataagccgaatatgatacgcgatgaaaagagaagagagaagaaagcaagctatttgtctagctgtaacatagactatgatatgcgatgaaaagagaagagagaagaaagcaagctatttgttatgtccaacatattactccctccgtattttaatgtatgacgccgttgactttttaacaaacgtttgatcttttgtcttactaaaaatttttaatcttttgtcttactaaaaaaatttatgtaattatcatttattttattgtgatttgatttatcatcaaatgttctttaagcatgacataataagcatgacataagtattttttttatttgcataaaaaaattgaatcatgttcttttaagcatgacataagtattttttatttgcataaaaaaattaaataagacgaatggttaaatattggttaaaaagttaacggcgtcatacattaaaatacggagggagagggagtatatgggtataatacctgagaccaggtattaatggtgtagtatatttttatacttaattattgtattaattgactgttagaatagcgatagatgatttagatctaacatttggctatactattagggacaattgcatccatgcccctacttttaattccaactactgttttaccctcactttttaaggtttgcaattttacccccatttttttaaaacgt

SEQ ID NO: 97377 - DNA, 777 bp, Oryza sativa
gggcgggcggcggcgccggcgggcccgggtggtggagcctcaacgtggagggcgtaatgctgctgctcagggtcgtccaggcggtcagggggcggaagctgccggcgccggagaagaggacgcgcgacggggcgagcgacgccgccggcctgagaggcggcggcatcatgggcggcggcggcggcggcgccgcgaggcggtggtgcggcggccggccgaagaagctgggcaacacggtgggcgcgtgtggaactcctgatctgaggctttgtgttaatgttcccaaaagtgaaccgagagagagagagagattattaataggtaattaagcggaggattaggttaatgatatagagtttaacaagttgatctgtactgttagatgcatgatcaggtactaatgcttggtcatagtgtttcttgttctgcttctaataatattcatgaatcggtgtttaattagttactggttttacatttgtgagttgtgactgatatcctaaattaaaagcggattaaattaaggccgcttgcgtttgaatcacacaactctagctattgacggctgaaaaaaagaacgggtcattagcgtataattaatcaataataaattgagtattacggatataatcaatcaatattgatcgagtattagggtatgtttggtgcctaactcttcagaaaagattagcgcattattaattaataattagttagtattaggtacgtttggtagcagctaagaattaatcgagtagccacttataagagcaagtg

SEQ ID NO: 97378 - DNA, 783 bp, Oryza sativa
ttctggccggtcggcggtggcaacatgaaccgaattggttttggaagtactccgtatttgacgttactgtaaaattatattagctgtataagtaatttctggtttgtagatatgatgaaactggccactcatgttttagtttgtgttaattcaatccagtctccactgattattttatttggtgaagacgagattaattgttgtacatgttttttagactaattaattaataatttgttaatgtttttcaaaataaatcggctagccgtcaatttaaatgaatagagtaggaaaaaactgtatgcaaataaaaactgtaagaacatgtacaagttaggtcccgagatgtgggctagtgattaagataacaagtacatctgtttcacaatgtaagttattatagcatttttcacattcatattgatgttaatcaatctagatagatatatatgtctagattcaatatgaatttaagaaaagttagaatgacttatattataaaatagagggagtagtagcgagttccctagccattgcaaggacccgtgttttgccctcttcttttatcttggttagggatgttgagatctcttaataatgttaaaattgaaatttcttttgtatttttttcccatatctcttagaggactagcaaagctaatatacggactacttgctttgaggctgcacaattttttcatgtaagaccgacttgagttcttaatttttattcagactttcaacttttccatcacatcaaacttttctatatacataaacttt

SEQ ID NO: 97379 - DNA, 1002 bp, Oryza sativa
ccaaaaaaaaatctaacctatttaaaataaatataatttagtattataaatcaaaacagtattaaaatatgtcacatctctaaaaaaacaagtaatataatacttaatgtgttattcataaaagatactaaatgagattggatgatgaagtggaggagagaaatgagaaaaggagaagatatatcacttttcatagagtgacaactttcacacaaactttaaataaaataaaataaaaagtgaattggacaaacaaataaaattacatcatagggttagtatgctagagatagtgtaaatatctattttatcttacatacatggataaaattatacgtggcaaactatccattctataaaacctgctctagttggtgttaggttcttttctacggacaaattactctatccatccaaaaacaaaccaccacgttttgtagtacgaatttaaacagttatattatttttgctttatatggaatgaaactagtactcactctctcccataaaaaaatgaatctaggattaatatgacatattctagtacaatgaatctaaatatatttgtatatttagatttataatattaaaatgtgttacatatgttggtcttttagtgacggaggaagtaggtgcgtaggaaggccatggccgcacggccgccgccgggtcagtggctggaccagtggaagcgtacgggaaatactagtctccagaaaacggctctcacaacttctttattggctggcactctaccagcagtactatacacaaaaacggtgtctcactagttctttactagtacactagtacacacgtttgagctgaaaaagtctccagagcacacttctctcagaacttctttggcagcactccacagtctccgctacagcacgctgtccagcttactagtcctttacactcagctcgtttcgagctgaaacttgttgtttcgaggcaatgttctttttttagagctagggatgtaaacagagcgggtaa

SEQ ID NO: 97380 - DNA, 1269 bp, Oryza sativa
tgattaaatttcgttagctgttcgtgtttagctttttgcgctcagaagttcatcaacatggcaacttgcatcgcatgcgagtaattaaatgattgggttcagtgctggtaggctgggaccggggtggctggattcacatccaaataatctccataatacatcttgataacaaatattgaaatatatatctacattctaaatattaattcttctatttcatctgtactttctccatcctataatattaagcacacccaacactaccaaaaaagtctaaaataattatcgcatggtctgaatcatatgttcaaatatgatcgagaatatacgatcctagaggatcttctctaattaatatcgatctagtatttctgatgatatccatttatctcgcttcaattgttattttgctttcctttttatccaaccaaactaaaatatgtgcatgtcaaaaacctatatcttttttattatgttaaatataaaatggcttttctaaatagaaccgatggcatttttttcatctagttttttatgaaatactcggactataataataaaaaagaccccttcatgtttttagttgatgtatcttttttttcttgctagctatttccttttcatgtttgattcctacatccgttttatagtacaagtagaaaaacatagcaatattttcaacacaaaattaacatattatcaaagtatattaaatattagttttaatgaaactaatgtggcattgtagatgttgttaaatcttttctataaacttaaatcaaactaaaagaaattgactagtaaaagagacaaagctagttataatataaaatggagggagtattcttttttttcatttaattatatgctttgtgccatcggtgtacttatatataccacagcgccttttttttatggaaaattgcaaccaaaaaaaaaaccccaaatgttactctgtgtttgaaatttccataagatttaaaaattgcccctcgatctcctaattcccctttgtttgagattcctcctgtatttttctctttccacctgtgttatatgaattagggcatctcatgatggatactatttcaaacacattttcttcctcatcttaatctgtccaataaatcaggcagctcacgaaaccccatgaggcaagcgtaatatatagctcatcttccgtcgtccgcaatgtcttgtagaggagactcgtgacccctttcgcccaatgacgtactgagtaccatgcataggatgccggaacccccc

SEQ ID NO: 97381 - DNA, 517 bp, Oryza sativa
attattgaaaaccgtgtaaaaaaatataggttttataatttggaacaaataaagtatatatttatatgaaactactatgtgtaggctattatattagttataaataacatggttaatttttagagctatcagctgagtatactattaaacgttgctcttatgtcgttagctgtgatatgctgcctcgggcaacctagaaaaactcgaggagtcgcgcggccacttgcggttgcgggggaaaaaaaacacgaaagcataggcatccacgcgatcctacgatgccagcgcgtgcggatgccgcgcccaaaaaccggtagctggtttcgccgccccgtagggagcgcaggcagtttcacgcgcgcggcccttggttcgctccgcgcaacgcgcgcgcgagcccaaaaaaaaaaaacgacgggggaatcatcgcctccgctgctggggttgtggcttttttgccctttggcgcctagctacgtaccaacccacatcacgcgcgtgcgcgtggtggcacact

SEQ ID NO: 97382 - DNA, 616 bp, Oryza sativa
attttttttctaatatgtcattcggcatattatcagtatatggccaaaagatggggcattaaatttataaaaatcaaacattgaaagttgggagcattagaacaatttagttaatcaacaaatgtaatccttctctctcttgtttttcttacatccacgtagttaaaagccttacatgacaatatctcctaaatagtgacaccgcaaaattgttcatgtcataagagaaaagcgatgaccattagaacgacgctattagatggggatcgctttcgagagagtacacggtgcctcgtgcttacgcatttatataaatgacatctagcggataaaaacatcgtataaaaaatactacatataattttgaatagaagaatgttttgaaattctacttatcctataataatgatatcgcaataaagcctctttactttcaacatttttctgctacatatttttgtaaacttttgaatgtgccatgaaatgctttaatacaattggtaaatgagagatacactttgattctgttaattcctttttcattcgttggatcgcatgatgagctctaggataaatgtcattctcgtatccacaatttgatttaattaaccatatc

SEQ ID NO: 97383 - DNA, 633 bp, Oryza sativa
ctgtacactttcatccaaatgaccaaaatacccttgagacaaaactttcaaattttgcaaaaaaattttgaaatgtcagactttaagtttttggccaaattttaaatgtttacaatcttatgtttataatatggtatttcgaaatttttgtccacattttggaagtttttatatcagaggtattttggtcatttggacaaaattgtacagtagtaacggatataaaccggacggcgatggtaaatcataaaagttaagtaaaaatcgatggcatattgtagaacgtgacaaagtcagtggcaaatcgtagagctctaacaaactcagtgacatataatggattgtctcttgatcgagactaccgaatccagatagaattttgttaagattcctttattccaatcccacacaaaaccaatcagcctaccatcagcgagcaaacccaatccaattccggtcaacacctaatataatactctactcttgagtagtactacccccgcttttttaatactagaaaaaaaaatctgtgcgttgctatgggtgaactacacgttgtaaacatacaaaaggaaaacccatgaacaatttataagtaagcttttaattgagtttataaaaatacatacattt

SEQ ID NO: 97384 - DNA, 650 bp, Oryza sativa
cagtccacactgtgaaaagtctgcacttcctcctatttgggctgggcctgcaatcatcatcacttcaaactgttaaatgaggcatcaccaaaagctaagctttctgtatgagtatgatgatgatgatgatgaatcagtcgtcttctcatccaattcaagctagttacagccagcagcagcatcgaaaaccaaacaagatatttcaagggcagagccgacaagatactaccaacaatatgctatactagtaacgggagtaaaatgagactttttttcaacaatgactccagcaatgagctatctatcttatccaacaacaagctgcttgccttcaatgattacacgttcgaattcgccaggaaattctcccatatttaataattcattcttcttactcctacacttctccttcagtgatcatatcgagttacaggtctaacacgctgagagttgagagttgctgaggctgggaatacaattcatcagtatactaacaccaaaagttctctcacatatagccaacctaacaggtaaacatcacagccagctcaaccgctagcccatacatcatcttatctctagttactacccatatttgtaccccaagcatagattctatctcccgtcttcatccctttcttcctccacct

SEQ ID NO: 97385 - DNA, 584 bp, Oryza sativa
tcactactgcacgtccatagacatatatagttctcataggcgtgtttcgcggtgcatcggccgctttagctagtgacgtttgacaacgcctaggagtgacacgtgccggtgataataagctacatattctgaatctgaaagtcaagggaccagcccacgaatcatgttcgtccaacggatgccatttgacatatatgtaggattggagttgttagttttttaacaacagcgcacgtgcactagtgtaccttggggctccttcggattgcagaatctaaaattaattttgttaaatttaacattgaatgtattttgataatattaatcaaatgacttataatatggaaaggagggagtagcaaattttggtcgtaattttaaaaatgataatcatgtaagtatcattcgcgtatgcacatctgaatagcaaatccgtctgaatatgcgacggctgctatactctagatcgcacatttttttagatgagattgtacactcttgtttcggaagtttccagagagcgccgtatgttggattgcaataagtggcagcgatccaaattcttacgattaccaccctcccct

SEQ ID NO: 97386 - DNA, 1220 bp, Oryza sativa
tcacctcactaggtcaccgggttgaggtttagcactatgaaccatagtggaaaaaatcggaccaatagatgacccggtcatcttgctggttcaccgatctgacagtccaaccgtgaaccggccggtcgtaaccaatcaaccagggatcgactccccactagcgcacattttcattcgatttttgcgaaaaaaaaatcaagcctgcgcacaagtatggcccaaacacactaactgggccatcgtgtggcacattcattcactaacttgccttagtctggtccgaccaaaggcggtttattgcccggttcatcacaaaacaggccggttcaagcgatctgaagcggttcaattgtacgtccggtctttctattcgaccgaaccattgcaacctctggttccggttttttcgggttaaaccgctgacctagtctgattttttccactatgaaccctaccagcactagaccgatctttggttttggcgacgagccttgagagtcctcttggccgtgcatctctccctcttatacaagtgctagtgggcttgggggctaaaccgataaggatttaagttggttgttaactgatcaaactacctctagttcttatctactctattttatgttaggaagataacggtggaattatctatcctttaaaagtcatatgaatttatttttaaatttaaaatacttaatggctcaccttgttttatatatgctcttaattttttcatttccccctactctcaaattaagtggttacttggctagaagtccgtactccatagtgatggtgtgtggcaaagttacgatcattcgctccattgaaccgcaatcattctacgagcaatccgttaacaaatctaacaagagacacaaagcacgctgaacagtgaatcggacgaggagaaaatgcatgataattaagcactagccataggcgtggaaccagtgagggtgacaacaaagtcaactaataaccggtgatctggattattaatttgatattcttagttccagctaagtaagttccatctgcccagctgttttctgggatcaagctgttggtttaatttgatcttccagaggtcaggtcaacttccttgcattgcattatgggagagccaacagttacacatgaccaacatctttttgtccataacttatggaccattagtacattatgctagtaccattaatatattgattgatactttc

SEQ ID NO: 97387 - DNA, 707 bp, Oryza sativa
tacatctcagcaatagactagattaatagtaaaccacctcaataatatgtctacatgggtatctataactctctcatgtattgccttaatatctttcaattagaaaaatatgctgacatggatatgttgtagagagtttatatataactgttgtgggtgtcataatgcacatgggtggcgggaaaccgcgtagcctcagcgtccgcgccagcgacgactctcgtactctctctctctctctctcctctcgtctacaaaaaggatgggcctcattggccccacccacgtcgccctctggatgagggtggcattgaatgcgtgtgttggtgggacccaccaccacgcaggaggtgggcccacctgccagtgtcacaggggctcagtacgcagaaagagagagagatcaggtaaaaatggaatggaaaggagagccgccaaggcggccacaggtgaaagccgacgacgaccacgaccaggcgtttctctgactagtgagtgatacactgatactcctacaattaactgtggtgctttggttggttgctttggcatgtggtaactggcaatgtggcacgcgcgctgtccgtcactagcgattcttgtagagtgtagtacaactatctcatcatattttcacctgatctaagggcccgatcgagagcaggccattagcacatgattaattaagtattagctattttttttta

SEQ ID NO: 97388 - DNA, 874 bp, Oryza sativa
agttaatgaagtttcctaccctgcatatgcatcattgatttgctaattgctaccaccgatagtttgtatattccctcctgtttccattataaaacttggtgagaggttcatttctgttctccaccacctcaagtttaagttctcttggattcaattggggcatctatttcattaaggtcctttttgacataggaccaaatccatttggagttgagtatttagtcatagaaatctatggatatagagtcatgactgcattgataacatttggatgaattattttgttcctattttagagaaactttaaaccattgtagcttaactttcaaactccagatctagtgtggatatgggattttttttttacattcaatggatatgggatttggagttgtgccaaataggatctaagttgatactagcttagtatcaatttagtatccttcaaatttaaacatttcattttactgtgaagattacaattacatatttaaactgtggtgactatatgcaatggtggatctagcgcaaatttgtatctatggcgaacaccaaagtgtaaaccaaacccaacactaaaagaactccaaaaatagtagctgaacacaatttacaagggattagggtggtaacattttttttctaaacctgaagttataaacagatctttgtaacaatcaaacaatgccttcgtataaataaataaatgcaattggaaattagcacgttgaatgattgtttacatggttcaccatatgaatttccttccagtcactctcttcaacaaaatacctagcttctacaaagaagactctaattattaatctaacaatataacctatattatcttcctttcttttcttcatcctcatgt

SEQ ID NO: 97389 - DNA, 684 bp, Oryza sativa
tagttaacatatatttgtgatcaaatttatttttcccttgcaacgtacaggttaaatttgacattacatgtttgtggagtaatttatcacatatttaatctatgttgttgaatttttttcgtaaccatttagatgagatgtgaacaacgagggatgtcccctcgagagtttaaaatagttttccagctccttacggctttggttttttggcaacatgcacacactcgttcttatggacacaaactattcctgtgagtattttcgaaggactaaccaagatatatcttaaaattgttgaagtcgtcataagcgtctcgctgtcgaccgatatattgacgggtacttgtctaccactgaaaaaataattagtcgtaaatacgattactcgtgtcaaatttaaaacttgaatcaagtaaactgattctttcacaacaaacttgaccatatttgaagctacgttcgcttggcagctttagcttcgttgagcaaaggagaactcacgttgggccacacccagcccacaaaattaccaagtcctgaagcctctttacgctaggatttagcccaatccactattacacaccgactttgctgagctaggtcttcggtttcttgaggacgacgacgccccaaagcgcatgaacttgcataattcgaggctacttgcggacttcatttaatttt

SEQ ID NO: 97390 - DNA, 1305 bp, Oryza sativa
atttccacatatgttattaaagggagagagaaaagtatatatattgatgcgcgttgatcgatttaattaaatacgaaacgctattgttaggacctgttcattttagaggaatttcaatgcacgggaatagaaaaggtgggcaaagggtgaatagccaaaagtggtccttcaagttttatctaaagcttaagtttagttcttaatgtttcaatttatccatattagtcctttaagttctaattttagttcaaacttatccttgaacccatttagaagccacatggctaaatataacaacaactttcttgataaatgatacttataccccccctcattcatatatataagaaaaacaattgcattcaatgattgttttatagataatgcacagtaatttatgtaaaatgaaaataaattatgtacttacaagtgtatacgatagccattgcttaagtttaatgtgcacatattgaaataatgagaaataaatctgcaaatgtggttaattattctgggttttatcttttctaatgtatagtttgtatacaaactaaagggcaaaagagacattctctaacagaaatattgaatagaaatagccacatggcatattaagtgggtccaaagatgattttaaccaaaaacaaatatttagacgacatatgtggacaaaatgaaatctaaagtatcaaattgagcatttgatgaaacttgagggactaaattagctattcacccgtggggaaaataggaatacatgcacactccaatatataggaatttttcaagagatttgagtggattgaaaattttctaggtttttttctatacaacgtgtggaaaagaaaaatcttttatttttactatatctacatttatattacccgaatagtatccatagaaattaatcctgagaaatctaaatactttaaatttctataaaacaaaaaagcccttaaattgtcgaactatatattcacgaaaaaaaaaagacaatataactagcatcaggatgttaaactcacaggacacagcaattatgataattcgaatgaatttgggttcgttcaggtgtgtcaaaggtctgaagaaacggctggaaccaagtcaggaaacaacgtatatttgtttccacccagaataatgcaagatctcccaaggccactttgccattcgtctgcccaagccccaacggtggggaacataactggaagagtgcaccccctccgttgtttgtactgttatctctcctcttattaaaaagtttgtgcaaatataaaaaatgaaaagttatgtttaaagtag

SEQ ID NO: 97391 - DNA, 537 bp, Oryza sativa
cccaatgattaacaacgctcatggattggaactaattacacagattcatcccgatctgcaggtaacaaaaatatgcgaacctttctgcagccaatctatgcaatggtacagaagtgtaaacagataattggtggcttgcagagaagatgaatctgaattatataagcaggttgggtgcttcttgttggtggccatgtgagtatcagtatgtgacccagatgactcggatgacacagctctgctcgccgaccgatatgaaaatgacggtgatcgactgcgactgccaccagttggcggcggccgaacgagaccccccgcgtcgttcctcgtcgtcctccaccttcggctccctgcttaaactgcttcgccgacctgttaactatttggcaatgtacctgtgattggctccctttcctaaaccttccgatcctgtttctataaatcggttgagcgttctatagaagcttgatgcctatttgtacagctaccatgtatcaacatgcatgattatcgcattgagctgtatcatccaacatt

SEQ ID NO: 97392 - DNA, 1277 bp, Oryza sativa
aacccccaaaagttgaattggagaattcagctaaaagaatcaaaactttctaatcaaaaaattggacttggatgcaaaagagaaaaaaaaatcttaagctcatcaaaccgataaatttcaaaacaaaaaaaaggttaaagtgtttttttttatcaaaacacagtgagagaggccctcacggtaaattttattaagagaggaaaaaagagtatatacaaaggcccaagggccgaaagaggggagaggagaaaagagagaaaccaaaacagcaaaattacaattgatcaatccatgattgcactagaggtttatgagcaattgattcaatttatgataatttgcataaacaatgcaaaaatgtgggggtttttttttcacagaaagtcaactctatggttactctactataggaaatatatgagccgagtttgaaactcttggagctcagttgaaaaatgaaccagctggttgggctaagactagctatctcacaaactacaacatgcattctgatatatcatctctattagttcaaaaacatagaaaataagttaagtcatttaggtagcttatgtatttgatctgatcagttagttgaaattctcacatattgttcaataagttgacctaattaatagtctcgccgtggccggtgctttgctatctttaagaatttctttagccgaccatataagaatgtatgtacctgtaccactgcaatttggttagttcgtgcgtcacctaattcacttgattagatgaaatacttttataattactcggctgtgcatgtagtctatcttttttgagaaaattccctatatgcccctgaaaatttactcaatcccttcaatacccttgaatttgacatcatctcttatatacccctgagtttttattttgatctcctctatacccatctccgttagttgaccattagttgaccgttaaatattttaaaatgactatattacccatcctatacatatgtggtacctacccaataaattttcatatgaaaaaaataacttatacaaaatacaagcaatataatcatttaatgcccaacttaaaaaataaaacttattattttttatttttaaaaaattatgattaaatccatacattagtttcaccagaaaattaagagcaaaaactaaatgttatttaggtttaaatttttgggaagatatacgaaattcatcaaatttgatctgaaatttattttctaatttgtgataaactaagagaaaattccctatatgcccctgaaaatt

SEQ ID NO: 97393 - DNA, 912 bp, Oryza sativa
gggctggtcggttttgcaagctccagtggctttattgtgggggtaatggagctgccgccatttcgggctcaacatccttagagcatggcatcacaacaggtgttgatggtggcagtggtcagcggcgtgccgcttgcaaccatccaaaagggggttggtgtggccatcgcctcgtcatttgttctgctcttctgccctgtctcgtgctcaacgtcctataagtgtcttggtgatggtgactggatggttcgtcgaggcggtgagatggaggtggctgttgtggccggttggacaactttagctcgatgacgacaacttgaggtgatggcgaagtcgtgggcagtgccaatggcatcctgctctccatgtgataataaggtgcctgcacgagaagtgaaaacagtgggatccttagtagtgccggcggcaaccggattcaccctaatggccagatctgtttctacttcttgttttgcaagacaactacaacaaggagcggcattggcaggatgaaggcaagctggttggcaatgctagtgatggatggggtgcgacattggatctggggcctaaatgttgttgtattgtatccgaggtatccgtgcgtgacattatctatttgtgtagtagcaaaggtgaactggagggacttcttctttttctcctctgaatgacattggcaagcgaaggaagtagatgctgggagttactaaatttgaatcgattggatccagctgtcgatagggatatggtggggaaaggagcgaatcaaatatggatgtaacgtggatgaggagtataggagtttggattccatatcaagatcgacttggtgtggttcttggtacggcagggctcgttaagtagaagaaaaccgaagattagtcttctagtccttttctttttttattt

SEQ ID NO: 97394 - DNA, 680 bp, Oryza sativa
acctaatacaatgggatgcatatccatccgtgccccccccccccccccatacaatttacacatgaaaaaaaaaatttagcctagtcttttgataaggaccttgtgcacagaaaaacttctagctctctctctctcatcgccactgccgctttggttcacctattgcaatgggcatatgtagacaacagagtaagaatgggctaacactggctatgtgtcgagcgcaaagactagggttgtgtttagttggatccaaagtttagattttggttgaaattaaagatgatgtgattgaaaagttgtgtgtataacaggttaatgtgatggaaaagtactaaagtttggatccaaattttagatttaaagacagcctagctatagttgctagtggagagctagcagatggatgtagtgattgaaccgagcgatgacataataggatgatagttggatgcatcgaacatggagaacacaatcgtcacttcgatcatcatcctcgaggtcacaacttctgtcacccccaacaaactatgcccatcgcgtcgtctttgagcgctttgatctcaagtccccacgctagttgacattgcttttctatatttgttatcgtctcgccgcattcctactgctattgttactcccacagtttatgcattgtcttacatgtactccataactct

SEQ ID NO: 97395 - DNA, 1108 bp, Oryza sativa
tcctcttctaatattccctattttttaattccgaattttagctatttctaaattggatttatatatggactctgctttttctttttctccgattaatgtgagaatttctaggccatgagagccaacgtggagactcctttttctattcctttaataatataatagatgtgcgatgcatgtccagcagccgaaaatatccaatagagtaaagtgtacgggcggtccttaaacttgtaggggtatctcatctagttccctaaactctcaaaatgcatatccaagtcccaaaacttgtcatagtgtgtcatctagatcccaaatcaccaaaacccttcaggatcctacgtggcattgatgtggcatgccacacggatatgacgtggtattattttggctgacaaataggacccatttaaaatttttcctttttcttttttcttgtctttttcccctgtattctcctttctctgtgacccgagcagaagaaaggagaaaaggaagaatgagaagaaaacggaaaagaaaaaggaaaataaaagaagaaaaaaaaagaaaaggacatgtcacgtccatgtggcatgccacatcagcgccatgtaggattctagacgggacgtgtcgatttgggacctaaatgatatactttgacaagttctgagacatgaatatgcattttaagagttttagggatctatatgacacaaccctaccagattaaagaccgccaacacattttactctatcaaatatatatatttgcaagtttgtaataattaaaacttaattaatcatgtgctgacagctaacttattgttgcccgtcgtcgtcctccgattcgtgcctaccttgttgttgcccgttgtcgtcctccaatccacgccaccgctgcttcagccgcctctccgctcgttggccactgtctcttcgcttggacgccctgctatagtggaaggaggggaggggacgagcaaggaggggggaagagaagtaggtggttgagagggaaaggagctcgagggagaggccttccgtgggtcgtcggctgcggccggggcagcgaccatcatggcgcccatgctccatttcctccgctgatgtgaaaaaaaga

SEQ ID NO: 97396 - DNA, 738 bp, Oryza sativa
gggttctcattggaagatagataggtaaacataagagggtaaacttataaatactacctttgtcttaaaacccgttctaagcagatacatcaaacggctaattagccgcacatgaaaaatgtgattagcatataattaattgtattaattattaaaaactttttgatttttaatagcttgtatataaaagaaattttgtaggtaagacatcgtttagcaatttaaaaacatactaacggaaaatgagaaatagctaagttgaattagcacttcagaataaggtcttaaaattagtagctagaaataaaaaaaaattaggacgaagggagtagataaatactaaaccttctaaaccacttaagggcaatcccaacactcaaagggaaaaatatgaagaaactattatttcttataaagacactagctttaaaggaacaaaaataaggataaaaagaaagagaagggagatgatttgatgagagtttattttaaataaatcgtctatattgggtatatagtttctgcgtacattgtcgatataacatggtatatatgaaaactagtaatagtttttgggttaagattgttctaatgatcaaccttctatttatttccgctgaatgccacctcacagttgtacgttcgtaggcaagtggccaacaagataacagtgcccggccccatcatggttatgggaaacccattgcaatagcaaaccagttggatccaattggccat

SEQ ID NO: 97397 - DNA, 594 bp, Oryza sativa
atcattttacaagcatgcaaattatcactcgtacaagttaaaattaaaaaaaaacaattagaatgatatatcacatattaatctaacttatatttttattattattttttaattatctatatgacatgtaaaaaataagagtacatctctctaagagattaaaataagttctcaaataatattgcatatgactgggtgaagcaatagtttaattttgtagaacacatgttttacaaatatcttttttccttttatgatatggtgagaaaaataagtttgtgatatcttttttccttttatgatatggtgttgtgtgtgaccattattttgctccacttggcactaggtgaaagtatctgttaaaccagatgcaaatccccgagagaagagctcgagctccacagcctgagctttcaactgcttccacctgtgccaacagacgttgtcctcgacctaattataagcctccagttgcctccgtctaatagaaggagataaagagagggagaggtgatgcatatgacatgtgttctatgaattatttttaatgctttttgctaattgatctgtcacgtttgtatcaagtaagtcagc

SEQ ID NO: 97398 - DNA, 560 bp, Oryza sativa
ttagtatctgacgttgagaggagtagaggacggtgcgggtgaccgacagcaactttctactatatgccaaacttctggaaataggaaaaagttactactcgcaggcaatcgagacccagttttgtaccagcttatacggagtagttctgaattgaacagaggctgcgtgttttgttgacagtttgaagagaaaataatggtgaattacagattactaacttgtaagctatctgtactagtgctactccacacagagatagcgtgttttgtttgacataactttaactcgcttatttttagttggattttcttatggccttttttttaggcttttaagtctttttttcaatgatctataagtcggtggataaagttttaagtttaagggtgaagttatacatctactttacattaaaaaaaacttctccaattagtttgtggcttaatagtgtaagagtgacttataagttataactttgaaaagccaaacgaaaaacctatttttttgctttggattataagtttaaacaaagagaacgttaacgctagaaatccttaaa

SEQ ID NO: 97399 - DNA, 647 bp, Oryza sativa
acaagtttagggaccttcgctgtactttttccttttaagagatgtttctttttcgaagcattagcgggcacaaggacctgtgcagtcgtgctgaccttgggtgaagcatttgacagaagaattgggaattgatcctatcatcaacgttttcagaggaaacgagtagccgagtactccctccatctcatagtaggtgacgttttcgattttttatttataacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagtaggtattaggtaaacaccgtttggtggaccgaatatacaggtagcagagccgagggttgaagagagcctaaaaacttgctctgggtgaacaatgggccaaccccttctgcttctttgatccgatgctacattccgacgtttccaaaaaaaaaaaaaatcatgacaacgttgcaaacgccatgagaaaagagaacatactaatagcatcaggcatcaattaaatataatcttata

SEQ ID NO: 97400 - DNA, 1309 bp, Oryza sativa
agaaattaaagccaatgcagtggcatacgagtaggagtattttagttaccatgcggcacaagaaattgttctgctcatgcacggtctgatgctgcatttcatacagaaaatccatatattaattcagctcaccactcatcagcaaaaaccacaactgcgactacaataagggagtagtgtaccatgcgacgcatatcctccagctgctggctcatgagctcatcctgcacacaagcacctcatgcagttaacacattctgtcatataaactctaattgtgaatttgtgagcaaagaaaaaaaaatcgtggaggacttgtatattccataaggatttgatgctgatctgcactaatcttctgccatatttaagcaagtgctagtaccttcctcgcatgaactttgctgagagatgattcaagctgcagctgcagctggctgagctcatccactgtggacacagatgacaggtcttctccagtttgcctccttaaactggcttcgagctggtcgatctcattccttagccttgtgatctccatgaccatttgctgcaaggcagcatcacacatgtagattagttgtagaaatgaagctttgagtgattaggaatttggtgtgggacatgcaattgcctttcaaatgtaaaaaagaaaaaaataacatgtgttagattcagttcgcttacctcatcatcacggtttgtctcctgaagccgagtgtttctggtggtgatctcataacggtgaaacagctccatcaagcttaacaaagcataatcaaatatgttacatccagaaacaatatggtattactagtacattggaccaatgaagtgaacttatacatgtaaaaggagtattagcttctagtagtactaatcgatgtggtcatgggcactgcttaattgaagaatgcactatgcagcaagcacaagtcctataggaatagatcctgaaatcaaaatttcaggatgccagaaaagattaaatcagaaagaaaagcaagctctagaacatgaaccatcgaaagatttctagtgataatgttgaatgcaaggaaagcgatcccaatttcccaaatccactaccaatcatgaagaacactacccatttgatcgggatgttaatcgacagtacccccaaacatttatctggaatgctgagtgaaatatcaactgcaacaaataaatgcaatgctaaatttctgaatcatcgcacacaccaccaatcaccacaaagaactgaaaactcagctaaggcatgcagatatatagaaatcaagattagaaatcagcacacgggctgcag

SEQ ID NO: 97401 - DNA, 1116 bp, Oryza sativa
gtgtgtttgttacattttgtagttttattagtccgatttactccctccgttccaaaatataacaaattttatctcttagaatttattctaaaatataacttctctccaatattttcttctaactaattacaaccctccgtcattcatttttctcacctatctccactacttatccgatcacaaccctacatcattcacttctaactattttcttaataactgtgtccaactttaaaatttttatattctgtaatggagggagtaattaattaattaattgggtccggtttgatcttgattccactaaatgaaggcatttcctctttcttcgcaatataatactggtaatctgtcgtaatctttgaagaaagggagcaacaaaacaaacacaccagtacactactgattgttattctgaagtagtattattggtgcttaagggcccctttgaatcacaggaatgaagaaaacggaggaataggaaaaacataggattctgacaggaatgtaagtgtgaaacagaggattgcaaaacacaggaaaaatataggaatgaccatttgattggaccacaggaaaaacacaggaatttaaggagagataaaaactcaaaggatttcttctatgaggttctacatcttattaaaattcctccaaaacttgtacgggaagaggcattccataggaatttcataggattccatagggttcattcctttgattcaaaggactttgtaggaaacatttctatagaaatgaaatcctctaaaattcctataaattttctttgaaggggcctaaagaatgattaagctatcttccggtgcataaaggacgcggcacctgatgccaatggccaaaagcggacgaagaatcttattttggtagggatgatcaaaagagtttgaattgacagctggttgtcgagaaaggacgtgcactaaaaacgcacgccctgaaaccacactacatctcaaccacacgaacacaagctacaaaaaaagggacccaagcatcgaaacgactaatgctatttgagaccggacactgctagacttacaacaacaccataggacggaaactctaaaaacaacgtcttcattaaggtgcgacgtg

SEQ ID NO: 97402 - DNA, 500 bp, Oryza sativa
aaatacaatttagaagtagttaaaattcggaattaaagaataaggaatattagaagagaagactagagtccttacagaaatacaattaagaaataactgaaattcggaattaaaaaataaggaatattagaagtggagtatagagtccataaagaaatacaattaggaaataactgaaattcggaattaaaaataagtaatattagaagtggagtatagagtccatatataaatataattaggaaaattactgaaattcggaattaaaaataaggaatattagaagtagagtatagagtccatatagaaataaaattaggaaataactgaaattcggaattaaaaataaggaatattagaagtagagtatagagtccatatagaaatacaattaggaaataatataaatttagaattaaaaataaggaatattagaagtagagtatatagtccatatagaaatacaattaagaaaaaaaatagaaattcggatttaaaaa

SEQ ID NO: 97403 - DNA, 681 bp, Oryza sativa
gtccgcgccgccgccgccgccgccggcaagccgatctcggagcatgaggcgatcgaacacctctggtccaggcaatgcgacctcaccgaaattcttcagaacagcagcagagagaagaagagaaacccctacgccgccgccggcgaggcttccgatcacccccagagcgccatgatcgggtcattcctcgtctccctctccggcgagaacctcgactgcctgcgccaatggctgaaacccgcgcgagatttcggttcctccggctgcgtgatctctgacgttgattgggagaagctgaacacgatgatccacggacatcagccaatccgaggactgaaaagaaagagatcatcatctgaaaacccactgaatacacaagccctgtcagaaatatcaacggtgagatcagcctttgtgaagcgagagaagtttcttcttgccaagtttgaagaattgctaggcacctattgcagacaacatccttgggtaatcaaattgggaacaaatttgaactcctgctcaaattttcgattgcttatttgactaacttttctttttcatccactggattgtgaacttgtgattgctgctgcaggaacgagctttgttctggtccagaagttggtacctccaggtactggtaccacaggtaccaaacgaaatccggccgttcaataaact

SEQ ID NO: 97404 - DNA, 784 bp, Oryza sativa
agctgaatatgcgctccacaactctgtagaaacgtgtgctccctagttttcatggaatcatgggaaagaaagaagtgatgatttggtttgtgttaaactgttaatgctaacttttacaatgtaggtttgattttaagtcagtaagaagatttaatgggctattgaatagaagggaaaatctgtgaatctttccatggaaagatttcaaggttttgctatcatctaaagaatgggtgatcaaactaagcattagttatgctttactggcgttggaaatgatatacggaattcttgtgttatgtactgtacgtacatagaagaaaagaataactcttttgctcaactctatcattttttccccaaaaaggttggtctctaaaaatcatatcaaataatgacgtcttattggtgtttgtttctgataaagatgattttgaagttttgttgagtcagatattttgtttgtctttataggattgcttttatgttatagttactaccaagctaacacaagtaggttagttcaggcatgtatgacttgatgtacccactattctcacctagatatagcatatcaagttggaaccttttggacttattctgttccattaggcacgtggagtgatcattaatcttcctttttgcaacaaatgtgcccttattagactttgttatatttaatgaatcaaacaattggtattggtactatatgaactatgttgctgacctagccattggatgtggtgtattggtgttcaggcttgttttacatactgattataat

SEQ ID NO: 97405 - DNA, 1140 bp, Oryza sativa
  unsure (1)..(1140): unsure at all n locations
ccatgttgaattgggctaaactgtgtaggttaccagtttgcctctgacagcttgaagagatattggaaaaagtacaccgaaggtccctcaacttgtcatcgagatacaaaatcgtnccccaaccacaaaaccaaatatgtgactatccctaanttacaaaaccgtgggactacctatacatttgttgacaagtttttctccaaaaatttgacagatgtaattatagtacaatcgtagtgtaattacactgggacttatatgtaatcacactgtgacttacatgtaatgcagggaacttatctgtaaataccacatatttctgaatgccttgaccaattacaagatttgttgtggcgaggaacaataccaatcatgacgcacatgtgtgaaaaaaaattgctaccacaacgtccattcaccagaaataacatgttacagacagatttttgaaagttagatataagttacaccatagttacagtgtaattacatgcaagttacagtataattacactacgattgtactgtaattacatctgtcaaatttggggggaaaaatttatcgacaaatatatagcaaaatcagaaaccgtttactctaggtccttcggtggttttgaccctggttttatccgacatggcggctgagtcagcgtgggacccgtgtgagcccccacatgtcatactgtccacgtcagctttctctttccctcttctctcccttcctcctcctcctcctcctctctctctcttctctcttggcatggcgtgcatcgggtggggaggagaccgcgccgctcgcccacgccgcccgcgccgctcgcactcgccggccgagtccggccgtgccgctcgccctcgccagcgccatgtcaactttcagctgtcggcgagtctgccgagatgagcggcggctggccctctgcagcacggggccatctctctaccgccggatgcactcaaggacaacgcccccgctgcccctaccgtcgacaagctcggccgcgcgcccgtcggcggccggcgcggttgggctccatgccacgggaagctcgaccaccaccatggccccggcacatcgccacacggcttgctgcgctctgcggtcgacaccggccgccatgttatggggcatctcgt

SEQ ID NO: 97406 - DNA, 647 bp, Oryza sativa
catggccactgaactaaaatacgaggaggattacaagctagggaaaaaaccagagcaagaaaaggaaaaaaagagagaaaaaaacagagcagagaggcaagaagaagcgcacggccacgagcctgcgcatctcacactcaacacgcccggaccggactcgcaaaaggagaagaagcagcagcagcagcaagcgagaggagaggacagaatccaatttccgattttattttttagtaaatagtttcctcgtcttcctcctcctccacctgacctccccgacgcttcccgtccccaaccctctcctcccccctctccaaaccctaaccctaaacccctcccccccactcccgttctgtcaatcttgtcatcgtcctcaccgccgccgaccggggctgcctccctcccgtctccggattcggattcttcaagcttgcctgccggattcgattctgatggcttcggggtgaccgcccgcgaggagggaccaagcgtagatggcattgggggatctcatggcctccaggctcgttcactactgcttcttcttcttcggcgtgccatgcgacggcctgcccaatcaccataccaaccacctcgttgatgaccaccttccccgtggagaatggaccggaccccatgatggacgt

SEQ ID NO: 97407 - DNA, 656 bp, Oryza sativa
tcttttaagaagggtgcatttttatgcaatttcttccacttatacgggaccatttgccatcagctgctgaagaaattgaatcagatattatttcgctggcacaatcgaaaggtctgtaacttttccttcagatgttcaaaaaaaaatctgaaatttcgattgtaacttttactttagaaattgtggattttggttgcctttccatctattaattcatagttgagccagctaaggctaaaatatgctattcttggaggtgttgaattcagttctgtattgactatggagaaggaagtaggatgtgattagtgtgaaataaattctgccactcctgtgctaacgcaagattgaacagaccaatgattttctttatgggttacaacctttagtgtgaggagacatatttttcgctcttcatttgtcattcataccaatgtcatgaatgtttgaatcatgaattagttatgtgcataaggctcaaacatagcgagaacttttgctccagcactagttttgatgggcatgttttttctgatgagcagattcagatgtttatgacatatatactgtcaaagaggtggatgatgatacaacaatggagggcacatcttcagctccatacccactgtaatctgattgacatgtgtttactatgg

SEQ ID NO: 97408 - DNA, 542 bp, Oryza sativa
actcgagaaaaggttgttgtcggtgacatgggaccgggagtatcatgactagaggcttgggcaggagcaatcacccacgaggcctgaccccctcgggggggtcgggcccgagggtgatgtggccgcccccccctctctttgtctccccgaggggtcggactgctcccatttcggccccgagggctgaggcgccccgaccccttgtaggttttgcgccgcgtgtatgggttaggtgagcacagcggggctcacctaaccgcattaattgcggtttggacgagcgcgtcacgccgcatgtaacgcagtgcagcgcgctcgtttatccggtctgtgaccagtctcagaccggtcagatcgtggattaggtggcgacaggcggtatgacacacgcctcgccccatcccgtcaagatgagtgcctccaagcactcgtccctagccggagccggcgtgttacctcctgaagatggcacgttggtcccggtcagatatatgccaggcttcatcctaaccattagaggcaagatattgtatgaagaaggg

SEQ ID NO: 97409 - DNA, 736 bp, Oryza sativa
tcatataatagttaatagtatgtagtatgttttctcattatattatttgaatatattaaaatgataacataattttaaattttgcaataactttacaaaactactaatgtgtaatattcatattgtattttatatacgtgttagttattaattatttttaatatcaaattttagttatttgtaaattatatatattgacttgttttttaatattttttttaattccgaattttctgtaaattgtatttttatatagactctatgctattcttctaatattatttatttttatttctgaatttttattatttctaattgtatttctatgtggactctaaactaatttttaatttcaaatttcagttacttctaaattgtatttctatattgactttaaacttcttcttcccatgtttttcttaattttgaattttagttatttataaattgtatttttatacggactctaaactctagttttaattttattatgtttattccaaattttagttagttttaaattcctatatggactctatactttacttctaatattccttattttttaattccgaatttctaatttttcttaattggatttctatatggactctatactctacttctaatattccttatttttaatttcaaatttctattatttcctaattggatttctatatggactctatactctacttctaatactctttatttttaattccgaatttcagtt

SEQ ID NO: 97410 - DNA, 1089 bp, Oryza sativa
ggattaccgactacatccaaactcgggaaggattctgatgcggccaagtcttgtcccaccgacataaatcacgggccgacaaagatgacttccgaagctatcaggtcttggtgtcctatccacaaaaccaagaaacatacccttcaagattgctgggtattcatcaacgtccgtgctgaaattcgcgcctgcaaagaacgtggaattcaatgtatttctccgactcgggatgtctattgtcctatccacaagacaaagaatcacgatctctcgagctgcaaagtctcctcggcgccatgaaaaccccgtctcctaagtcatacgtccccgctagggataacggcaaggaacagggagcgactccagcctcagatcgattcgttggggtaatcgatctcgatcctcacgaaccatcggtcttacatcccctcgaagactacgggtcatcgacaacaagtgcgccgcgggaggtattagttatcgatgacgttggcacgtcagcgcaagccaacgcagaagcggcgaatcaatcgactactctagtccagcacatcagggctattcaagctatactgagggaaactccttacgatcccgttctgaacgacgacctcgagcgttggacagaatgattacgggagtcggtgactaacctcagcaatgcgttcaaagaggctgctaccgcagcacaccaagatcagccaccaatcggcgacgccaatggtgaagatccggagcggagggaattgcctcgacaggctacccctccacctcgtggcactggcgatcttcgagatcaaattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcat

SEQ ID NO: 97411 - DNA, 724 bp, Oryza sativa
tccccacttgtggcatgatcgaccaatgcagcgtttacactctaaacccctcccctcgtttttcacgtgtatgtttttcaaactgctaagcagtgcttttttttaaaaaaagtttttatataaaagttgcttaaaaaatcaaattaatacttaattaatcacgtgtgcggtccattttccatgtacactgtttgggtcgggaaaaagagtgtcgaacacagctatgtatgtatggattgagatgtacaacagcactggcaagaagtcaagaacaacccacgacttttcgaacacacgagcgaattattcgccgttgctctagtaatctaatactccatattaatatccctccacaccgtaacgacaaaaatatttttgtaattagcttagaggggtttctaggtccatcaaaaagatgattataattagagctagtttgtatgttggtcaatttaacattgttgtaatgataaagttttaatggtaaataactatctaaccctatacagcttatcttcatgtcttcctactggctccacttttgatttacgatgttaccacagaagagcatgatactatgcacaatggtgcttgtcagggttacgggtcaggcatatcccctacccttcgatatacgatacgtatcgacatggcatacccacgcgcatgcggatatttcctttatgatctaaggaaacctttcacgaaatcaatatacgggaaa

SEQ ID NO: 97412 - DNA, 698 bp, Oryza sativa
aactattttatactagttacatgcccgtgctagcgctacggcgaaacaacaaaaagatatacaatatattgtttgggctatcaagtatagattcaagacattaattaagacttacatatgagcgagtttagttaagaagcttattagaagttcctcagttattatatactcgaaagggataaacaagccaaataaactacatccaggacaaggttcaaaatttgcaaaacaagccataaggtcgacccattcagtcgacgatgtatatgtcttcaacgtcttttctccatgtcacagaaaaaccagtaagcaaagaacaaaagtctgattgatatattaagttctaaaccgattccaggacacattcagtcaattcagttcaaatacataatcatgcgtttcaacattaattaaagtatcacattcatatatcagtacatggcttggcaaaccacaaagctgaggctgccttaatctaagctacaacaaaatttcttttttttttgcattttagaataaacagtaaaagagaatggataaatcacatgtcctgaagctgtaaatttctacgaagtcctgagcagctcaattttggagagggtagtagtgttgttccctttatggttcatctgatgcatgaagaaggcaagttcaatttctggttcagtaactcttgttgttcctactgcttccaggaa

SEQ ID NO: 97413 - DNA, 991 bp, Oryza sativa
cagattgagatatcaatctagaaagaaaaaatcaatccaatcaaaacaatcaaaagcaagaagccacccaagacccaggaaaacaagcaaagcctcatcactcaggtcggccaaaccctgatgctcatggagcccaactacgatcaatcagcaacccagctcacagatcggacgagatgatcggatgagcgagggaacttactagcttcgtcggatcaaaaggccactctcgccgcgccgcgccgcgcgacaggagggtctcgagttcagtactcacacttgctgtcggggctcgagctgatgagagcgaaggagagagaaaggccatctttcattccctttcctcttcccttttcttttggtttttaaattgggagaagaaattgtaaccaaacccctcaaaaagatgcctttttgctgtttttctatgacctatttccgtgggtcgaccaccaaactgatgaatatatttaaaaaatccaaaaatatcactgcctccttggagttgagttatcgtcaggcaggcacagtatttttcttcccagtgcttatctcactcaccgcacaagcaccatcacctttttctctcttttttttaaaaaaaatctgcttagtactgtactaattagattcttttttttttgcggttaaagaattcagaaataagataatttgagtttgggcggcgattttggtgtattttgtcctttcactgttctgaagatcttcaatgctcatcacccacttgcatctaccggtctgtctccatgccccttcccttctactactgtcgtactcggtacatcagcaatttcagcagtgagctcacagcaaaatgttgctacgtgcagtctgaccataaggtatattcaggatttcaggtgattcagaaatcgctgagtcatcagtggacatgaacgctttcagaccgatcgagctgtgctatcaaccgcattgattttgtgtggggagaagaagcttcaggcttaat

SEQ ID NO: 97414 - DNA, 700 bp, Oryza sativa
aatcaacaagagatagaacaaagaaaccgcaattaatcgctatgaatgatagccgatcggctaggtgctgatgacatatcatttatttcaagccgatgtcatgcgtacatcgatcggcaaatatcaataagcaattcagactaaatctactcgatcaactgtagacattaatgatatataatccttatatcagtatatacttaaatcaagtgattgggatagatcggtcgccttgccgagacagtataaatcacttagattgaaatatatattaatagtaggattatatacattcataacatagctgatcaggtaaatctagcatgtatcggctaatactccgataccactctatactaagatattaaagcaagtagaatataccaaacataagcttaatatacttagatgcaataaaatcttaacataaagggcagatttaacgtatcaatcaagcatataaaataaaattagttaaatcagataagatcggctgaaactccgatattaccctaattggcaaccagaaagcaggctagagattgcaattctaagcacgacttaatagatcaaactcaactgatgcagcattaagtatgaaaagaagaacaatatctagataatcaagccgctggaagttttatagagtggtagatatatcacataatctaagttaacgtcattgtataacctaatcggc

SEQ ID NO: 97415 - DNA, 712 bp, Oryza sativa
gaaaacagcatttaaaagtcacttagttgcccaaagccattttataagacgatcctagagctacacaatattattaatcaaggccgtgaaccctcacgaacctgccttaacccaagacctacgatgattcagaccgaactagcaacccgaccctgagtcccagctcgtcccaagccaacccaggccaaccattccacattttagttgttgagcaaattttaagaattaaaacactaacttgggtacattgctttgcttgcccataacagagggcgcggctattcgaatagattatactctgatcagaggtgtacatctttacccacaagacacatcttcctcacatgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcgggctgcagga

SEQ ID NO: 97416 - DNA, 738 bp, Oryza sativa
cctgctgctgtgcttatgctaaagcaacatgggcattcacaaggattaagtatgatgacttgtagaatctcctggtgcagccccacgataagagagaatagataacttgatagacataatgataggtggagttaaggtattgaaaagagaagtgtagtgaagtgtgtcacaaccgattccaagtgtcgaattctaattggttatgcataatttagataacatgaaaatgccagattgagatatttaaagtcaaagctgggatcgaacggtaccaaatttacagcaaatttttaacttaagtagcatgttgtatggaggataggaggagtcagcaagacccacaataaaaggtgctgaatgtttggggcaagatcatccaaagtagtagcttttgtgtctactttttcttttgtggagcacataggtgacaagggcacaacaactgctgaaataagatagtaatgtttttgagccggctacttgatctaggagtatctttgcaacgaaaagtcaatgattcagtggttcgtcagcataagctttttgcctagtactatgagataatgtcaaatgacatggctgattgatagaccaatcagtgtgagcgagcaacatgaaagatgttttgaaaccgcgtttgacagttgaggcaaagactgattgttacccaagttttgagagcgaaagcaacactaaattcaatgtagctgcagcatgtaaccaaccaaaatacagtaa

SEQ ID NO: 97417 - DNA, 570 bp, Oryza sativa
ggagttttctgaaaaacaaaattcatatataagatagctttgatgtgcacgttcatctttcacctactttttttttttgttgtactgcaatcttgagaggcctaggcagttggataacagagatatattaacaaggcacggaattatatttatatggacataagaagcacgtacgcataatcactttgttgaaaaatgttgcaaattaaaggctagaaatattgtctgctataacttttcccgttgcaatttgcactactaggaaaagcattatcgcaagcggccgaaaagggtcttcgcaggcggggcggccgtccgcctgtaagccaacgactatgaagatcgccgatcttcgcaggcggggaggccgtccgcctgcgaagataattttcgcagacggacgttggctagtccggtccgcctgcgaaaataggaatcgtccgcttgcaaaaaagaaaacttccgcctgcgaagataggtagaaaatattgaaatttaaatataatttggccgtaaattacttttaaattatttattagaaattcttgcaggtacatatattggaatatt

SEQ ID NO: 97418 - DNA, 820 bp, Oryza sativa
  unsure (1)..(820): unsure at all n locations
cacagagaataaaatagaatagagtgcatcgagcgagaagagggcaaacaagatcaaggaatagtctgagtgaataggacaaattagatgatctagttagtagaggtaatggagggataaatgcacatcaagatagaggaaaagtgaaggaaggaacggaatgtacgcaaaaaaaaacagtggaaggtagtgcccattagtatattgtgaactataagagaaggcggcaagataatcttttatatttaaataaggagtagagaaaaagttaagtaagtcaatggtgaggattaaaagtaataaacaaagtaagtcgaataagcaggaggaaatatcttcgtgaagcaaaagaggaaagagtaggaagagcgatcaggagggaagaaagaacgaaagggcagcaaagaaagaacaacaccgagaggggaagaggcgaggaaagcaggcgcaagacgaaaaccaggtagaggaaagagcgacaacgccgacggcagcnangcncnannnagnnnnnnncngtcntgnngnnnnnnngcnncagccactctggcgccccaaaaaggaccattttttggataagtttttctaggggtctatttgcgaaataagtttttcaaaaggaccaaaacgtgaaaaatccagggcggttaggggtgaagctcttcggccagctcccagatggaggcctccgcctgaaggtacgattcttattaattacagatgctgctgtcttccagtcagtcaattcttttggtcagcgggctgtgcttgttcgctgctaatgagcgacactcggggtgtatccaacctgaaatggcag

SEQ ID NO: 97419 - DNA, 772 bp, Oryza sativa
tcctgcagcccttttgaaagtctctgaatctctggtgtacaagctaggacaaagcgttctcactctagctccctctcccccctccctggactcgaacctccttttatacttcaaggggttctcacatgcaccaggtgtgccgctcggtgaaaagggggggtaacaattccctatattaaatgtgtgtctgcgctacagcttggaagccacctaggcatcggctctcgtgcggggcccatcaaatcatgccggctgacgcaggccgacacggggaggatccccgtctaatgcactgtttttacttcctgtagtttgttagcagggctcctcacttgccaccagagctgtttctgctgaggtataatttccttaattctctctcaagtctaagagccttttctaatggggtttctctgttaattgtgtgtaatgtgttaaaatgcatcttgtgtttcttttcaaggaggtatggtgtttttcattgttctaacataatttatttccttctattcttgtacttttaagtcttcgtatgcatcacaagaagttattattgggagagatcatatatagaggcgatgtatctgtggataatgcagacacaattagctgtttgcacagtgacccggatgttgtttctgctgtatggactcttgttgacctctgtagctcatcgtctgtggcaaatgaagcttcatcggagcttgctgattttatttctaaggtgtgctttcagtctttattcttaatcgattggcatgctcctccatta

SEQ ID NO: 97420 - DNA, 725 bp, Oryza sativa
cacttctcctggtcgtcaccatctgaaaaccccacacggaaccagcaaacagagagagctgacaattaaaactaaccacccacgactaccataattcttgagtttaatactgctattaaattggttcattaaggttcaaattgcttaggcaaataaaataaagacaggctccgacatagttataccacacaccggcataaccatgccccatacgactctagcaaaacaaacaaacgaaaagaacacacgcgcaagcctactaactgctcgtctaccgctgcgacgggccaggacggaaggtgagcagcagcgcatcctccgtgctccctacgccggaggcttccccctcctgaggaaccacgggcgcgggctcggcacgaggggtctccacgaagcaggtccacgccagggactgacaaacaagctcgggcctggaggtactcttgcgagcggtgatcttctggctgcggcagacgcggcggcgcttgggacgacagacctctccctgggcgaccttgagctgacagagctgcgcctccagcacgtccagatccttcttcagctgcagattctcctgacgcagctccaggatcttcatgttgttatcgaccatcccgcggcgcaccatctggtggaagtcgatacgggccgcgtcgtacgcctccaccatgcgcgccaggtgcatgatggtagcgtcatcctccgagctagcatcccggaaggtg

SEQ ID NO: 97421 - DNA, 690 bp, Oryza sativa
caaactccaaaagagaaccaaaaaaaaaagagtaagcacctgttgcaactgtcataaacacaaataacatactccctctgtcccaaaaagactcaattcctgggtttttgtgtacaatgtttaactgtccgtcttatatgaaatttttttatgattagtatttttattgttgttagatgataaaacatgattaatactttatgtgtgacttatacttttaaattttttcataatttttttaaataagacggacagtcaaacgttggacacggaaacctagaaattgagtcttttggggacggagggagtacaagagcatttgacaactggcacaccaaagaagaggcacatgctaaaaataattcaaaagtcatgtatgcaactctgcaagagcatgttaatgggaaccaggcactagggctgataaagaaatatcaccaataaccttaaaaaaaaactgtccccgttacataattctgatgatatctcaaaaagaaaaggatttcaaattgtattaccaagtacagtacctccagcaagttcatgtcaggttgtgtgaactatgggactatttattagcaagtatgttgcagcagttttctcatcttaaaccacaagccagggacaaaaactaccgtcacatttacaaaatgcgtgttgcttttaggaaacttatttgaagcaatatat

SEQ ID NO: 97422 - DNA, 555 bp, Oryza sativa
tttggatgattttcttaagtttggggttagacttgtttgatgtacagggcaaaaaccgcgattcaaatctgggccggatcactagtatagattgcggcccagactgcatatggactaaaaatccttccaaaaaaaaaaaaaacagcacgagctgcgctatcttggtttggttcaaacagcacgatgattttagtggctttgttggcgcgagttgggtggtttcccgcgctcgtagcgtggcaatgttgcagcgtgacgagtcaaccaaaaatagcttgggggtctcgaatcgtaccgcactttagccgcaaacggccgaccgactcgactcctccctccatttcgactcggggctccggccggcctcttcttcttccggtgagccaccgacaattcgattcttacatttcgtgagcgatcgattgatttcgtgttgtaatcttgcgtgatcgatcatggtgtgtcaattaatggcaagggcgtggtcatggagccccagcccggctcgccggaaaccgccaatctgcccacgcctatggtgctagagccgccgcc

SEQ ID NO: 97423 - DNA, 570 bp, Oryza sativa
catatagttaattaattaactagcatttctaattaactaatttgtcttcattttaatttgatcgaacccatcacgttgccattgcatgcgccggccatacatgcatgtatatatacttatacatatgcttcattattaaaaaaaatatatacatatgcttgtacacgtcatgactatctatctctatctctatctatatatctatatcctcgtcagttattttgtttcatctagctaccttttccagatgtgcggacaccagtacatgcatcgtgcttatattttataattacttttctacaaaagaaaacgcatatgcacatatatatactatacgcgcacatgatacatgcatacatgcagctagccatggatatatccggccggtctcctggtgtagtatagcatttgaattaatggatagagctagtgatatattgctcgatccctaatcatatccgaaaatgcatacgctcatatacttatcgctattatgaacatacatatctacttatcgctatcggtgttttcgagaaactagagcgatatatcttaagattatcgaagtca

SEQ ID NO: 97424 - DNA, 571 bp, Oryza sativa
ggacggatggagtaataataattaatcaaaagatacatatactatttgatagaggtagcgcgagagctagctagtaggcctttagagaagaagtgatggatggattagatgcgcttaaagctacgtacgacatatttgatggaacttttggaggtgatcgagtacatttttcctttccctttttattgtttgcctttttctctttattttccctttcctttctcccgatacctttcgatgttacctttcatttctttaattaagatcgatgcatgcatggctctggctctccatatgaatatatgatctctagctcatctttatatacagtacatatgtctctcctttttatactgatgtgatcgatgtatgttaagggtgggtttagttggggaaaagaaaatttttgggtgtcacatcagacgtttgaccgaatgtcggaagtgtttttggacacaaatgaaaaaactaatttcagaactcgtctggaaaccgcgagacgaatctttcgagcctacttaagccgtcattagcacacgtgggttactgtagcacttatggctaatcatgg

SEQ ID NO: 97425 - DNA, 695 bp, Oryza sativa
ttaaaatggtcattgcccatgtgtacttgagttggcctctatgtagaagatatcagtttagtgagcacaaatttctgaatggttgtaatagtgaccttatctatatatctacatttgatagaaggtgtgataatatcttcctgtctctatacatgggactgtagtaaaaagggcagcaagctaggtagctgcagtgggcttccgcctgagcttgttgaaggtgggtctcagaggttggcttgcgctgggttcaaatggcagcaatggcttcttgatctgtgttccggctccaatgctggacgctggtggtggtggagttgtgttgctgttgccggtgcgtgtgctggtggtagccctctgcttctttgccctgggagcttccagcctctccagaatcctgcttgtcttgtcgtccaggcccagcggtttcactggggacggcagcttggggttggccctagaagtagaacatgtgacggcactggtgaagtcgtcgtcgatgatgataagctgttcccactcctcggtgatgctgggcctgggcgacgccttctcctttgacgctgcctgtggctcgctgaagctgaacgattggatatctccaccctcctccctacacagcctcagcaccttgttttcctctggaccccggaatgtcaatatttgtggttcactcaacgaatcaagatgatgag

SEQ ID NO: 97426 - DNA, 535 bp, Oryza sativa
agtggtggcactatggactgattgaagcaggtcaaaagaaatgaaatgaaagggccagacctcaccttaatttgctgtgcatttccactaccaaaatttagagtcagtgatccagctgagtggatgcactagtatctcttcgcaagcagctgtacacgtgtcatacttctatcagatatacggagatgtgtatgtatgggttgatgagatacacacacatgtcgtgtcaagatggagtatgtcccatgtgtatgggtaattgtcatgttaagtagggtaggtcatcccacgaggccgaccggccgaccacgccattcgcctgcgaagaaagaaaatgcctgaatattcaaccacgccacaagtgctgcccacaattttattagcaataactcgttttagtttgtgcgacacatccataggcggcccactaaatctcccatttattcttccccctccttccaagtactgcactgcaatttaattactcacccaacaaaaatactactccctccatcccaaaacatgagagactgct

SEQ ID NO: 97427 - DNA, 641 bp, Oryza sativa
ccctcccactcgcctttttagtttaggatatgacagacaattcaacgcttcatattaccacggctattgttgctatatatgacctcaaaaagtaattatctctactacttaaaaagagtgtagtggtggcgatgactccaactctagcagacacgcggaatgtgaaccattcaatcgtcaaatccatcggttcagattaggcagacgcgcttctctctccttctctctgcattcttagggcaacagcaatgtgtaatatggaagtgggtattagtgtgggaccatttgtcagtgagtagtagttaaattagccatcacaatgtatgagaatagagagaaggaattaagatggggcccacggaataaaacaaatcgctacccccaacctcccgtgactttctcagttcctcccgcggccgatgcgatccccagtctcgactccatcgctgccttatccaaaaaaaaaagagaaagagactccatcgtcgccgctgcttgcatcgcttgatccggagcagtcggccgccgcatcaggccggcctccgaggcctcaatgcccagcagcctaggccggcggaggagcagctccctatcccggagcgcctctccatccaactctcttccgatcccgatccaaaatc

SEQ ID NO: 97428 - DNA, 637 bp, Oryza sativa
atgatggtcatctggttggtgtgtgaatgcaatcgacacgacaaacgatgagccctccatccaaccgtgctgtgtactactccatatgtgatccgttttactcaatgtgtgatctgtagctcgtctactactcatacgtgaggtgtgtatgtgggacacagtagaacgtgtcacaccagtacaacgtgtcacacactcgtacgtgtcgcatctgaacgtgtcgagtcacacctgtgtgttaggtccgatcgtacgtgacttgtcacatctgaacgtgtcgagtcacacctgtctgttaggtccgatcgtacgtgacttgtcgcatctgaacgtgtcgagtcacaattgtgtgttaggtccgatcgtacgtgacttgtcgtatctgaacgtgtcgagtcacacctgtgtgttaggtccgatcgtacgtgacttgtcgcatctgaacgtgtcgagtcacacctgtctgttaggtccgatcgtatgtgacttgtagcatctaaacgtgtcgagtcacacctgtctgttaggtccgatcgtacgtgacttgtcgcatctgaacgtgtcgagtcacacctgtgtgttaggtccgatcgtacgtgacttgtcgcatctgaacgtgtcgagtcacacctgtgtg

SEQ ID NO: 97429 - DNA, 738 bp, Oryza sativa
ccctgttctacaggcaattcattgtatgccagtgaaacataagttttttacaaggtatttatgcaaggggaacaccatagaagcctattaagttattacgcctaaactatgaagcaggtatatatttacagatgtatatggatgttgtagaggcaattcattgtaagccctctcaaaaaaaaaattcattgtaagccgctcaaaagtttatcttttcggttagagtaaatttaacaaaactataaatatattgaccaaattatcacaaaactacatatttaaaatggtgtatcacaaaactagctataggttagtgtcaatttaattacaaaacttgaacatttataactcaaccataatattagtgctaaggatttaaaccccaaaatatatagttttgtgataatttaattattaaatatataattttgtgatacttagagttaaacctgtagttttaggataaatttattgttaaatctatagttttataataatttgatcaaaatatctataattttgtgaaatttactcttttttttgcgaggagaaatttactctttctgttataggctactaaggtcactttttttagacaatataactacatggagtatatggtaacatatatagttcatttttccccatcttgaaaatcaggatctgaggtatagaacctacataactcaccagaaaatagctttttcttttagttggtaagttttcacgggagtgtac

SEQ ID NO: 97430 - DNA, 1167 bp, Oryza sativa
atattccaattacatcgttcatggtgtacttagggtacctcggtttccttatataattattttcaaaataacagcaggataacatttccatatatactacatcgtagaagtatacttagatttttcatataccctaataaaccgcattatatttgttgccaaataaacgcaaatccatgattatggtgacaaatatttagaaaccaaataacggccgtgaactgttgatggaaaggtattaaagacgctaaattgatactcctaaatattttgcatgcatgcacaggctgtcaattaccaaacctaggtattaaagacgttactaaatattttgcatgcatgcacatgctgtcaatttccaaatcaaatgtacttaacgggtgaacccgttaatcaaatatacatgtaccgatcaactagatgagaatgtgatccaacggcagatgtcagtggtgcccgggcaccatggagccctatctggtttagggtttagggtttatatgtatgtaaaattgatctggaatgtggcggttacatgggcctgaactgatgtgaggagaaaatttgttctacttgctaggacatgatatgatctggacatgaaaacggaaaacgtggagcaatttgggagggggcgatatggaggaatcggaccggaaaatcgtaaaaaaatacgcacagggaggaaaagaaattggactgcgcagcgcattatactgggacaacgtacaaaaatacttggcaaaagcatcttaaacatttatgataggtaaagatctacatatttcaataaaaaaaagtcctacctaaaatttaaaactaactcaaaatttgaaaactttgaactctcaacatgaaatttgaactttcaactcgaattttgaaacttttaacctgattttaaaaactttcaacttgaattatgaaaactttcaactggtaatttaaaaacttttaacgcgattaaaaaaatttctaactcaaacttctaaaactttcaactcgaattatggaaaatttcaactgaaaattcatgatctttcaactattttttaaaactgtgaactatcctaaaaaaataattattgatgtatttttttaaaaaaaatattactccagtacatattaccattagcgctaattaggtcatttgcggactaatcaccc

SEQ ID NO: 97431 - DNA, 508 bp, Oryza sativa
atatgggtgtaatattattgaaaatatgtgcactactttttttttataaacttgggtgaactttgttagttggtgtgtacggagtgtgtaccataagattatgtgttcatagtatatgttccttcttttttaataagtacatgtttataatttcttagaaaaaaaatacttctcagtttgatagatccaataatgatgctatttttatccatactagcataaattttgacatgacatttttttatgcgatcgactactagcataaaaagaatacttctcaaattgatagatccaataatgacactgtttataactacagcataaataatgacactgtttactgtggcatcgcgtgttttagtagccagtacattgcattgtcggcaactggggtacacatatgtacacgcagttgctcacacagtgagatcgatatccttgtgggcacatgcactgtgcaaacccagatcttggatgtacacgtagggttcactccttaaaaaatcta

SEQ ID NO: 97432 - DNA, 907 bp, Oryza sativa
taaggtttgcagcgtgcataatgatgtgcggttgaagttgaactcagttttgtgttccttttttgatatttcgattttcttcttttcatagaaagaatggattggagtaaatcagcagcggtgtggattgtgctctgacctcggcaggggcggatacaagaacacagcgatgagatccgtgcggtttgtggcggaccaagcatgccggccgatggagatggttctctgcatctacgcattccccaccaacatgccgcccttcaggtacaaatcaagtctgataaaacactgccatccttcttgtgttacatgttctgtgttacatggtggcctcctcctccaccacagcggcggtgtcggcaaacagatttgagaggtaaaaacatcccttcttgtgttgctttacggccatatttgagaggagaatggcatgatgctgcagtttgatttcaccggctttcctgcttgccgtatttgtaatctcaactttcatttcaagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattgtccaagtatggctgctgaccaatttcttccctgaagtaggtgaggttagcccgataggaacacataccacctatattgtgatatttggagctagggcacattcagtcctgttatttgatctgtagcatcaaggttgtaaaattatcagttttgcagaggatttttggtcatcaaattggagttgatgatattttttgagacactgaattaactaatatcaaatatataatctggatttcccttcaactc

SEQ ID NO: 97433 - DNA, 1077 bp, Oryza sativa
aacgtggccttgtaggtcagttccaaccacaaaagactgagcaatcaacatcaagctggcgacagtcaatccgtgttggtcctgattcatgaacaaaacacaaaaagtaacatgatttgctcgtacgaaccactgagcttgaaaaaagaagaatattatattaaattgatatatatggaaatcatttttgacggattcctaagacttgtttggttggagactaatgatgccacaactttttgactaaagtggctaagattagtcttgtcatacttttgtggcaaactaagggcttatttagtttggagaaatttaaactcataggaataggaaaatggagactaggaatttttccaagatctttgagtggatggaaaaattcatatgttttctctatacaccttgtagaaaaggaaattttactttgattttcctatagttcaatcctacaaaccgaatgacatctataggcattaatccttaggaatccaaatcctttgtttttcatcaaaaacaaacaagccctaagcttaggcagagttagagagtataatatgtgggccagatgactaagagataggtaaaatagagttgtggtagaaatcaaatattgtctacaaaatagaggtatgataaatttagttgataaccaaacatgcccatcaggatacaatgcattttctattgttagtcaagtacagaacaaatgtttcttattttttgtacggttaaattgatttcagcatgaaaacatagaacaacgacgtagaaaattgtaacccaattcaacaagaatcaagagagcacaatttgggtatggtgagtgaattttggatgaattactttatccaataaacttcaagcatcttggttaatattcatgcacaatgaggtgtgttttaatacttttttttttgaggttcaaagagcaatataatgctgcatgccatcaattcagtgcctgttatcatggattatatatttgattgtagagattttctatacttgattatagagatagatcaaatattttcaggaataaacttaaaaaatactacatacgtaatctgtagcaat

SEQ ID NO: 97434 - DNA, 960 bp, Oryza sativa
gcgagggtgcagggcagagatggagaagagattaatcactggaattaatatggttcagtggacatatattagcttgtttgttacgactagcttaattagctttgtggtggatgttattgtgttgtgattgaagttttggaaagctaattaaagaaggttgctgatggcgaccggcacagcaatatgcatgcgtgcgcggaaaaggtagatttttttttctttttgaccaagtcaagcttatatatgtcatcaatgattagagcaatgtcaatgatatagcagggtacttagcggcaatatttggttatttcacatatactccctccatcaaaaaaaaacccagagtccaggtttaaacctagaattgggttttttttttacggagggagtagccactaagagagaaagtatatgcagtaaattagctgttacattagctatatgaaatagaaaatcaattaattcatgcataggtatcaagctcatccttgtagctacctatgttatatgcaattatataagctgtggtgattttatttgcagaatacaccattgatgatggataaggtttttgtttttttgaacaatcagtggtatgatttattgattaaagtaggaaataattacgaggatagagtcttcaaaggcaatacttcgtccgtttcacaatgtaagtcattctagcatttcccacattcatatcgatgtcaacgaatctagatagatatatatgtctagattcagtaacatgcatattaatgtggaaaatgttagaatgacctatattgtgaaacggagggagtagctaggaaagaagaaaaaattccaccatcacacatcgacgtcacctatatacagctaagaagaaggtttagcaccggtccgactgtcgctaaacgacgaaatagaagtatagaactgagctaatcgaagcaagcaatttaaaaattagattcattt

SEQ ID NO: 97435 - DNA, 721 bp, Oryza sativa
ctgcagccccgtttgttggcttatttggagagagcggaatgttaggatctttcagcacatcgccaagtcggttgatttgctagcaaacggcatcaataaggaaatcgtagtttggagggcagcagggatcttttcccagcctggcgagtaatcccactcagaggcggggcttgccacattgtttctatttccttaccgtctttagtttgtttgagaccagcgcgacatccttcatatagttataattaaaactttatttcctccaatcataatgagattggcctgccaatatttggccgacccggaaaaggagttctggttccttccattgtccctcccactcaaaacatcatcagatttatcgtaaataggtaaaagcgaggagttccacgaaagaacaataaagagctagcacattcagacggctacctctaacttttgtttgtcgttttcatatccaggtttgcctcattttacaccatcctctcctttgaacagttcatataattattcacacgtgtcagtaaggatatccaccgaagaaaaataaaagagtgaacacatttgagcaagcggtataatttctttgaagttttttgcttgttgctttcgtccaagttgtctccttttacaccatcgtcctatgaacagttgacatttatatcttcagctatgtacattatatcttacgtcatcctccaatcaaaacgatcatctttgc

SEQ ID NO: 97436 - DNA, 905 bp, Oryza sativa
tgcaatttatttgtaaacaaaacatttataaatctaggatcaatatgtttaaggaagggagcgtagtgacttgccttgctataggttcctaatgtcttcgagatatccgcattagttagaatacccgcgatcgataaatatccgacacgtctgataaataaccgaagaatatccacgcataatcctaaaagaaataaaataaagcaacattcaatacaactaatggtgccaatttaatagatctcgaatttagagagattatggatgttggacggagtcaatcggggttatggtccaaaagatatgaatttccgaagttgaaaggttttataaaccgaggagggagtgctctcgggaagggaggtgatttagactttatgatagggctctgggctgaaatgaggatgtgtatggactttagtgtataggtaggccgatggtgggctctggaggataccaattagacttctgtaggtgaatgaatccctcgggttctgctagggggaaaagtacacgcaaggtccctcaacttgttagccagatacaaaatcgtcccttaaccgcaaaaccggacatccgacgtcccccaacttacaaaactggtcacaataggtccctcggcggttttcaccctggttttgtcccacgtggcggctgactcagcgtgggacccacgtggaccccacatgtcagtaagccacgtcagcaccctatctctctttctctatttctctccttcctctcgctctctgctctcgcacaggcggctgcgcgcgcggccgaaaggtggtgcggctagcgacggcggctcccgggtggcggtgcgcgggctcagggcggtgcgagttcgccggcctccccgtccccctcgtgcggtcagcgatggcggcgcgcggctacgacca

SEQ ID NO: 97437 - DNA, 2407 bp, Oryza sativa
aattaaagtgaaggaatttatggcgccaactaactcgcaccgctgcatttaaggagatggactaaatactcatcgacgaggaggagaagaagaagagcatggttaggtttggttgggctaatctctccccgtggggagattggagattgctcagcatcagcatcggcatcagctagcttcagcttcatcactcaacagtctcatcagatacaatatgtatcacgcattcatcagctggaatagctagatattcgcaatgtgcatcgtggatcttccgggcagtaattaagtactacctcccccacattttaaatgtagttgtaagttttatatccaacaattagtcgtccgtattatttaaaaaatttataattttttttaaaaattattgacacataaagtaccctttatatttcatcatctacaatagaaaatattaatcataattttttttaaataaaagaatgatcaaatgttgaagatgaacgatgtaaaattattttttttctggaacggatgcagtagtaattagggttctcagctcgctcctgtcgtggagtatataaattggagtaaattaatataaatagcaagtggaagagtggggtaaaatttaatggatcaataaataaataaatcatgcaatgcaggggaggcccatcgtgtccagacacggcagaagcccgtcccctgcaggtacgaagccacacagatattttcgctccttgctttatactctgcaccgaccgaccgacgtacctttactgtactgtcctacattgatatttcctttcattttttttactacattgtccattatttatcttatttaatttttttaaaataaatcacgataaattaaatgataattacatatttttaataataaaatgaatggtcaaatttatgttaaaacatcaatagtgccaaatataaaaaaatttacgaggagtatttttgtttcaatatcaaaccgttattctattgatactttttttttgcgaggatccattgatacatttatttactacttgggctgaactcaaggctggctgaagagcctagaccggttgtgagaccgcctaagccccagttcggccagatgcccatcatcaaccaatccagtcggcagaatgtcattgtctcatgttcgactcccacgcagctatactttatcttatcgtgactagggtttagggtaagaccttgctcttctcatttttgcatttatttagtccaaaaaataggttagaattttgttttgttcttgttgtttaatttacttcataagtttagatgtatatcatgttattacttgtttttgtgtcattttagattatagatggtttataaagtatatattacaagatacggcaagaagtactctaataccagaagaataatttttttctccaaacacataaaaggattacacgtcaatatattagaagaaagtagagtttcaaatacacaacacaactgccagaaagaccactgcccccctcctccaaaaaaaaagtaaaaaagaacaaatatacatagagaaatttaaactggaacctaatcctattatactgaacctccacattcatggttgacaaaaatttatatataaccattgtttaccaactctgacatacaagctccatttgacccttaatgatcaccgcaacaattcatataatgcccaaggacgaagccatacaagctcctaacagtcatcatctcatcacatatatgcaataaggaattcattcaagttagcactgctctgccgttgaactactccagctagctagcacgcgtatgtatacgcgtaggagtgagatcacgtatatgcattgcatatacgtatgtacgtacataacactggtttgaagcgaccgaccgggcggtcgatctgatattgactgagctacagcactgtacgacgtggggctcgatcaggtacgtgtgatcgatgaattgtgatagggacgagatgcctatctttgctgttgccaattaattaacatgcacatatacatatatgcatcaagattattgattcattaatccggttttagtacttaaggaatgtactcgtattatgcaggtgtattctaatatatcccttaagggatgtccccttgtgtatctcctttttcaaattcaatgcaaatagttttagaaaaaaaatagaaaaaaaatgtgaatttagagtatagtgggtagtgacatctaggagtaacacttaatttcaaatttgatctgtatattgagaaaaaaaaagataaatttgggtaaattataccactactatttatatccgaatttgtttttttatatatctcaatatgtgagttgagtttggatctaaatttttgtggagtggtacatatatgttatatgaacgttcatttttttt

SEQ ID NO: 97438 - DNA, 590 bp, Oryza sativa
ccagtcccatacttcctcaggcaaatttcttctctttaattgtttttgaatcttagggtgtgttttttttcacgttaaaattggaagtttggttaaaattagaacgatgtgatggaaaagttggaagtttatgtgagtagaaaagtttcggtgtgatggaaaagttagaagtttgaagaaaaagttaggaactaaacaagggcttagcctcatcggtgcgcctaaaaaaacaaaatcaaagctaaaattcaaattttaaacttaactttgaagttgattttaacatattttcaacatagttttttttttcagtattagttaagtcattaaaaacatatatgtatatacatttttttttatctcaataagctgttatggcttataataagcttttggataactaatgaggcactcggtgttggctactggtgatgaatgctcaaatcctgtaggcaatggtagttgtccctttgcttctttgatgtgttttcttttgacttggttcgaagagaactacacaaatgtggatcatcaacatttgcattgtacagtagtactatatttctctgatgaatctgtgttgaattttg

SEQ ID NO: 97439 - DNA, 584 bp, Oryza sativa
aattatagcacatactatggattcttaaaaattcttaaaaggtttcatataagatgaggctttaaccattcttttcatttacacaatagccaactttacatttcaatttggaccaccttattctatccaagtccggtgattcagcaatgactctgcacataaactctctctctctctctccatattctttttccctccaacagttggataaccaatagatctagcaagaaggagcccaaatatagcgccttcgcgcttcggtaggtcagctcctgcctcccaaagtccctgcaagcctgactttcccgacctgaacgacaaccataacaatagggtgcatcacgataggggagggtaaaaagacatggcggttactagaggggaaggctgcgcatgtaaaggcaaagaggaggaatgatgatggctcatggagaaagagaggtggtgggggggcgtaaagtgacagttagtgtttgttggtgggaagaggaaaatgttggtgacacaaacgctaaaatttccttaagtattgaagaaacgtggatcaccaggtatataaaaaaaaggaactacttttaaaaaaa

SEQ ID NO: 97440 - DNA, 644 bp, Oryza sativa
aagctaaagaaaaagccaaattttaaattttcaaacttaattttgatattgattttgagatattttcaacatagtttcttttttagcattggcttttaagtcaccaaaaacacatatataaaaattttacctataaatttattttattttctaataaaccgttttggcttattaggggaaaaactaaatgatggggcctaaaatttggcaccatgatcaactcgatgtagatttgctcgaaaagtacttccataatgccggatcgttaatggttactccctccgtttgatattataagttgtttgattttttcttcgtcaaagttcttaaggtttgactaaacttatcggaatatatagtaatatatcgaccacaccaaattagtttaatccaatttaacattaaatatgttttgataatatatttgttttgtattgaaaatgttattatatttttctataaatttggttaaatctaaagaagtttaaatgaaaaaaagtcaaacgaattataatatgaagcggagggagtagaattttataggtttataagaattttgtcctaaactataagcttttataaccggaggaagtactcaatttggtgccaaatccgatgtagatttgcttgaaaaactggcacaa

SEQ ID NO: 97441 - DNA, 586 bp, Oryza sativa
agcaatcgttacgctagtgatatgaactcaaccaagaaagtatctcgtaatcacatccatatgaacacatataaacactcgtacttataaacggatccgcgcacaccctatccatatgaacacatttaaaagatggggccccgcatattttaaaatcgataaatatattatctacctcttaaagaataattagccataaatgtaaatgcatgtgtcaaatctataagtttaaatcagataaactgattccaccacggtaatcctaatcagtttacactcagcgatagactgcaaatctgtaacaggagcatcaacaaagtagtgctgaaatgacaatctcatgatcatacaccacatacatatggtacgcaaacaacgatagttgtctcctcgacagtttaggatagtgtcccacgcatgcgtccacgagtcctcgacgcaacgttcccgccatccacgcgaccacgcatgcacggggggcgcgcgcggttgatgcactggacgtcgagcggaaaaacgccctgatcgatctggtgtgctgagcccccgaggattcactagcttttgccaattgtatccatggccg

SEQ ID NO: 97442 - DNA, 553 bp, Oryza sativa
tgatttaaaatgggctggttcaattcagctctaatccaaagatcaaacaacaggtagaccccttgttagcaacaggacccgggatttggccctggactagctaggagacaactgaatgtggcccgaatctagacacgtctacgttgttccattaatgtcggggtagggatatatcatgccaaaaaggtaaatcacagcgcaacaagctttcaagttaagtacactagagtagtaatttagacgagcttaattaggttggtagatttctcgaagcagcacgagcagagagcatgtacagtttgctcgtctttttcttcactaatcatcctactagaacatgtgcaatgatactctactacactccttaacatagagatggtaatgctaatatgttcaactgcgaaaattaacaccggacgaataatacactgcattaccggtattgacattataagtaaattcagtatttctatcaattaacggcatcttaattataagttgggcctgaataatcacgcagctatgaagcaatcaaccatggcgtgcacgacac

SEQ ID NO: 97443 - DNA, 764 bp, Oryza sativa
cttggacggccctagtcaatgagtatggtcttcaagaggagaatgcatatctccaaaaggcgcagatgttaatagacgatgaaacgaagcccaatgattcacaggtaatttattttaatatatttttggttcacgttcagctccagttctggatttgtcactcctgctcttaacattttccacttgtttttttttcgtaggagatagatacagaccgtaaagatgtcaagagggaggtggaggctcctaagttgatcatttctcgtcatagtgatgataaattctcatcctagtgatgagaaatgagactcgcccaccgtctgaatagcaaacatgaggcaacatgcaagtaccagccgaaaatcaactctctgatggtgtgatatggttgccagccatcggtcaaataagcagccattttgtgtttttacatttatgaatcacaatcgtactgtaataataaactagttacatctatatttatatttatagatcgtttttactttaattagcatatgtttcatttatattatgctaaactcctatgatatgtggatgagccaattcaccgatattttgtttcctttcagacttcacttaagagatctactcttccaattcagcatattaaacttctaaaagcgcatctaaaacactgtggaaagaaattgaatttaatctaaatcggcacatatggaaaaacatggtggaaataataatacacagtacacacatttaaattttagatatacttaaaatccatg

SEQ ID NO: 97444 - DNA, 612 bp, Oryza sativa
atcctctataggttagtaaattgtcaagaaaaaaaaacatttccatacatttaagccgttttacaaaactgaaagttatggattgtggtctattttatactgcaaattagcagccttcctattctctggataaacaaccgacattatatttttttaaagaaattaaaaaaataaccaatagctgcattaaattactgcaactgttcaatttttttggtgttgctttgcactatcatgatcatcaagagttaaatcacagtgcagcactgcagctaataaaaacccctatgatcccaccttactataacttgagaccggcttgcaaataacattttatcgatgtattaatctttgtcatatagtataaacatatacaattgacaagtaccagagcacatgcatatgatagcaaggagaggtaaattaagtacctgcagtaggagtgggatgtttggagatggcagttgcgagatagcatctcatggagaagagggtgttcttttttccgtcaagcttggccgctccttgaatctccttcttcctgacatcaagggcgatcatcactcctcccatatcacaatccctgttggcagaattgcacaagaggtaaac

SEQ ID NO: 97445 - DNA, 2070 bp, Oryza sativa
cgattttaaattgttttttttataatttatagaattcgaattttaacttgcttatttgcggagtactatattactggttaatatatctttgtaaatttatttttttcataattatttaattgacatgcgataaaaatccctctccactaccatactacttttagtgtcttgtctattggctttaggcactgttcttttagcttttcttttttagatttttgacatggattatttgctttgcatttaaagaaacgttgtttttttaaaaaaacactatattatttagaccactttcttaaaactaattttgaagtttatttatcaaaacattaatttattaaattaatcaagtaaacaatccgcgtaaaaatctgtttgaatgcaaagcttaccttttactgctaaacagcatcaggaaggaaaaaaacagtgtaagcgatggagatagaagctttaaccagcgtcaattccacatactgtacgtacatagcgtctattaggtcattttcctttggtcagaaaatgcctgcctgcctgcctgcgttttgtcgtcaatcgctgactgatagagatcgatccatccatgcatgcgatttactatacaacttagcaatccagggagtgtttcgttgattactgcagctatctatctgtggctctcctttggtcaatccgtggctttctgctagtctgtaacctgcatggtgttctgacctgaaaggttgaaaccaaccaacacttgcgtctgcactgacggagacacaaccatctcatggaatctcttctctcatataaacatttctacgtggtctagtaaaaaaatcgatgaagaatatttcttttcagtcacctcattaatcaaattttaaaattttgaattgcttacattcccttctgaagctcctaatcggttgaaaatgctttgatttcaagaacagtaatatcattggtataaattttgaatcttaaaaatgtttatattttagaacggatggggtatctatctgatgtggccctcgtgcgcagaggcagctgcgaagctgccgatcgattctctcgtgcctcagcctctgatcatctccaaagatctgtctcatcagtctcagtctcagctagctggggaccgtgatatttaatcaccttgtctgaatgatttgcttatattacgctccaaatcttcttctccttcctcctctgtcactcgatttctcttacgtgttgatcgacttcaggccagattcttgacaggttacctgcaattgctgcttatcagttaactctttcttttattaattatgtttcttctccaccctccattcttcggcaaaagcaaatgggagtatcagtaatccgtatatatactcggttagtcacttcaagcttagtttggagacaacactgaaaagccaacacagaaaaacttatattcttgatcgaatatatagctagccccattagcagccaatatgccctcagagaataacaagagaataaacggcaaattcgttattcgagtacgatttgtacttccaaaagtgcgctatccgatccatctctcattatttttgtttagataatggatcgcatctcattaattatttatcactggaaatggataatgtatccggtatgagcttgatattaagttagtcaaatattttgtcaggaaataattaagccgatatgtatatttataacccaaactctgttttggatatatatcgcatatatgaattattggttgtcaattcttggatcatgtacgtttcagaggcttgagaatgtgaccaccaacatctgatagcaacttgcttgcaagctaaatggacctctactataattaatttacggtttctggatttctttcctcttcatgcagtcatctcatgttcaggcataattaaatatgaattataatgtgcatgacaacatgacaatttgcaaaaaaggctaattcatttcctagtcgttctgaagaccattgcttcttgctgaaattacgccggaacgaaaacttggaccatgataaagaaaaggagaatctatggtcatgtggtgagaagagaagat

SEQ ID NO: 97446 - DNA, 726 bp, Oryza sativa
atgattaatcaaacaagtatactataaactattgtactattttgcgaggaagaatttaaaatttaaatcattcacttccttatagtattttggaaacattggttgtcctaatacgggcttaattaggaaaaaaatatgataaacttctagttacgtacttagcgatttaaaagccaaatgctgaaaaacaaactttgttaaaaaaaaagaatcaggtttcaaaattcaaaattttggcaacgcggcaaaagatggaaaagccttcaacagcatcacagcatcaacaccaacatggatcggatggcaccacaggatgatctgcagctgctctgctttacgatgatgcaccttcgaacgactgcgagaggtgctttacattccatcccacaggtcgctattaggtgtgcaagggtaacggaaataggttgatacgattgcatataagtgtgtaaactgtgatcgagcatatggtgtgcaagggtatgataaatacaggagtttgcatacgtttttacaggcaatgtctgataagctatttgcaatctagcagttcgaagtgcttcaaatacgattaggaaggtgacctttgaaggggggcctcctgctttggacgcctgcatgtaaagaaaaatctatattaggttagcattgcctgttgatcagaggatgagcaactcccaatcaaaatggtatcacccaaaatcattttgacagttttaactagat

SEQ ID NO: 97447 - DNA, 633 bp, Oryza sativa
ctgtcagtgagaaagggtggacagcttgtgaggttgtgatagacacaaatgccaactgcacgcagcctgtatcgcagtactctgttcttaaaaaggaaaaaacagagcactcctcgcgcatagtaatcccttctaaaaaaacgtttgaacctgaatacaatatagaattgggttttttgacgggtgaagtatatgtatttgtgttttaaaagcaaaattgtgttaaatgtttaaaactttgaccgttagttttgcattaaaacaaatggtttgtaaaatataaggagtttataatgctatgatcgtatttttgaaataaaatttacggcacaccatttttctttcctttaaactataagtattttatatgaaactactccctccgttttaggttataagatatttttgactttggtcaaagtcaaactgttttaagtttgactaagttcatgacaaatatagtcatatttataatactaaattagttctatcacatcactaattgaatatattatcataacgaaatttgttctgggttgaaaatgtaactatttgtgcctacaaacttggccctactgataacagctcgactttgatcaatgtcaaaacgtcttgcatcctgacacggatgga

SEQ ID NO: 97448 - DNA, 576 bp, Oryza sativa
gaacaaacataccccctcgataaacaacaatcctattccattattgcccatgccattgcccataacggcttcggcttccatccagcagcgagctagcacggcatgtgatgcatgcctgcacatgctcctctcgatctgctctatatgcctcctctatcacatctgtcagttactcgccatagtctgcatcaccgatcgagtctgcagctgcatgcttctactcgtgacaccccccccccccccaacccccaaagaaaacgggtaataattagctcgttcttcctctgttacaaaataaaacaactttttttatataaattttaacataggtgaaggagcagtacttcgaccacgatagctgaaacaccttagcacgtcgaggaaatcaagcgtacacaccggccggtacacagatccaccgatggatggatcggtgaggaaatgaagcatgcagcagcagcagcatctgctgactgcaatggccatggccgatggctctgcatgtcctgtgccctacaacaccctgcatctgcatgctagctagctgcacgcgcgtcgttgcgtgcacacacacgc

SEQ ID NO: 97449 - DNA, 682 bp, Oryza sativa
tttgattgtgtgtatttgtcaactaattgaccacggtacgcaagcaacctgtttgtccaactcaactggagatgtccttccacatgactaattgctgtgatagttagcaaatacctttatttctttcataagtgtctgctgcttttaatcatgcagttctgttctgttccaataactttttatttctgtattatgggtttgtttgtttcctaccataccaaaatattagcaataccaaaacctaggtgaattttagccttttttttcttggcaacctatgtgtgttattggcatattttggtagcaaaccaaacactagccaaagtactattcgaagggtcaacaatttggtagggcacattttggcgtcaaaccaaaatggtcctgccatcataactgaaaccaatatagagccttacataggcaatttagttataaaacgtttggtttcacaggtgttggtaatcctggatcctccagaggcattcattgattgtgtgttggtggtctgtagtctaatatagacagattgtcaattgattacaaacatctgtacaaaaaaaatatgttgcaacagaagtacaatccaatatgttcattttttcatttcttgacacattacctctccactaatttttgtaccttggctaagcatgggttggcttcctgagctgatactata

SEQ ID NO: 97450 - DNA, 720 bp, Oryza sativa
taaaaatatctgaaattcggaattaaaaataagcaatattgaaagaagtttccaaataagaacccaatatgagattaataaaaaatcaaaataaaaataaaataaaatctaaaattagaaaagaaaagaagagtccaagtagaaatacaatttagaaatagctgaaatcggaattaaaaataagcaatattgaaagaagtttccatataagaacccaatacgagattagtcaaaattcaaaataaaaacaaaaattagaaaagaaaaggataatccaagtaggaatgcaatttaaaaatagctaaaatacggaattaaaaataaggaatattaaaagaagagttcatataagaactcaaaacgagattaattaaaattcggaattaaaataaaaataaaatctgaaattagaaaaaaaaagagttcaagtagaaatacaatttaaaattagctgaaattcggaattaaaaataagcaatattgaaagaaggatgatataagaacccaatacgacattaattaaaattcagaataaaaaataaaataatatccaaaattagaaaaactaacagagagttcggaatacattttgaaacaactaaaattgaaaataaaaaataagaatattaaaataacacaatatggtattaattaaaatttggaaaaaataaattctcaaattagaaaaagaaaaataagatttcaattatgaatacagtt

SEQ ID NO: 97451 - DNA, 602 bp, Oryza sativa
ttcctgcagccctccggataaaattaacacgccatgcaccaacgcattcatggcgtgtgtgtgcacgcaacgacgcgcgtgcagctagctagcatgcagatgcagggtgttgtagggcacaggacatgcagagccatcggccatggccattgcagtcagcagatgctgctgctgctgcatgcttcatttcctcaccgatccatccatcggtggatctgtgtaccggccggtgtgtacgcttgatttcctcgacgtgctaaggtgtttcagctatcgtggtcgaagtactgctccttcacctatgttaaaatttatataaaaaaagttgttttattttgtaacagaggaagaacgagctaattattacccgttttctttgggggttggggggggggggggtgtcacgagtagaagcatgcagctgcagactcgatcgtgatgcagactatggcgagtaactgacagatgtgatagaggaggcatatagagcagatcgagaggagcatgtgcaggcatgcatcacatgccgtgctagctcgctgctggatggaagccgaagccgttatgggcaatggaatgggcaataatggaataggattgtt

SEQ ID NO: 97452 - DNA, 695 bp, Oryza sativa
ctgcagccctttccgatccttaagctgtctggctgagtgaatgatgagtggtgaactacgaacagtgcatttgggggacattgctttgtttggatttaaagcttgttttaacttttgcaagcaagttgtttggtaagagtcagctaaacaaaaccaagctagctatgacgaagatatagatcaatagatgccccggtgttcacctttctaccttccggttttcttcttcactttctctaatttttctctttctctttatttctctttctctttacagaaagggtggccatcatctgcatctgcaagtgataaggatgcatggctagctagatgcttttcatcttaatttcatttgttaattaattacgacaccaattctccttgtgttgtcactgaaattgtttccatggaattttatttgaaaattttaaattagagccttgtcgcggagcatgcatgcagctctgcaaactgcaattgcataatttatgttaacatcattcatgcacaaacaaaatacacactaaattaacaattctgcctagagaagaaaaataagctaatcggtcgatcagcagctaaatagttttttttcttgggaagtagtaactaagtaccttttctccaactcttttccaagatatactctgtatatattataaaatcaacagtagcagtataattcttaactgtgg

SEQ ID NO: 97453 - DNA, 2663 bp, Oryza sativa
attaggataacattcttatttatgccagggcaaaataatggagttgtctaacgaatgatgattgatgaatccttttgttcttctctttctttttctttttccatccatgcagccgtttaatccgtcatttttaagtagtcaaacagctatagatcataggagtagcagttagtggtccaagatgtaagagggccgtgacaactttggcacacttggcctaagtcaactgctataaaaactgctcgaaaatgaaatagcaactagagtcagttctttcaacttaaatagagatttgtggtattgttttctaaaatttttaaaaaagaaatttgtctgtatttaggatattgaaatcatgatattttttatgagatttgttttccctcacacacatttataggtcactgcgccaaatcagcactgatggcccaaaccgtcaattgtgacaggtaaggctctcgtcagagatgactgattagtaatgactctacctcatctttaatggatgaaggcccgtcagtggaggtaaatatttgtgatgagtagtaacaaacacccgacaatgaggctgttcacctgtgatgggatggtattttagcttgccatcgaggacacttgtctaaggtgggttataattacaacctagtatcatatatgcatatgatgggataaacaaaattcagctcacacgctagtatccgtcactggtgcagattaccgatggagaaaaaaaaaagagggaaaagtccattttacaccctcgaactcttgtgcttatctaaaatacacccccgaactacaaaaccggatataatacaccctcgaactgtcaataccggacacttaaccccccagactgtttttaccgtggtttttgccacgtcggataccacgtcagccctagccacgtcagcgcaaaacataaaatgggccaagcccatattctctccccccctctctctctctccctctctatctctctctccctccctaccctgttcgctctcctctctcacaaccgttggcggcagaggtggcagcgcggagctgcgaaatcgacggctacggcagctgcgtagagctgcgagggcggcggctgcggcgtcggcgtggagccgcgagggtggtggcggcggggagctggtgtgaggccggcggcgctgcgaatcatgagcttgatgcccctcgcggaagaggccaacctcgcctgagccatacgcgcggggaggagtcatccctatgcagtgccgccaccgcttggtcgaggacgaggtcgagctcaagctctgcatccgccgccgcctcgtcaagctcgagttccaccggcgagctcgattcatggagaagatggagtcatggagctcctggaggcggcaggagaggtggacctttgagcttgtgctcgtcggtggtcggcgcggaagggaaggctggggatgtgcttgagctccgtcgccgcaacgagttccctgctccacggccaccgatctcctgctcagctccaccactgctctctgtctgggaggaagaaggatggagagagaaagggaagaggagatgggggaagaagaagtggctactgacgtgtggctctaatttttatttttagttttatttgctgactagacttccacatcattgacacgtagacaaaaaccagctgaaaaactacttgagggtgtaaagtgaacggtattgaaagttggagggggtgaaatatctagttttagagttttgggtgtattttagacaagacaaagagttggagggtgtaaaatggacttatccccaaaaaaaagagaacatcacaatccgggctcgttgccattgcatttgtcacgatcacaaattcacacaggaaggatggcaagaaatacatcacaccataaatttatttgcactctggaaaatgattacgaatcgacaatctgggcgcctcaagagatgctaggggtagaggaggggatggtgctgggacgttgagagatggcgacaggagcctggcatcggttcgagccaccatgaggtcgaaggccataagatcaggtgtccctctgacctcgggaaggctggatctgcgattcttagggcagcggaccatgcttaggagtagagccagaatgcaacgccattggtgctcaacaacggtggtggagatgacactggcgaggctcttggggataaaggagtcgacaccggtaggcgacacatggggatggaggaggcggtgtctagcggttaaatctatgtcccccgaccctgacctcgtagaggatggatccgatggtcgggggacaaaggaggcgacacttgcatcatggtggatgggaaagaggattcaagcctttaggggcagaggaagaagaaagagagagagaggaggggatggaggaagaagggataaggacgagacggggagggagagagagactcattaagggaggggagttgttttatttgattttttaggtcattactaacgtgttaaaaaatactctcatcacagatgagtacctcatccgtgacgggtgtaaactcaacacctgtaacatacaagagatcatctgtaacgggtctatatgtgagctcgtcaaatatgttttgtgctgagtctccatcacagatgagtccttccctataacagattaacagaccgtatccct

SEQ ID NO: 97454 - DNA, 580 bp, Oryza sativa
ggcgaattcgagctcggtaccctatgttactagctttgatgtaagaagaaaatagatactatatgtggatatgcatcttcctcatgcgcattatatcagactagcaatccagtttcatatttcagtggcatatttataactcactcgtctgcttaattagacctcagaactttcagttcacctcaaattcatctagcattccatggtctgctaaaagttagaatgccaacacagtttgacaatatttttgcttacagtagtaacaatagatggcatatgtgaaaaacacaggttgcattttgtaaagaagaaatatgtaacagagttgcagtggtgggatggtgtttagtgtctacagtctacacaggccaagacactaaaacattaagtgaagtacgtacccttaaaaagatacaaggttgttcaaatataaagcataaattgcaggatgctccattgtaggaaggaacaaattaatgccagattctgggcctaaacagatttctatgaaactttcaccaaggcagtgttttcccctccacttatttgctcgtaaagtaaaattactagccaaacatat

SEQ ID NO: 97455 - DNA, 580 bp, Oryza sativa
ttgtccgtactaatactacatactccctcctattctataataattgatgttttggacaaggttgaaatcaaacttttaactttgaccatcaataactttaaaaatatttagtttaaagaaactagaacagcatatatagatttatcattcaaagcactataataaaagtaaacatgcatttatttattgtatatattataatataaaaataaggtcaaagatatattttgtagaccgtgtcattgtccaaaatgccaattaaaatgaaaccgggagggagtactgttttgcgtgctactactctgaatgtcaattctgcctttgtgcagtttagctcactaaactggtaatttatcttcaaacttcacttatttgtgatacccttgttatgcatggtaatttttatggtatatgaatagcaacaaaaatacatcagtaatgagggtagagtgtagactgcaatatttggggttatagtctattttctctggttcattttcctaaacttttgatgatttccatttgtactaaatttcttctcggtcgattttgcagctatttttgactgcttcagcatata

SEQ ID NO: 97456 - DNA, 2693 bp, Oryza sativa
agagtggttgcttgagttgtgtgtgcctgcgtgtacagagctgagctgatatgtactaagccaagaaagaaaaacgatttttggtttggagctttcagagtgtgaagcttgcaagtcaagcaatgttgctgtatacattgccacgtgtgctctagtattgttgatatgatactacgtcccgtcctaaaatacttgtcgctttaagtttttatttgtaacttttatcattcgtcttatttaaaaaattacgaaattattatttattttgtttgtgacttgctttattatcaaaagcactttaaacatgacttatcttttttatatttgcactaatttttcaaataagacgaatggtcaaacgttgaaaaaacaatcaaagcaaccactaatttagaacggaggtagtatactactgtacttttatcaatcaaactcattttggacgcatacaccgtagataaaatcaatcaaactcattttctgaatgtgacatctgactgctgaacatctagtactagcactagaattgcatgccaatgagcctatcattatttgtccgcatcctgtcaacgtgatcctgaaccgaccaagaaatgggaaataattgttcgaagctcaagtaccaaacagagtttttgagcaagattagtaacagcgacgtaacagtaaatacaaatcaaaatcattgaacacttgcacatatctttatcaagaaccgctgcctggcttcctgagagaagagggtgaacaagatgtatttgtcacaatgcagctaaaatagcacgccacgttgttcatgcagacaccaaacaatgaaaatgtagaggactgattggttctgttttgctgaagtggtagcatcacaagggcactgtttagttaacaccaaacttcccccaaactttcaactttccatcacatcacatcacatccaaaacttttctactcatataaactctcaattttttttcaaactaccaactttctcaaaacttctcttgaatttcaggaactaaacacagccaaggattacaaacactgcctgtgtgcaagtgcaaattaattaatacagcaggcaatcaaacagtttgatccggtttgaaattacaaaccagtcaaacaatccatgcatgcgattttttagttaactaatactccctctgttttttaatatatgacaccattaactttttaagatagtttaaccattcatcttattaaaaaaagtaattatcatttattttatagtgacttgatttatcatcaaatgttttttaagcatgacttaaatatttttatatttgtataaatattttgaataagatgaaagatgaaacgttggtaaaaaagttaacgtcgtcgtatatttaaaaaacggaggtagcagaattgctgatgatcatccaaagatgtcacggccaacatgattgagaatggcatatataggccggaaatgctactgggcgaagggcgatcagattttgccccccctccctccctccacatctccacctggtttccttttttggcactacattactttcctattttagtaaatttatacacctaaagtttacacatctaaagtttagagaccaaaagtttataagtcaaaagtttatatttccgattcaaatttgaatttgaattcaaatatttttttatatatagtatttctatacatttaaagtttatagatctaaagtttataagtcaaaagtttatatacccgtttcaaatttgaatttgaattatatccgattcaaatttgaatttaaattcaaatattttctatatataatatttctatacatctaaagtttatacacctaaagtttatagatccaaagtttataagtcaaaagtttacatacccgattcaaatttgaatttgaattcaaattttttatatatatagtatttctatacataaatttttctaacttttttttaattttttatggtgtactgtagtaggaagagaagaagggaaggaggaatgggagaagtgggaggaggtattgcctatagggaaaggggggggggatccgatcgctgggcgatcgcccaggcgatcgatcgatcgtccattaggccccccatatataggcctcatgcgatttaacaagtaatctgactgtcggctttcattttgcagagtgaccaggcacgcagcgttggagtgatgctcattgacaagcatatgctatgatattaaaaacggaattgctaaaactctgtcgatagaaaatcctaccttaaatcttgcaaaatttggattactggatgtgcttcacgattcgtgctcttcttctccaactccggcgaccaccttttcttctccggcaccggcaaacctaaattccggtagagggccgacgaaatagggtctcggggtgggggtggggtgggggtgtggagggggggagttcaccggctttagagggatggccgtgggaggcggcagcccggcggtgggtggcggatcgggcgggcggcggtggcggcgccgaagccgcggggctggaggatggcggcgggggcaaagcggaaagagttgtaagaggaggcggacggtggtggcgcccgccgctagcgatggggatgacgacggacagctcacggccgccggcttgaggcaaaggagaggagagggagggggagggggaaggggagggggagggggccggctg

SEQ ID NO: 97457 - DNA, 677 bp, Oryza sativa
tatcaaagatgtacctcaagttagtttgtcaatgttaaataagttaatttgcaaccttgatcggctgcttgaagtggaagcaggtgattctacttgacgatctgtactttcttacaatgagaaccatattttgtatttctgaaaggcgtacttttgtatatattgacatgcagagagcattagcggccttccaaagactacttggagaagtctacttggcgcagcattatcatcatatcatgaattacagcttattaacaccagtataagttcagggataggccaaatcttatctcttgccaagaaacacagcacaagtccacaagtactatctgctatagctgaatacttggattccctgcatgggtaaagttatatgctctctacctttaaattctatattcatctaccatgttactttgaccatgtgggggcaattaaaactttttcctttgtttctgtgagcagagcagcttccctgggaatgacaggagaatgtgatccacaaaaccttttagatttgttctctatctttgctgttaacttaagcagtccaaataaggatctccgggttttaacattgaggattttatcctattttgggaagatggatcaacgtctaggcacagatgaagagcgtccacataagaggcaaaaaacagaagattctggtgacg

SEQ ID NO: 97458 - DNA, 512 bp, Oryza sativa
aagggaaaagaaattatcgctcaattaggatcaggcaatacaaataagttccagaactcatcaacacataacattgaaacgaggttaatcatggcattatgttcaaatatgaactctgcagcaatcataaaatggaacaaaaactttatcataagttcagtgattcaaaagattgatgtccaatggcaatgcccaaaaagggtaagagcctattgtactacaacaatgctacaccctcacaataaagattctttgagcaacgctgtcagtgcccaacgaatcggaatcttcacctcacaatgcaaatgcaaactaagacttgtatcaccagacagaatcacacaggattcatttgtaacaatacgccagtccctttcatgccatacgcggggctgatccaatcctcccccaaaaatcagtaaaacctaaccaaatcgtggccacagcacacccaacagcaccatccaaatccgccgggagcagcagagctacgtgctcccccccccccccca

SEQ ID NO: 97459 - DNA, 1574 bp, Oryza sativa
  unsure (1)..(1574): unsure at all n locations
tttgacgctgaacaaaagaatcatttttgaaataagttttggcggcggttaatttgtaaaattagatttttcaaagggttaaattgtcaaaatttgtgtgatacccggctggaagttctgtgcaattttgttcatttccttcttggaactacgaaggcgcgcgccatatacagttactcatactgtcatacacggccacacacctgctgagtgtaacagtgtaacatacacaaactgatggagcctagcggcaaatccccaaccacagtgcatccttattgaaaatgcagctacatgtgcgtaaaattcatagatacactaaggctgatatcttatctctactttcccaactcatctctctcgttttccgcgcgtacgtttttcaaattgctcaacggtgcgttttttataaaaaatttctatataaaagttactttaaaaaatcatattaatctatttttcaattttattttagctaaaacttaattaatcatacgctaaacgctgcttcgttttgcatgctagggaacacagcctaagattcaatcgtataatggatgaagtcatagatcacctacaactctaccatagttacgtaccactcatgcttcctcatgcaattttattctgatctcgtttacaagacaaccaaattgcgggaaggatcgcactcattctctccggctaaccctaggaaatatgccggaacatttttagatgtttcaaattcggtgattgtattggctacgtactggtcaatcaagttgtcctattagttcaaatgcggcaatcgcctaattaaactgatacatacaacatatcgtcaagtttcaggtgcacttatgatgcatatttactaacaaatatacaacaatttacatgtcctaatcatgggatatgatgtataactcctaaaaggaataaaaacccatgtatacaaatgcactcaatattaatttcctgttatcaactaccaagggcatgtacagatatagagttatctaaccattaatgtatcaatattttntgnactcttcttttctttcttgcaccaccatgcaacaaaatttactctaataaatttaagaggagccgttgtcatacataataaccatatttctcttttctcctttctcttttttccatgtcatcaaatttacttgcatggtaataggaagagaccactaataaataccgttgtacatgccctcattaaatccaaatctatctctatctctagtactcattaaatcaatcttcagtactcaacaactacacctttaatctaaatcttctagatattattcactatatcttttactagttaatattgtatatttaattcttcatatttcatttatgtatttactactagcaattaatgataagtcactcatttattatagggaatacttctatatatattgccccctcaactattaatatgttcgtccaaaaacatcacccatcttacaaatttggtataccatcaaaaccgtttaatttatcccctcttggtctaaaatagagttgtttttgtctatgtggcagtcgaatgggacaaaaaaaatcaa

SEQ ID NO: 97460 - DNA, 676 bp, Oryza sativa
tgtaaaaaaaaaaatcccaaaaatcaattgggaattgggttccattggactcgtccagaactttgggtagttttctgtcaacaggaattttggaggagctggtttacgaaagttttaaatctatgaacagcatttccccctactacaattaatttgcatacacatttctactcggtggcaccattgataagtagatctagctttcagtacatctttttatgtttatgatgagttcaatcatttatacaatgcatctttgctgactatcagtcagattatattgaagaatctatatttgttgatataagctggacacttgaagaaatacatttcagttgacataggttggattattgactgtttaaaaggaattcaataagggctcacccaaacaaaagaatggaatagacaatgaagtgtaattaggtttcaccgcacgttgttaggaaatgcatgggttcaagttgtgctctccaaggtgacatggatgcaaaatgtagcctacctagatctcgtttagcatcttcaaacagaaatgttattatgccgcaaggcatacaaaatacaagaatttggcaggtaatcattatataataagaacttgtggacagtcaatcttgttactgatagtacccatttttcaatttatatggtatctacctattatatgcataaa

SEQ ID NO: 97461 - DNA, 784 bp, Oryza sativa
tttaagtttagcttctttttgatttttttttttgctttcttatatcctataattttcggttgttagaagacaatgaaaaggaaaacatggcaagggaagggaattaggatgttcatggttaatgggttgtcagacagttgggagtagaattcagagaataattttatacattttgcttcctgctcatgatcaatgctggtttatgctctgtattctgtgtgttgctgattgattatccatttatccattgctactcactttccaggatactgtatcattctcttgctcatctcatctctagtaagtatattcagcttaattccatcatggtagaactgaactggaactgaagtgaattatgcatctcaatgattcaagggcactagtatcgaggacggcacattcagtcagacaccgattggacactgccgcattactgtatcttcagggctggatggacattggtgtttgttaagaccaggaatatacattttgcagtgacagggacagagattccattcatctgcagtgtgtgctctgggcatgccagacaagctcaacatgcggcacgcttcagtaatcatagtcattagctgcagtgtcatgcactccctccgtcccaatatattaaaacctaggacatgatgagacattttctagtactacgaatctggacagacctccgtcccaatatattaaaatctgtccagattcgtagtactagaaaattctgtccagattcgtagtactagaaaatatcccatcctatcctaggttttaatat

SEQ ID NO: 97462 - DNA, 647 bp, Oryza sativa
cgcggcgcgcgtgcgtggacttgagggagggggtggggtgatcgcatgtcatggtcgtggacgaatcgcgttggttgggatgtggagtgacctggcggtgtgggccaatggggcttcgacgtgtccgaactcgagtagctggggggccaattaacccaacgcaaccatcacgctacggaaagggcaagtactagggtaccgagtaactacggctactcctcgacggtccaatgcgagaagggcatagtaaggccgtggggcgtcgcgccgctggctggggtgtccgtacagtcggcaaccacacgcggcagcgagaggatatagatcacagtacacaggtcaccccgcggcagcgcgagcctacctgggcgcgccacgccttgcatgcaggtacgcgtctcacgggaattcgcgcgctggctccgcttgccccgtcgctcctccgtactccgctactgtctccccaaatgggccatgccagcccgtctccaactctccgtgcatgtatgcctgccaatacttcggtttggataattttagtctctctcacatcagacgttgagatattaattagaagtattaaacataaactaatgataaaacctattccaaaactctggactaatttacgagacgaatctatgact

SEQ ID NO: 97463 - DNA, 506 bp, Oryza sativa
aacgatccttcttgtacttgatttctgatgattgacattcgttgtttttggtgattgattatattgtcgtacttcatttttgaatgtgacggagataaacctccggggtacgccctcgagacgattccgtttactatgatcactgttattttgatgtaaattatatgccgtctgagagagttcactcccgcgacatttgattattgtgtgtatgttttgtatacaccacgaatgattatacgacccttgatatttgtgttgatcatctatactaaatcgttgatattaatcttattgtttgatagtgtggtttgttcctcgtgagatcgtcaagttaaggtacgacccccgcccggggagttctacacatcggttgatcagtgtcctcttaccttctttattaagcagagtctcgtactgtattgcaaatttagtagttctatatttctgccatgtgctgaatgtacttgaaaaatgaagttccatgattaatgatgagaatcagt

SEQ ID NO: 97464 - DNA, 732 bp, Oryza sativa
ttgtaaattggaaaataagtacaaagtgttgatgaaaatgtttatcttttgttagtcgtaatattaaaataataattgtgtttatcttacagatggattttactttttacattcttacatgtgtgatcagtacgcaaatatatctcattaccggggaaggtttgtaatttcctctttcctattcttttctattccaattctatttgactattttatgatacagtgcgaatcacaaaaaatgccaagaaggtataaagtaactctttatgaataatacatttgtgaaaaatgtgtatttttaaatttgaaacaagaagattgaccttaattccatatgtcctcattttgttataacaaaatcccatcttggcctatgtattaatggtttcctgaaagaaagaatatattcttttagtctttcatctgttgttgatatttcgtgagtaattccgcaatgcatggaaatatcatcgcgcgatttttgaattctttctctcaagtcttgcatatttttaaccgatatttcacggacattgcatgtacgtttgcggggactcgtgtcttcttctgtttttaaaacctcaagccagccccaaagttgagaattatgaaccttatgcacaaatcaaatagaaaactgtaggttgtattaatcatctctcaaaataatggatgcattgtcaatgattgtttttcattgagatggaagcctcaaatcgcagggctgcagga

SEQ ID NO: 97465 - DNA, 526 bp, Oryza sativa
ttatatctcagcgccaatctctatggcgctgagaaaacagcctatttttgtaattcgtttttggcatgattcaattttgaaataagttttttaaaagggtcaaattgtcaaaattacggtactcattgtatattttaccccttttagaagacgtactcctcattttgatggctagaattcttgtttggtattttgtcattttgtgaatccaactgccattatttgatagatgacatgactcattttggttgcttattgagtttcaattttcacttaggtagatgtgtaaattactttcccaatttaattaatatatatagtccagtactactagtagcctctcctaatgtttttcatcaaaaaatattctaaaaattgaatagttattatatttttaatcatgcttacagccaattctcgattcattttttatacggaattcataacttctgcttctatttatcgctagtcattttcaccgacatgtacacgattcttgcagggtcaagtccgatatgcaacgcat

SEQ ID NO: 97466 - DNA, 563 bp, Oryza sativa
tctgcaaacatgcattgtggataggtttcgggtggttcatcatcaattctgcagttgaaggagaggctagaaaaagaagtacttgaggtatattttttcttcagaacaaactaggactgccctggcctcatcctgtttatacttcccatttttaaatgtgcaccattttatagcctgtgcagccaaacttttaaatttttaactactaaagtacattgaaaatattccggggttgctacatggagaagtagtggtaggtttgcctttttcatgaaaaagtatattttatcattatatgaataacatataattataaatgcagaacttagaaacagttaaagatttgtggttggagtcctttgatgtctctaatgccatctgttttcaaacagaggaaacaacatataggagtcaagcctatgatctttttctttgttcttgtccaatatggaaatacaagaataaatgaatctcattttttttcttgggatagttaataacgggccagagtgcaagttaatagaactctattctgttttcaggctattgaaaatgtttcctta

SEQ ID NO: 97467 - DNA, 642 bp, Oryza sativa
tttggagagtctaatttggagatgttgttggagatgctctaatcttcttgggctgtaccgcaggtatttgcctattaatatatatactccatagtactgatcatttataatatttaataacgaaatttggttgtaacctacctatttttttcatattctcaccagctgacttcttaccagctgtttctcaaaattttaaacttatctaaataaggtctatatacccaattataatcgtaaatctgcataaaagataatatgttaccgacaacatgtcatgcatcaatttttcccacctacctattctacccatctccaccttctatccatctctaattctactctagacccattgaataggtaagtattgagctcatgagtagtcaatgctatggctatggatatggcgtagctagccgtctactgctggcctgcggctagtagttggctattagcttaccttccgatttttgctgctgcagctagctagtgcagccgagtaagctcagtagtaactataacctagtcaatacaccatgtttgttatagaattgtttgatttttcaattacctgaaaatacccacaaatttcaatcacctttagatggtatagattatgctacaactcgtatgctacagaaa

SEQ ID NO: 97468 - DNA, 954 bp, Oryza sativa
tgttatacatatatactctggctaaccatacaagaaaatcgatctatgtatttaaggtggtatttttaattactccctccgtccaaaaaaaactaattctgggtttgaatctatgtgtggtttgaatctatgtgtctagattctctatgtccagattcaaacccagaattggtatgtccagattcaaactcaggattggatttttttttggacggaggaagtagttttctagtctttagttatttgtcatgtaacctccataataattggttagaatgaattaaattatttaaaaagatctcatattagtcaagaaagatatactccatccttcccataaaaaccaacctaatactgaatgtgatacatcttagtacaacgaatctaaatatacatctgtctagatttattgtcataaattcgtttttttttggatggagggagtacgcatgttgctcagatcgtacatggtaggtgtgatcatgtttgcagatttccagttcgatttctaccagccgcacgccaaaccttcgatccacgcatatgcacctagtaaaacctgaagatagatcgatgtgacttgcattgagaacgacatcgatgcacatatatatttccacatgcatgtcaccagagcaaaacgtgagaaattgccgaacgaacgaattgaaggcatgtgcttattaattgtttagcacgtacgacacatatacacgtacacgtgttcattgaagtcgtcgtagttgcacccccgccgttaagcaacaccgacgcgatcgagtcatatgtctcgaagaccaagaaacggctgtgctactgtgctcccatgcaattgtacaccgtccagccaaaactgtggtgatcacgacagatcgagatggcctccgtccatataatcaatgatcaagatgcaattaattagctgcggggaagcatagatggtgtggtggtgtg

SEQ ID NO: 97469 - DNA, 659 bp, Oryza sativa
aacttaatcatatttttgtcaaatataggaactaatatagaaaaataatattaaaggaagtgaaaccagcaacaaagaaataccatgttagaatttgacaataccatattttctcaaatttgacaataccataggaacaaagaaataatattttctcaaatttttgaaattataagtagtcaaatgtaggaaacttaatcatacttttgtcaaatataggaactaatatagaaaaataccatgtaggaaacttaatcatattttctcaaattttagctcataacatcaataatttgagaaaattcctaacggaattatataaaattcttcaaattgattgtatcaacatatcaatgatctagtaaaattctggaaaagaataaagataactaaaaatgacaatatgcatatctcatacaatagataaaaaatattaacaaagttccattgcaaaattaatggaattttaaatagttttatgacattgcaaaaatctttcggttataccggtatacaactattctgaatatgtaaaagtctttctgaataccgatatacaactgttcctaaatttgcattacttttcggttaatgaattactattgattaaaaaaatatcacatgccatagagcaataccaaaaagaaaaagaaaaggaa

SEQ ID NO: 97470 - DNA, 620 bp, Oryza sativa
gatatggggaattttgtcaaggcgggtcagggtcacagcccgtgcgtcgcgtcatcagaaaaggggcagggcccgggcattgccaggccaccacctgaaggccatcagccaacacccagtactatccagctatagcgttgtatagcctcttcttgcatgatcaatcaaaatctaatggatgcaagctagatgtcacagttagggcactgtcgccacaatgtcctctcttggagggcatatacatgcactaattattattaattcttggaataactagtctggatcaccatgattataactccctgttaaatcctgacgcgacagccagatgaacagtgtgactaattgtgtgcatatggattagtagttaatttgattaattctgcagccaaattgacctgtgtttatgttgatgatgatgatgattatgatgatgatagcaactgcagatgaattcgcactctcgttcgtacgtacgttcaaaaactacgtcccaactaatgctagctgatgatgaattagtctctccgggctccattgatctttcttgtgtgtttgattgatcatgttgactgcagaaaagtattggagctttgctgtatgttcgttgttgctgtacg

SEQ ID NO: 97471 - DNA, 511 bp, Oryza sativa
ggcagaagagcagtactagcatctttttggttgtagtactagctctgaagtctgaacattgctatcaggatcttgtttgcagaatacaatgtatcaaatctatctgttttcaagcatttctttttgttatctatggtgctttttagatgcctgctcttcttttaaaaaaaaattaaggattagatcatctcttcttttctgaagtcttctggatgacaagttggctgacaagtgaaaaccgaaaaaaactgaagtgctacttgttttcaattgaaaagaaatgcaaaataggatgtggcttgcacgcgttagtaactgcatggttagactgccaaacaaatcgcttttgattaaggtgtagattaatacaagaatcaaagattgttagtttttggtcaaagctagtacctttacagaatccatctgccctgttttgtcaaagtaagtctaagttggctgcaagctctgcctctagataccttgagtaaattctctttttaagattagcatt

SEQ ID NO: 97472 - DNA, 588 bp, Oryza sativa
ttagcaaaaatatgtcatgcatgcatctaccatatgtgatacttctacactgaaaatcagcatcagtcatccatccaccaaataaagacttcatacgcttacaatcctacctctaactattcatacaaaatgagacatgagccaaaaaaaaatgttgatgagaaaaagagaaatgctcacaaagaaaaagagacaaaatattctcgagcatgaaaaaaagaaaaaaaaaagggagaaaaatagccatgttcactaaataagtgcaaggaggaggatcatacaaaggggttatcatttcactttcacatttccacacacatgcatatcttgatcatagttttataactagctatcttcttgaatccgatttttgactttacaatgtatgttatacaagtacgccattcttattttctaccatgagctccacataagccttatgacaagtagaattagaaaaatgtacaatcaatgtcatggtgagaagtcgtacacattgagcgatccgagagaatcaattaaggaaaaaaattaaagttacgttccttatcagcaaaaagaaaaaaaacaaattacttgtcaggagta

SEQ ID NO: 97473 - DNA, 680 bp, Oryza sativa
tcatcaatatttttttctacaaaatcacatcattaaaaactaacaagtaaactactttgctccacagttacctgattcaaaatttttcattgcaattactatatttgtaataccttttataatagagaaaattcctccatacccctgaaattttagccgatcccttctatgcccctgaattctcttcactccctttatacctctgaattttgatttggatccctttcatacccttgccgtcaattgaccgtttaataggtatagaaaagtcagttttgcccttcaatacatgaggaatatgtagaaatttgtagactatattgttgaaagtatagaaatttgttgtgtgattataacattcgtaagtttgttgtacatagacattttaataaatattaaaaagtatgtatagaattttctttaaatgataagcatagttttggaaaacattcctaatatataggacaggaaaaaaaatgttgatctaagtaccataaaaaatgctacatatactcttttaataagtaaataaatattagttttttatgtcattatgtaaaaataaactttgaaatgaataataccttgtacaataaaatcatgaatataatagtcttatataacaaaattatacacttccaacaatatagctagtctacaattttcagatttccttcatg

SEQ ID NO: 97474 - DNA, 1002 bp, Oryza sativa
tttttattctgaattttaattaatctcgtattgggttcttatatggactcttctttcattccttatatttcattcgaatttcagttatttttaaattgtatttttacttggactcttcttttctttttttccgattaatgtgggaatttctagcccccacagtaaacgtggtgcctccattcaaagccgcgtaattacgcggctagcacccatataaaattatatactttttaatatgattttacttaaaatttattaactagttatcttgttgtcttaagattttgaaagaccaaacctaatcatcctcgtgtttctaattttatagtttttaaatgtcacatagttgctaccccttacttctgtcagattattctttattagcttgctcgatctaccactatttctattcattctccttggaacctttaaaaaatggatctaaaacttatagtttgagtttattgtccagttgggcttctattttataatttccataagtcccgtcaaatgctgatctaccactatttctattcattctccttggaacctttaaaaaatggatccaaaaacttatagtttgagtttattgtccagttgagcttcttttttataatttccataagtcccgtcaaatgctgccattatactcctctacaaccgtccaatgcatcttctctttattgcattgctattttaaaaatcgaacataattatcattttggttcattttttttactttctagaagttccgccaaaacgttagcgactttgtcactgtacttctctatggcctgcccgctgccgcccttctttattgtcatcgcgattttaaaatcaaacatgattattattggggtttatttttttattttttggaagcctgaacctttaaaaattgaaccttatagtttttagagtttattgtctcgttaggtttcatttttataatttctagaaatcccgtcaaacgctgccactatacttctctatggctcgtcc

SEQ ID NO: 97475 - DNA, 620 bp, Oryza sativa
ttctggttacaccgaagtgattctcctccgcttcctctctctattccatggattagtttgtgtttttgttgagtttttgatccatggcatggaaccctaggtgaagcacgaggtgttcttcaatttgcaccaatagagggtagtttcttggtgtgattcaactcctccaactggtaaatccctctccctcttgtgcattctctcaaatcgatctatttcaccctagggctatgggtagttgttccaatcttgatgaaataggtccaaccctttgatgttctagttccactcttgtgcaatattgttctagcaatttttagactcaaatgagtagatgtgaaaatttttggatgcttgaacttgtgggaggaggtctacctggagccacaggcggtctgaccgtgggtcagccgccggtctgaccggcgagtgcgcccggtctgaccggctggcaaccgtctgaccggcctgatgccgtcagacgccctgctggctgtggtctgaccacccctccataggatatagtcaaattttcacctctccaaattgtttctagaattattgctaatatctatcatcctttactctttgacagtgatgcctccccgcacttgccatgg

SEQ ID NO: 97476 - DNA, 569 bp, Oryza sativa
ccaatatgatatctgtgaaaataaacaaaatcagtgatcaagtctagacatgttctttttcttttgaaaaatggtacataaactgcagcaagaagtgaactaatgataaaaactaacatgttcaacaggtaaatgaacatgaaaataattgtaaatccctacagctctggtgtcatacagtcataatttaagataagttagtgtagaaatataaatgattcagccagaaacacaaacacaacaccaactgcattattacctctagaaaaaaagagtctcttagggattatgaaaaaaaactagtcatttactcaagtaactcagctttctaaacaagatttatcatgcaaactccaaaagtctaaatagaggaagaggcccaaaatatgatataaaattacagatggctcactaagaaagctgcaaatcactggccatagcatgcccatccacaatttatttgatactattatgccagttccaggatggcatatctcgttataaatggttgagaaagtcatggtctatactacacttgtattcaatcaacaaattcatttatagcgatc

SEQ ID NO: 97477 - DNA, 539 bp, Oryza sativa
gtatcatttagcgagtccaaactttcgatgtgactgggtgaaaaaattgatctaaacaagtccagaatcaggatgtcaaccgcctattgaattgcattgctatgctaaacaaaatgaaactttagcatttacatacgtacgtgcctccttagtttattatccatgttgatcgtccttttttttttatgtcactgtaattttgtaggggacttttccggcaaaaattttgtagggggctgattgttcatttgtatctatgcatatcataggagtgagaggttgttccaacaagaattgagaagagtaaacaaatggttatatttttttttgtctaaatattgtgagaaaacgagtatagttcatctttctggtcccttgatgaacagagaactctaatgttggcaaagtttaacttcaacatttcttgatcaatctagcgactttgcttgttggcaaagtttagtaggccataaaaagtttgttgatgatcatgtgctctacgacaatattactatggctagtggatataatcatttgtc

SEQ ID NO: 97478 - DNA, 511 bp, Oryza sativa
cctctccgctatcaaacatattctcgttcttgcaatctgcacatggacaacacatgtaatcactgggtcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgctttccttggaaaaaggacaaaaaatcgccccctacagcctaccaccaaaatagtgaacagtgggatacagttacactagggggggggggtatttatacttggcaacaaatatctggaacggccctaaaacaatcaaacgtgacgggcatacaagttatctctatcgggccttaaaaaaaagaacggcaaaaaag

SEQ ID NO: 97479 - DNA, 733 bp, Oryza sativa
atatacggccgtatatattttcagaatgtatatagaaaatttaccatgatcgagtacaacattttccctgtgtttttttttgaaaaaattattgtcacgtttatgacttattcagattgatgtcattttaaaccataccattttttttaaagttgccaattatgtgcactgtttagtttcttaccaaattttgataaaatacttaaaaaatttctatcgtgcttagatgaaatacttagatgaaacatactatatttgctactactcggaagacttattcgtactttcgtggtggtggtgacatatgtttagagtttagacacttcattagttgcgggatatatttattcctccgtggagatgcatattttttcctttcgattaaaaaatatatatacttcttcattctataatataagacgcacatgtgttttaggattgaacttttaaattatttaacaaaaaaaatactataatataaattgaattttatttgctaaaagttacattattgaattgatatttgaatttatttttatataattataatttctttgttataaaacttataacatacgagaaattataagcttaatattagttttgaagatcatttcaagtttgaccatatcttatattatgtttcaattttaatttttaaaatatttatcattattattttattatattgggattagatgttacgtgactgaatcttatcttatatagtgaa

SEQ ID NO: 97480 - DNA, 672 bp, Oryza sativa
accgtcaattgcattgcggatggcctcgaaaggccgtcgagtcgacgtttcagatggcggatcgacgaggaaaagtctctggattgattcggcaaccattgacaaaggggaagacatcatgcggtggcgtccgggtgtcgctacgtacaggcggcggcggcggcgcatgcaggtgccaatgactcggatttgttaccatctacttcatacagataacaatatgacggattattaacatacaagtcacaaccgacacagtgtcccaagcgcgctgatccataagatcggcgatgacaagtgtattaatatattcgtagatcaacgactatgttagccagatagacgacaacttctaggtggtgtcgtgtgttaccgagtgtgaggtgtcgtcgtttgggatagcactccgtcgttcaattaaacggattatgtatgtgcaccttcttgtgtacacggtaagcgcgttcgggcgcgtggtgctgaacttcgtggtcggcaatataacaagagaagagtcggcgcaaaggccggacaaatacatctattcatgcgagaaaataaaacgactagaggcatgatctagcatattaatctcgctgctgctaatttttagaattgatcaaatcgataacttatctcgtttaaccgacgtaaagttcggggctgcaggaa

SEQ ID NO: 97481 - DNA, 720 bp, Oryza sativa
ttgcaaaatagacatattcctcccccttttcacgccaatcataagaaaatttacaaaatagttatcgtgaaacccacatatttgttgtaacttcatggtacaacttttctaaaagaaataatgtggttgcgggtggatatatttaagcttcaatgcttaaacataaatattctaattgttcatgtgcataagtaaactttacatgtatgccaatatggcgtcaatgcacttagaactatcaacctacatggttgattgaggcttagtggataataagaatacattcgccaaaaaaacttcaaataataggcaagacaaatatttacgttcaatgttagacatacaattcacaattttattccacaaaaggttaaagaattactacaagtaaaaaaaaggcaatataggtaaggtgagatgacctatataaaaaaaaattcagtaatctaatgcagaagcttctatgactaaagcaaaagataaagatgctctacatgagcttaaccatgttcttcatattgaacttaatctaaactataatgtaactcgtgtattgtaaaatactatctcaaaagaacgaatgcaagattactgtcattactattcgtctccccctgagttgaacatcaaattcaaatataccaaattcctttccttccacaaattttgagtatgcatgttcttcatgaacatattaatagtataagtcatatatgtgcg

SEQ ID NO: 97482 - DNA, 809 bp, Oryza sativa
actcaaattatgtaataatcgagtccatatgcctatgagaaatataatttccttactgaaattgatgactgggtgtacaaaacatgactcacattttgggatttgaacatatatttcctatatatattaagaaattgtgtattcttacttagggatttgatctgttggtttgtttaacattgcagtactcccttattgattccttcctcgcttctgaacaaaaaggactcagaggtgatacattgagtgcggcaaatttggttctctatgtgtctattcattttctaagtaagctgtaagtactaccagcattactatgtagtcatgctacgcatcatctgcactactgacctctaggtgcttgttcaggtgtttgcatattgttttataatgccaactgaacctatctgaaatcggttcctctaggtgcttgtatgcccgtgcgttcattgcactattgtgcagtttgctaccaaatcaatctcagatttttctagcgagcccggttaatgaatttgtctatgatcaagtgtagctttaatttgtcagatatggtgacctttaatttggatttatttatgatatttccttgacaacctttataaagtttatctactttctttttatctatctgcaaagttaaacagatggttccttaatttgtagtgaattcggttccccatctctggtcctatggtccagagattgacatttctctgttttatgaggaattcaaaaaatgtttttgctaaatgcatactagaacagtacaaccatataaagggggatctgtggtcggcctggtgagt

SEQ ID NO: 97483 - DNA, 675 bp, Oryza sativa
atgcatattttttccttcgattaaaaaaaagataaacttcttcattcctataatataagacgcacatgtgttttaggattgaacttttaaattatttaacaaaaaaaatactataatataaattgaattttatttgctaaaagttacattattgaattgatatttgaatttatttttatataattataatttctttgttataaaacttataacatacgagaaattataagcttaatattagttttgaagatcatttcaagtttgaccatatcttatattatgtttcaattttaatttttaaaatatttatcattattattttattatattgggattagatgttacgtgactgaatcttatcttatatagtgaaagcagcaagccttcttatacgaggatgtgctatatcatcaaaaatatgttagccgtctgataaagagcttggataaataatggtctttggatcgaagagagcatgtattaaaaaaaatcataaatgggctaaatatatggaattttttttggaggtttctggcatctcctactaaacatatgatacatacaaaaagaaaggaaataaagagaagaaagatgatgcttctagtgattcctcttataaacatatactccatcagttttacaatgtaagactttctagcattgctcacatttatt

SEQ ID NO: 97484 - DNA, 606 bp, Oryza sativa
atgttgatcgggagagctctcagatgttgggctgccaaattagaggcctcctcaccacaaaggtttattctaattaaagttacgtgtgacaatcacatgtttatatcacaaaggatccattttcttatttaatcttaccaaagatgtatgatatcaaagattaaagtatcaacctagtattgttctgtagttataaacaaggtgcaactaaacatatgatatcaaagatatcgtatgatatcaaagataaatgacaatgtatcctgggaacagaacaggccatatcccctagcatttcaatggaactcctttgttccaaacaggaaatttcaaccagaatcaatcaatgggccatatgctaagttacagcgtactcttggtttctgttcccaaaaccattaaattgtcctcctgaatctcatgttcaagttcacttagcattactactccattaactatcaccagtgtacaaaagtacgcttgtacacacaagattgcatagctgattagcttttcatcccagcagctcctgaatttatatattcttatacagtttaacagactaaggatgagagtttccaattttatttgcaattttcagttctt

SEQ ID NO: 97485 - DNA, 567 bp, Oryza sativa
atgttgatcgggagagctctcagatgttgggctgccaaattagaggcctcctcaccacaaaggtttattctaattaaagttacgtgtgacaatcacatgtttatatcacaaaggatccattttcttatttaatcttaccaaagatgtatgatatcaaagattaaagtatcaacctagtattgttctgtagttataaacaaggtgcaactaaacatatgatatcaaagatatcgtatgatatcaaagataaatgacaatgtatcctgggaacagaacaggccatatcccctagcatttcaatggaactcctttgttccaaacaggaaatttcaaccagaatcaatcaatgggccatatgctaagttacagcgtactcttggtttctgttcccaaaaccattaaattgtcctcctgaatctcatgttcaagttcacttagcattactactccattaactatcaccagtgtacaaaagtacgcttgtacacacaagattgcatagctgattagcttttcatcccagcagctcctgaatttatatattcttatacagtttaacagactaag

SEQ ID NO: 97486 - DNA, 604 bp, Oryza sativa
taatcaggaacaagatgacgtaatgcgtagaggcatattcgaatctttcactgttttgatccgcttggaacaccggttaataacggcataacgcgtaatatacgccatagtgatttggacttttttttttctacgtacttttttcttttctttttggcctaacgaccgtcatgatgagcatttttgactggatttgtattcgaattcgatttattccgtctgactttgcttgggtaaaacggcacctgaaaattcgtgcgtgcgtgcgtgccttgaattatgcacagcatttgcagtttgaccaaggcttgtgctacgtgcggtttagctgcagagatctcggtgtgagtgagtgtgtgcactgaacgatccaaatatttttgaatggtttatgccaagtggaatttgaatttgctatgaaaattatggtattcatgcctacaaaattgtttgtaatcagttttggaaatttggataccactgtattgctggactcgatgggcgcgcacacaggatgtgaaatgtggggaagaagcagtttaaagtttaaacaaaccataaactgaaaaaaggggaaagcaaaagtgagttgaaattttgcctg

SEQ ID NO: 97487 - DNA, 706 bp, Oryza sativa
ttcctgcagccctgccaaaatagcatcagctaaaaacttcaacaatagagaatccagaaaccaaagctagcatccagtaggatgggatcttgtcaggtccgagaaacctttactgatctagaatcggaagagcagatcgccagataagataactaataaatccctcaccagcgggattgaaccttctagtggatcgatctagcgtagtaacacgtataggggctaccctatatctctatctctactacttaaaaaataagaggtgcttccatcgtccgtcaaaaaaaccgggtgaaaaaaaccgggtagaaaccaggtttatccaataaaaaaccagaacggaaaaagaagtccgatccagaaaaaagggcgaaaaaaaccaaaaaaaagcggacagagtccgatacagaaaaaaaaggcgaaaaaaaccaaaaaaaaccggacagagtccgatccacagaaaaaaggcgaaaaaaccatgtttgtccgataaaaaaaataagtccaactcctatatcaaccaaaaaaaaagtctgactcagattggtgaaaaaaattgatctgccggattgaagatctgtttgtaaaaacggactctacatgtcaagagcattccatttttatatgattttaatttttggatttgtacttttatatttgagtccctgtaatttttatatttgcatttgagtccctataatcttgc

SEQ ID NO: 97488 - DNA, 700 bp, Oryza sativa
ccctcctctcacatgttctgcctacctccacaatgtgtgtgttgccccactaataccctactacccctctacagtcgcccactactggagaaagggagcgagaaggaggtagaaagggattatgacaatggcggctgacatggacctggagtcctgcctttatggccgatgcatgtgttgtcctgccacttccttgctgcctttcctcaacctcgcgccgctttgctttcgccgggatagggatagagagagggccagagggggtagggaagaaaggggtgagagaggatgacgtgtgacctggtcatatttttgttaagagtaaaatgcattggtgatacacggacttatcaagtggatgcaatttagtaaatgaacttataaaatacttattttcgtacatgtacttgtccggtgcgtgtgaaccaaaatgacactacatggctaatcttgatgatttaggtgttgattaggatgctacgtaaacatatacatgaaaaggttgctacttagatatacattggttcaataaaaataaagaatgagacgtagtgatggtaaaaaaaaaaacccagcaatgatacaagggttagaaatatatgaaattcatcattttaatgatgaaggataaattagtgacccaatttataatagatatagcatgttttaagcatactcactacggataagcatgtcacct

SEQ ID NO: 97489 - DNA, 1327 bp, Oryza sativa
gggccgcttgcaaaatggccggccccggctggcttttttgcattggggccccttacagccccaacagagggcggcaagggttttcctgcaaaaaaaacctccctccgtcaccgcccgtcccttccccgtttgccacgtcagcttgccgccctggaggtgggcggcagggtcaatttttgtaatttttttggctgatagattatttctgtaaatatttaaaaaaaatctaaaaatgaaaaaatttctaaaattctactgcatatgtacggtcaaaggaaagtccagtttgcatccctcaaatatgggtcggataacactcaactacaaaaccggtataacgactcctctcactctctacagtttatcaatataggttctttgcccattttcatcaaaactcccatatataacgatattgcatcgaacatcgactcatgccggactaatattctttcatacattctcaactacaaacatcagtcctcaataatcagattatcactaaccaccaaaataattaggggcatagatgtgatttcaattcaaaccatgtaaaatggctccctcgacagtattaacagtggttttcattgaagtggtgcccgcttagtagcccagtcaacatagaaattttaaaaaaaagtaaattgcattgaaggtacgcaaacttgttaagtaggtataatttagtacgtgaacttgtaaagtactcgttttagtgtacgaacttgtgtaatttgattaggaggtgacatgcatatacgtagtgagtatgcataagacatgctatatctattataaatttggtcactaatttatccttcatcattaaaatgatgaatttcatatatttctaacccttgtatcattgcttggtttttttttttaccatcactacgtctcattctttatttttattgaaccaatgtatatctaagtagcaaccttttcatgtatatgtttacgtagcatcctaatcaacacctaaatcatcaagattagccatgtagtgtcattttggttcacacgcaccggacaagtacatgtacgaaaataagtattttataagttcatttactaaattgcatccacttgataagtccgtgtatcaccaatgcattttactcttaacaaaaatatgaccaggtcacacgtcatcctctctcacccctttcttccctaccccctctggccctctctctatccctatcccggcgaaagcaaagcggcgcgaggttgaggaaaggcagcaaggaagtggcaggacaacacatgcatcggccataaaggcaggactccaggtccatgtcagccgccattgtcataa

SEQ ID NO: 97490 - DNA, 596 bp, Oryza sativa
aaaatctaccaaatgacatcttcatttctaccatgtcctgtctcctctgatcctattactctgtcccctcacctacaccacccttcgaatattgtttttctaaacagcttatctataaatagaataattctatgtgtgctgttatcaaccggtaattaactcgtctaataattttgatatatttgtatgggatttgttctgttcaaaaatacaagtcaggctatgaactttttaccatcgtagtctactcatacgagtacattcagaaaaatgggccatcaaattttaagattgacgaagtcaccgtaggcgtctcgctatcaacagatacattgtctaccacttgtcaaatctaagactcgaacgtgagtggattattcccaacacaataaacctaaccagtcaagcttcagtcactttgctcttaaaagatgcaattctcaaggcaaaaacaatttcagatctaataaatccaagggaataaaataatgtaccacaattttgaaaaccaaaatttaaaattttcaaatggattctaataaaatttcagccttgttcgtcataatacacttgtagctcttccccggttttaataa

SEQ ID NO: 97491 - DNA, 626 bp, Oryza sativa
aaaagttgaaagtggtaggtatgcagcaaaaatcatttccatttttgttttcgtcagtaaccatttccacattgctcgtcaggtaaaaattggaaacagtcaatcgggaattttcgtgcccattttcacccctagaagttgccctctaccaacacaaagcgacaaaaccatttccacattgctcgtcaggtaaaaattggaaacagtcaatcgggaattttcgtgcccattttcacccctagaagttgccctctaccaacacaaagcgacaacgcacgaagtggcgcacaatgctaagtagttgctcaacaattatcgataggaagaagttcacttgagatccctcatcttgtcgtcgagtttcaaaatcatccatgaaccagaataccagatatgatatataccaaatcttacaaaacagggtcacattaggtcccatggcagtattgatgacggttttaaccaatgtggcggctgactcaggatggaacccataagtcagtgggccaatcataaaattgttttccctttcgttatactccctcaaaaatgccatttatatgaatggttgttatgttcatcaaagtgtcatcattgaaggatcaagtgtagaggactgatcagct

SEQ ID NO: 97492 - DNA, 618 bp, Oryza sativa
tacatgtgtaactgcgctttacgggagttgggtgttccattcttgaaatgcaagttggaatggtccaaaactattttggcaagttctttgttgtagccgtattttggtgctcagggatgggtcgactgttgtgagaactttttgttccatgtgctcccaagtcatgctaatgatggctaccatacaaaatttcaaacggaaattgattccggcaccgagatgccattaaacctttatctgttattatcgaaaaatttcatctgctgcttgtagctcaggaaagaacgcaaacctttttctctctctgaaaatattgaaaaatttggcaatgtcggtttcaacattcttggataggatggtaattttttttcctagctgggacagcaaatagctccggttgaactttattaaaaccggggaagagctacaagtgtattatgacgaacaaggctgaaattttattagaatccatttgaaaattttaaattttggttttcaaaattgtggtacattattttattcccttggatttattagatctgaaattgtttttgccttgagaattgcatcttttaagagcaaagtgactgaagcttgactggttaggtttattgtgtt

SEQ ID NO: 97493 - DNA, 624 bp, Oryza sativa
agcataagatcgtacatttatctttaaaagaagatcatatatttaatcaggccattggaattaagtaaatagcatccacatatatgtcgagagatataattaagttggttgtgagtcaataggtccattgatgctataattaaggttaaggtaagcggttaataagttattttgattttattaaaaaactaagttggatattttgatttgtaatgagaacttttaggattttttgcgtatggatgtgggtccaaaatataataattttattagcaattaaatatggttggtatagatattaaactattgatttaattaaaaaaacacaatggttcaaccagatcataaattgaatatataatttaaaatttacagctattgaagattctttatttatttataaaacataccaagatcaatatgtatgagatatattatctatacctatattttcaagtgtatgcaatctttgaaagtatgataaaattaacttactaatatagaagatattatatacccttaagccttaacttaattaccatcgaaaaaagggaggcgagcaaggaaaaaatcacacatactcttatcatgcgtatggatggaagcatgtatatgtgttgggcg

SEQ ID NO: 97494 - DNA, 533 bp, Oryza sativa
aagcttgataaagctcatctcccctgggaagcacttgataaaagacagggtcacacgcttgagacttctaaccaaatcttcactcatatatgcttctagaatcccttcatgaatctcatcatctccctgtgcttctttcagatcaacctacaaaacatatataggtcaagtaaatgaaatgccaattataattttacaataggccaatctacaagaaaaaaaagcagtgttctatgctgtgaaggtattttaaaagtgacttgaagagatgcatccagtgttacctcaatattcagttgttcaatctgtggagcacaacgcagtaaagaaaagattgacatgatacttgagattttgccaaaatcaacgctcaagtttgaagtccttaagttccggaacttccatgtaattctctccaatggattttcatcgacctgaaaatcatgacaaatttaagttagactgatatatgatcatcaatgcaacttgatctacttgcttgcaaacagtgtatgagtaattggagtatcata

SEQ ID NO: 97495 - DNA, 1212 bp, Oryza sativa
tcgtttggttcaattaatttaagcatcaaggtcacaactattttggtgagcaaagggcagtctcatcgtactggataaaactagagtacatgtaacagttaaatccagttaaacagttgagttctttcctacaatctcaaatcactgcccaattctccaggcaatgatgcaatgctaaacataacatgatagttcaagtatggatccatctcgaatcttgcaagataaaatagatagtgcagcatggactaagcaagtcagcacgccttatccatcgaaaagctacagcacaatttgtcaggtgcttgtaacgtggagtcagaatcttatctcttgtgttacatacttacatttcagctttacatacttatataggccagaagccacccaaggaagtcaagagtcagagctctctcattcggaatgcaagttagatacaggatggtctaaagctgggaaggaaaacgccaatggctcttctaattaaggcgagattgtctgctgacaacaatgatgtcacaacactaatattagagaacctgactaaggagaactagagaaggcacctaatggatgtatttgtaatttgtcaaccacttctgcagaatactgtatattgagagcattattgtggctgaccttatggaggtgactgacaaatcactttaaagcaaatgaaatataacttggggtgcttaaaaagttaaaagcttataatacccgactatgaaacggcgtgatcacgagtttacatgccgatgactatggtttggaaggattctccctaagagacaatgattggccatttttgggtgccataaattgctatgatgctaatcactaatcagcatcaggtgaaaacaatacaacataataacagttgacagcaagcactaaaaaaaaatccggttaagggcaaaagcagatgattacatatggaggaaagagaccgatccatataatcctgatcaagcctacttgttaatcactaatcagcatcaggtgaaaacaatacaacacaataacagttcacagcaagcactaaaaacaatcaggttaagggcgatagctgatgattacatatggaggaaagagaccgatccatataatcctgataaagcctacttgttaaactttgcacacgctttactgcaaattatttgcatatattacgtaaggaattacagttcaataatgtactgtaatttaaaa

SEQ ID NO: 97496 - DNA, 580 bp, Oryza sativa
tttctttaatgtgttttcccatgaaatgagaaacgcgaagcaacaatttttttgcatcgaattcaagcaacacttaaagtagtaactgatggaaaatttctataaactatggtaaagagatcagtttaatgtatcttgttttgtcttgccagcgagtttacagtccagttaaagaaaaatgtttcttagagatccgtttgcaaatattcgaattgaaataatttcactctcctgcgcaaggcctcatttatttatttatttattgccggaacagggcctcgtttgttgatcaatattgcatttaatcaattaataaactctcttattcattagtacctatgtttttgtatcatatgttgctttgacttttattctaatcaaacttctttaggtttgatcaagtttatataaacatttagcaacatctataacaccaaattagtttcattaactataacattgaatatattttgataatatgtttgttttgtgttggaaatatttctttcctttttttataaatttggtcaaacttaaaaaagtttgacaaaaataagttaaaatggcttatattatgaaa

SEQ ID NO: 97497 - DNA, 519 bp, Oryza sativa
cgtccactaacggtttcttgtatctttggggaaacggaagcagccgatgtgtcgcagtactcttgcggcactattttacttggttgagctgctttgtcggtatcagccggactagcaggtgatgcctccttgttactgctctgtgttcctgcagggttaggatatggcggatcccgagtagactttccccggctcatggtgatcgccttaacatactctaaggaaggttcgggttgtcctagaatcctcctagactcatttgtagcgactagagcagctaactgtgccagctgtatctctatcatcttgttgaagcttagctggttttggaatgcggaagccttctagcttaacatatatgttctctaagatcttgtcataggtggccagctttttgctaagagcatcagtggttttggcttgcgcgaaaacaagatcctttaaggttgattattgaaattaccgttattattgttgcctccttggaagtatgggcggggctggctccacccatggcct

SEQ ID NO: 97498 - DNA, 1298 bp, Oryza sativa
aatgatgacaacatgaagagaatagcggaaagtaaactgaacataaagaaagtgaatctgagttgcttgttcgtgggagctattcccagttatgaaccaagtgatatgttcgcagatagtctacagaggtcagagtaaaatcacatctaaccacgaagcttcaaaatttggccggataacgctcagacaataagaagtccaacagtaaaactatttgggaagacgtcaaagtatatcaagtgggataagttggttctcttgggaagcataattcaaaggcaaagttatcgaccctcgaatcgaatagcagaagtagctagcacccggagaccagggaagctaatatgaggcagttaggggcaagtggccaaacatgatatcctagtaatgacaaagctgatgtcgacgcatgtcacgaaggtggtaacttgtatgaggttgacgccaaagatatgaatgataagaagttctagaactgaagccccatcctcaaccaccgcagcctagtctgagtcagttaaaggtgcaaccagggacaagtcgggtgaagagaagatttcatctgcaacaggagatcgagccaagcagtccagagtggagaagtttagttagacaagtttgttatagaagacagagcggaagaagtcagacaagaagagaagaccgcccaacctatcttcttgctggcctcctcgaatctcggggacgagattcttgtaaggggggtggatttgtcacgtcctgataaattcatcccgaattaaaattcattctctaaaaggaataatagaattaattaaaattcgaaaagaaattggcaaacactaaaatacgtacaagaaaaattcaaaagtggcccggagaatttttgtcaaattctccttggtctaaaaggagccctcaaattttagtggaattttcagagcacaaataataattgttaagaaataaacaaagttaaaaaggatttataaaaagaaaaaccctaaaagaagtccttttccccccctcccttcttgggccggctcggcccagtccctccctctctctctcttcccccgcggcccatcggcctcccccgcgcgcgcgccgctgacaggcgggcccgctccccgctctcgctgacgggtgggtcccgcctgtcgtcttcctcctcgcgccgcgccgccgctcgcccgtgccctagcgcccccgccgccgcggatttcgccgcatcccgccgtcccagcgcgcattaaagaggggaaaatactccccgcgattccctctcccgtttccccctctttttcctctctctc

SEQ ID NO: 97499 - DNA, 612 bp, Oryza sativa
aacatgtgagaaaaagtcaacggcgtcatctattaaaaaacggagggagtagaaaatagtattggcgatttgtttgaaaattaaaattctcatttttttgtctcgccaatgaagttgaatttggacaagactttttatactgctattgaacgtcatcttatctacatgtgggatttttttccatgtagatttagataacctttactccctccgtcccaaaaaaagtcaaactgcgggtttacgtgccaacgtttgaatgtccgtcttatatgaaatttttttataattagtattttcattgttgttagatgataaaacatgatgaatactttatgcgtgacttctctttttaatttttttcataattttttcaaataagacggatggtcaaacattggacacggaaatcagggttcgtctttttttgggacggagggagtatgtcgtggtttattcgagttttcatggtttccacagtatattttcgcactcaactaacaaatgcactattagcaggggcaatgcctggatggatcattaccttcctgctcatcctacagtttatttcgtcgctccgtggattggtaatcttcagcttcgttgctcattttt

SEQ ID NO: 97500 - DNA, 808 bp, Oryza sativa
ccagatagtacgtgaaatagacagggcgtaccgaacgctcttggaatctgctggctagtatgcagcgccttgcagttgatcactgacggacactaagcctgagatatgcacagcttggaagctacaactgaaagaacaacacgggacaagatctgaacttagtggtagtgtagtttatgcatgtgctttacattcaattcgcgtctatgcatgtgctttacatttcattagcccaacaggcttatagcccacgttcgaagctaacctgatctatctttttaatcagttgattctataaacaatgacaaattaggtgaacctatttacataccgttagcgaccatggtataaacctgatggttatattttaattaatgtacatgtgcgataccaggcaagtaatggtataaacatggagtacaatattccaatggcaattaggagtggcagcggggtggggcggggccaggttgggcaggaacgcccccacattccccccccccccccgctcccggcctcacattggccaccgggtgaataacctgagccacccccgatcctgtagaggacccgacagttgattgggccccgcagctcctatgaggggaagggacaaagggtggttgccgcgtcactctttgataggcagggcaagccgactactcgaaggagaaggagagacggagggtggttgcatcatcacgcgctaatagcccagggccccgctgggttacccgaaggtgaatataacctcccccaccggcgctcacccatgggtgtgaaacctgacttggcctctgcccccatt

SEQ ID NO: 97501 - DNA, 1302 bp, Oryza sativa
gctgacggcctggagcagcctcctgcctggctgcctcctgggcccctgcaggctgccgcgccggctgccgcacgcggcacgccgtcgcccgtcggtcacggtgcgcctgccggtcacgggcttggcgccttggccttggcggctcaccgcctcaccggtcgccgtcgccgccgccgcgccgcacgctgctgcacgccacggccgcgccgcacgccgccacggctcccgccgccggcagccgcacgctgcacgcagcccccgccgaccgccgcacgtcacgccgccgcacgcctcctcccgtcgccgtgctgtactgctgtgttgtggtctagggtttgcaggtttgggtggccaaggcgccaggcgggtggggaattgggggaaaattgcaaatgggctgatatgtggcccaattagaccacaggttgagaggaaagagggaggcgagtggaaaatttaggcccaatagagaagaaatggggaaacaaggcccaatatagcagtttaagctttctttttatttttttaatacctatatgaactatatagtatatatacctattttttttttccaaaaatcttgggtatacatctgaatacccatgaatacatagtgggcccgcccctgcctgttatggatttctcgtaaaaaatacttatggatgttgatatatttttgggaatagataatgaacataggattggtggataatcgtttcagatgtatttgttggtctatttttgtaaagtatccttaacggttaaagcggcaaacattgtatgctgaactactgggttgttggaggtggagctagacatcctatgaaattttaccaactggagcagatggtatgacccgagaggtgccatgtttgatcggggggagggggtgcgactacaactttaggtgagcatgattccatgcataactcttgacaaaggacaagaatcacttgtacaaccaaacttgaattatggttgcatgatcagatgcaattgtccgaggtatacgatgtgaaccacaaggtataccagaaaaaaaaggtagagggaagatctcaagctagcaaagatgtaaagtcaacaatgttgtcacgtcctgataaattcatcccgaaataaaaatcattctctaaaagaaaataatagaattaattaaaattcgaaaagaaattggcaaaccttaaaaagcgtacagaaaaaattcgaatgtggccaggagaatttttgttaaattctcattggtctaaaaggagccctcaaatttttcttgaattttcagagcaccggaaatatttatta

SEQ ID NO: 97502 - DNA, 577 bp, Oryza sativa
gcaaattagcctccactttacacagagctactagcaagatgagtaagattcagctgggcatgtcaagtgaaataatgcagccgacttgaggcggccaaaagttattcagcagaaagctcaaaagcggttgtgaaaaatgagctttgacgaaacttatgcctttccattgtcgtgagctcatgattctgcttttgctgatggacgcatttgaatagccaaaaccgaaacttcgtcccctcgattagtttgatttgatggattataagtgaaggttatctgaattctggagatgtctttttccagctcaaaagtgtttgttttattaatctttttctttcttaccgaatattgtttctagctgcaatttttctcttaatcatatgttttttcatcatacttatacttatacatgatgttcctgcagactttaaaaaattgtcttgaaaggatcttgcaaattttatagcatatatataatataatatagagtaatagattaagcgttaatttctaagtgggtttcatatggccttatgggccatgatttttggactgggctgatgatgttcaaggccta

SEQ ID NO: 97503 - DNA, 594 bp, Oryza sativa
tcaggtttctgaattttccagtgaagaagaggatgtccacccaatttctagaacctgaaaccatattctgacggctgtgtgcactctttgggtgcagaagcccgaggtgctcccaaaataattgtatcacttgatagaattttactgagattaataaagcttccattatctaaaaaaaaatattctgacggcaaagttccaacgatcctgacgcggctggcacaccaattaatggcccaaaatatcaagattcattcatagcctattagccttgagaaaaaggattccatttgccattgttaagatgacaagtagagacagcaagtggcactcataacgtgtagaaaggattcctgcctggatcatgagagattccaaccaagactggttgtagtgcctgtaattgcacgcaattcaggaccagtattactctgacctgctcttcattcttcagactccagaattctcatgcacgttaattcttgggttaatcctgctagctgcctagctttgtatagtactcatgtattaatatgctgtgctggggttcatcaatactacttagtattgagtgagaatcttggacaaaataat

SEQ ID NO: 97504 - DNA, 1413 bp, Oryza sativa
agttctagcacggactccaagacgcagtgtgtgtatgacaggtgggaccaggtattaatagtgtagtatataactattgtatgaatgagctattagattggctatagataaattggatctagtagttggctatactattagggtatatctagagataattaattagccccttatatacatggggctgccttttaagctaaattaaattaataccactctatgcatatccagagtggcgaagccaaatacaccgataaatctagacgactataatgacatttttcaattaccaaccttgtttaatttctgaacacacatccggcaatcagcaaatggagacgcgcggccggtgatatggaacccggccggccgcttgagtggtctgggaggtgactccacggaatatgatttttttttcagtaaagtcagccggcagcaagctttcttctattatatctacatcagtaaaaatgtaaattagtaatattaatctgcactgtgacaacttaagaaaacattaaaaaattatagtttcacaggatccggaggcacttaattataaaatgacgcctcagtgtacccgcgcgcagtcctagctagtgatgtacatatgtctctgtacgttcaatcttattcatgtttttcttagttattctatctttgatatgccactcatgagaaatagctatatatatattttagtttggatggagtatatggttgccgtatcaaaattaaagtacacaaatgatttggatgtcagctttgcaaaaacttttattaaaactggtttaattaaattgcctttaaaagagtttttttttgtctgattttgtagtaaaaggtcactactacataaaagttttttccatataagaccccagtaggttgcaggtgattataagtagctgtgcctataaaaacatgccccaccatgggccggttgacggtccgcatgcgatattggccacattattgcatgcggcattcctaagggaccgcatgtgatgccgcatgcgataatgcggctattatcgcatatggtcagcttaagcagccactaccataatactattatcccatacgtctgcttaagccgaccacatgcaggcaatgatggcccatatatcaccacctacctcaagctacacccatttgaactcaaagtttctctctcctaaaccaagcaacaaaaaggggggggggatatcaactcgaaatctttgcttgaatttgatatagaaggtaacgcacttgctttccttcttcatttatctccatttattttaaatttcatcagtgcaatgcggcaaatttctcatttttatgtgagtttttttttttttttgcaaaatctagctcgaatagaatgtttcgatgagcgaattgttgatgtaagcgctattacatact

SEQ ID NO: 97505 - DNA, 1240 bp, Oryza sativa
  unsure (1)..(1240): unsure at all n locations
attttttatattttagcccttctaaaatatatgttttacatataggtccccagaaaactaattatagatatggtatggaaccaccttggtgctacggatattggcaccaagatgggatgccttaagactaaatatgttgaacgccgaggttgttttggtattgacgataggccgagtattgagttgccatcaatttttggaaaagaaaaaacctaacaaatcgatgtatcctagttcattctgataacttttttagtgaaagcttaatctgagagaagaatgtcgatcattcactcctcccaatacctaaattctcttgatttgctattaaattttgaaaagaggcaaaattggattgtgactcattatttgtaattttttccccaaagctaaccaacaggatttaggtattcatttaaaaaaacaggatttaggtataatgagggagggacatacatcctcccccatattaagaaatggtacctannnatnnatnagcggtaataaaataagntacntcgaatttgtaagttttatcccaataaattagcatcaaatcagtaggatttggacaaaccctagatggtagactagccccaaattgattggcgccgtaataaaaacgtcagcaccatatggtgctgagatatcccacctcggcatccctgagagtctatttgtaaaatacgttttttcagagtgtgttaaaaaaatattgaaactggaggaggtcccgagccacgcgtccatgcatggccggggagatattatcgtcgcaggctagctttgtagttgtatgtgcctatcaaccagccggcatgatctgctgtagcgagcaggacagacagaggctggacctgggttggaccaccatgttgtggcctatctcctgcttggtctgtgtaccacactactagtttagttagctagtagatgactagaggtgcatatggttttatactggagcattattggatatatattgtatatatagctagctaccgtataaagaatccatccgctgtcaacgttctagaaacttctgtttctctacacgcatgcatctatatcatggggtcagattcaagtggtattaatacaacgacaccgttctatgtatggtaataaccagctacctcagtctcatatgtagttgttactagtatactcaagagtgcatgcactttttttctttttatggacttttttcttagattacccatccgattcacgatccgat

SEQ ID NO: 97506 - DNA, 618 bp, Oryza sativa
tatgccttagaggcaatcatagagatgattgtatcatacactatgtttacatatttatccgacattgttctttgaaatagataactccttattggttaatgaatatgtgattcttttatgagactcttatgttgtttgttactatttctaaaggatccctgatcaaatatcatatgtggaacaaatatgtttatatgatcagcacatgtattaattgatgatcatgtcttatggattatggtatagacataccaaattaataatgtggacacatgttggtgaacatgttattggatagacccaacatgagacactgtaagagccatatgtgttgtgtcatcagtgatctcttttagtgttggtgtcgaatccttagacctaagattatcatggttctcaccatgtgtagtatcttacttagggattgctaaacactactccgtaattgggtagttataaaagtaattttcgggtatgctatgaaacatgcactgggatattaatatcaacatgggatttccccctcctatggagagatatttttgggccccctcaatgttgtacattatggaagtgcatggccctccccaaggggaatgaggagcaatcacaagttat

SEQ ID NO: 97507 - DNA, 2026 bp, Oryza sativa
aagttacgaactgcacaatggaaagtttgttcctgtcagattaggaaattgaataggtaaaaatgtatgcacaatttatatcccaggcatataatacctaccaaaattgttgtttaaccgatgggaacagcacagagaagcaaccacgttttgcagaatcgtgtcttcctcatgtttgcactttgtggagatcattggagaaaaaaaatcgcggatcctggctctgtcctggaggtaacccattttacagattgacatcatcagcatggattcctggaagcttgaaagaacgttggcaggcatattaggtttcattagcagtgttctttaccttaaaaatattgtactacatcaaagcaggctgagggcatgcgcacaaagattcccacatggtatgaggtatttttctctaatagtccatccaattcattacatcagtctcaagaaaaacaatacactctaaaattaactgcgatgtcattatgttttattgaagaagaataacaactacatgcaattgtttttttgccacaatagagaacgcataaaaaggggagatgaacatccaaattttaaagcttcgaaattcaaaattatatgattagcaaagctcgacttaccttagcaatggttgaaaaagtgggatgacagacgatgaaccaacaaaccaaagcccccaaaagggatttcactatacagaactaaaaagaaaaaataaactactgctccaggataaagattaagtaaaagtaacaatacgaaggcatcaactgtattaatcctcgatataaataaaaacaatctatgtgctttactgataagaactaggtagagatcataattctcaataagctgtgcactcccattgaacaaatcaaggtataacagaagcaaaaagaactactgccttccaaaagtaggcaaatactccaagaactacataggccaccgacagaaatgaagaaaagaaggccagtacagatggtttcaggtttaaacaataagataccagagcaaatacagacaacatggaaagagtaagggacacttgatttcagtggctgaataaatagttaagaggcaaatcaatccccagaaaaagaattagatcatgaattatttttttcttcaccagatcaaaaccattttgttgtgatactgagtgtgcataacaaaacttcacggagataatatttttggttaactaacatgcattccactgtaactgtatcaagcagacataataatggaaccatcaaacctatgactaggaaactacatccaacatgcatatggcactgccgaccttattaaatcataattttagtaagtttcactttgacaccactacaatataatggagaactaatgcaaagctttgctcattttgcccattagatatatgctacaaacctatcaagtggatccctctacatattttttttctttccttatttgatgtaactgcttttagattccgaaaagacctttttttttccttttgtgaaaatggccagttgcagagtgccatagcagaactacaagaatagcatccagaaatagataaatggtactctctctgttttttaatgtatgacgccgttgacttttgagatatgtttgacgatttgtcttattcaaaaaattcatgtaattatcatttattttcttgtgacttgatttatcattaaaggttcttaaagcatgacttatatttttttatgtttgcacaaatattttgaataagacgaatggtcaaacgtttgttaaaagttaatggcatcatatataaaaaaaaacagaggtagtattaaatagaagatgaatatatgagtaaaatacactacatgtcgctaacctgtccacctgcttcacttaggtccatgaagtttcaatctacagtttaaggttcctaaacctatctaaaccgttcactagaggtccgatattgccccacaccacctacatggaagccaaacagtaccaggatagacaggagtgcaccaacatgcacagtccgatcaca

SEQ ID NO: 97508 - DNA, 1006 bp, Oryza sativa
aattctggttgggggtaggattgcatacaagatttgagtatcgtgcatgacaggccagttaccatcaacttgttgactaggagtctagtttaaaccctgtctttgaactcggccctgattgttcgaattatgtggaacctcaggtttatctttcaaggtggcattgatattcttcaactgttggattctcagacttcctaagttaacaacacaaccttgatcacattcacccaagcaaggatgcaacataccacaaaaattatcttgggggcatttaactttttccactttttaagatatgataattaaagatttgtcactcgaagtctataatgtctataatatgtgggtatagtggtaaatccttaattatcacttataaaagtggcaaatagttaattattccttaaaaacgggggttatacattactacctctgttttatatttttatattataagttgttttgattttttttcctaatcatactccattttatatttttatattataagttgttttgatttttttcctagtcaaactccgtttcatactgtaaaaaaatagttaacatctagaaaactaaattaatttcattaaaactaacatttaatatattttgatagtatgtttgttttgggttaaaaatattgtcatatttttttacaaacttggtcaaacttacatttgattaaaaaaagtcaaagcaaattataatataaaatggagggagtagtaaacatgttctacaaattaggccacgcttcacatacaattctatgagcaaatcaattgagcactcggcttcccaagcacaaagctgacgaaagatggccaatataactggatttttcacattttggtccttttaaaaaacttatttagcaaataaacccctgaaaaaacttatcccagccatgttggtgccctcatcccgccacctcagcatcgcctcgccacgtcggcagggggacggcgccagccactctggtgctccaaaaaggacc

SEQ ID NO: 97509 - DNA, 1501 bp, Oryza sativa
agtttcttgtttcatgccacgaatcttaaggcatgagcagacttgtccaaagtctcgcagatgattgtaggatttttctagatcaaagccagaaaaaggattttccctaaccatactgattagttgtgtaaatgggctccaataaaggaggtggctcatagaattcgccccgaggagcagacagctcaaaaagaggttgctccatggtcgagaagagtgacaggaatacttctctagtatagcagagcgaaggtagaaataaaaaaaataaaaaggatatgaggatgaactaggttcagaaatgatcagcaaccgttccccggcaacggcgtcagaaatgcttgttggtatttaatacggtcacagataaaatccgcaagcgcacggatataccgatgtagcactttccctacggagtattccaagggtatcgaatccaagggaacgtgtgtggtcaaatctttcttcggttcatccaaggacaccaagcaaatgataggctaggatagagaggatttactagtgagaaacagtgtctagggaaagcttaactttaatcctaatgcaatacttcaggcactggcaacccgctgtttccagatgtcgctctactacgtacccggacagggaggacttaagtgatctcgagggctgtcatcacctctacacccacctcaaacgttctgtgggacatgcagcaattactggataacaattacctaaacaccacatctaagcaattactatctactttagtgtttataactcaccaaagcaatcactatattttagttgattacagtgaacaataatcttgtatgctatttaggaactaaccaagagataattctcacaagataaatctaaatttctcaggaagaatattatattgaattcagagtaataaacagaataaaagaaataggagaagattaccgacaactctggaattcttccgacttcttctactctactttcttcctattctagtatacaatatagtacaatagagcctcttataattcagctcaagcttggagtgtgtgagtgaagtgaagaggtgatgtccttttatagggcagtaatgacggttgtgagaaggggaaatgtccgaactgccccgcaaccgtcattggagagcatttggagcgtccacgccaaaccccagcctggatggctgagattgtggctcggccgaaccccctggttcggccgaacctgggctgggcccaactggcctagctcttggcccatcttctcccctggacctcctctatccatttctcggagttttgggttgatttactggtatttggatcaagttcacaacccctccttgtatagatacatgattctcctcactgtagtctgattttcctcccaacatcggcgtttatcgtctgcatacaaatatataccaacacttgtggaatatatgagagtaagcacctatcactctgttggatgttttattatctgaactttatgcagatgttggcgg

SEQ ID NO: 97510 - DNA, 1514 bp, Oryza sativa
gagtgccgctgcaacgcacgccgccgcctggctccttgcaaatttagggtttgggattggggattttgggagctgcctgggaggggatttttgtttcgaaatgggctcagttgcggcccaagtagaatgcgggccaagtgaaaagggggaaggagtagaaaatttagacccaacacagcagaaatggtaaaacaaggtccaaatgagtagtttaactctttttctttaactttttgcatacatataagaactatatagtatatattctttttgcatacatataaactttttgcatacatataagaactatatagtatatataccaattttttttccaaaaatcttgagtatacatatgaagcccgctgaatcatagctagacccgcctctgacctcacatgcctcaagtggctaggagagtatcatcccttatagggagatcttccactcctagaataggtaaggtggcataaaatccccatgctcactatcccatgagacgaacgttagtgattttttaaagaattaatatttgaataggctaagtcccacctatcaacaagctagggtcacataacaggtttattagattgggttcgaatatatgctagaaagtgcgcaacatatttttttcgataaccagttattaataatttattttttctcttttttttcaggacagaaactgaaggctagcttaggagcctagaggagtggtacccatacgagcgtggtacccccaataaatctgtggtcagatatataatattagccaaaatctaatccgcgtgcgctctccgttttaccttatcgcgcaacacgttcatcggcggtcggattccacaagtgctggtgcgtccgaacatagcctggtgattcacggacgtggcatcatctaaagggatccaaattggaagccatgtgatgttatacactacgccggcttcaaaaataattttctcttaaactaatcatccgatctacgatccgattaccgttgtgttggtaagaattgaatctttataacaagatctcacatgattatattttgatgaaaaaatagaaattatttttataatatatctaaattacttttagatttcactaaattacttctcagacacataaaagtatattcaataaagcctaaaagtaatttacatatattatagaagtaacttagaaaaaaagaaagtaactttatcatgacattaaaagtaaatcagttacggaggtaaaaacatgagtctatgtagaaactaaatttaatcagcataaattacatcattgactaaaaatgattatataataaacaactcataacacgaatgtatagatttctttcgatgtcttgacaagttacttcacttttgttacttctataatataggtaaattactttcaggttttattaaattacttttatgactaagaagtgatttaatgaaatctaaaactaatttagatatattataaaagtaatttctatttttttcatataaatatagtgatgt

SEQ ID NO: 97511 - DNA, 584 bp, Oryza sativa
tacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgatgatgttgcagccgatgaggcaaagaggttggcaaaagggaagagtgttgtgacggcactgattaacatggtctttaccttgccagccgatttcgggattgatcaagccgatgtcgacgaggtggaagaggaatcggctaagttggttctatcaccagaacaggcagtgtttgagaaacccgaggg

SEQ ID NO: 97512 - DNA, 1181 bp, Oryza sativa
gataaaagtctagtggaacaccaccctatggttgatataattcatctcggaaatcaccaattcaatgtagtgttcctatgattaaaattatgtggctagtcacactagtggacagtaatgtgaagaccaggattaaatagaaatttagtggaaggagtagtagattaggtggtggtttggaggttgaaccccaccttcccacaaccagtactttgtgccagataagttaaaactaaaatacaaataattaagtgtgaacacattttcttctttctacttggtggcaaaatgtgccatcgacaatgttagtacccattaatggtttaaaacaaaaatgaacatggataattaatatctcaagcatgatatattaattatggctagctacttgtaattaattcggggattgacaataacaacatgttttcaccaaaaatataaatacacttaaagttaaactttaagttgcttgacatcggcaaaagattaacattcacatcgtttatgcttcaccttataagttgtagctaaaatttaaatttaaaaattaattttacaatcgatatattttaggatttttttattgaagtttatttctcagtacgtgcttttaaattactaagaacacaaaaacgaaagatttattcacagactcataacccgctactgtttataatcagtataagcgaatcgatgattgtgtaaacgaggaagcatgaacttacaaagcgcaaatcaaacgcccatagtaacataatttcagttccaccagcaaattaatttaaggacatgtttcttagctgccatcggttggctggtcatggacaccgaattaaccatacaacttctctcttctcttctctctctctctgagacggctcgcaaattatggtagcggcattacgtccacgccacgaactggtccttaacccgcgccgacctccacgatcatgtggctgtcaactgcaaaagccaaaggtgacaggacacgatgattgattaagataatcacctctacccagatagagagagagagagaaccacgaaatgcttaattaaaacactggtgtgttaggtgactatgcacgtacacgtaccctgttaattatcgagtactttattaaaggttgggctaggctcgaagttgatactatcatctctgcaaaacaactttgaggtta

SEQ ID NO: 97513 - DNA, 829 bp, Oryza sativa
cggccaggtgcattcaagatggcagacggcgatggtcgcgagttagcaaattcatggaacattgatcaattacgtaaattttatgtgtaaatcaatagtatccatacttgtaagacatcttacgacttcaaaaaaagttgattttaggtaaagactacaatcaatgtgttccttcccgacgatcccttaccacgacgacacatagcgttgaaacctatcctcatgtccctttacgccgtcttgacaaggcctctgaggaacctaagtgaacttcggcttgggacgcccagagcggataaggccttgtcagatcatgtagggacaaacgaccatgtaagatctgttcatgtaagagctctcgccgtgcgtattaaccaagccgtgtaatcggaaactgagttttccaacttcacggctaggggctaggattagtgctttttttcaaccgaggcaagtcaagggtccaagagccttatcctccgagaacgcttctccaacgacaaggctgggggctagggagagtgtatgactcaaaaccctaaaccctaaaccctagtcagatagattccttttctatttcatgagtacttcttacaatttataactactccaaaatatattacatgtctccttgaagataatttttacaggatacaaagactcccaggacggctaacgccaatccatggattgaaagactttctcggcaagcggcgccattgacttcgccagattgtctatctctgcgggagtcctccgagaacgtgaaaacccttcttggaggaactcgaggtgcagctgcgggcggtgatctcggacacaggccagc

SEQ ID NO: 97514 - DNA, 1498 bp, Oryza sativa
gatttatatgttataattttttttaggttttccgttttttacataatcaatatagaaagggcggacaccgggtgtggaacaggagggagctagggagtacgtatgtacgtttgtacgtatgtgtataggacggtgatttagtgatttagtgagagatcatatagcatgaaaatagaaactaatatagcatggaaataagagagatcatatagcatggaaataggtgagaattaaagggatagaggggagggagggcgtgtatctctgatctcccgtacgcacggaccaagcgggatgtggatttttttttaccaaaaaatagaactaattccatgtattattgggtccaccaaataagtgtaaatctaataactaaaaatctgaaatagtgggtccaccggtttattagattaccacgtggcggcttaattaggagcgtttgtaggagtccaatgtggcggcatgagaacgtttgtaggaagtttaatggacttttaatatataataataatagatagatagataaataaattgcctacgtatctatccaggcttccttcctagttttgttaattggagggaagaaatttgccaatcgactaggttgtgtagatacgtgtagaaatggggttttgatatttgcatgtcgcgctttgtttattaatttcgggtcatgggtattcctgctctgatacgtgcattcaacgcattgacaagtccttctatgaaaagcttaaaaaacatgaaattgagttgactacgaggcattgacaaatatatcgtacaagaagaatcacgtttttccccgtttgcatgtggcattttatttataaagcaattaccctccctttttcaagagaggtacctatgctgaggaacatatgtatagaggaggtactataatttaatttatgagtgaagtgcacgagcggtccctaaacttgtgcgggtgtgtcatctaggtacctaaactctcaaaatgcattttcggatccttgaacttgttttggggtgtcatataggtccaaacaggtccaaacgagctccaaccctttccatgcgctcgtgtggcatgccgcgatagttcatacgtgttagttggacccacgtgtcagccacatagaagaaaatataattagaaaaatatattttctcctctcttccttaaaatttttatctttttttctgtctacctaagaggagaaaatatggtttttaattttattttttatatatgcttgacatgtggattctactgacacgtaggcgtcaccgtggcattgccacgtcagcgcatcgagtgggttagaacctgtttggacctatataacacacatgcaagttcagggacctaaaaatacattttaggagttcaaggacctagatgacacaccggcacaagtttaggaaccgcccatgtacttcactcttaattttattaactgaatactagaataaactctaccattacttgattgtaaacctgggcttttaacca

SEQ ID NO: 97515 - DNA, 542 bp, Oryza sativa
agataaggatatgatatatgctgatgcaggactacggccacacctcatgtattattcacataagaaaaactgtgattgtgattatgaatacgaggacgtgcttctggttctgtcggcccttcggcaaagcggagatgagacgtgggaagaggagttggctgagttcggtggtgggtgttggacccatcacccacacacgaaaaatgaagcagtctattagcgcgtgattaataaagtattagctattttttaaaatatagatcaatatgatttttttagccactttggtatatttttttttaaaaaaacaccgtttactagtttaaaaagcgttcatgtgtaaaacaagagggagttggaaatggctggtatcgaacacagcctaagaggactaaaggaggtctctgcggtgccgtgggaggtggtggtgtggtttgccgctgctccggtcgatagggagggggcggctggagttcgccggtgtggtggagagagaggaagacgtgaggagatgaggggagaccaagggagcacgggcagtg

SEQ ID NO: 97516 - DNA, 736 bp, Oryza sativa
agaataaaactttgatatcggtttttccacgtgtacccacgctgtcaacatgttacgaccaagtgagcccattcaggttttgcttgagatcgatttacgagtggaattttagtggtccaaaaaatacacttaattggcttgtttataatataataataaattttattgttccattcatttcaaattagttatcattttagtattgtcctaaggcaaacgtatctatccttgacaattaatttctagaaaatcgtataggttaacaacatgtgaattatatattatgaaagtatatatcaaggcgaatctacaaacataaatcttatgatattaaactacatgaatgtctagaagttgatggcaaaatatacaaatgtttaaattaaaacaaacctagaataagaagtaatttgaaacagagggattacatcattaaaatgaataaatatttgacttgagtggctagtaactaagctgattactgcttataaaaaaatgcaatggttgaattgatatgtatcatgggtcttgttggcatattaattatgattggttaatgtaggttttcgtgggcacaaaaacgccaacatgcatttttctttccaggtaaatttacgacatcatttttatgcataagtaacaaaaaaatcatcattgctgtaatagaccacgtggcttgtttaatgcaccaagtctttgagccttatgatatgtacctcggattttgaatttatcg

SEQ ID NO: 97517 - DNA, 660 bp, Oryza sativa
attttattttttattttcaatttcagttgtttcaaaagtgtgttcctacttgaactctcttttaatttttctaattttggatattattttattttttattcgaaattttaattaatctcgtattgggttcttatatagattcttctttcaatattgcttattttaattccgaatttcagctaattttaaattgtattcctacttgaactcttattttattttcttttgctaatttcggatttatttatatttttattccgtattttaattaatctcgtattgggttcatatatggaaacttctttcaacattgcttatttttaattccgaatttcagctatttttaaattgtattcctacttggactttcctttccttttctatttttggattttattttttttatttcgaattttgattaatctcatattgggttcttatatggaaactatggtacatatgcattaagcttaagccaccaattcagctgatgatgaaccggatgctactggcattctagctccctacctcttcataggcgagctcctctgtgactaccgactgttcgttccggtcgtctaacaccccaccctgtactacttgttcggctcggggtcatcagcagccgccgccgccgcgccgtgcaacggtggcggcagc

SEQ ID NO: 97518 - DNA, 742 bp, Oryza sativa
  unsure (1)..(742): unsure at all n locations
gagattgaagacacttgaaaangctagtaacaactgacttatgccgaattcgagctctgtaccccgagatgcttcaagaatcacgcacgtgtgaagagaaggtgcctaaatcaaaccaagatgaattaggatgtggggatttgcaacaaatcttcttatggggagacatctcaaactcagagtgacatttggggtggtttttgcaattttctctaaattaaataagatggttcctagccacctaataaaacacgaagacggcctgtatacatcaatagaattttgggaaccaccacaactccggatctgatttattcttttctctggagttaaactgaccacgtttacacttttaaagatcattaaatacaaattatgcggatcgggtatccttactgtcaagacacaaaagatcatcaatccgtatattatcagttgattcatgatctcatatttaaagaggtggtaatgaatatattcataatcaccatcacttaaatccagaagatccattttcacatttatctacattgagcagattataagcagggcattcgcataatcaccggaagttatatatttatcatgcactgttattaacgggtgaacacaacaacgtttcacagcccgaatccgattagaactcgcggggtttggtggtcgctcaccatacctggaaaggagttccatccaaccaaacaccactgttttcacacattccgtcataccggtatgcacttct

SEQ ID NO: 97519 - DNA, 740 bp, Oryza sativa
tgaactaaagaagttgaaaacccctgaaatccacttctaattatacctcggtaccctgctaaatgtgattcttaagtatcgtattttgtaatgtaattggaagacttcgacgatgaagaataagaagaagagggtgccgttggagatataatgtaagcctttatgctattttctgaaaatgctcatatcatgattgacagaatcacagaatgctttcgcacactatttttatctttaagtgattaaatactgggatatcaaatggttttaactacattttaattgcttttgtgaagatcggtatgatattcgcagaaatggaaaaggttgtcatttataaatttgaattgtaaatcactggaatattcttcacaaccttttcctattttatcattttcatgctcggcacataatttgacctgtttaagttaattgtcaaacttacttattagatgatggctagcttttcatgagaccaacagctcataaaagggcatacagaggccaatggagtaggaaaacaattggctccaaataatggcatggagtggactcaattaaattagcaaacattaagtatgtaagacaaacatattacattttcacgtaaattgttaaaaaaatgatgatagcacaagaaattggatttatgaataacaattagattaggcataagtcaaagaagaagtctgttgaatattaaaatataggtataaccacatgtgtggccaatgtggaat

SEQ ID NO: 97520 - DNA, 825 bp, Oryza sativa
acaggagccgaaagatggtggaaatagcggaaaagaggcggaaaaagggagataaggggggaaaatgcgaaaaaaaaaaaaagaaggatgataacgctgagaccgcctgatatagcgcgaatcgagctcgggacccttccccttgtagttaaccacctaatagttggcagaaccgggctgatgggtcatgtgtcgcgcacagcaagatgtgtgggtcgagtcaagtaaagtctgaggagtcgatttaaaatatggaacgagcacaatggatcccgtggagggtccattaagatgactcaattagcaggagctggcgagcaggtgggcatataatggggaaaatgacagaaaaaagcaatgcacaaaatgcttggaaaagaaattatccattcacaaaagatcatccaatttgggttttatacttacgccctgtttatagaggcacaaactgcctctatatctattctcgcgacaaaaatggagaaaagcatatagaagaaaacaaagactacatggcactgacagtgcttggcaatattaactatttagtgctttgattgactgcagtgtgaaactatgagttgcctttgtagggccatgacttattgattaaacataagaagcattacaatcttcaagcaagagatgcttgacacagtctggagcctcagctaaccaaacagcactactgccgtagtgtataatagcatgctgagctagctcatgtgctaccttattttggtctctcttaacctttgctacacaaaccccacccagtaaactcatcaactcatttggatcacttatgcagccagaattacaaga

SEQ ID NO: 97521 - DNA, 660 bp, Oryza sativa
attattattatttcataggttagtttgattggatgcgcgtgcgcgtgcgtgcgtggagaacgagttacagtggagtacttatataatcgtgtatactgttctcacaacacgatacatcagtctgaattacgaaagctctcgagcataagtaagcttaataatgttgtgcacatgtaactaagatcatggactcgtggatgtgtgtggttgcccaaatttattttagttattaaaagaaaaggaaaaataaccgtgttcgtctatttatatttatgaacgaagggagtttgttacaatgatttattcgtgaactgtttctattcttcaattaatcgagagaaagggacacaaagtaacactcctttttgcccacgaaccgaaaaaaacactgctaattagtcatccatggatccatcttctcccttccgacaagggcaatagagacgacgacggttgctccactgctctccggccgccgtgtagtggtggtcgcctcgtcggcacggtggtcaacttggcccatctatgtaagtcggttgatcgtcggcacggcgccattaattaattactccggccgaaagtgaccatatatacgtactgtacaactctccggcatgcagatttgttgatccgctataagttaatatcactcgcgttgtt

SEQ ID NO: 97522 - DNA, 615 bp, Oryza sativa
tattagagaagtgtcattgttcattgcttgagtcagtaaaatgtaacagctagtttagttttcattttttagcaaaagaagctccatcaatttagtccattgagtgatcgtcaaaagcatagaaatttaggtatcagataaataaggataaaatgtgaagtgcccattaagttatgtaagcaacataagtgcatacaaagcatgtaatacacaaaaagtctcctgcagaagttcagattctattgacataagccatgcaacaagtcactccaaggagtcatagaagcaactatacaaatgattcttaacttcctgaagcttgtgtctaatattagaatttagaaagttattaattcatcgatcatggcagaaactcaaagatactaaacttaggattgttaacaaaaattcatcatttttaatgcaagatgagacatagattagaattctacaacacgaacttaactgttatgcacatcaagatcaaatcattttaaaatttatttttgactaagaaaatattgattcagcccactttggaactgagtcaaacccatcttgaagttttaactctaaatagtaccattatttcaccaacaggttataaacctttac

SEQ ID NO: 97523 - DNA, 742 bp, Oryza sativa
  unsure (1)..(742): unsure at all n locations
tgaaatggttgaaacattgaaactctattaggttgttaaagctcgccaccctttgtgaagaaattccatattccctacccacaaatttttacaataaagagtgcccttctaggaccatctttgtgctattatgatgttcttcctttctataccatgttcttgatatattacatacaatttgaagttttcttgatgtgtaatctcgtggccaatttagagagaacgtcgtcaaaaggagcgtgaagcactacaagccaatggttctctacaaactgctaaatgattttattcctaggtatgtgcgtgacactccttgagaaaaatctgtttgatggaagtgttcatttttataaccagtttaggagtagcttcacaatttggtggatgtgaaaggaaggtgagaatccccaatttatctggtaaaaaacttgagatatatttttgttcaccctagtgatagtgaacttgcttttggtatgctttatttatgcatgcatttgtttaactttgaattgacattgtatattttaaattttcaagtgttttattacttggttagttcgatgaaaccctggattcttcattgatatggagtgaagaaaattttataggcaggtaatattgtgatgctcttcagatatgagtagatctccgcactccaggtcttgcttcataatgctactcaactgcatcattacatncttgtgaaattaccgaggaaactagatctgatgaatattgg

SEQ ID NO: 97524 - DNA, 747 bp, Oryza sativa
tggagaatggtgaaacgttgatatcgtcaaataccatctggtaccccaacgatgtagtgctagaaggcatgacggaagctagatagggacgattggttgacagggatccggtgagcggccgtcttaattgttatgctgttttttaaaaaaaaaaatttggttaattgcatcgtgtatagtataaactaactgaaattatcctttggacgatatacaattacagaggaaaaaatagtctcgtgcctatgatatgttaggtatgatccacaatgatctcaatatgagttgcacatgcgtgattactagttgcgaataaaggcacggcctccacggggcgacaatgagtataaacatgctatctatgtcaagtgccatatctctgaaactacagcttgtcaattgctatgtcccagatcacatcatatattgggttaaaactggtaaatgacatcatcatatatttctggtgtcccttttctaatggctacttatacacaagcgaagaccagtgtatcattcgctactgatcctcaaaaattgtagcatttgactactcagcaagaggtatacagttcttctccacaagcttgaaaagcaaagtgcggaaggcagaattcatttttagttgatttaagtcaaactagtttcatatactcacggtatgaatactgtgattaaatgtccaaccattggttattgtttaaactggagcctcagtcctactgtccaaggtttaaactggaccat

SEQ ID NO: 97525 - DNA, 752 bp, Oryza sativa
  unsure (1)..(752): unsure at all n locations
ccgcgnattgatttgagtactgattgaccanatccgaattcgagctcggtacccttagacaagtttttatgttttgatttttctcaaaataaaaatgccttatatattttataatagatggagaaacaagttagtattcctttatcatacaataatactctattgtcataatatatgacgtttgttttttcttgagcaaactttcaaaatttttcccatcaagaagatctcaacggcagggcaccgttggcctgacctatatatacacatcttttaaacgggtcttaagagccacgcaacacgtggcttatgtggctagtttaaaataaagctacctataccgcttatgttttgtttcacaagtaaagatatttatccatccactctctcatctcaacctattataactattcttattttaatctccatttattttttttcacatactttttctttttaatcaaccgtaactaatacatgtatctaactttaaaaagataattgttacgagtacaataaaactggaacgattttagtactatactaaatagtatggttatcgattgggtggaaacatcttggatcgcatatttaccgcatgcatttgagactactaaatatcgtcctctaatagtttatagcatgcttttttttaaaagaaaatgtttatgttttaggatggatgaaatactatctgaaaacancggaggnataaaaataaagttttgtaccgaacttttgtgaactaaata

SEQ ID NO: 97526 - DNA, 744 bp, Oryza sativa
  unsure (1)..(744): unsure at all n locations
ctgtccaatggtacgcctnnnnnnnnnnnnnnnnnnnnnnnnnnnnnnnnnnnnnnnnnnnnnnnnnnnnnnnnnnnnnnnnnnaatcgacgacacaaccgagctgtggtagctgtcacaaacagactcgacacggatcctcgttacaccacctatacgctaagtgaactggctagcatattgcggtgcgacatatggacacattgacaccgtgagtgataaaagcattgtgctgcagccagacaccatttctgtcataacaagctgctactctagtacacactatctacgccaaaatcaccgacgtagagaagttactctaaaacaacttatccgacatataatcatatgacaccgttcataacaaaacactaaaacgcacatcaaatgagggtacagaagcttgacaacaacgatcgaacatgatcctattccgtgaaagatacaaaagtgctcatatgatatggagaagccactaatagatggcactgcgtttcttcataaacatatgacatgaacattcgtacatcttctaagcaaatgacgtctcatacttaagaaggctcaccgctacagggaaagcatggcatggcagcaaccgcgagcggattacagatagcagctggttcaaagtgctgagaatacgcgtatactatcaggaagctgatgagcgagacgcaatctgctgtatctggttgacagaagtcgatcgctaccattatgatgagatcggaccgcagtggg

SEQ ID NO: 97527 - DNA, 644 bp, Oryza sativa
  unsure (1)..(644): unsure at all n locations
ctaaagtcaactactcttctgtttgcatgtcaccttgaccaccttggatctttttctcatgtcttaattaacacgcagaatgccgaatatacaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaacttctttccataatctaaagaaccgctgtcaaggttgtcattatttttaaggcgtgaagattggtggttcggctgagattaatttttggcggcacccgaaatgatataatacattagcgcatgtatcaagcgttaactattactccctccgtttctaaacatttcatgtcggcgacttttttaaatatgtttgactgtttattttattaaaaaaatttaaggaattattaatttttttcctatcaattgattcattgttaaatatactatatgtatgggtaccgagctcgaattcnccctattatggggccggat

SEQ ID NO: 97528 - DNA, 1043 bp, Oryza sativa
cctgcacccccaaggcagcaaacaggctagaaccatgcaaatgcaaattaagacaagattgtaaccatcaagacatagtaaatatatctgatgtcaaaataataacacaaacaacataatgctatcgagtctgagcacacagatgtatattgtcaggagcttcaggtgtgtggtgtgtctgtgttttccttaatatgaagactagtatatttaaatatttcaactgcttagacagtgagataataagggtgacaaggggaaatgcttctcacttctgtatgctcaattatgctacctttctcatcccgtaacctagcatatccaggaagattgcatcatcagtatatacaacaattattatatttgaagcattggatgaacaaaaaaacagtacttaggggttaggatgtttcaaatagattgcttgaattatgtgaaactaaactgtatgctattgaaataaagtcattcccaacagtggtagtagattacatattgtccatatttgacagcaaatatggtataagatagaaagatgaactggcaattgtgatgtgatgtctaccaagtaccaacttggatccttcccaaaagaaaagtgatgaagattgaaatcctaaaatgaattacctttcacaagatttgacaacgttcgcaccagcttcaggctcacatttacgtgtcttcacaaatttttcttcaggtttgtaagcaacatcctgaagatacacaaaaaacatgttacagaccacaaaggataacatctgtccagtttggtaatagagtgatttgacaaacagaaaaaaggagaactttctaacagtcaacatgccgaaaagagatacagagagtgcacaaaagaattttctttagaagagtcagataagaagtataagattactaacgaccaattgaacacttcaatgttttgtacttcctccgtttcacaatgtaagtcattctagcctttcccaaattcatattgatgttaatgaatctagacagattcattaacatcaatatgaatttgggagggctgcagg

SEQ ID NO: 97529 - DNA, 686 bp, Oryza sativa
ttcatttttaaatagtgttgttaaccttcaaattgtttgatcattcatcttgctaaaataacatgtaattattattgatgttgatgtgacttgtttttatcgttattagatgtcctttaaagcgtgatctatttttttcatatttgtataaacttcttttaaataatactacgacgtgtgattaaatgtttccaaaatccaaacatcaagaacatcctatatttaaaggcactaactcggaaaatttgcttgtcctaaatctcgagaattaacaatagagactaatccaatatgggtaccgggggactcaagtcccccctttgtatccccatcgaaagaaggagagagggggaagggaaataaacggaagaggaaaaatagtagaggggtaaaggaggaggaagaagatgagcccccccaaccaaccctagcactaaagcctcttgaaccggtgaccaacatggtagcaaatgaaataagagaagtataccaacgatgatgatgtagtatgtagagctagcaatagcaatggacattgattcttacttcctccatccccaaatataatgcattattgtgtggtgaatgggaaggtggttggtgtcgaaggataaggtgagaagaaaaattgaatagtgaataattaattggatatgatgtactctatatttcttatatttaagtaa

SEQ ID NO: 97530 - DNA, 576 bp, Oryza sativa
acaaatttgcgtaaataattacctgataaaatagccataataacagagaggctgggatgcacgtttatcccatacttcagaataagtaaagaaatgaattagatcattatatgcttcttcaatatgtgaaaggcctgtttccatggtgttatttacagaaggtaaaatagattcgatcatctcagaacaaaaatatattaggctattgtgcactccttccagacatgaaaactaaaagcatgctgttttgtacagatggtctccagaatgtaatgtactccacatgaatcgtatatcgtatgtcttcatagctgaagggagcattataaagtagtatgggttctagaagtacaaaaacataagataatttgccaactgaaacaagtccaaaagtcaatagtttagacagtagcttatttgtagaatcagcaggtgagttaatcagttaatatttacagtattgtaatttacatagaacaatggtaaatcacaactaatttcataccaatcatctggaaaacgtagacagtgagctgtgttagcttttcctttcgccactttatcaactgtaaaata

SEQ ID NO: 97531 - DNA, 590 bp, Oryza sativa
ttttttataatggaattcaatcaagagatatatgagctgattaccaattatgacgaacgaaaacttaatataatcagtgaacacttgcgattttatatgttaatttattgggattatgaacacgatgcatggaatgcataaatgcaagctagtaatgaaatcatgtggaaattgtgcgtctcaattaatttgtacatcatgcccatcgtttttatatttgaatagatgaacttggcatcatttgaaaggcgtgcggcctacaagagaatgcactttctttttgcttgattgtatgctttgtaaagttatcgcgtttatttcatgtcttatttttatgttttcgttcatgatgtaatgactaaagcagctagcaaagacatacgctgtacagtaggactgaggtcactatttgcttcgagcaactgaacaaacagtgtgcacagatgagtatccctctgtgctagtaataaccgtactataagtttgataaaaatctactgcaagcatctaccgcccctatatattaagattgcagctctgatgaatgacattgacccaacgtgaatctttgcagaagccccccccccccc

SEQ ID NO: 97532 - DNA, 609 bp, Oryza sativa
agttgagtattcagctgttgggaaaatttagcgatggaccacaaaaaaccaattacaaaccaataaaaccattacaacatcacacatgattaaaacttttttcgctacaaaagaaaagcaaatgcgtgcacagctcaccatcatacactctgctcaagtccatatgcacacacacctaagtacgcgagcatttgatgaagcagtcaaggataaatcaacaaccatagaatagctagttcatgctaacctgttcatagtgtaccctgggatgagaatccttttgtgagcggactttacaccaacactccaccacacaccaaaattaatccctcataattaatctaaccacacaatatttgatgaaatctgcacaggaaagtttgaatatgtttggtttcttatagtatagttctcccactttctccaacacataaataatcaccttccatcatttcaaaaaagtactgttattctctatttcgtcatgctcttttctctgtgcagataccaaagtaggccacatattagcaaaggaagtgattagcttgcagtaaacccctttttttaaaaaaattactcatcaataatgacttcattgtgaaaacgttg

SEQ ID NO: 97533 - DNA, 561 bp, Oryza sativa
atggtaaatacacctgaactgaatggagatgaaagacctctgctgtaaaagaacaaagatgcatagcaaaattactgtggtaaatacacctgaaggtaaggataaaaaatgaacgtagccacgtagataagtttgacatcaactgttaatcaaagtagttatcaacttatcataggatactatggtgacttgagttttcagctactgaatcactaatagtacaatagtgtactaaacaagtcatttgtcaggttcagtacattatagaaccaaccttacagtacttattttattgcgagcaaccttgaattaacaagagggattcctataaaaaaacaagaggctaatttccacacggagataaaaaaagcacagatacaaacagacaagttggtcagcagtaggtgagcagcaacaagtgccatttgttctacatgggaagcaacaaacacagcatgtggcgtcagatccatctggaaggatttccggatagagtttgggcaattcagttgaaccctcaattctacgcataacccacacagagaagtagaaacattgaat

SEQ ID NO: 97534 - DNA, 630 bp, Oryza sativa
cggtaaatttaattcattttcaatttaccatacatattataacattgtcaccctttgagcgtgcgcttaggggctatttctatttgatattcttttctgagcgttgatttcaggaaaattctattcaacattgtggaagactccatgtccctatggttctacaccaagatcgactaagacgagtacgacaaatgtcgacaaagctccgtcgcagactctacgccttctcgatcgctcgagaacggttgctggatctcgacaaggaatatggaatgaagaaatggtgtacacctagacatatagcacataaaagcttagctaagagcagagaataacaggagctacattattataataaaacaagggcatctgtataaagaaaaaaagtaccatgtcttgaagtcttgattgtgagcacgataatagaacaaatatattagttgtcatacctccaaagcatcgataatgaactgcttcgaatcttcatcaacatgtctccagtcatcatgattgagagggaaacccttagttcttacaagtgtaccaacaacatgtggaaactctttagcagctttccctactggctgatcaaattcgttgaactccatcttgatcagtggctcgtcttct

SEQ ID NO: 97535 - DNA, 727 bp, Oryza sativa
attttactccctacaatccaaaatatatagaacaacaaccttaatctaaaaaccaagaaacaattattatcatctcctaagttaaatcatcgtgataaatataatactgcatccaacaaaattagagatgttgaagattgaggatttaaaaaaaataataatttggtggtgagaagatactaattaattgtatgtatgcacatcttatattatgaaatatatgaaaaaaaatagttgtgttttacattatgaaatggatggagtaaatattagaagttattatattttaggatggagaaagcacggagtatttgtatttggttcccagtcatactttatcaccattgagggctcctctgacgtaaagttagagggacatggtcaccgacgtatgggccggccccacctatcagggacctatgtccctctgactttacgtaagaggagctccgtccatttgtcaataaatattgttacacttgtttaagttgagacaattaaattcttggtcgtacattagcaagtctaagtgaatcttaccaaacttttttaagttgacccaatatattaaaaaaaaatcttgtcacaactatagctacaactaaacaactgccagtgtgattaaacttccctaatactagatgcaacaaaatgtgactgataaccacaaacacccccttacattggccctcaggtgacaatggtgacgttgaaatatcgagcagaa

SEQ ID NO: 97536 - DNA, 584 bp, Oryza sativa
ataaaaaagagagataatttaaagtatactttttttgtgtatttgaagcacgggagtaccaatctttttggaacttaattgtatatactccatccgttccattttaagtgcaaccataaattttcgtgcctaactttgatcgtccgtcttatttaaaatttttttataattagtatttttattgttatgagatgataaaacatgaatagtactttactcgtgacttatgtttttaaatttttcaaaaacttttgaaataagacggatagtaacgcgaaaaaatcatagttgcacttgaaatgggacggagggagttattagaagtgctctcccatgccgtggtgctagctagaggtagatctctctttatcacacctacctagcttagctgccttttatgtcttctctgccctgtcattttactgtcaataatcgaaatcgaaaccaatcacactcgcgaccgaccgacgccctagcctagccacttgacgctgtttccaaaaagaacggatgaactttttgatagatcatatcgatcgatcattaattggtccatcttttacgatctccattgattgattgat

SEQ ID NO: 97537 - DNA, 576 bp, Oryza sativa
taaccattccgtgagcgtcacatggcagacaggtgggccccgtgggagttagccccaaccaccgtccactctgctgcctttttcgcggtaaaaaaaagcgagtaaaacgaaaggggaaattcacctgccccattgtgaatagtcccgtcgtccccttcctcctcttcctcctccctctctcctttttcttcttcttcttctttcgaggagaggaaggaggcagccgcgcgcgcgcggaggcgggcaacctctcctcgactcctctcccccaccgtttcgtcgtccccgcgtgagaggtaaacgagctcctcatcgatcgatttctctctctctctcgccgcgaattcgcttggtagccatgcacgcgcgcatggagggaaaccttttctcttttgttgttgtcgtcgtcgttggtgcatgtagcttcgccgtcgttagtacgtgacaacctccggcgacggatggatggatcggtggcggcgaggcggccgcgcgccggccggcattttgctatttttttttcatcatgatgacatgagcgcgactgcgtacgtgcttggtggcgcaagaagggga

SEQ ID NO: 97538 - DNA, 512 bp, Oryza sativa
tcagtagataacaccgagcaattgcagtcatgcttaagaaaagctacaatcaaaacaacgaacaaaacattgcatacctccatgttgaaactacatccaatcactgggttacatcttaacattacaaggaatataagaggctaatcgctgatgtgctatgcagctcacttcatttcttgcttatttatttatttatttatttattttagacaaaagaagcttatatcaacctgacaataataatagctacgactagcaacattaaaaatatctcatgtcttatgttgccaatgtaaagtacaggggaggtggagtgttagaacgaaccaaagtagtccagatgttgaagcttgagtagaggagtgccatggccaaaggcggctgtgccaacaatggcatcataggtccagcttgttggggctgcaataccatgtcaataaggtggaaggcctgcgcacaaaggcagcagctccatcgcagctctggcatgtgggtacggcatcacagcgaca

SEQ ID NO: 97539 - DNA, 710 bp, Oryza sativa
attcctgcagcccccttttcacaggctcaacactagcagcagccgccatcgccgctaagccgccatgtcgcctcgctgctgcgtcgtttgcgtcatgccgtcttgtatcctcgtcgatcctcgcccaggcgttgccctgcagcgactcgacggcagctgttaccgtcccatccatcgtcgccacaagcaagtgtcggcggcctgcctccgcctccccaagccgacaccatcccagccacaaccgctcccaatcggtgttgcatcgtcgtcgtcctagctggcaccggccgctagccccgccatcgccgcccctagccagcactacattgttgttgtcgtccctagccagcgtcggcggccagccccaaccgtcgctccgtcgtcaccgccaacatctatccctgcccgggtgcttcgagtctccgctcacccggcgggtccccagcggggctggggaagggtggggttttccaccgtctagcaatgcggggctggggcgggggataaatgcagagagcgggggccgatcaatcacctgttgctagctcctgctcaaaatacggagtgcaccaccggcagattggccgcagcaacacgaatgccacgggaagaagtattgacgaggtaggccgaaacaagtggttaggatttcaattccaaaagaaataagtttattttccctccctccctcccaaaaagaaataaaatcg

SEQ ID NO: 97540 - DNA, 1835 bp, Oryza sativa
aaaaattataatggcatggttccaaattacccctttctaaatggctcatgtacagtaggcgaccaaaaccatatatgttgttgcacacacatataatgtacattccattatagctatgctattgatttaccttttccatacattaaactggggagtatatgacaaatatgtatattagataaacactaattataaatttcgacctcctgtaattgatcattacgggaccacaattacaaataatctgtacctataacctcacagatctaacatatagagcatggataattattaagccttttataatttataatgacaagtaaaatatgatcataattaaaataatgcctcattggaaaaaatgataatataaattaatcgatgtaattatttgtttgaccctaaatccatccaacaacagaacccttagtataagaccatttatagatgtatgcgtagtcgtataaccctcccataaccttgtagcttgactaaaccacatattagcaaaatgtgtatatcatatattgtgctagttagtaccaatagagccatcatgacaatataaaagactaagaatcttggcccttagcatgattagaatccattagcaagccggaatagtatgagcaaccctaggttcgacaccatcattatattttgcttgtgcacatttgattgttgtttgaatattggtttttctcgcgtattatagaatttgtatatcggttagtcgtgaggcagcgtatgcagcttccaggaggtgaagattgatcaagattatatcaagaataagaactatcctgagcaggcaagtcatcaccccattccttgagcatgttgatcccaattgtgaaattgttttgtttacaaataaaattgcatgcagtgatgaatatcctacttgttattatgccatgcctttgattattgcttatctcattattcccttgtacccataattacgtatgagtccctagtcacttatgacgaatgcttagtaatgctaatttagattcatgcattctcatatttatcaaatgctttatgcttgggcaactaccttgggaaaggtagttgagatacggcatgtggagacatgagcgccatattgccatgacattgatgagatgatttgtgaaagaaagttaaaaactaaacaaatgttttcgactagggcggctggaggatttgggtggtgtccggtaaaggctagtgccgtccctggtcaattaaggaccgagccatgaagctaagcatgaaacgactccagtacaaccgtacttctcgtatgggtatagacttagcagagtaaatagccgagcggaggcagtatccctgcatagtggttttcttgatgtgtgtgaggcaaggcctatggtggggcagccattggtaggaccacgaggggcgagtgcctacagtggtgtcaccatcggtaggactgccatgtgtaaacctaaacttaactataacttaatgcatgtgtgagtcttcccttcccgggagagccagaactcctctcactgctagaaaccttggacgcctagagtgcatgaggactaaagttcatggagcgggtactgccaaagtggggttattgaaaggctttgccgtggcaagtctcattcgttgggacgtaggctcatgtgttgggcaagtcgcggagtacgggtaaagtgtacatccactgtagtgtgagtaaaccaaatctattcgaatagtcgtgctcgtggttattgagcaccgggacatatattacacttggctagactctaatttcttaatctgattgggtggaatgttgcatgatgattttgtactggtagatcaac

SEQ ID NO: 97541 - DNA, 656 bp, Oryza sativa
taaaattgatattgtacagtagagtagatgtcaaatagatatatttaacatgttttgtcactgtagcaaccacataaactaagtataagtgatgtctcaaatgaatggatgtataggaaaatactagtacttatttaatattcgatggccatataattaaacccatgacttataggttagttaaatcaagtttagcctcatattttgtaactaaaatattaatactcatagataaatctttaacttgtttatgagaataataacatagctagatgtggaggaatcaccaaataatttaatcaatgcaataccatatagaatagcacgtatatacctaaactggttaccacttattagtaacccaacaaatccagtgcttaaacttgcccatcacatatataatatcactcatagaaactagctaatgtataatttaactataatatattcaggaatcacttggagcattgggtagtacaccttctaaagtgaaaattagaaccatgccattataattttcactttagaaggtgtactacccaatgctccaagtgattcctgaatatattatagttaaattatacattagctagtttctatgagtgatattatatatgtgatgggcaagtttaagccctggatttgttgggttacta

SEQ ID NO: 97542 - DNA, 899 bp, Oryza sativa
agattttatgcccaaacaaggcaaccgggcggagcgtgagaggtggagagcgtatagtggcgcagcatcgagtggtagtagaagcaggctagcagcagcgatccatgcatgccgcgtcccaggacgcgcagccccacagttctgcatgcgccatgatgccgttctctatccctccatcgctcgcttgtccggcctcctccttttgatctcatcatcggcaactatagttacattgctgctcctacctagctagagtaggaggggagaagagatatcctgggcatgcatgcattgttggcttggctaggtgcttgtggaccttttccaagctgaaaaagctaaaagggttctctacttctctagcttggggattttgggatgttcttggcaggctttgcgggagaactgctggtagtgttgacatgccatggcaagggcgaaagcgatggcttgattcactgagcgccgtgtattgcatggattgtctgggcctagctaggttgcaacttttctagtagctggacagtggatttattgatcatctctctctctctctctctctctctctctctctctctctcttcttttttttttggcaagacaccaaggcaaagagatttatgctagctagctcatcacaataccaatgatcgagcacccacactcagggtatgtcttttttttagacggaggaagtatttactgtcataccgcagaaagaaattgtgggttccggccggtcatcatgcgtaattcaagtactccatattcaacacagcaagaggaacttgtagtcttgtagacagctttgtcagctgttgcagcagacgacacggataatgaagagggagacgggtatctaggggaagagacgaccaaaactgacgggctgcaggaat

SEQ ID NO: 97543 - DNA, 680 bp, Oryza sativa
tattgacatgctttgttctgtatcagctgctaggaagagcagtctggtggcacataactatttgggacatttaagaaaattttggtcaaactattaaaactttgccatcagttttatgttggactatgttttaacagtatattttccaagggaaatctatgcatactatttattttgtttttatgaacattggagagaagttatcgatgcttaaagttttaacagttttgttccaatcttttcttagacggtaaatatttatgtccagaagttgattatttcgttaattgtgtgctgtgatcccattgtctaattgtgtacgatcagatcccattgttcaacaggtttgtgattttgtctgaagttgacgtcatcatttatttccattatatgattacgtttatcaagtactcctgtggcgtgtagttttgctgaacctggacagcaaatttattttacctggccctcgttctgcaattgattctcaacagccacatttcatggtgtactttctctaattgaatcataacacctggcagtcactctcacgctagctgtgtttgtgacggcccgctgttactgtttgctccggcttgataataatcgtcactcgtcgttttggacacggtctcaaaaaaaaacaattctgattattattttttattataatatgtataaaa

SEQ ID NO: 97544 - DNA, 728 bp, Oryza sativa
catgtcaatagggtcggttcaccttggtaaagttagtagtcatccttaagaaaaacataataaaggagtgtaacataatgcaaaactcgcaatatatggtgatcaaacaatacgaacgatactgcacactagagtactatattttgaagccagtctgaacaaaactggaccacttagaattatcaataatcaggttactgaaactgtctagctaagaaagtggacaaaaaacagaaaaaaaaagagagataactgctcaatcgtcatttagaaacaattacaagtttaagtgtgctaatcaattcaataacagaagcatagaacaccacttggtgtcatatatctagaaccttttatgcactatttttttaattcatggatgcaggtgcatgaagaacacaggcatattttttgtacataatgaaaagcattaagaaattaaattacaccccatcatctgcatatatcagatgcacacagcccaacaaagaaaaaactcacatgaacatatcatgctatccagtagcaactggtcatgaataaccgaataacacaaaattcttagacagtactctaaaacaaaatgatgtaaatgatcctacaaaaaaatacaagtaaatactgcagtcttctccatgtctattttgatcgagaacattgctatgaactttgcataacatcattcggttatcatacagcaagtttgaatcacttgtaggggctgcagg

SEQ ID NO: 97545 - DNA, 1475 bp, Oryza sativa
caagccatcatacatgggtagagtgaaattgcttaattgtgtgcataactaagccacaagatctgtttgcagtgcgcttgtgtataggcaattaggtcttccatcgcttgcgctatagcttatcagccgcaagcatgcaaccaaaatatttagatctcctttggattaataaaagaattaatagaaaaaaataaagaacctcaatacactgaaaaaaacactaaaaaaacacttacgataactttgaaatgatataattgctgccaaggaatttcatttatagcaaagcttcgttcataggaggatttttagggtgaaatactttgattttaaatgatataattgctgcaaagggcccctttgaatcgcaggattgagaaaacgcaggaatatgaaaaacacagcattttgatataaatgtaagtgtaaaacaaaggattgcaaaacacgagaaaaacacatgaatggttgtttgattggaccgtacgaaaaacataggaactagaggagagataaaagactcaaagaaaagttttcatgaggtagaatctatcttatgttataattccttcaaaacttgtatggcattatgcaatccataggatttcataggatttaaattcaaatagctatataggaaaaattcctatagaaataaaatcctctaaaatttttatgaatttccattgaaacgaaagagccttaaatgacatcatttaaaaattcctatgtatcccatatggttgcatttaattttgaacgaatcttgatgttgtccctcgaataatactccctccgtcccacaatataatagattttgagtttttacttgtaacgtttcaccactcgtcttattcaaaatttttttgcaaatataaaaaacgaaaagttatgcttaaaataatattgataataaagtactcccttagtcccaaaaaaaaaagcaaactgtgggttcccgtgccaacgtttgactgtccgtcttatatgaaattattttataattattattttcgttgttgttagatgataaaacatgattaatactttatacgtgacttatctttttaattttttaatatttttttaaataagacggacggtcaaacgttggacaccgaaatcagggtttgtcttttttttgggacgaagggagtaagtcagaaataaaataaataataatttcaaaaaaaatttgaataagacaagtggtcaaacgttgtagtcaaaaactcaaaatctcttatattataggactgcatgacatgatgtgacggccaatctaaaaattaatcttgatagacaaaacctactgctatttccgaactaataataattgtcgttttagacaaagggcctgtttggcacagctcgagctcgagctccacacctcctgtagttggaactcagtcaaacagtttcagctccaccaaaactagaagtggagttgggtggagctctctcacaaaatgaac

SEQ ID NO: 97546 - DNA, 2316 bp, Oryza sativa
tgagatgtacatgttttatagagagcatcttgctttactattgtgggtgctctaatacttagttttattattaaacttgctccgttggaagatagccttaaaagaattttgcatcccaatgcagccaagtattaagagataagggacgcaactatctaaacagtaggcggtcgccgtaggtgccgcatttgccgtaggaaggcgacgtcatcacctgaccttcaaataacactgtttactacccatgctcccagctcgaaatagctgcgcattcctccagagtccatacaaatatggaatatggccttggcgagcacggacaagtaaaatatacaagcagctggtgtaataaacaagctgtgacacactgtggaagcagcctgtggacaaccaaggtacagccgtcgactgcactgttcctaggaaacgagaaggcaacggctttgcgctggagagagtcaccgtagtccgcggccaggggaacagggggcacgcatcctgtcgggcacccagccaaccagcgctccttctgcacgctcgcgtggtcgtattccagcgccaccaccgcgtggcagcttggcagcttccttccgcctaaaataagcgccacggggactcccgggcttggacctccagaaggtcgcgagatctcgaatccgcacggtcgcggccctcgctccgcgcgaaagcgcgtcgaagcagaccgcgactgcaagcgatcgaactcgataccgtacatggccacgtccggggatccaggaacttcgggttcgcaaacgcaaagcgtggaaactggaaacccaaaggatttgccatacggaacggaatccgatccagccgagcgcacgggcgcgctcgttcgccgtgccgagccgtgcgccgcgcggctagtagccgtggcttctcgttctccgcgcgcgtccgtggcaagcaagtcccacggaatcgggggcgagttgcaaggcttgcagctgtcgagccgtggagcgtacgtgcgttcatcaaagttggacaaggcccttttgcttgccaagtttcgagtcatcaccagttaagcatgccccaggtggccaggtatggaatggatcaaatgaggtagaaatagcaggagctgggatacgaacacatgcgtgtgatctggccatgacaactactcccttcaatagcatctcccaaatactcctttgatcacaaattttttgtaaattttatagaatgtattaaaatgcaatatgacgaaagttgtcaatgaaacaagtctgagtggtaggaccagcaccgcccatttcgaccataattgacggcacctctaagctgaagtcatgattctaaggatagaggggatgacatagtagtagggtagtagttgtagtacatacgcatgctacatgcaatgctggggtttttttcttaggttgtgttgagttcacactgaagtttgaaagtttggttgaaattgatacgatgtgatagaaaagttgtgtgtattaaaggttcgatgtgatgaaaagttgaaagtttagaaaaaaaaactttgtaactaaactgggccttagtcaggcttctcaccgtctaacgctgatcaattcaacgatatatgatttttcggatcctttttcgttgcaaccaacaaaccaaggacatgtttactttgatgccaaaaaaaccttactaaattttagcatttggcaggatttcttatatagttaccaaaatttggcaagaaactaaatgtagccacttttttttgtaactttaccaaaatttgataaggttgaaaatgatatcaaagtgaacaggcgtcaataattgtggatgtcagatcaagcagctctatacgtcccgattgcatttcgaagccaaggagataaaaccagtagtcctctacctgcctgacactggcacacaggttaggtggtcgtgtgatcgattagagaagcaaacgaagatatgccgatcctaagtcaaaagattcctcaaaccaaaacttgctctggaccgatcacaatagctctgatgtcatgcccaatctacctcgagagcgaccacatgaggaatgaactctcaacgctcccttttgcacacgtggttttatctcatagaacgccatcccctgcatgtcaaaaggatagtatgtgctgcaacggctgcaccgtggaaaaatggagtgcggagtcgaaacttctctcaccgacgcaacaacacacactttgcaacccgtcgaaaaacggccacgccacaaacaaccgcaacacaccatagccccatcggaatcacccgatcggcgtgattggcggaagcatcgatcgatcgacc

SEQ ID NO: 97547 - DNA, 1227 bp, Oryza sativa
ttatccttttccttttttatgtataggtgagattccatgtgtgctccctcctggtacctagtaccatgttcagaggcatgatacctatccgattcctccttggtatcatgcgcgcacagcataggctggtacctgatacttggtacccgatacccggtacctgcaggtacctggtaccagtatggtaccagttgcatggtgtgtggtacctgtggtacctggtaactggtacctgtggtacctggtacctatggaattgaaaggattcaaaaggatgggacgggggaattgataccacccatacaagccggagaaaaaatcagcaaggaaaccatcaagcaaaaaaaaaaagaaaaacacacatgaggaagggatgcaagcgacgatgaagcattgccggtgtgcggggggagggggtggaggaatcagtcagagtggaatggagtgcgaggggtacctgcaaggtatcgaaaaaatggatgcgagcagcggcgcagcaccgccggcgtggagaggaggatagacggaggggaacagccgcggtgcagcactgtcgcatgggggtggagggacagaggagatcgcggtcctcgtcggcgcgagagccgtgccgcgccacgcgttcctgaggcagcgggagcagctccacgtggcgctgccttccccggcgccggcgaaggagagcgggccgagcgccttccacgcctgacgcgccaccccgcacagctagccgccatcgtcgtctctgtgctcatgagggtgggagagagagagagagaagaagaagaagaagaagaagaagaagaagaagaagaagaaggggataagatggaagaagaggataagatgctagtggtcgtagttatcccatgtgtacgggataccgttgactagtttttctgttttttttactagtaccatgcccatgcattgcaacgggatttgaagatagaatgacaaatggtttttacatggttcagtttttttccaatcgggtttttttggtgggtcaattttcccgtgataatttttcaggtggttggttttttttaggcacggtgggttcttacctggggagtgcaatggttagggaggagaatgattccacttgtaaatagtagagatatccattactcccttcgtactcgtaaaggaagtcgtttaggacaatgtttaagtcaaaccttgagaacataaatcatgaataactctcaagttgttgagttt

SEQ ID NO: 97548 - DNA, 718 bp, Oryza sativa
caatggcattttatggattatctctatttgtaatatgtgatacattggcatatgaagcttggtgataaacgaataaaaatcagatatgaaaagaagctagatcatgttagacatatagagtaccaaaagccaatcaccacaagagatagacatccttgcgattggtaaagatcatcgagtgttgtaatatataccaacaaattttcgatgtcatctatgacagtggcaaaccaaatttcatttgaccactggaatttcctccttagatgattgaggaagtgccttcaagcataaatattccaagaaaatccaccggatcaacctagatatgtctagtagatccattggaaaaaaaataaagggaacgaggaagaggcagacacaatgtagtggtgtaggctttgggtgagagatgtattagttagtggttagtgataaagtgagatctaatgatgcatgaggtaactaataggaagacaaaaggcattgatctaacggttgatttgcatagacgcgagatgatctaatggtctagatgatgtggcctcacggttgatctaatgtatcaactatacaggaagaaaggattagaaatgatagagtatatataatagtactagcattaacagtgagtgttactgtatgtttcaatacaagctagctgtatataagggcgtaacgctcattcaggctccctctgagagagagcgcgtgctta

SEQ ID NO: 97549 - DNA, 669 bp, Oryza sativa
attttctcagccaaaagctgcaatctaccaccaaaactagtagaaactatcaaaccatttctacaattggcattgaatctgactagccccaaatctaaacaactccattctaagagacatttcgtcgaacaacctacatgcgcaagtcagactcgactaactcgtaagctacacgtgctatagtaaacttcctaacagcgcctcaccgaatggatacaactacgggagtgtagcttgcgagttttgagtaaaaaacttcccctcaccttgagatggctcggaagctcggagggagctcggaggcttagcagcgccagggaggatttcacagccttccaagaggagggaggagaataactctgcgatggtctccgccgattcccctccccctctgccttctcgcgagtggaggagactacggcgctgcagctggttggagttcgaggcccatctccatctccgccgccacctgtttcgagcgtgccgccccgcggcgagcccggcggcactcgggcaccgaaaggagaaaaggggagaggaagcggggtcgcgaacttgggcgtgggctgctctgtttttttttattcccagcgcgtatgcaccgttcgattcaaagcgaacggtccaaacaagtccaaagcaaggacgggccgacggagcagggcatct

SEQ ID NO: 97550 - DNA, 640 bp, Oryza sativa
tccagtatagagaggttaaagtcttaaaccatgaccaactagggttactatgtttcatatatatgctcattggctcccgctaatccaaccccaattcgactgtttttatcgattaggaacgttacgttacgttggttatcattatgtacgtacaggactgcagaaaaggccaaaaaggttatcttctcgtggctgaaggctattaactcgctagtttactagcagcagctggcatagtacgtcccggctacaacgccagcaatcccaatcatacacgcatgctcctccccatcaaactttacgtacgtacacgaggtatagtacgtacaagaaaaaggcaagaatattatactaatcgcgtagaactattacaccaatcagccaaaaagaagcacgggaggtggcactccagtagtcgtactcgtactgactggtggtaacgccatgagctgagaaaaggctactccattccagcaatgaatggacgacggaaagtggttttttgatcgtcttctcgcctccatggcaggcatacgcatccatcatttccaaggcagctggatgcggagcgggaagcccatcacgtctcgcattgatcctaaccacgccggccggcccgtcgcaacggaacgcgggcgcc

SEQ ID NO: 97551 - DNA, 1092 bp, Oryza sativa
cctgcagcccctccccccaaaaaaaaagaaaggaaaagaaaagaaaacaaatgccaaaacgtcaccaggattacaagttgtgattttaaaatttaaaattgattcattataacgctgtctgtccgtataatacaacaaaattggcactagtttgcatgtagttttgctctgcatcagctcccaccacgtgaaactgtgaataactggggcatgcatgaactgagatttttctttttgcttccacttacacacaactctgcattacaatatctgaattcagaagaacaaagtgcatttgtaatctctcacagatgcatgttcaccgaagtatattgtccccgaagcacacactcttgtgactcactctctttagttaatttcaattgccattctctcgcttcggaatccgtgcagagaaatatggcaagtgtagaaagaaattgccagtgaacaggtaaaagccatggtcccagacagatcagagttgtaagtgacttatctacacatacgtgcatcacttcctttttgcatagcctatagccttgttttgagaattagacaagagttattttaagagctattttttagcataaggaaatagccctctaataaaatagtcctaaattgtttggattcaagggttattttgagagctatttagcctttaatgcaccttcccatgaagagagatagaaagaaaagacattttttcagtgggccccacccgaaatagccccaattagcactccttgggtggaatagtttttttatgtgttatttccaaatagctctcaactagctcactcttttgaatctttttgagctatttgggctatttgagggagggctaaaaagtattacttggatccaaatagggcatataagggcctgtttacttcgtgaaatgaaaatttttggatgtcacatcggatgtttgaccggatgtcagaaggggtttttggacacgaatgaaaaaactaattttataacttgcttagaaaccgcgagacgaatcttttgaacctaattaatccaccattagcatatgtgggttactgtagcacttatggctaatcatggactaattagact

SEQ ID NO: 97552 - DNA, 1619 bp, Oryza sativa
cactatgcataaatctaaaatgcaagggatgatagttgttgaaatggcatgttcgacaaaagagctatgggacagaagacaagtgctaatgatagttgaaaaggtgaatgcaaggtttgaagaaataggatggtgttagtgcaagcaacacccatcgcacacttgcacgttcaattatacttgaaaaaagctacggtctagaaaaccttttagaattagtgtagctaacaacttaacgtgagttaactttcaccataattattatttaaaattgtaggtttaggtatatgaaaatgatatcggcaggtttgctataacaaaagatttcataaaattattagtacaaactattttaatatctttataaaaggatgaagttagaaccacggggctgtttatttgtgctacttgtggctgtgttacagctaccacaacaatatccacaatgaaaaataaactacgattatatagttgttgtggctgtgatgttgtaattagcacaatgatcagagcctatacctttattgtttttaaaagcctaaaataatatttctagactagtaattcgagttttcattaatagagtaccattaattaaccggtctcaatttatgaactaggaagcttgcgctcctgctcatgcgaaaaggaaaaaagaacgagggaaactgtgcgaaggcaaccgttcccacgggtaggatcacggccattgcacgttgttcatcccttagctggaatgttgcaagttgcaacacgaacacaactagaataaaacacaagtactctctctataaaaaaaacgttaacctaaaataaaatgagatatagtctagtgcaataataaatttagataaaaatgatgatattagattatgtcttattttagattggatttttttatgaacggagtacgccgctagccgcgaaccctgttcaccgcccgacgagcgacgattaccggtttccaacggacagccggccctcgctgtcttagtgtcgtcaaccctcaggcaacccactccgtcctccgtgttttggcgcctgcctgtgccgcactgcagcctacagcggcgcatgcagcgtgcgtctcgcactagaggagaggcttgctgtcgtctgatcggtttgatccgctgacgaggccggtcaagcccgtaccatccagcggtaagacggaccatcaagacgggcgggaggccgtcaatgccaccaccaaaccgaaccacaccccctgtgcaccgcaaccgcaaaccccctgctcctctgcatcgccaggcgccaccccattccgctcccttccaaaaggaaacggacaaaaccagtaaaaccacccgagtgtgtgcagcgtgagaggctacactagagctatagtgtgtgcgagaagggggagaaaaaagaacatggcctcgtgttgcctcctcgcctgtcccctccattccccgtcacattccccacactcgcgggcttgggtgcggggatagcgaactccggaactatagccatcggtcatccttgtatttttctcccctctcgctacaaaacagccgcggccctgccatatcaagcccagaaaaagaagcgtcgttgcgcgagtgcaaacaaatcaaccgggacggggc

SEQ ID NO: 97553 - DNA, 1340 bp, Oryza sativa
attcctgcagcccgaggagggtactgttcactttgtttcccaaacacataggtgtacattgtacagtgaagaagagtggccttcttcctcctgtcactctctactgtagtgggagccatgctgagctgcttttcacataaccatgcccaaattataatctgtctacagtagtacaaccaaatcatggagtcttggttgtggccccaaatcaccaaagcagaatatacggtcaacttttttgtaactttttttctcccatcttagatggttgccaagtaaagttgaagagatacaataacgaagggaaacagtaaggatagctaatctggatggctttaaaaagatttcgttcagaagatctagtgcctatggagtgtgtgacagcttgtaaatgttgaaacctgagagaattatgcatagaaaaaaacctagcatcataagtgtcttcctagggtacgattgataccacaaatgccatcagtgtggcattgacttggacattttttttaaaaaaagggggagaaataaataattggctggtttgataaacatccatgttattttactttgtcacaaataataatccaagcagaaagaacctcagagataaataagtgatgaattcgctcatatcacatctcatttggggcaaaattttcgatttgagatgtgttactagtaggggcggatctacagtacaagcgtcggtgtcaggcgacaccgacgactttcggcaaaacctataacaaaactgcttttccatatgctataacactatgttttaagtataattagtatactatgacaccgataaacacgttatgacactaaataaccgattttctagatccatcactggttactagtacagtgtagtactgtatttagcaacagaaagtggcacacaaacactgacacgcatggttgagataaacagtggcaggagcccaggaaaggtaacctggctcagagaaacaggagaataaatgattgaaccaagaaaaccacaaaaaccatggacttgcagtgaaacccatagccccagcagacagtagttgatggaattaaagacaaaggcagaagtcacaggcaggccccatgcacattgagcaaaaggaagcccaagcaagtgccggaaaagatagggattggcctccaagtaaattctcgctacagtgttatctccctccgaagttgcaatgagatcttgttataattctctctggaatctctctggccatctccctcagatcttgctattcccaaagagattggcgtggtccaccagtccactctgaaatcgtgagacctgaatgtcaaaacgaaataatggaaagatc

SEQ ID NO: 97554 - DNA, 988 bp, Oryza sativa
gtccctatagttaaaatgtaagaaaacacaattatatattttattcctatgacaggcgggacccactggtaattaaacaagaaggtttgaccctaagtcaaccagggccggtcccacatgtcaaccacagtgggttttggataatgtttccgattaaaaataaatcatttatgaacagtgcatttttacaatttctcggattaactcaaatttgaatctttaaactagcataacttattcattttagctccgattcgagtgaaacttgaacctaaattcatctaaattcataagctttccaatggtatataactcactatttaataaaatatattaatatcaaatgattagattatggtcaacttaaaaatgtgctaataaataaaattgatattgtacagtagagtagatgtcaaataaatatatttaacatgttttgtcactgtagcaaccacataaactaagtataagtgatgtctcaaatgaatggatgtataggaaaatactagtacttatttaatattcgatggccatataattaaacccatgacttataggttagttaaatcaagtttagcctcatattttgtaactaaaatattaatactcatagataaatctttaacttgtttatgagaataataacatagctagatgtggaggaatcaccaaataatttaatcaatgcaataccatatagaatagcacgtatatacctaaactggttaccacttattagtaacccaacaaatccagtgcttaaacttgcccatcacatatataatatcactcatagaaactagctaatgtataatttaactataatatattcaggaatcacttggagcattgggtagtacaccttctaaagtgaaaattagaaccatgccattataattttgcaaagtttgagatatgccatcctgacctacatgtcattgactcatgtgggtcctacatgtcattgagataccgatggcatatctca

SEQ ID NO: 97555 - DNA, 698 bp, Oryza sativa
attcctgcagcccaacctcagccgcctctggctacgttcagtgcatcagcttgccttttcacgtgtcgttagaatggctatgcatggaaccttcacacggatatagctagatgcttcgaacgagagaaactgccatgcatccctcatgctcgatcgatcgtgcattcgtgctgcatggattggggcacatggacagcatgacacatctcacaagctgctagaagttggcaccaagctctcgctcatgcatgcttaatagtgacaaagctgaaggtttcttgtcaaaaagtacatcgagaaagaaaacctggcatgggttcggcatggttcaatggttgctgttcaagacaattaacacgtgatgccattttagataagtaggcacggcacggtgtaccaactttgttgatatgatgccacgcgggctaaagttctaatgttgctatcgacatccaagggagcccccaatttgatcagtagtacactactctactgtataaatctagtcaaatattcaatggtagccaaccagtacaacttcattttggaatcatattggactagctagctacctagctcaaccagacaagcgaggtgtagaaatattaattccactgtggattttagtagagagacaaacagacactcgtgcagatcgatcgtggaaggctaggtctcaaaatactgactgaattttt

SEQ ID NO: 97556 - DNA, 960 bp, Oryza sativa
catgggattctactgtggcattcatatccctgtgtggatgtgctgtagtataccaaactgctagtcaatggagcggcacggaggagtccttttggaactgttaccacagttgatagtggagctcggagaggaggcctgttgatagctaaggttctgtcaatggtgcgcaacaatcgcgctcaggcatgctctttgcttctctttgcagtgactctctcacacgctctctctcttatctcgctggtttggtttgtcgtcgttgatcgagttcacagttaaattttcgtgatattacgtccctatgatggatactggatagagtaaatgaacaagcagaaggacaaaaaccagtagttgtgcttttgtgcaacgccacttcagtacgtgagagaagtatgagaatatcttggttgggcttcagaccatatataacatgggtatagatttataatttgcacgttaaattacaatagttaaaaaaatattccatctaaaactgatgatttagatatatgaatttcaggagttatgaatacccagattaaagaaatattgaattcgaagttgtgtcaaccaagtcttaagaacgaatcaggcaatcagtaggtcatagaaatacaatcctatgtatagagttacaaagagaacgtaacatagttagttgtaacttatagttgaagtataacctatacttcatctgtcctaaaatagaataagtttcatcgttcaaactttatcccaaatataacaacctaatatttataaaactttatctactaaactatctgtctacccccttgattttattatagccctaactaatccgttcttctaccttaacaatccgaggagacaaccaaatgttttatctctctcgttaatacacgtaccaaaagttaaaacttgctataatttaagatggagtgagtactatatattcatgagtagggctgcaggaat

SEQ ID NO: 97557 - DNA, 3598 bp, Oryza sativa
attcctgcagccccggactgcgacgttatcgttcgatatcctttcttctgtcaggtaaatttcattgattagttattctgaacattcaaaaaccaaatccagtacctaaaacaaagatcactcgctaaagagccagtgttctattgtcacatatttacatgtgaaattaattactagtgactagcacttctagtcgaactttaactacgtctatatatatccacttaattattttattgcctatgctcttattgtatgggagactatggagttgtatttagggcaagtgatatgatagatgtgactaccacctctaaatttatttattttattcactcatgaactaaaaggtaactcatacaatgtatcacctctagtacacaaataccaatatgtctaatattctcacatattttttaaaatttgtgtggaggttgcctcttgatttaggggtggctcatctactctctcctcacttctctcatccatctcatcactcaatccaatgtgacacttttaggggcaatatatggtacattatagttattgccctaaaccatacagcacacgtacgtgtacctggaaatcgttagttaattgcagcacaaacctctaagctaggacagctaacttttttactgctaagctcactaatctatgtttggtacattttggacatggattaatattctactagtggctttttaccacctcggcagatgaaacttaaccatggccaggatcgcctgcttatccgttgattcgacgaggcagtcaaacttcaactgcaaagagggggagacattttgcatccttcctggagtagccatcatctgatccagtggccatgccttgttcagtttattactaacagtttacatcacagtaaagcccagcagcagcagcagtagtacgtttggtcaagtctcacctcgagtgaaaacttgctgctgctggctgctcctcacctcgatcgtgcaggtcacgtactgattcgcatatactttcgcacctctttgcccctgtgcttttgaagccttgaatcttatgccattgccagccttcaccacggattacaccgaactttactgcttttccttgcctggctgatcttgtatttactcctttatcttttttcctctcttggcgttcctatctttgtttttccgactgtaaagttgtggcaaaagttgctggatccggatgtgtggctggctgccgtagctagctcagctctgaactgttagtctgcaactgcgagtaaatatttcagcagctggctagctaggacagcttcgaattttcagttaggagcttaggataccccagaagaaaagcttagtacccatgccttgcaacaatgtccggccacacacacataaaatggccggccacacacacagaacgagcaagcaagcacgcacgcacgcactcgcacggactacttcatttctgcaacaacttgtaaagggcactactacgctagtgctaccgggattggaatgcttgggccctgtttggaagattaacccagggctaattttgagaaccaatgtttagtcttgaattggtaagctaaatattagtttagggtaatatgtttggatccataggctaattgagggctaaaagatggagagagagtaaagagagaggagagattgagggagatatggctgctttttgatggtccccacaaaaaattagccccattagcattccttggaggggctaatattttgaggggtctaattcactttagccctaaattagcccacatatttagatccttatagggtaatttagagctaaaaggtggaggctaataattagcccatggaaccaaacaggaccttggagccattgaaatctagtgcctagctaggagtactgtagtagtaattggatctcgcaaaaaacctttgtggaagtagtggtcaagatttgcacgccagccaatgcacaaagaacacaacgaaatcactcaccccaacaccaaaacagttgctcaaagaggcacaaagtgacgatgcccttgtagaaaagaaaaggaattctggtactatacgctctatacaggaatcggagccgtacaccatcagcaggcagagagtgattgagtgaacgtccatatgtaagtagtcatgcagattgtgcttttgacagtctctcatgagtcatgtgtgcatgcatgtgggcaacccaaacacattttatactgcttctgctacacaagaatatgcagctctgtgccgtatccagaagccaagattagcacatgaacctccctaaaaattaaccggacgcatccatgcctgcctctgatccgcggatcatgatggaggagccggttggtggctgaccaccagccttccagagattctgttctttcaaacgaaagcacgagctgcatctgcatgcttaagcgaacacctggcccagtagaaaaatgatgtaaacaattggcttttccgatcaccaggtggtggatgcgactgtaggtgcgtgtgaggctacgagagctggagtagcatgcatgctcacgagtccgcatgcagctggctgcaacagtgcaggtttgtgcgagaatggatcgcaacaagctactacaaaccagcagcgctctaatccgttaggattagatcatggtggtgcggaaatgcaattgatctgtgcgcatgtgctgtaacccaagaaatcatactgcttctgaatcaaggtacatcggtgttggaaagattttcagcaaatcatgatgtgtttgctcctcgctatggaggagagactctgcaagtctgcagcttgtttcttcagtttctctctataaaagataaacgaaaaggtttcttcagtcacaacccaatgggatttttggaggtctaatttttcttcgtgcagtgggctcgaatagtataagcccaaatagtaaagcccaagatgttaagaaatggctaattctggggaaaaagtacacggaaggtccctcaacttgtcacaaagatacaaaaatgtcctcgaaccgcaaaaccagatatgcggggtcccttaactatacaaaaccggtcacccgagatcccaggacagtattgacgtcggatttgtcctatgtggcggctgagtcagcgtgtgacccacgtgggtcccacatgtcaggatgccacgtaggacaatctctttcccctcttctctcccttcctctctctctctcactttgctcctcgtctggtggccgatgacagcaatgtggcgcgacttggtgcggcgccgatgaggatggggttgagcccgggggcaaaccgagcgtcgcggcgtcgagctccaccctgcgtgcgacggcgccgagagagggaaagagagcttcaaccgagcatcgtggcgtcgagctccctgacagaggccggcggggagaagtgggagaggaggaggtccggcggccggcgatgccatcaaagatgctagccacctcgaatctttcctctttaaatccaggtagggagagaagccacctcgaattcaaattatccccaaattttttcctcattctttacgcttcttacatttgctcttgaatccttagagttgtcgatgaggaagtgaa

SEQ ID NO: 97558 - DNA, 769 bp, Oryza sativa
aactgaatttgcgtggctggtggagaaggcgattgatcgatcgttaggaggaagagacggacagccacggacgaagaagtcctcaacacccaaccacgggaagaaaaaagccccatgttccaaggcgagcaagacaaaggatcttgcatatgcgagctatgaaagcgacgtcgcacccaacacagcaaaccgaaccccgttcgctgccaaggcagaaaatgactcaacgagagaggttcctcaaatctcaatttctcatgcatcaaaacctacgccactgtgctacccgctctaacctaacgaaaatggtttcatgcaccatcatgacgatctaaagtacgcactatatgtatatgcagatatcctaagtgtcgttgtagtaataataacgaaccgaactgagtgctggcttgctaatttgctgacaacattgttgtgtgacaggtacttttcctagtcaagtaggaatttaaatttaaatggtggaatgttatattttgttaagaagagaatgtagatgaagaagttgttacattttaaaataaattttaaaagttaaaagttgttatattttgggataaagggagtaagattcaaaacacatataaaaattggtcatcaaccaaacatctcagcatctcaaatcatattgatcgagaaacataggtaatctatagaaataatcgtttggatgaaacgcaagaaaccacacgaaacagaagaaagatagacacacagaatgtttccaataggttggaccttatgttaa

SEQ ID NO: 97559 - DNA, 1942 bp, Oryza sativa
agtaacacggcgtgtttagcgagaaaatctcttgattttctttttaaagaccaagaagaaaaccattgggaactcgttgagcatacatcaattgcttcacgcgaacgagaatcacgccttccaccgcgcgagcgatattcaactgtggcatatatttaggatgtagtgatgtagtactaccgaattaattgcttagttaagggtcatttgcgaatatgatgttgcgaaaaatatactaaaacataatgagccgtttaatgcgttttcagggaacttttattatctcctttgaaacatgaaacgcatgattaaaaaaacagagaaatagaaaataaaattgtaagtgtaaaatatagaactataaaataaaatataggaaaaatttaggaataattgcttgattagacagcaagaaaacatatatgaattagaggagatcaaaggaaactttccttggggttcaatctcatatttaaaattcctccaaaatatatacagatagaggcatttcttagaaatattgtaggattcaatagtatccatttttttttgaaagggtcatagaagaaaggcagaaaatgttatataatttaattcctacaaaatttagtgtttttccttcaaatcagggcaagctcaatatatatggtgtagcgtgaataacgatattgttagcaagatcttttacgtgcctggagcaatgaagccggtagcaccactgctatccatgaacaagctacagccaagcagagacttaaaaaaagaaaatcacaaagatttgtgctccttttgtttataaacttgtgtgtaagaactgagtttgttcgctcggaatttatgtggttgtatgtaccccattggtgtatagaagccaggttttataaattcctattatctaaaaagaaagaaaatcacaaatcttgaatgacacaaagtttatccttcaactagaacatcaattactgttaggctcattgtttggaggagctgagaaataaccggcgggtattcagttgagcgctgaagaagttacctttattgtctaaattctatatatacttattgagaaccgagagtaaaatcaaagacaatttgagtactagagattctaggagtggagtagctgttgcggccagggttcaatattttggtttgaaattttaggaatcgcaacccccaaccccaaaaagatcgttaaaaaaaataaatttaatcaaaacttgtttaaatttcaagtttttaaggtcaaaattttcgggcaattcgggaaattttgtttctctggatgatcaaaagtatttttgatttgcaagatatagaactttggctgctactaaggctgcatttggtaccaccaattagaaacttgtctctcacgcacgtataacaaagcaagttattactccctccgtcccataatataaggtattttgatttttttcttgtattgtttgactactcgtattattcaaaaaattttggaattattatttttttgacttactttattatccaaagtactttaagcacaacttttcgttttttatatttgcacaaattcttcaaataagatgagtggtcaaacaatgcaaataaaaactcaaaatcacttatattatgggacggagggagtagcataagattaattaaatattagctaaaaactttttaaaataggataatatgatttttttaaaagcaatgttagtatataaaaattttataagagacgcatcgtattttagtaagcgtgcgaaaaaaataagagaaatgttatgggatgttccatacactcgcacgtactacaataattaggttttacgaagtccatgggcatggagtcatggacaacgtattcactaatcattgaaaagaacaggtgcgtgcatatgggaaaaaaaagaaaagagaaatagaaaactaaaaaaggatagagataata

SEQ ID NO: 97560 - DNA, 528 bp, Oryza sativa
aaatggagagctcaccggcgacgcgagggaatcggagctcctttggcgattcgcggcaatcgagcgacgaacaagcagcggccggcaccggggatcgcgatggcggcggtggggaggctatacgacggccctagcggcgactagcggctgccgaaggcggcggtaggcggcgacgcgtcgggagagcggtacggcgacggcgcacggcaagcgagtgatggccgatgtagccctcgcagcggcagagctagcgacggcggtggcttggcgcggcggcggtgctagcggcggcgagcggtggctggaggtggctaaagggcagcggcgacgggtgtgacggcggcggcgcgatagagtgcacggggaagggaggcgaaaaggggaaatgtgagaggaggacccgaggttgctttttgaaagcatggggagggtggacaagaccgggaggcggtcggatttctcgccgacctggaagatggagagagagagtggggggaattcaattggattccgctcttgcgggcgcgc

SEQ ID NO: 97561 - DNA, 653 bp, Oryza sativa
ctacatacgggtacggatatgtttgtccgcgtaacgggagtggttagttgcagggaaaaggctctctctggctgtgtttgcatagcataactatactttctttatgattgataacactcccaaatattagaagctaatggctaacatgtaaatcgatcagctttacatatcatcattcattaataattagtccgtactattttagagcattttaaatcttatgcaatatacgtagagcttaatatataagtatgtcaaatcatttttctcacatcattttcacaatgtttcaaattttatcatttctataatatttaacatatattcatccataaatttcgcagcaaattaccacggggtgtcacgtagtaaatatatagatattactctgcccgtgctttttcacctgtcaaaatgcacatatttttatcgatagctactaatattttgcacaaatatatttcttattatatatttgtaaaaatgtattggaaatattaattatatgagtgcattttcataaaaaatgtactgatattattttaacgtatcaaatcttaatttatcttttaatttatgtctgatttaggattttttttatttcttgatcgtactcatctactctaaagattgtatctatttgtcgacgcaat

SEQ ID NO: 97562 - DNA, 599 bp, Oryza sativa
gctcagttgtagtcatcttaagtcgtggatttgataaggatctataccatattctttacccccatctttctaacttctactcacttgttttatacgcacatccttctcaaaccactaaagggcgtgttttttttaagaatatatagaaaaattactttaaaaattatagtaatctattttcaggttttttaaactaatacttaattaattatgcgccaatgtataatacttaattaattatgcgccaatgtatatttcattttacatgatggagagaaggggttccgaacacaactttaattgtccgacaccaattatttttcttggttgtccaagtactctggctttccattctaaaatataaaatataaagacactattatttttctccatgtcttataatatatggcacgcagtcatgtatatagtactaactagctcatttaaatttgctttgttttaaatcatctaccatcaaacttccaatcacataattatttacatgtttcgaggtgatccaattgatgaggtgattaaatttactttttgtttttgtgttagtggtggctattttttatattttgggataaaaagagtat

SEQ ID NO: 97563 - DNA, 782 bp, Oryza sativa
cgtttgaggtcagatgccccttgggtggagcaggatcccccatgattttgatgattttttcttgatgttaggaaaaacaagttcaaaaacctctaaagtgggtttcatgcttttggctgctttagtttggtccctttggtcaattcgaaacgacatgatccttaggaataaaatggtttcatcatcactaatggctccttttcgtttgattggcttgctactgcagtggaagattctgctgaagctggaagaagtacctaccctggaacaaacaactaaggcgattcaggaagcaattgatgccctgcgaccttcgtgagctggaattggttagccttctctttaggatctgttttttttttctccttcctgttagtgtgttttgctgctgctcagtcagtttgttctgaaaggttgtgatgttgtgagggttgatccctttcacccttctgcttttgttttctgtgcctatatgtcaagctggcgaccccagcgctatataaggatcagtttgcaaatacttcatgctttctataaaatgcagggcctcgcgtggcctttcctctaaaaaaaattacaaaacaactgagaagttatgttggtgtacattccttaggaatataatactgtgagttttgtttcattggagcaggtatgttctgtgcaatcttgcatgctatgtatttcctcatgggatataagatatttgtgaggtgggctctggattggtctgactttttttccatttccggaaaaaaaattgaaacctattttgtaactct

SEQ ID NO: 97564 - DNA, 514 bp, Oryza sativa
aatggccctgtttgaatcaaaagggttattaaatagtcctccggaatcttgctatttagaagtattaaacgtacattcctgacaaaacccattcaataccttgtagactattttgcgagacgaatctaccgaggtatattaatctataatgatttgttatagtgatgctacagtaatcatccgttacccatagattaacatacctatgatccagacagggccaatattgctctaattgtattctatttaacctatgattagctaatcagcctgacaatctctatattgtgagataaatatagatggagggaatatcatatactgaccatagaggtaagtatgtggcactaatagattaattagcacaagaaaaggtttgaaagtaaatagacaagtattacaaataaaagaaaataaagtttttttaattttgttttccgtagtaatgctttaacaaagcttaaaatctttacatgaatatggttactacaggttaattgttcctcaacctttt

SEQ ID NO: 97565 - DNA, 511 bp, Oryza sativa
ccatattcatgttaagattttaagctttgtaaagcattactacggaaaacaaaattaaaaaaactttattttcttttattcgtaatacttgtctatttactttcaaaccttttcttgggctaattaatctattagtgccacatacttacctctatggccagtatatgatattccctccatctatatttatctcacaatatagagattgtcaggctgattagctaatcataggtaaaatagaatacacttagagcaatattggccctgtctggatcataggtatgttaatctatgggtaacggatgattactgtagcatcactataacaaatcatcatagattaatatacctcgttagattcggctcgcaaaatagtctacaggttatggaatgggttttgtcagtaatgtacgtttaatacttctaaatagcaagattccggaggactatttaatagcccttcggtccaaacagggccattgtcatcaattacagtaaaatatggttagtt

SEQ ID NO: 97566 - DNA, 671 bp, Oryza sativa
ttataagtgattgatggggcaagtaatagcttctttatgatcgattatttcagcatagagtttgaattaacgtgcataaacaattgatctggtatagtgatagtactcaagcttaattaacaagtggcaggccacttggtggtaataattcatttcaaaatggatagtagtgaacgtgatcatgtactgccgtcggataggagatttgaaccctatatgcaaatctagtggttttaatacatgaaagatatatgaaagacgctggagtctggtttacgaaaacagagtggttcatctggttctttatacaggatgattaaaagtacatttagccttattatatataaagatagtacatttttccttgcgcagtaatttcgagtaccaaatacgacctttacacgtaatttctgataaacttttaatgctgtgtataaattctgataaaattttaatatatatatgaaccaacgaccaatatgtataaataatattcatacatactcattgcgtcgacaaatagatacaatctttagagtagatgagttcgctaagatataaaaaaaatcctaatcagacatgaattaaaagataaattaagatgtgatacgttaatataatatcagtgcattttttatgaaaatgcactcagatcattaatatttccaata

SEQ ID NO: 97567 - DNA, 545 bp, Oryza sativa
catgcaagattgcacagaacataactgctccaattaaacaaaactcacagtattatattcttaaggaatgtacaccaccataacttctcagttgttttgtaattttttttagaggaaaggccacgcgaggccctgcattttatagaaagcatgaagtatttgcaaactgatccttatatagcgctggggtcgccagcttgacatataggcacagaaaccaaaagcagaagggtgaaagggatcaaccctcacaacatcacaacctttcagaacaaactgactgagcagcagcaaaacacactaacagtaaggagaaaaaaaaaacagatcctaaagagaaggctaaccaattccagctcacgaaggtcgcagggcatcaattgcttcctgaatcgccttagttgtttgttccagggtaggtacttcttccagcttcagcagaatcttccactgcagtagcaagccaatcaaacgaaaaggagccattagtgatgatgaaaccattttattcctaaggatcatgtcgtttcgaattgaccaaaggg

SEQ ID NO: 97568 - DNA, 599 bp, Oryza sativa
ttcaaatttatggtgtagtaggaagagaagaggggatgagaagggggatggagggggggtgatcacccacccattagcgttgcccattcctgattcaattgtgttaagattggggcaattgtgttcctgcccttgctttctgattcaattgtgattttacctcttctttttagggtttgtgattttgcccttgttttttcaaattgaagcttctgtttgcccttactctgttaggatgaattaacggtgttaatttagtagcagaaagactggtgtgccctttgcatttctttgtgtggatgtactgtttttgccccgatatatgatgtggacattaactttgagattgtatggcaactccacacaaatcaatttattgccagttattttcaggaacatgtcagttgcatatattcatcatcacgaagggaaaaagaaaggagaacgcaaccaattgtccaaacaaatctattacctagctttttcatgaacaaagagattgcacacatcaaaaaggagaaagaacagagagcccaagcaaaaaataatccccagatccatctaacagagcctcaatgattcatcgcagttgcttgccg

SEQ ID NO: 97569 - DNA, 1117 bp, Oryza sativa
  unsure (1)..(1117): unsure at all n locations
tgtaccagcgcccttcccctctctctccccgtgccgctgaccggtgggccccgcttgtcggcgccgcgccaccccgtgctgacgtcagccctggaatatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcacgtagatttcggccgtttcgtcgatccgtggtttctcgaagacgttgctgtggttccatcagtgcgagagcaaggcaagtcatgcaatacaattgatcatattgtacctaatttacaaatgtcccgcatttctattaaatattgcattgttttacaatatcatgtgggatgggtcctattactcagctatatgttgttttccttatgccattgataacttgggtattaaaatgactagatgttggtttaggagatgcttagccatgcttagttcaactagtgcataaaaggggaccacattaaagcatagacttgattattggcaatagctctggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcgtccggggtgtccggttgatcggctgccggattcaccgcggcacgaaaggggggctgcccgttgcctgctggggacggnggcgaaccctaaggtgtggtgcgatcggttagagggggttatgcgaagggtcctgtcacggcctctttccggtatgtcgtggtgacatgtcggcgcacgggaacgtgtcgtggggctgtgtacttgtgggtacagctgtacacctctgatcagagtaaaactattcgaata

SEQ ID NO: 97570 - DNA, 507 bp, Oryza sativa
aaactttcttcggctgagttcttatcccaatttttccaactcacatctctcgttttcagcacgcacgcttttcaagctgctaaatgatgtgtttttttgcaaaaatttctatacgaaagttattttaaaaaaccatattaatcatttttaaaaaataagttagttaatacataattaatcgtgcaataacgtgtgctctgttttgcatgccggggtgccgaacacagcctttgaaactttttattaccaaattaaatactccatatagcaatgacgactgggagcgggatgcatggtataagcactaatcagtcaagaaaggtgctggcagaaacgcgttactagctagtacgtgtgagtccggccaggagcatggatgcagcttcttgggcatgacggagcaaatacgtatacgtgtagcatggatgcgaccgagcgtgaagactcggtcggtcgggtccgccgtgttcatgttacatgcggcgacgggtttcatgactagaccac

SEQ ID NO: 97571 - DNA, 695 bp, Oryza sativa
attcaggatgggagccaagtgagatgagccaggaaagcatgatcagctctgcatctcagaatgccatgtatgttgacagcttgggaactgcaacaacctcaactgctgaaatggtgaccaataacatcagcactctagaacctgcatcaactgttccagattctgctttgtacagctggaattcgggcatggctgctgatgatcacttcagctggcagaacaacacaaaccttgtaccctgggatcatgctaattgatcattgctatctggagtccgaacaaattaatcctaattgctatcggtttagatagctagtgttgttatgcttttactcaaataataaatatgttcatattgagggagctgtttttttttctctaatcttaggttgtttggctcttatcttttcttaaccttgatgagtgcattttgtagcaatatctactggtcaagttagttattatgaaaaaaaaatagagggtcacatacgtcttccctattaattaatgcaatactggtagctcgtatatactagcactggtggagaaaccatctttcgtcggtcgggctaattccacaatagtcccagttgcaacaaaaagggtaacgggcatatttgatatttgatcatctttagtcccggttcaaatgctgtcaggacctgtcaggcccccccccggtatctttagtcccg

SEQ ID NO: 97572 - DNA, 816 bp, Oryza sativa
atatgatgaatagtagtatcattttttttaatttggcaatgttgcagaggcatggatctaattaacccttataaataggacttcggaattcaacactgagacatacaaccaatatgacaagtaggcaaagcacatagtgtatacgcacaaacaaaactagaactgttcttaggtggcaacttgcattgatgattcacgaaagactgatccaatcgcttagataccctgcccttggtcaccggtcgtcttttttttttcttttgcaaacaatcttggatggatacatatgccctatataaaagttgtagttatcaacggtaacaataacattatacaggatttttcctttgagaccatttacatcatcgaatatgcattataagtgataatatctatcaggaaaaatatttttttgaatttttcaaatgacctcaaatggaaacatgccatgtattgaagttgtagaactcaactagatctacaatattataattgacaatatttttatttgagatagtttataagcccaaatatctattataagttgagatttatattgagaaaaacgaaatgttgaatatattctattaatgacctcgatggagatcttccggatataaaagttgtagaacaagacgttttcatttgaagtcacttagagtgttaaatatatgttacatgattcagagtggaatagtcaaaagtcaaaagaatatagatgagttggcaagggtgctctttgtagagtggaggcattagcttcaaaactcatcaaacacataggtgtgtacaatggttgaaatttcattgatatgt

SEQ ID NO: 97573 - DNA, 585 bp, Oryza sativa
atttcaatatagtatcagttaatgatttatgttttttataatggtttttgaattttaaatgtgaatacgtgttcattattacatgggaaacttgcattgcaagtgcaatatggatggtttaattcacagtggttattacgtgcatgattactatcaatataaaacctttcactgtcccgtacgatttgttaaaaaaaaagaaactaaacacaagactagtggtacatggacacacgaacagagtatatatatacatatatacatatatatatacatatatatatatatatatatacatatatacatatatatatacatatatacatatatatatacatatatacatatatacatatatgtatatatatatacatatatacatatatacatatatacatatatacatatatgtgtgtatatatatatatacatatatacatatattacatatatacatatattacacatgtgtgtgtgtgtgtatatatatatatatatatatagacacacacacggtagcgctacctagcgctactcacagccggtgcgcgccaggaagaaacgtacgcgactcacggtggaaaa

SEQ ID NO: 97574 - DNA, 522 bp, Oryza sativa
tgttatgagtccaaagtataccgttgtagattaataattggatattataggcatgtgagtcgttgacataatacaactctattctatgtagcaaaatctggtcaagaaatacaatagaatccaactccagttccaaagcaattaggagtagttgttaaaccagatcagtagtcagtattcatgtactgattttctctttcctttgaaaggattcactcaggaatgctcagaagcatcaaattaaaaaaaaaaaggtctctgacccggttcaaacaaactggctggctagacaacatcacttccatgtacatacatggtggttgtggacttccagcagccatgcacattgagagaacagagaaaggcaggctagatatttaacaaatgaaaaaaagtttctgttgacatttaatcaaattttgctaaatggcacaatcaaattccagcttcaaacatagtagcacaactaaattttattcatgcaacaagcataatgaaaggcccgctgctaaactggccaat

SEQ ID NO: 97575 - DNA, 970 bp, Oryza sativa
atttgatttctctggtgtgatgtcgttcatttggctataatgctatatcatctaaaatttattcattcaccagctaaatgctcgtaatattgtttcaaacaaatgattgtgagtttttttttcattgaacacacccttcatttatatataacttgtcatttaagttacatgaagcacttgacaacttttacattactctggtcataaaattacttttatactgcatatatatgcgacaatttcattatcgtaaagcttcgaattataaatttgtattttagaggcggaataagatatgtagaaagactgttttgtaatactaaagaacttcaggaatgtgttgataaaaggatctactgtagagttggtgtggtggctgattcactgccaccaccattgacttataaaatttctttattcccttatgcacagagaagtgaaaggagtaaatgaaagatcttgcctttttttcgcacaatactgagaaatgttcaagtcaatttctatcccggttttggaagataagaaatacatgaaaatatgaaatcacaaatggcgtattgtaacttacaaatataaatgcgagtttgatccaagaattctacatgattatatataacttccgaaggcaattgtaccaccagaggcctactgatcacctcttgcccagtaatccagctattgaattgtcttttgactcgagtcatgctgtagttgctttaaagtgtcaaatctgttgttgcatcacttggagccaacaaaatatgtgttgcttgccctgccttgctctgattgcattatctgcctgagccatgtgtttttatgtatatgtttttctacttctaggaggttgctatcttgatagctgtgtctagttaacacagtaattgatgccttggtagcttaaattgctacttgtcatgttgctcgtcactcctcaaaagcaccatccagaatgctgctagttata

SEQ ID NO: 97576 - DNA, 1287 bp, Oryza sativa
gctgcgatggagtggactggcactggacgggggtgatcaatggagggggagggtggatcgggttgggggcttttgtttgggaggggtgaggcggaaatgatggctcaacggtggaggatgaaaggtgtggtctacacatgcaaagcgtggaatcgattcgatgggttgatgattggaattgggttttcttcgaggagattatgcctttcatgataattatttctaatatctgttttattagaatataagcttttttttaaggtgtagctatatttatggcgccgtatttttcaccaaaaaatagtcggcgtttatttatattgtaagtctctaaattacgtatataattttagtgtatttataatgtaaatatcaaaattacatatgtaaatcctaaaattacatatgtaaattcaaaaattacatactaattatatatataagttaggtgtaagcgggtgtaagtgaggtgtaattactgtgtaagtagctaaaaaaatcgactatagcatgtgtcgacataattttagctaatccgtttttaggttgtttagcaaatattaaggtttaagccaatttaccctatttagtcaattgcgtctacagtaaataaatttggtaggtgggtgcgatctagttcaaaaacttgaaaaatgagtatataggtacaacaacttggctagtgcatgcattttggttaaaagatcaatattccacaccatactttttatacaatataaaaaaagcagctaataatgccatctcgacaaggatctacatgtattatgtattgctttcaatttgttagttataataataaaataatctatcgatttgaaaccgaaagatatatgattatcaaaattaagtgcatgcaaatagcataatttccgagcgatttgattaatcaacatattcattatcttgggttatgaacatggcaaaacacgaaattgatccaatgatctactagcagttaagcttataataccaggattaatccaaggtgtgtatcaatatttttgactaaaatgcacgtggttgtcaagtttatatacaattctactcatttttcaagttcttacactaaatcgcacgcatctacaccaagttcttgtaccgtgggtgcaatttactccattctctttgtcaccttggtagcctaattttgaaatttaaaatactaacattcccctttcaaacgcctgataactgaaaatgaatgaatttctggatattcaaatgttttgaaatacttgaactgtggaaagaaattggaaagatgct

SEQ ID NO: 97577 - DNA, 541 bp, Oryza sativa
aataataaaaggggggtggctatcaagctagaaaagtgtatgggtttggagacaaaggatttatacaggttcaggccttcttataaaagaagtaataccctactcctgtccggggatgaatccgccgagtgtattattgattgtatgatttgggaaaaatcagcatatgcccctagaggcgcccggaccccctttatatatgggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccaagtgcttcaagcttttcatgccaaggcctgccgagtggactgtaaagggcgaaaagataaaa

SEQ ID NO: 97578 - DNA, 520 bp, Oryza sativa
cacatgtgtgtgtgtgtgtatatatatatatatatatatagacacacacacggtagcgctacctagcgctactcacagccgctgcgcgccaggaagaaacgtgacgcgactcacggtgggaaaatcccaccatcgagcaaacaacccagtgtgaagttaataattaacttatgtacatttggaggtgggttatgattccgttcgcgaagagctaaatttttacttatttttagttaatgttagataagagttttacttttaaaaggatggtatggtgatggagttaatatttgacttatacacggcttgtgacgtggatttggtgtataggttattgagttacaaaaataaccttgctgattcgtaccctgcatgattcgatggatgtttttttaactataatattaataaggggcttcgctaatttgtgtgataatggcgtagccacgaatcttcgggattgtacgtacgtacaagctaactaatccgctcagcacaaatatcttcgattactccctgg

SEQ ID NO: 97579 - DNA, 569 bp, Oryza sativa
taatagatggaggtttatttgtgttttttttcatatatataattttcatttcagttgataaggagatagaaaatagagagaagaatgacgcacgctgtacacggcaaggaggaatggaggtttgggattttttttctaaataattaatctaacaaactaaaataatgtgtcagatatttaagtcgaagctgatggtcgaatgttttgttttcttgttagaatttttaggattttctcttatttaagagaacaacgtaatatcttaagagtatattttttccgatttaagagtatattttttccgatttaagagaatgacataatattttaggagcttttataagatgtgtactttttattgtgttacaatgtttgggggggctgttttttaatattactcaaagatatgttcattttacttttattagatataatttaattatcaccaagttatatacgatgataaaatatatatcattatattttatattttataattacttaaatggcacacaaaagttagaaaatatagccccaattaatatgacatatttctctttgaagttgaa

SEQ ID NO: 97580 - DNA, 789 bp, Oryza sativa
  unsure (1)..(789): unsure at all n locations
agagtggagtgagctgcatcgtattcctgcagccctttgctaggaccatctgaaactctgaacgaccccaacccaacccaacactacccaaaccaaagccagtggatggatgtcgttttcagccaagctaacgatgatgcaaagtacttattcgatcagtataaccaacgcccaacancgcctagagaatcggatccatgtagggtactacccagccaggagacacttttctcgctgccatcagatgcatccaaagttgtagcctagaggtggtattgcaaggataacaaagttaattacatgttcacctaaaaaatgttaatttggacctaatacaaccagatatatagttaatggtacaagctagtactgaagtacacaaagaggttggtcaggcatatgcaacattcgcaaaatgtttcagaaaattcagagaatgttttcagcgtcgcaatgacgccaaatgtaatggaacaacagaagcgttaacgaactgcatccgtgcaatacgcttgggggacagggattagtggcgactgaatattcgccttcacatgctgtgcttgatgatagacactttatgtttttacctgggtttatagtacactcactctgatcacaaacagggcaaaatgttcagagctatgctcccttgaaagtgcaggtttcacatcaaagaacacatgtgatgtgatggaaggcttgtacatgtattggaggtgcaatgagtgaactcagctacgagtgaaagttcacattcagattgatgccttccatgctgtaattgat

SEQ ID NO: 97581 - DNA, 649 bp, Oryza sativa
ccctcagattatatatctgtcctgcaatgtcagcccaagaactgatgagaaaatttcagtcaagttcagaattcagtggtagtgcttgtgccttgcatcgctctcagattcacgtaggagatgtgaaaccgtttatcaatttgtacaggcgaagtgtatgtcatgtaagcgatcactcaacctgattgatccttgtctgtcgagaagcaacaaaaacaatgtcacggatgaaagcaagatcgaaaatggcagagtctcagacacaatcacctctcctgaaattcagactcaagacttcccttatccttagcaacttctaacatctgctctctcatcgttcggacgcacgctttccaaactattaagatgtttttttaaaaaaaatattttacaaattactttaaatatatattaatatattttaaaatatattttagttaatgtttaattaatcatatactaatgaattactctattttgcgtgcgggttcaaatcaggtagtagctcatacctagaaaccacacaatttcattgaaacgcagttcatcatggttaactgaaacagtataatctgtaacctgatctgaacctttaatgagagtattttacatgctagtatagtagtagcgtatggatttgcggttgctc

SEQ ID NO: 97582 - DNA, 609 bp, Oryza sativa
ctacaatgtgttggtgcacatgaatctgaacacttaaatttccccctgtttctccaacaaatggcaatataaagttccaaacaaatgcgtgatccaacactagttgaaaatgaaaggagaaacaacatggacaactaattacttataaaaaagcactaaatcacgccccgttttaaaaaaacttgaatctgtcaattaaaccgttgaaataaaattaattgtctccgttaaaaattccatagaatccaggtaaaattcagacgtacaaaagagtgccatcattagtacgtgtgagctcacaggagcatgtccctatcatattaccgtgtgacggattatgacagaagacacgagggcatgggcagcgcgaaggctgtccgttgtcctgcgatcccaatcttccttctcatttttgttatgacaataatgatgtagggtagggaaagagatagggataggagagatgttatatatctcaaaaattagtctttgactcctgccatgagttctaaaaagaaaatcccatgacggattggtgagcaatcagcctcactgcccgatgcatgcattcatccagtccaagatcacagagagacagtgccatgctct

SEQ ID NO: 97583 - DNA, 653 bp, Oryza sativa
caatgctagagagtcttatgatatgaaacggaggaagtatttatctggttagatacaaatcatgcttgcctgatgacttgcatttccaacatgtggttcattgaaccttaagcatccagtcatcatgtaaccacgggaagttggaaaaataaaaggattggcaacaacaggagagcatggctaaaaggcagtatctacttccagtcaaggctgactgcttaacctttctcccctttttctcatcctatgttcacacttcccacttcccagtagttagtagtatttaatcacctggctgaagattgtagtgtacctgcaaacaatttgtttgggtgtccttgtccctgatttattgggggaatggatccatcataacttagtttattgattaggtggttatggctgcatcgctttatgtctcatctattgtagtttaagcgcatagtgggcatgaattatgttgccttttgtttattgtccattattatcacgatcgattaatgttgagtgggaacctaaataatccatgattaagtgccactcagagcagcctctagtgctgtcgggcatgactttatggtagtgtgattgatctaagcctgtcttgcccaatcaaactactattacagcctgacacgattgctggtactggt

SEQ ID NO: 97584 - DNA, 572 bp, Oryza sativa
ccgccaccgccggcgatctctcccacaaaccctagcaagaggaaaatcgaggacgctcgctagcgtcctcgattttgcaagtgggggccacatcgctgccgagtggggcccacggcatggcgttcgtttcactgacaggtgggtcctgggtcctgggtcgcttcttcttccgaactccggaaggggaagggccacgtgtcgattttgcaaggcactagcgcccaactgcagaccgtagtattggagtacatctgtgatctgtacatacaagcatttcttatctttgaaaaaacaaacattttataaagcctctttgtacggaaaaattttagacgaatttcgtaaaatttgaagaaactataaagttatttgcatgaccgaacaaattgtccaggaacttgcaatgcaatgcctaacagaacatacaagcattggatgctaagttaaatccatgtatgatatttcttcgatttgcattatttccttcaatttatcttccttctaaattctccatcaatgtatgacatttttaaagaataatgtattgtatgatatttctgcgttgtcaggct

SEQ ID NO: 97585 - DNA, 681 bp, Oryza sativa
ttcagaggtagctacagtgcccagctttagatgtactgtgaaggtccgatagaagatggacggatcagatgagatgctacagtaaatctgctacaccactaaccagcggtgctacagtacattcatccctgtagctacagtaatcgcgactgtgctgtgcattagaatactgtttcccctcacatattactgtggctacagtgaccctctgcgtaatgcagaggatccgaatccacgagagtggctgattatttgtaaagagaggcgcggagacatccttaatttaattttgtatcctatttttgccagatatactccatatctttcctaaggtgtgttcaagagaaaacaaaaatagatattaattaagaagatacataaaatgagataaataattatcatatgattaattaaacactaaattaatacgattttaaaagcaacttttttatatatgttttttttaaaaaaacgtatcgtttaatagttcggaaagcatatgcgtgaaaaacaaaaaaaaaaccttttcttcccattgtgcttgaatcaagtgtaacctaaggctctacactacctctaacaaattaatctcaataattttattttacctggttaatccacttttctttctatcatttttcttaaagtttgcatcaagattatcccttacatgacgggtga

SEQ ID NO: 97586 - DNA, 757 bp, Oryza sativa
ttgttgccaatttttatttctttacactgtgctggtacaatggccgtgcatggatgagccatcatctgcattattttttttgctgctgctgtagcacaaaactgtgctaggaattttcttgagaagatgcatggtgaaatggaatctactcccaccaatctggctgccacccagcccagatcacagtacaatgtttgtaaaaaaatctccaattctccactgctcaacaagccagatgcatgagagtcgtcgtccgatcgcaatccaacggcttagtagtaaaaccatgtaaaattttatatcctctcatcgtctacatgttaacttactgagcttagccaaaatttgaatttaaaaggttatattttaagttgattttaagattttttttcttcttaatctattttctagtatcgtctttcaaaatcgctaataacactaatatagaagtttgaacataaattatttttgtctgattcattcatagtagtcaatgaagactgagacttaattgattgtattaaaataatactacatttcacatgaaaactcctccctccattctaaaatacaacgatttataggttgtttagcaaatactaaatttaggtccaaatattcccttttaatcacttcggttatcaatttttaaattttgaattgtttgaatttcactttcaatcatctgattggctttggaatcattaaaatgattgtaatcatgagaatcagttttggaatgcttacatttaatata

SEQ ID NO: 97587 - DNA, 517 bp, Oryza sativa
catcgactccaccatccgcgtgtacgtcgtcagctgctcctctacgggtaccggaatccccgcgcctaaacgttggatcgtcgttgaaccatcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcacggtgcctggcatagaggtctctagtgctcgcaacgtggggctgctactccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctaactgctgactcttgcgcgagtacctgcgaattaatgtgtaatattagtgtgaaacgacagatgtta

SEQ ID NO: 97588 - DNA, 1060 bp, Oryza sativa
gcatatgagtttttcaccagctttcaggccctaggaattcttgtttcatgcttaatttctaacttgcctatagctcagaaagaccgaaactatcccatcaaattcaaaatatgttccattgcagggggaaccctcagaggattgatgctacaactgctaataggcgtgttacctttacatttgaacaagtaagccattttcttcctgtatgcttagatccacagtgatttttggctttgtaactatgctttgcacaatattatttataattctagttgcacactcctatcctttgtgattgtgtactaagtttatgatattccgtgtaagtgccactatgttttggagatgaaactgtttggttgctttgtttttattttcagtgtttgatgtatctataccatcatcctgatatatggtatgattatgccatgtggcatgccaagaatggttctgtggattctgcaattaaaatatttcaacgtgctgtaaaggcactccctggtaataaatattcctgtatccccctccaattgtaacttttgttttggagtaagtctctggcaatatggttgccataagcccataggagtcaacattttatgcctagcatgtaaccttgtctcttttttcccctcatatttgctagtcactcgatgtatgagtatgtgacacaattatcctatgtaaatttcaatcatattgagcatgcaccaatattcaatggtaataaaatgataaggttgttagtagggggtgttgattgcataaaaatgaatcggacggttttgtacaaatcaaataatctgagtatggttttcagataaaatggaaaatcaagacatttagatttttttttcatcacatactctggatatgaatgcaagatgaacgtacaatccagataaaaattgacattttagtattctacatgctaggccttgttgcacttgtttgtgaaatctacaatagcattttctaatctggacttcaacttaattcttccacattttttcttcatagattcaggagtactaaagtatgcctttgctgaactgga

SEQ ID NO: 97589 - DNA, 624 bp, Oryza sativa
gactaaagattggtcatctttgcctcaaaagtggcgcatctttgcttcaccatttttgcattggatacattttgtgatagtgacatgtggtcatatttttattcgttataactcctagtataatttattgagcactaagggcatcagagtcgagaaaaccaccactgacaggcatatatgttaccagcctggccactccagagttttctgaagagcagacggattttactaactagagctcacatttgactattaagttagtaagagtaggttttaagctgattaatgtgattccaacagaacagtgtgcttttgtatttgctctttcaaggccagaaatatccatcaaatttgagagagataagggcatttccgcatatgccgcattcacgttctggatagtttctgcaaaaaactgtgtgttttcagtcaagttctttctgagttccacacttccactatagggatgtggacttgtcgcatagatactcagatagtgaccatctatgaaaggacatcatttcagaattcagagctctgccagaaaaacgtggaacttgttattttcattgagtttagcaatgaaatttatagaatccatgaaagggatccctcttggatggt

SEQ ID NO: 97590 - DNA, 694 bp, Oryza sativa
attcctgcagcccaggcattatatggttagtggaccaggagaggttgtacgttgtaggtatcccgtaaccaccagcagaaatgagaatatcgggtgtgtttagttcctgaaaaaagttggaagtttgaagaaagctgagagtttggaaaaaagttagaagtttatgtgtgtaaaaaagtttttaatgtgatatgatgtgatggaaagttgagaatagagggaaaactaaacacggcaatcgtatacatatatcatagctaaccaacgcccctactcgtccttgcgatgaacagtgactatacatacaatgtgtgatctgtgatactccctctccgtcccctaatataaggaattttgatattttactcgcactgttttaccattcgtcttatttaaaaaaattaaaattattatttattttatttgtgacttactttattatctaaagtacttctttttatatttatacaaattttttttgaataagatgagtggtcatacatcagaagcaaaatgtcaaaatcaatataagagacggagggggtagatatcagcagaccgatcgatctggtcgctagccttctgatagtacggtaggcatgacctatcagattgatgtcgtacgtgatcaaatgggatgccgatgactcgatttactactgtgcatttgcacatgcatttgcatatacaccta

SEQ ID NO: 97591 - DNA, 709 bp, Oryza sativa
gcggtcgcgcgagaaagaagagaagctagggtttggcgtgacggctgggggggtcggcggttttgtttgcccgatctccccgcctggccgtccgatcgaaccctagcggatcggacggctggcgacggctgggccaaaaacggcccaagaggggcgcgcgcggcggtttcccggcccaggcccacgttgcggcttggggaaaaaggggagcgcccgcgcgcgccaaaagggccgtgggccgccggcaaaagttcaaattaggtccctcgggggccgaaaatgatgaaaagagggacagtagcaaattttccttttattttgttaattttcatgcaaatttcaatagaatttgaatagatttttgcatgttttacctctgtttaaattcgaaccaacgggagaacttttacagagagtaaattacagagttttgctactgttcatatgatttttatatagattttccgctgcaaatagatgaaattgatgtttctaaaattaaatttcgaaccaacgggagaatttaattttaggaacattaattatgtgctatgatgttgtaattttctgaccaacgttgataattgcaatgttacagttatggttatatgtattatgtctagggatggcaacggggcggggcggggccgggttgggctggaacgcccccgaccccgacccccgacttcagcccccgcccccggccccg

SEQ ID NO: 97592 - DNA, 500 bp, Oryza sativa
atccttttgcagaaaaaaacgaggcttatgtgtttttacgcaattattacattttactgctgcttatgcctcgttgttagacgatttgggtaagaagaaggaaccaaaatccaactagcgaatttccttgtgtaattttacgcagggcaaatgaaaatataattagatttgatatacaaaccttatattctatttctataaatacaattgcatttttcatgtaaaactgaaaatatagttcgactttacgtacaactcttacttaatgtgcataaagttgtaacgtataaatcatatacatacagttttactttacatacaacaatatcggtcggcctatattataatttagagctaattatgatcgtatggtcattttttttcttctattactatgttgatatattcttgattaagacctgagctgtagtgtattttattttaaaagaactctagtgttatgtggatcctctgctttgagtgggtgaaccactgcacat

SEQ ID NO: 97593 - DNA, 605 bp, Oryza sativa
tcattcttgaactcgacctcttctggataaactttttgtaattgattaatacccttaaccgaatccatcaagaatctaactgttggtgaataatagttagcatcggtctattctaggactctgaaaccgatactacctctaggccgatgacaactttgaagtataccaaacacccgtccaacaacgatggcggtgcaccaacaccacttacgagttacgacttggagatcgtcggatctatcaatgcctcggtctccaatgagcaacggcagtgatggtttttgttaaaatttttattcagtttttgtatgtgttcttggatcgaagcatcgactcgatttgaaccgatgtgagcagtttttttttattactagagcctcaaaggtgccggtttgttcgtatcacctgaggggtgccggctagaaaatccggcacctatgagggtttttcaaccgataccattgacgttttcttgtggcaatgtatcttgcacgattgcaccgaccaattccgttttacgtatcattcgtccatcatcgaatggacgataccacatacagtacttgcaggattgtgagaacaaaagtttacaaacaaagactggc

SEQ ID NO: 97594 - DNA, 1265 bp, Oryza sativa
atttgatggatatttctggccttgaaagagcaaatacaaaagcacactgttctgttggaatcacattaatcagcttaaaacctactcttactaacttaatagtcaaatgtgagctctagttagtaaaatccgtctgctcttcagaaaactctggagtggccaggctggtaacatatatgcctgtcagtggtggttttctcgactctgatgcccttagtgctcaataaattatactaggagttataacgaataaaaatatgaccacatgtcactatcacaaaatgtatccaatgcaaaaatggtgaagcaaagatgcgccacttttgaggcaaagatgaccaatctttagtcttgatttatgtggcagaaaagtatgatgaggggaggctctcttttgaggatcttgtacctgttacattgtagagtgcactgcttaagtgtttatttgtcgaaagtctatggaatcttttactgggtattttggtaaatagtattatttttctacagtattttggtaaatggtactacctccgttttaagttataagactttctagcattgcccacattcatatagatgttaatgaatctagacacacatatatgtctagattcattaatatatatatatacatatatatatatatatatatatatatatatatatatatatatacatatatatatatatatattaaaaaaagcagcactcaaactcactctcgttctctctctcatcattgttgaataaagagagaaaacccctgattccccaatgttgaagcgtagatttttcacaatttttcttttaaagaaataggcctgtgtatatgcaggaaaagagcacgtggtggtagtaggaactagatggcactctaagataggtaattaaactatacatggatgaatcttgtcatgaactattattagcggccagaccttttgagaaatcagtttcagcaaaatgttttgagctgaagtaggtgcacatctcatgctagaagagtctgtctttgcacaactataatttgggcaacgtatcctatgcacacactacctctaatgcactccgccaccctagaccatctgattccaatccgacggatacaaatcgagatggtgcatttttgcagaaaacaacccatgtccctccacctaaatttacatgtaacccctcacttggctctcaccttatcttgttcaaccttcttcctaaatcaatccccaatcctcagcatgatgtaggaatggatgccgacgacatct

SEQ ID NO: 97595 - DNA, 669 bp, Oryza sativa
tttgcttgagcacattgtgcacgcaagtgttcctaatttcctactgttccactgcacgagacaggacatctctcacttttctaacagtctcgcgatcatggtgtccatttctagtttgaaaacacgacaggatatctgaacttagttccagcatgaaacttgacctgctagtcactactcgcgactgcaaactaaaagcaggttcattcattcttccattgctgacatggtaactcgtaaggcgtaagagacacatatagcaagtttcttgattacgagtaccgcacggtataggtaacttgacttgtgactcggtagttaaggtaagagtatttactgagtcaatactcaagattatgctcatctgatacagaactcactgtgaagtcagtatgaaaatcttgcgattgacgtctagcggatctgtccctgttatactcgaccgggatcattccaaatttcagcgacgacggacactttgggttataaattcagtgatcttttcactttaattaatttccaaggaccgaggttaatcatgatggactaaattaagaatgttgtttggttttgctggcttagctttaaaattcttggagtaactcacttcagtgtgatttgtgaagtactatatactattctctttgtccctaaaagatctttattttt

SEQ ID NO: 97596 - DNA, 607 bp, Oryza sativa
atcgatctcaaattcacatcctccactaaaacctccctcaaaacccttcatattccccccaccaacgaacaccaccgaaaaacccaagagtataaaaaaaaacccgacacatcaacactaaatcgcccgcacataatacgcatccgatcgaacacacaggttcgccgagcaccgacgccaaactggggaaagcacagcactctagagcgctagtacagctagtaaagcgaacgatcgcacgcaccgagcagtggcggagatggggctcggcggcgactgcgtgggcggcgagtcgacggcggctggatcgcggcttcccttcccttcccttcgctccgccgctgctgcgccgacgggtgctcggtggttttcgtcgccgactcccgcaatataagcgagcgcgacggtagtgagcagagggattcgaggacgaggagtcgcccggtcaatgtgcacgtagcatttaaaggaattaaagcgaagacggataaatgaaggggcgcaggaggccagggccggaggtgtcacgtaccgttgatgttgcttcgagattcgtgcaaagcatggaaaagaatggaacgtgaaggcctatatatatgtgtggctt

SEQ ID NO: 97597 - DNA, 1066 bp, Oryza sativa
taatagcggagccaacacggagttcccacgaagcaggggaggctatataatatgcatgcagatcgaccacactcgacacctcgtcttgtgcagagagctcgcaggtagctattagctaacgagttagctctgaactcgcctttggcttaactaagcagtgagctgcaaggaagtagatacttgtgcaagctctgagcgagagaaacaccagtgtgcaatcgtagaacttgtgttagacacacacacagagagaggaagagctcatataatggccttggtgaagaggtttgttttgccactaatgatggcggtgcttctggtgttggtcgtgtcaggatcggcgcggcagttgggcggcgacaaacgggttggagtggccacctccggcgatcatctgtcatacagttcctcaaacatctgtacctgcagcagctagcaggtccaggtcactcgtgccaaaccaatgacccaaataacccatcatgtactgcctcggccaaccaccactaaaaaacagggtagacgccaaattaaatatcccaccatgtatatatattgccatcacttgcatgctaacaccaaattctaaagtttggttgtgatatttctctataggagacaatgtagtgtatatatataagatctttcaagaaaagacaatgtactgtatatgatctttgaaaaaaaatgcaatttagtctttttggattgctctgtttcttgttagattgtgataaactgcaagtatatgaattaataaaatggcagttttttgtttgtaacttctgttcttcgtactaccttgcccaagtgttaatgtaaatgttgtccaattaattcgatgaatccatccagtgttatgtgagatatataatggatttgatatatatgggtgaaactggaagctagtctgaatatatatcccacgcagtagaccagtagagatataacagaaatgctatctgagtatctgacgggatcccgtcccaatcgtgatagacatgatagggcagccaccaactaatccaccgattctatctccttctaccttatgggctgcaggaat

SEQ ID NO: 97598 - DNA, 749 bp, Oryza sativa
aaagataaattcatttgactctgttcctgtttgtgtttggcttggttttcaagctgggtaatgaaaattgcctgattaaaaaaaagataaattcagtcctaggtaaatactattcggcttcctcgtgctggcagctagcacatctgaccgacgctatgagcattttgatttgtactaaaaaaaggaaattacaaaatttaagaccatgagatgctgccgtaaagtcgtactccctccgtcccaaaaaaaaaaaaaagacaaacgctggtttccgtgtccaacgtttgaccatccgtcttatttgaaaaaattatgaaaaaaattaaaaatataagtcacgcataaagtattaatcatgttttatcatctaacaataatgaaaatactaattataaaaaaatttcatataaaacggacagtcaaacattgacacgtaaatctatgatttgattttttttagacggatggagtagagcgcaatgcctgaccagaaacggagcagagctgcaagtcaaatgaaaccgaaaagcaccctcgtgccaacacccaggatctctgtcttttccttctttctgtccccctccccactttgcccaagtacactggtctctatctgaacctatcgatcgtcgataaaagacgacctgatgaagaaatagcacattgtttactgatcaaggaggagagatccaaattaaggccgaagagcatgaacctgcgcagcttgctttctccgttaatttctcaac

SEQ ID NO: 97599 - DNA, 772 bp, Oryza sativa
cgtcggagggttagccgaccttatccaatgtgttaaatttctctttgatggttttcctggcttggttaaattcaatacataaccattttgatcactgtcatattagcttgtttaaatctatcaggcaattatcaaccttatgctgcatcggttggtttcgacctatgggggttgtggttgtaaattagatttatttaagtaagtaggcatcaataattatatcatcgggggtttcaaccaatgcgttatctggatatatattgtttaagtgttgtatcggcttataaggattatatacaagttggttttaaccgaatgtagcaaacacttcattgtttatccaactatttaagtctatttgtatcagacttccaatcgatccaattctccagcagccaattgttcaacctatcggctaattactgctacattgacatcttgttagttgtagaattaaactaacttgcatgcctgcacctcatcaagatctatgacctgcactgaacctaagtagatcttccaggccttcatgtttttcgcgtcaacaacgggccaaggggagtaggtcactgtttccgttggatggagaggcgcggatcgaagaggctgccatcgttgttggaggggagagaggggcgccgctcaattaatttggggagaggacgaattgagaaaacacaagagagaggagaggaggaggaggagaaaaggccgagaactaaaagaccacatgctcatgtgttcggctccgctagctcatcccaaagttcct

SEQ ID NO: 97600 - DNA, 592 bp, Oryza sativa
attcctgcagcccggacctgtctgggaagtttttagcagctacagcttctcacaaaatctccagctctccccaaacagtttaaattgtcacccagaactaagaatctgtagttataaaatatagaaaatgaactagaatccaaaagctggaaaacccagcttctctatgttctcaaaagcggctaccaaccaataaattcttataatcgtaagctcccaaaaagagcctaaaggaacctacaacgagtttagcatgtggcagcccaaagactagcgataacggtggttcagccagtggtgggctagtagtcggtaatgggctaacggctgcttcataaatgcgcataggtggtgaggcgggggggggggggggggctaattggcgagtgtttatccacgacaatcgcaagtgctaattcgtgaccagtcgcacacgccctccccgtgcgactggacacgtgtcacccgcggaaagggggcggcggacggcccggtttctttttttttttttgtgcggtttccgccaatgacacggtttctttttctttttttgcggggtttcccttttttgtttttgggggtttttttcttt

SEQ ID NO: 97601 - DNA, 674 bp, Oryza sativa
cttcaagatgaagttgctgaagcgcatgttcctggagatggtcgtcgccgacttccgggcggacctcaccatcttatgcgtccgtgccacggccttctctattaggtattaatcgcgatacctcagtatcaagcctggtacccgcctggtacccaggtacccacaagtatcaggcctggtacccaggtacccacaagtatcaggccatacataagatggttacgttgactttttaacatatatttaatttttttttgaaaaatgtaattagaagtattatttatattgttgtgacttattttaatgctagggtacttaagcatgacctatatttttacatatttaaataaaatttttaaatgataggaatggtcataggtacattggtacatatccccatgccatatattaaaaaaacaaaaggccagtattaaacagttacagtatacgcactttattcatcgtaattggccacgaaaatcacgagtacataatctactactaaaatatattaaagaactacttacgttatgaatgaacaccgaaaaataaaattaattatgggtactgacacaaatagaccctgacacggtcaatgctagaactgattaaggtaacgatctgtctatcaacaattcaacagtgggtattacttattaggagggctgcaggaa

SEQ ID NO: 97602 - DNA, 593 bp, Oryza sativa
tcatcctgcctcggttcggcttcccagctcgttaagggaaatagtctcaaatgatggagaaaatataataaattatgaaaaataattttaaagatagctcgataaaaaaaaactgatcaaagcttcctttttttttcccacaccttgctcattcaaccatttatgggaagataaacatcgcttgatttaaggaaaaaatggcaaatgttatcataattagatcggatttttagcaaatcgtaaattgttttataaggcatctaaaagcaagcatcgtaacgaagctgccttacgtgtcaactctcaattatcctagctgtcaccctacattaacaagaagcaacatggaaacagacactacaagttgtttcagactattattgctatattggagtatgacaatttgtttttagttccttgtacttggggtaatcaccacctttcgtccaaaaaggtaataaaattttagcaggaattggaaagcttagcgtgccaaggagaaacgatgttaacactggagaaacaatgcatagagattctccacggcagctagtgccattcggtagtcctaatccttgattttggaatagttt

SEQ ID NO: 97603 - DNA, 1019 bp, Oryza sativa
agagtctaagtagaaatacaatttaaaaatagctaaaattcggaattaaaaataagaaatatcgaaagaagagtccatatagtaacccaatacgagattaattaaaattcagaataaaaataaaataaaatctgaaattagcaaaaaaaagatgagtccaagtagaaatacaatttaaaaataaattaaattcggaattaaaaataaggaatattgaaagaagaatccatacaagaatccaatacgagattaattaaaattcggaataaaaaaaataaaaaatcaaaattagaaaaaagaaacgaaaagaagagttcaagtaggaatataatttaaaattaactaaaaatcggaattaaatataagcaatattgaaataagagtgcatataagaacccaatagtagattaactaaaattcgaaataaaaaaataaaatataatatgaaattaggcaaattaaaaagagagttaaaataggaatataattttaaaacaactgagttgaaaataaaaataaaaatatcaaaagaacacaatacgaaaaataaaataaattctgaaatgagaaaaagaaaaataagatatcaactaggaatacaatttataaataactaaaattggtgagaaaaaaataaagattactaaaagaaaaaaccatctgaaacacatgacttgattaattaagtagcaggcctatagagtagcagagtgatggcggttgaagggacatctaaaaactattaataaaacaccaaatagaatcctaatgatgattaaaaggaagtagaacagacaggtcgtgaagcaatcggttaaagcgggtggcaggacttctagaaagtaaaaaaaaacccaatgatagtcatatttgatttttaaaatcttaataataaaaaaatgaaaggtaacgggcgggtagtataggagtacaatggcaaagttatgttcaacttttacaatcctaatgacaataaagagtatgcggcggacaggtcgtaaaggagtatggtggcagcg

SEQ ID NO: 97604 - DNA, 609 bp, Oryza sativa
tctatccggacagtcagactacttacggcaaaaagagagatcagtggcagaaagctacatctgaagaagagagttattacagtcttggttttgcaagttcgtaagaaagcatgcactgaccgatcgaccgacagacctcactcgatataactttgcaaagttgcatgcttgtagaccaagaaaacctcgtagctgctttgcaatttcattcacaaactcgtcaaattaattagttgatcagtcagacagacagtcacacacgtaaaaagccaagaactttcagggtttggccttggcatcaggccatgtctcatgactcacgagcttctcccaacctataaataaccgatcgtaacatcgaccattcttcgtgtcacagctcaaaacactgcagagttaattataatttttgtggagaaaacagagcagatcagataacacaactgtgagcgagtatcttcgatctagctagtacaggagttacagtatacataatcgccatgccaacgatgaggaaggttgcagtggccatgttcttcgtgccgatggtcatgtcggcctcatggtcgccggccatggcgaggccgtacgccgatcaagcctccggcg

SEQ ID NO: 97605 - DNA, 655 bp, Oryza sativa
ctgtgcgtgcgaaaaatgaaggagaggaagtttggaacttagaaaaagaaaacaacctaagtgttatcaacctatcagaattgttgtgtttaataacaagaaatttagtccactaacctgtgatgactacttgattaactattgtaatgtaccctgatcaagattggttattgaactaattaacatcttaaataaatatgtagttttactatatgttattatgaacgatacgattgcttatgttgttatatgataaaagccgaataaccgtgctttgttacggattaaaacaaattattagtgaggttttttgaataattttgtacctataaatgtcatattgtacaggtgaatatgatagaatcatacatgcagagagatcattttataacattaaagcacatgcatggggaattgatagaaaacatgatggccggagtagatgataaattaaagaaatactatatacttggtgaccaccattgttctcttttaaaaggagtatagaaattgtgctaattaagcgaatttacaatattatggtttagtatatagtttaatttcacgatacatatatagttttgtagaggtgtatacagttttgtgaaatagtggtatcttttggtacatctaagaactggtaaaactgctcgaa

SEQ ID NO: 97606 - DNA, 776 bp, Oryza sativa
tgctctgcctcaagggatcggacgccgtcgtcaacttcccctcctccgcctcgtctcgccgccgcctcgacatccaccgggggggcacggactcggcggcgggcgacatgtcgccgaggtccatccagcgcgtcgcggccgccgcggcggcggcattcgacgccgccgccgccgccgtcgtcgtcgacgaaagctgctcgtgcagcgccgaggcgatgtcgtcgacgccgacgtcgggagcgacctcgctgtccacgctgggaagctccggcggcggtgacgtgctggaccacgcgacgacgccgtcgtcgtcgtcgtctgccgcggccaacgtttgctcgccgccgctggagggggaccatgagctgtggacggagctggacgcgttcgcgtcgccgaagttcatggatctaatggccgccggcggcacggcgttctcgtcgccgtgggaggagcccgaggaggacggcgagctgatgaggctgtggagcttctgctagcttagctaggagcctaggaaatcgatcgtgaatccattcgcccatgcaacacaatactaccattgatccaatcaatttctcctctctttgagcatcgaaagctaggttaattaggccttggtccatggcttcagttcttccatagattcttcttcttttctttgataatatcttgattaattatatggttgtaatttatataagtattttacggtgttacactgtacgggttgttgaatgagactgtgagtgcattggatactggttggatttgtt

SEQ ID NO: 97607 - DNA, 788 bp, Oryza sativa
tctcaagcaaaggtaaaacgtaaaatgttactaataattcagacagtggatacttgtcctttgtggttgcggtggttgccttatgtttggttgaatactgtatatttgttcatggcttttgggccctgcacaagtttatatttataatatttattatattgaatttaggctttgtactacattataatgttctctgaattgcatacattttcttaaaacaacaacaattgtttaagaaatattgtcttattattgttaagcagtacagtcgggtattaaaataagcttaacttctgtctgtgtgaatcatcctccaatgttttacaacgtcttggatcttaatatactcaatttgagtgttcctcgggaaaaaaaaagtcatggttgctgttttactcttctgttgattccaagattgttcttgtctgaaaagttcatattattcattgccaggaaaatcggaggttatcatctggaaagaaaatgcatccattttttgcttctcggaaaatacacaaaggtgctggccaagatattcttaatgttgaggatgaggatatggattcactttgtgcttttgaaagagacccacctttatgtcctgttcatgttttgtacgaactggaggtgtgtctatataaaaacatatattttgttcatctggttccataatgtatctcacctttgtgcttttgtggtccgccttagggtggtttgtctaatgcgactgaacatctgtgtgtgtgtatgtgtgttacaggtcactatgacaattcactgggggtgca

SEQ ID NO: 97608 - DNA, 1878 bp, Oryza sativa
tagagctagggatctggtggagtccatgagcctaccgtagacccccatggagtgctcatcaacagccagtgtctgcacaacatgggtcactggcaagaatcactcaacagttgccagtttggagacacctttatatcaacaactgtcatcttatgaccgtttattgacaagtaccggagtgttcattcttagtttctgactagagagtgccccttcttgtaaactccataaatatattcacacgcaagattttgggttatataggaggacgaaacatatataaccagtgtctcgatcaacctttccccacatttgtatttaaaagaactttcctcatatttacttcgtaaaattgactactattcgacggcgttaatgcctaacataatctgggatagacaagcgtgatctctaatgtggctacgactgatttttctcaaccaactagatgataagaacaaaaggatgttggttttggggaacaacacgtgcaaaccaaaaaaaacataagatagttgtttacagttcttatgaagtttgctctttgttttcttgccaactagatgcatagcgaagtgcagtttaaatgacaatccaagcattcttgtctcaacttttcaaatttgcatgtttgagacaacctcagaagtatcttttggtttcccatgcaggtcacaagacgagatcatcggtttaccaataagcaattccttagatccagcttcagggactcctggcacggctgaatacaaacaagtcattaacaagaccctcatcctatttgaagatgtagatactgtttttgatgaggaccgtggatttatttcaactatacttaagatggtggagactacaaaatggccaatcatactgaccagtaacagtaagcctttttgtctttaggattttgtacatctctaccatccttcgaaatttcatttgattaagagcatactaaagctcttgttattttgttgtttttgtctttatatttcctgaagagaaagatccgccattgcctcatctcttggctcagctagtattggatttcacatacccatcatctgcagagttactttcacatgtcgacatggtaaaaacaaattagttctaggctgaaataccaaaaaactatgctgctttctgcaattattgaacgatgaccataccatgttttcgtgcagatatgcaagtctgaaggagtagaaatcactgttcctcaacagaagcatataattgatgcctttttaggtgatattaggagaacaatgatgcttttacagttttggtatcaaggcaagcagcaatactcaggttgggtgctttgaatgtaaaatccctttcaactcactatatggttgcgttctggttctgacctgttggcccattactaaaataaattaagagtaaatttcataaaactatgtatactttgcacaatctatcacaaaactatagatttaagaactcgtttcacaaaactacagattcagtgtcttcgtttatcacaaaattacaggtactttgcacaatatatcacacaactacatatttaagaacttgtttcacaaaactacagatttaatatcttcatttatcacaaaactacaggtttagtgtcttcattatcacaaaactacaagttttaagaatacaagttttaacattcttaaaacttgtagttttgtgattgttaaaacctgcagttttgtgataatggagacactaaatctgtagtttgaaatatcaatagatgcagcagccaatatgttcagttgtggaacttgtttgcaaatcctcctagactagcgacttctgagtttatgataaaattgactttaatgggctttatctgtcatcaaacagttgttttatttt

SEQ ID NO: 97609 - DNA, 647 bp, Oryza sativa
ctatcataaaatgacttgtgtacttgaaaagagtatcgagttattcatttctactttcaactgatggaacaatgtgtgatctagagcatttaatatccgccaaaaaaaatcatggcttattggattcattctgcatatattgtctgtcctgatgtgcaagatatctaaacttaaggagtatgtggttatttgggcacgtattggtattctccacctaacccatgtattctgaaaggtttaaaagaaatctcctgttcactcttctggcagattgaatggaactaacaaacagaagatgagacattaggagttgtaaccaatccagtttgtgttgcgcatattgagtgtaactctgttttcaaaagttatgccttatgcagaccaggtcatactagatttacaatttgaaactgaactgatcacaacttcatatgtctcttgttccatgttttgtggaattccaatccatgataaacattgaaaggaaaccttctataccttgattaggatgatatcattcttaggtgtatttccaattgcagacttctccaatttggtagtattttatatatgtgcatcatttttttcaaaatagcctttcttttttgcagaaagctcaaacttagatgctctttgatttattaatt

SEQ ID NO: 97610 - DNA, 1361 bp, Oryza sativa
tatagatttttggttttatagccagtgaatttcttgttctaatcatgcgctaatcttgatttaaacacaaccatttgcttttctccacagattgatgttgatgatgagtgcctgttagcatctagttcctgtttccatgcctctctttttgaaagcaaacaacacgaaagggtacagcatgaattgcctgaagtcactccgaaagggtaaactgcattggacactatttgccttgatgtgtgctggacaggactacctttcttcttgttgtcttaattttgccttcagatcacaaatgaaaaagaaaatcaataatcatttgaacctcaccagcctatgaagttgcaaagcgtaaactcctgacactcacaagtactggtcaaaattaatactccctccattccaaaatatagggcacaactttttttttgatgttccatagtacagagcatgcattttttttttgactgggagggcatgcattcatgcatgcaattaactagcacacacccctcccctattttttttaataacaaaaatcccctaccctcaagatccttgatcccattgggtgcatgcatttcatttattggggtgatccaaacgagaaagtgaaaataatatttttttagtcttcgtgttagtgatagttgtgccttatattttggaatggagggagtagcaaacaagcccgccctctgtttggtgtctgttttaatgctcacttaagtggtgtcagccattaggatgctactttgttttacacttacgttgttttcatgttcattcttttcttggcacctactggttctatgtcctattatcttttctttgatagcctacctcataatatttctgttgaatagttgagggagagaaatatactatgtaactggacgattgtattgagacttagggggctggtatatactgtatagagtacaagagataaggggatctagagataaggaagactatgatacaaatcaatcctatcctaacatccctctaactaccatatactctaacaatttctttatggaatgtagcctattgcacaatataatagtacttaaatttgcatcaattgtgctccattcctcatatatttctatcccttttgagttgcacattactaatggcctgatagtgtcaatcagcgtaacacaataatgcaaagtaaaatgctgctggcaccgcatagttgtctttttatgactgccatttctgaaaaaaaaactgttgatttcattattgatggtggcatgaaaattttcattgttttgttgtagccaataggtcaactgagctagtgtcaataatctagattttgcatgatatattttttgcatcagccttta

SEQ ID NO: 97611 - DNA, 530 bp, Oryza sativa
ccaaattttactgttaacacatagggctccttgtgtcgtgtgggcatgtctctcatcagctctgagctatgcggtgataatgttgccttgctactgcgcggccacttaacaaccataggccggtctcatcccacaacatgcttgatggattgggtggccaggtgtacaccggggtactggcccctacaacttatatctgaaaatctagtaagtgggtccggggtctagtttctggtcactttcacttatagttgaaaatctagtaaaaaaaatgttgtcacctctatagcttattctaaatgattccatgagcatccttgagaaaatgttaactttggagctccgatcagataacgactttcactgcactatgttgttgcattttctactggtttccttactcctccgacccttaagtgtttactaaatgtttatgcagttgaagcaactatggtggagaatcatgtgtcaaaagaggattcaaagaattataaattgaggatgggctttgtggtaaaaaaaatccatct

SEQ ID NO: 97612 - DNA, 517 bp, Oryza sativa
cgccaaaacctcgccgccgtcgccgttcgtcgtcaatctcggccgttctagccaccggtgagttcgccgcgttgtacttttcgcatagtgccctccgttcgcgcccttatgccctagatcgctggcgaacttcgtttcccgagccaccgtccttcatcctctttttccttttatttaatacattaataaattagtaaagtcttttctgtattaggcaaaaatcatattaaacttagaaaaatcatatctaattcattataactcggattaatgtgtttcaagtcgctaaatttgtataaaatagagatctatattaaaattacttataaattgtgttgttaatctgtttaatccttttaaataggttttaattgtattaaatcttgtaaaattcataattaatccattggaagtcagaatgaggccgttcaagtctcataattcatctaaaatcatggtctacatgtttatttactttttacgtactgtttatttggagttccttagtttttttcct

SEQ ID NO: 97613 - DNA, 501 bp, Oryza sativa
tcatgacatacatagcgggcagtgttacaccgtatgagtcgtgtgtgtttacgtgccttatcgccataagttacttatggtaagatctgtaaatatattgcaggttgagatatttttgttttcggggagtggattttacctcagatagatgctcaggggtgagtagtaaagcgagtaatccgggatagatgttctaattagcggtattgtaatttgcttatgacgccccttcactgtaaagttgaaagaatctccagttctgctagtcacacactgggcttcagcatgttttccacttctcctgaacatacttgtgctacaggtggctgcaatccaaaacgcacataacttgctgcaagtgttttcaagagtaaaaacttaagcctcagtcctcagattaacacaatgcagttccaggctttcagcccccagaacatgtacagagagtggcacaaacgtatcacaacatcggtgccatttctgcaaggggttgagtgacag

SEQ ID NO: 97614 - DNA, 644 bp, Oryza sativa
gcatacatcccggggggtctgattatgggggctcctccccaaccaatatagctcctagccgctacgagtctatgggctcgtcgcaatcctctcctggggtgtctacgatatattgtagttgccatagttacattgtggtgcccccctctctattttagagagatgacgggttacagagttcgactctaactccaccctctaacacctattacagctccaagtccaattgtaaccaaatagaactagtatattcgacacctattctaacagaactaaacacggcaaaaattttcctacacacataaattttcaacttttttcttcaaacttccaattttagtcaaacttccaattttgacgtggaactaaacacaaccttggtacaaatcatcatgcaggggcatgaaaacttccatttttttcttgggagtgtcagtcacttttctcatcccttggatgacaatccaatggctcttatcattcccactattaattattcaaaagaaaatcctttattttcacaaataaaagattaaacaaaaaattgcactgacctaacatggaataaattatcaagttataaataaatacatgtaaaagtatccaacttggataaacataaatctacaacgacaaaatcaggg

SEQ ID NO: 97615 - DNA, 721 bp, Oryza sativa
tactgtggtataaaagcactgcaactcgtgatttaagattcaggatcgtgatttaagatgctatttaaagatccaggatggcatccctgttccggtggtcactcacgggaacagcagccttgctgatctctcttgctgcagtcgtattcattgaagacggtattcacaatgctcccgggagaccaactaccatggccacgaggagcaaacgacctgtcaggccgccaatttgcgcgtacgtccggacgccagtggccccgccgctactacgagtcgtgtgaactgtgaggctgtgactgttccggtgggcccagcttgacccatgtgctactgttacgatgcacccgtttcttggcccacgttactaatacagatattgcaattggcccacgtaatacagtcacttgggctcggtccagtctagtactcgtaggaggccctggctgcagcgctaggcctaggcgacgccggctagaacggtccgctgctttgcccatctccgtgtgccgcgagaaggcggcggcctacggaaacggtgaaccttcacgtgccgcgcggcccatccattgcccgtgccggccgtgcgcgtgacggcccgagacgacagtacgccacggtgtcggtcgggcggccgcgcgcgcggccacgtacacggtgcagcgtggcgcggcagaggcgcacctcttcccgcgatgccgtggatattcccccgcaccgaccc

SEQ ID NO: 97616 - DNA, 666 bp, Oryza sativa
cgaacacttaaccattaatttaaggataatttattaagggaaattgacgaggcatgatctcaaccgtatataaataacggatggcatagatttagccaactccactcgatacatttgtacccaactctaggggatccagaccccaatatcacgatgacccctttgaatcatgttctacacattgtagttccatttactgctgattgcgacaaataagcagaatcctatattttaaatacttcttctgtgctaacttagattcaatatgcaccttccatatcaagtctcttataagatgcatatgcctaagttagaaaaggccaaaggagtccagagaatcctagctagcgttaggattagtttagacaactgtccttatcagaaccaaatgtaattaactacacaagaagagtgtctatacttgtattggtacttaattttgatatcacagagaatacataaatactgttttcagctaatcaaacatcatgtacctgtcaataaaataattccaaatttggtcacctttggcatgtaaagatgagtgatttctcctaagacttcaaaatacctgtgaataaattactctagccagtggttttggagaacccgcagactacgtacgtctgctcctgctcgtatgccgccaccgacgtggggggcgag

SEQ ID NO: 97617 - DNA, 642 bp, Oryza sativa
cctgcagccctgtgatgtgatgtgatggaaagttgaaagtttggggtaggtgggggtgaactaaacacggccttacctgaaggtgtttggagatttgcttgatgtagataatgatgcccaagctgtgtgactgcagatgccctgatcctagctgcaatctctttagttaattatacctaaatgacctatgctttcaggttagtgtctgcagtcaactgaaatatttggctagcatataactcttgttttgctaattatcagtaagagctttgataacttttcttttctttactaatctgtttcattttaccttccatatttgattactatgcggtagtaattattatttttttttatcattgtcaatacaactagataaatataagggattttgggtggatgtgataatgaaatatatatattactaatcaactattaaatgcaagggtacccagacacctccaacactgaaatatagctatcccatcaacattaaagttcaagtagcaggaggtatttcaaccaacatgattttccacgtcaccagacggtcgctgcaacttgatgaaaggatgggcagacttcgcagccaaacaatgacatatatctcgaatcattctgcatcttccacttgtataaaac

SEQ ID NO: 97618 - DNA, 691 bp, Oryza sativa
aatttttatgtacaggacatctcttttcatgtgttgtccacaagaactctggaagaaaactgatacaagacttatggacagagcgagaaaagagagaaaatattacgatgataagaggggatgtgccgacgacaaacgtaagatgcaccaaaaattaaggaaaacaaaaaagaaaaataattaagaaaaatatgtgccagctattttcttaaaaagaagtattacatatgcaataggtgaatcagtgaaagaaaattaaacaatactccttccatcccatctatcccaaaatataagcattttttggatctcgacacggtctttgagatgttattttgaccaataatatctataaaaataaaatgttataaataaaaagagttgcatattataatagtttgattaattataaatctagtaacatcaattttacattattgatatttttttatttttttcctttcaatagtcaaaattaaaaatggttgacttggcactatgctaaaaatgcttatattttgagacggagggagtagctaaaagtggttcagtggaaaaaaaatacacaccacaaacgtcacatgaaaaatgcatggcttgataaagttatgggatttaccatactaccatacatattgtataatatctcatccaatttatttatactaagatatatcaaagtgagtaggtg

SEQ ID NO: 97619 - DNA, 629 bp, Oryza sativa
aaaataataaattgttggattgaaatatgcctattaaaaataaatttttcagatttggaaatatgactatcaaaaatagatggagggagtattttgttactgtcctaccacatttcattgtaacagcaaactcagctcacaggtgacacagagaggcatttaatgtagcagcaaactaatatatactattgacacaatgagcctatctgtattacagcgaaggatgcacatcctacccacctccttggtcatcctactaaatcctatcccacgcaaaaaaaaaaatcaatctgatctcgcaaaaacatgttagtgttcaaatgaaaaataaatctcccggcattatatggtttatagttgtgtcactatatggtaagccatgcaatctcttttcgttcgaagcatggactgatctagtgtgggtgttggagggactcgactcaagtccccctatcccgttggatcgctattgataaaaggagaaagagaagggaaaagagggagaggaagagaaggggacagaaggagaaagaaagagatgagttccactctaatatttttcctccggtttggaggtggtctcaataagaccctgtttaattccaaaaacttttcgtaaaaacatcaca

SEQ ID NO: 97620 - DNA, 535 bp, Oryza sativa
aatccaaactttatatctaaacaagaccgtaatatcgaaatccagaacagtactgaagttaaaagcgcaaaagcagttgaccttggcatgatcacacacggcatctggactggctacatcaaacgatcggtatatataggcatccgttgatcttgttattgttgctgatatgccttacaattaattatagagatgattgcatcacatactatatttataactttgaaatagataactcattattggttaatgaatatgtgatttattcatgtgacctttttatgttgtatgttgctatttctaaagaatccttaatcaaatatcatatgtggaacaaatatggtttaatgatcaacacatgtattgaatgatcatgtcttatgaatcatggtatggaggcaccaaattaataatgtggacacatgttggaaaacatgttgttggatagatctaacatgagaggctatatatgacgtgccatcagtgatcttatttagtgttagtgtaaatccttagacctgagattattatgatt

SEQ ID NO: 97621 - DNA, 600 bp, Oryza sativa
ccttgtctcgttagttttccctactttttttcgtcattggtagtcatgctcgttgctcccaccgttgacaagcctagatctagcgagatcccactgtcgagctccaccattccttgttgcggttggttctatcacactaaagagcccttctcgtcacacgagacccatcggtggcagtgatggaggaggagatgcgtagcaatggagtgagaggaaggtgatgcgctgacctactttctcatcatcgatgccgcctcactttcatcaaccatcgtatatttttaaagtaattttcgtatatttttttttaaaaaataacacattgttttagcatttcgaaaagcgtgcacgtaaaatattgagaaaagtgagtttggacctaaggaaacgaactcatgctcggcgctgcatgaatttatatttatgtattctatgtattcagcggtagatgtacacatcaaagtcaatttttgttttgcaatccacgccgctcaggatgcttccttcgaacacagaaagaaagaaagaaatgcgaggcattgagtcgttatgttaactaggagcagctgtctagatgctggactttttacacatggccct

SEQ ID NO: 97622 - DNA, 644 bp, Oryza sativa
ctcaagaagctgacagctacaagacttgagcacagcaagacagatgggagttttacataggcagaacagcatcaaatatctgcagtgtcttactctatattccaccattcatgcatagaaccaaaactgagcccacttcctgtttgtgggacagactactcaaattctagtcttctttggctaaatctggttgatcaataccgttcctcagtatctcatatgttcagtaccagtgcgatagcagatccaggacctccaaaatgctatttttcacatcaccaagggcaattgtttcaatacataaaagataaatatctaacacatttcaccagggcagctgtgtcaatacttatgaaggtatatatctgaatgaagtccatgcacactatgactagagtctaccaaacaaatatttcaatctctatgttttattcaatgacattcatgccagatttagggaaaatgtgcagttacctctggatagtcaagttctagctgaagaatggataccgtctcaaatcgccgcaagagcattactgaattcatgtgatcagtgcagcgagagagtccatacactgtaattgggtaaccagcttccggaggcgtttaacgccgccaaattggaccgtggtaggatcatacgc

SEQ ID NO: 97623 - DNA, 538 bp, Oryza sativa
tcattcggatggttttgagcttgactgcttttacctgaaaccatgcggcactcaattgccgcacacgcaacgcagcgcaattcactcagccgacccacccttgtgggcaaacatgttgtgccgcgcgacgcgataacgatatttttcgccggcccggccgcctccacggtgtgagacgtgaaggcgatacggccgttacggccgttcgcgcgtaaaaatgccgactgagatgtggcggctcccggctcgggacggcgcatgcgcagcatcgaccaccatccgcgacggcccgccgccccgcgagagcgaacaaccacgggttgcgcggcccacgctataaggctacgtacaaggccgcgtgcagggcttggggttgggggatggaattttgggccttttggtggaatgaggggccgatacgttgcgttggggaagcccatcctatctgagagagttggagtttacacccattgggtcttaggcctgcctattagatcagcccaaatacgcccatttcaactcgtattcgatagctaga

SEQ ID NO: 97624 - DNA, 605 bp, Oryza sativa
aacttcttttagaccagtgttattagagaacttgcttgataatccatataatacaatgatgtcccttagactagatcccctcatcaatttatccaccagccgttaacaattattcctgtataccggttctcctgatttctgttgagatttttcatgtcgttgtatggtttgatagagctgttgaacctaccataatgccatatacaaaccgtttatagcgaatgtgtatgtggatatgcaaactccaacgaaaatcaaccagactatgctccaaaagaaattatcaagtttcctctatataattaacaacctacctgaacaagattgacaaccaatgtgtatgtggatacgcaaactccaacgaaaatcaactagactctgccaccataagaaaccatcaagtttcccctatgtaattaacaatctactgaagaagattgcagtggttgcaaattgcaatgccatatttatttgagttgctgggtcaagcagcaacccaattagcacaccacaccacaaaggaattaaagctttcctagctcttgtcctctttgggtgatgttgagagattttgtttggtggcccatgcattgcaatgctacaca

SEQ ID NO: 97625 - DNA, 989 bp, Oryza sativa
tgtgataaaaaagttgaaagtttgaagaaaaagtttggaactatactcggcctaatttgcccttcagagaaggtgtaggacacccggtcggaattcattgcctgagtaccaaaacaaagagaatttataactacccgattggacatatgtaagttttactcacagcttattttaaattaatactaagcgatttgcataaacatgagaaacaatgagttcaaacctagtctcgtgctattgagatcaggtgcagttactgcgttaaggattatagttggtctcatttatccattttttaataaagtgttcgtatttagtacttgctacagaagcataataaatttcaacgttttgaacgacagtacggtctccaaaacatattataatacaacataaaaataaatatttagttttattaattaaagaattattttttcacttattttcgcatatcaaccaattataaccctttacaatttcacttacctatttttcttaatcttattgcatactccctattaggttgtttttaggacggatggagtatttttaaaggttgctagtatattttaaaactgatgggtaattaattgtttgacctcaaacatgttcaaaacttcaagatttatggaaaatgggagtgtggagtgtgtgggtgtgttgggggttcttttcctaactaagagtgttaaaacgatcctaacccttgaagtcagattaaacaacgataagtagtgtgactgtagactgattaagctgcagtcacactatcactgtctcatgcacaatggaattagctttctatagctcggatgactcatggccatggccaactgcactaataagcagtcgatcgagtaggcccgagcatattatctggtccataccgctacttcttgcaataccattttttcgattacacgcaggtttcatatgcacgcctcacacgccgtgaatgcacttctctaataatacatacttagagagac

SEQ ID NO: 97626 - DNA, 620 bp, Oryza sativa
tattttggttgaaatttttatttttttttaattttttccgtgaattttggtgatatttattcaagttcaactaaattttattcaaaattttggaaatttctaaaattttggcattccggtgagtccgatcaaatcggctaaaccgaaaggtttaaccctgcctgcggcgcacctacatgctacaggtgcaacacagcgatttcgtactctctccgttctacaatgtaaatcgctctgtcctttatatgacgaagctatatgacaacgaatctggacagggtcagtaatgcatcacatttaatgtataaaaggtatattatggcatatcagtgggaaatactggagtgagatggagggagttactcgtcaccactctatggaagacattgcaaccggccagatgcgatgcatcgtgtcacagagaataagctacgtgtagccagtgtatctaactttctctcatccctataatatccacccgaacgatgctcgtcatacagaggcgagcgcgggggctcgatcgatatattacagccaacaagcggcagctcgatcgatcgatatatcacaatggttaggctcgccgtggactccggccttggccgaggctttgccggcgg

SEQ ID NO: 97627 - DNA, 616 bp, Oryza sativa
agaggtttgatgttcctatcttttacaccctggtattagtttataaattgtcttgtcctctgcattataattttttttcttgggtaaggctcttaacttaagaggtatagtgtcaaatcaatgcaaattacgataacctgttaaatttgcccgccgtcatttgttgagtatcacacgctagtcagctcaccttaaaagaagaatctgttagggaaatgcaggagcaaggcattcagtaggctcactagcctacagtcatggggattcatattgagaaaaatattttttttgaaagatccggtcgtattgagaaaaatatgagatagcctatccctgttgatttgatgatttgaggcatgcaacctaatatgttgtactgttgattttttatggccatgcttgtgaaggtaggagtaatagagaagggcagtatccatatttttctggttttcttttccccgcatgattctgtcggagcggtttgtgaatgtcatgataagtgcagccattgcataactcttgtgcagctagctggttgaagatggagcggcaactaagcagtcaatactacggattaaatgaacgagcgggtgattctgtaggtatttatgttcaa

SEQ ID NO: 97628 - DNA, 1756 bp, Oryza sativa
  unsure (1)..(1756): unsure at all n locations
ttttaaaatagtgtaaacaaagagttcacgtggaaattaagccctaaattccaccgtaaaatatgcaaggtgacaagagtgcataatgtacacagtaccttctagatatagtctttcttatttttacttgagttacacgcactcaattattaaaaagctgtagctaggagcctaggagagatggttatatatctaccctactaaactcacatgatgactatgtgttttgttaattaatacaccatccgttctaaaatataagcatttttaatatagtgacaagttaaatattttaaactttgattattaataaaaaaataaaaaatcaatcttgtaaaattgatattactagatttatcattaaacaaaatatcataataatatgtattcatccgtttcacaatataagtcattctatcattttctacattcacattaatatatctatctagattcattaacatcaatatgaatgtgggaaatgctagaatgacttacattgtgaaacgaaaggagtaacttttttatttaaaatatcttacttttatagatattgttagtcaaagaagcatctcggagactgtatcagagtcaaaaatgcttactacctccgttttttaacagataacgccgttgactttttcttacatgtttgatcattcgtcttattcaaaaaatttatgcaaatatataagatataaatcacacttaaagtactatgagtgataaaacaactcgtaacaaaataaattataattatgtaaaatttttaaataagatgaatggtcaaacatatgagaaaaagtcaacagcgtcatctattaaaaaacggagggagtattagtttatgacaagctgggagtaagtggtaattagggtcagctcttgattttaattgtaataatctcgtcacagtcattcacacatcagaggttctgctcccttctctgcgtgattccaattacccagaactatcgtgacgncnngcagtgagcattgctttaagtctttctggacatggaagaagttctgggttggccatgnngtatgtacgctccggtcataaaatgagcgcaaattgggctcgttttttaaaaaccaacgtgttgtaatttcaacaccattatcaggacggcgcccctgtttctgcaattaaagcacccataatagtaaagtaagttgctctctataaaacatgtacatctcagcaatagactagattaatagtaaatcacctcaatagtatgtctacatggttatctatagctttctcatgcattgtctcgtttttctctatagactatctctaggttagtagatagctttgctctctctcttcatttaatatcttccaagtaggaaaatatgctgatatggatcttttgtagagagcctatagataaccattgcggatgcccttagtagcctataagcaacctagtcaagtatgagtagctcacagcaacagcaaccactaactagtttatttgtagattaggcacattttgtcaacatttttaacccggcctccttgtgctcgaatgcctaacaaaaattaaaacctactacctctgtcctaaaataagcgcagccataagtttccgtatctaactttgaccattcgttttatttaatttttttttgaaaaatctaaaacacataagtcgcacataaagtactattcatattttataatctaatagcaataaaaatactaatcataaaacaatttttaataagacgaacggtcaaagtt

SEQ ID NO: 97629 - DNA, 550 bp, Oryza sativa
tattcctgcagccccattataactttatagtaagatagatctagcacgtacatggataatcccatcaaaataataattctagtgtaattatatacccacttactgtaaaaattaaagctgcaaaagaaacatgtaagacctcatatatactggaatgcatatttagaaatcttttttttaataatggtatgcatatttagaaatctatactccgtacagaaaagattagtatcggtggtggttccgccactgcctccactgcaactcccaacgaaaaaatggcatgtgaggctagatggcccacatatcaactactctcaccaactctttattttttgtgggaagaaaaaaattagtgtagaactaaaaagagattaaaaaatatatacgacaaatgagagatgttaataacatgttaaagataattttcttaaattgcaattctgttgcaccgcacgggcaatatgctagtatatatccaataaatttcaacaggaatgcatggttttagactatatatgctcgctctttgctgtactattgaacacta

SEQ ID NO: 97630 - DNA, 527 bp, Oryza sativa
caattaatttgatggcttcagctttaaattctgtggtgtaagtcttgtgtttcttgctcatggtaaactcctgatgagtgtgtttagtttaccaagttaaaacctcctgttttttcagcacacatcactcatacttgagctggttcacgcgcaacttctcgaaggtattctcatgcgttccttcgaagacggtctggatcactgcgaaccccacgtcttttgagctcaacgctgcatgcaacttttgtagcgtcggaaacccatgcaaatggcaaccttggcaccaatgctggaaggcaaacaagattttcgggccgggcccgatatctgacagtttgaacggcgcgatactttccccatctttgccaatccatttttgcacccgcagctcaggcgcttgtcgttcgatctcgttcatctgatcctccaaccccgatacagaagcttagtggatgatcgcgcgtcgcgacggtgcgcgaacgtccgaccttattttccctatttcctgaagccagaatagatcagat

SEQ ID NO: 97631 - DNA, 511 bp, Oryza sativa
tacgtggtgtgtacgtgcagaactgaagagtatgttataatgtcaaattccatttgctatcacagagagtataaattttatccgtcaggtttgtgcttcgcgcttacggaaccagccggccgtaattaaagtactgttagcttctctctttttttttctttacacgaaactttatcatgtactagagaatagatagattcactgtacaatgctgcaaaagtatacagtaatactccgtattttaattagatcgctggagacgatttcgcaattcacggattgatccaagtcgacggatggggaaaatgtcaggaaagtggttcgcgctttgcttgtcacaccatttcggcccaaccaggcaaccacgcgcgtgggccgtgccaccaggggagcgaacgtacgggccggcccgcgcgtggccgctgggctgacgaagcgcatcgatataggaaagatcgagttcctccctttaatagcaaaaccgggtataacgtatctcttatcatttaaa

SEQ ID NO: 97632 - DNA, 542 bp, Oryza sativa
aaaagggaaggaaaaaaactacctggatctgccacttgccaaaagttctttcctatccgttaagtttggtctaaggtgggaaatcatttacctagtgacgtgaaccaaattgaacatccatataattgatatcggtttagtagaatatcagcagttcaccgcactcccaacatctggataagaacacgtgcaactagaatgacaccctaatttgttcaaggttaagaacagctgacgccaagcgcaagagagcgggaaaggaataaaggggatttggattgcaggccgaggagaagcatgagactaccactaatcagaagaatcttcacatgacctaagcaagaacccccaccaatttgatccactgcagcaaagctaagggctcttccatgattacaccaactcgtaaaaaagggaaagttgcaactcggtgtagggtggactcttaactcgaagtcgaaacattttgactctatttttaggaaaattctcaacgcaagagctccatctggaacggaggaaactccgagtggattcgagat

SEQ ID NO: 97633 - DNA, 716 bp, Oryza sativa
ttcctgcagccctatcaaaccatactattacacgcttagtactactacctaaatggggctcatgattacactacgtcattagtactagtacgtggttggtgatagtcaggttggttatggttagggaggtggtgtgacattgatgccgcgacgtgggcagctcactagtcaattcctggagctttggatggcagcactgactctcacttgggagcatatcgttttcgtgcgagcaagtgcgagaaactaattgatttttttgtacaggtgtaccgaaatgcaagcgcagctaagtactaatggtgtacagtaatgctgatatattccaggaattgggggtgagctagctagctggtcaatgtcgatggccacaccaggacactaccccacttgcgcagttagttggcagtcacctccatacagattgtccggataagatggccggatccccaacctcacttcagcctcaatggctgccactgttcatcatctcattgcactttgcacttggcagcacagcacagagcagaaagttcttatgcttagcctaggccccccaagattctagcacttgtactcctactagatgaaccgtacaaaattactgcaaatccaaacaaaacgcaagagatttccccgttctaactaatagtgtcttgatagtctaatcaggtactattatcagtgtgaaaacatgacataatgtaaccaggttg

SEQ ID NO: 97634 - DNA, 557 bp, Oryza sativa
gaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgctttagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgcttgacaccttttaagatgcattgtccaactcctaaaa

SEQ ID NO: 97635 - DNA, 1011 bp, Oryza sativa
ggtcctgtttggttccataggctaaacattagcccccaccttttagccatgaattagccctcaaggatccaaacaagtgggctaatttttggctaaagtgaattagcctcctcaaaacattaccctctccaaggggtgctaatggggctaattttgtaggggaccataaaaaggcagccctctctctccttctctcacctctctttatactctctctctccaccttttagtcttgaattagcccatggatacaaacttaccactctaggctaatgtttagcctaccaattcatgactaaacaatagctctcaaaattagtcatgagctaatctttcaaacagggcccagatgtatggctagaattaatgcgacacggggacagggagctaattaaacaacagttcttaggccctctttgtttaggcttataagccaacttataagtcaaaaagtctaagcctaaacaaacaagcagcttttccgtttagcttttttgaagccataagccactctaacactattaagccaaaagctaggttggagaagcttttttggcttatgtgaggtagatgtatgactcaaccactaaacttaggacattaaatccaccggcttataaatcatataagccaataagctgacttaaaagtttaagccaataagtctaagcctaaacaaagagggcctttaagtgtgcaattaaagttcatgtgtttcggtgtgctcgatcgattaatctggcccacaaacacaaaggaaattaagatgagaaagctaaactggactgcgcattcgtatagttctttttttaggagggttaagaaattaagagcacattcatatagtaaaacacagttgcttggacctgggctgagctgaaatccaatgtgcgatttcattagtactacctataccaattacggtcctcccgttcttcacacctacctggctacccctacttacaatactctctccgtctgtcttattttaaatgcaactatgaattataa

SEQ ID NO: 97636 - DNA, 732 bp, Oryza sativa
tagataaatatccattttattaatggcatagcattagaccaattctctattaacattcccattcactcacttatgatgatgtcagaggaatggctggcatcaagatattgggccagttagaagagctttaaatttagattataacaagcaactggtgggctggaatttggagaagctaaaaaaacaagcttttgccttcgtttttttttttggattatgttgtttgaggaagcttttgattttaaaataaattacaggaagctccccacatgccaattgtagcgggacattttatcgtatggatttactatcgtaagatgcttatcagttataaaaatatatgatttggggcatatttgaaatcattatttttaatttttttagaatcaatatctttctaaatgttttgattaaatgcatcttatgtgtaaaatttatataagtgttttataatattatactataattttatatgtttttttctaatatcttatagtagaaccagtgctcggaatatattctgaagactgtttggatgtacaaaatgacatattttggcataaatatgccctttttatttcacttacgaagttataatggacaagtttggctctatggtgcattttgttagctatattttaagaactagccaaataactgtgtgttgcaacggattgtagaagatagaaaaaaaagtagttctcatggttaaaaagggaatgggctgcagga

SEQ ID NO: 97637 - DNA, 698 bp, Oryza sativa
tgcaagtgtttttggtgggtggattggctgagaactttaggccaagttgaattttgtgctgaaatagcgcaagtgtgcttgaattgaacccactctgaatgataagagttcgtcccggaaagaatgcatgaacattataggatttattagttaattctcaccaaaaccttatgtttcaaagaaggcgttcagccctcaacagctcaatataaaaattttgggttatcaattgatagataatctattttttataactattaaccggtacgaacgaatgaatttaatattaaaaattatatataaaagcttttgtaaaaaaaaaacatcgcttctaagaggcgtacgaacaaaatccagaatctacaagacatacccttggttaactctccaggtgagcttgcactgaaacgaacaattctcacgcacattcagctcaagcaaaaaatcacacttgggtaatttgggtacaaaggattcaatgttgagaattcagtgatgagttgcgacaggtcaggtggggcggacatttgaatgcattggatcaagcaagcacgtggacgaacggacaaacggaaaatcaaacagtgaagagctggaatcaagtcatctgctgttggcagagacaaaaacagcggggatttcagaacccaagaagctgaactgccctataaaacacacacgtggtagggctgcaggaa

SEQ ID NO: 97638 - DNA, 529 bp, Oryza sativa
tcgaaatggttaacagaactagtatatatgtagtgaaaatggcggtacaattaaaacatatgtggcaaagcaatagcaggtgatatttatagccacagatttggtaaaccggaataccatgaatgcaagtttatcagaggaaagagtgccttacattgttgatgatcagcagctaagctctccgtggtttccccatctatctcgcagctgaatccatcctcaatacaatcctgagagaggactaacgcagtaatttcttcgtcgatcatcttactaaccatatcacccaccttgtcatcatcatcagaggacaccgcggatttatcctcactggtgttagccatgttcttcagcaccacattgcgctgcttcgaagttacatgatccattgcatcattcccttcaccacgggattcatatgatactgcactctttctgacatttgacaaatcagctgatttaagaggcaccagctgcaggacattgccaacaatctcggcacattgagctgccaagccagccatggcgc

SEQ ID NO: 97639 - DNA, 666 bp, Oryza sativa
agggtgcccgaagaacgcgcgcgcgcgtggccaaggtggtgggattgggacgaggctggcaatggcgtacgcggcgacgcctatgtataggaggaggagaagaggaagccgggagaaatggagaatctctttgcccgtgtgggagacgaggaggaatggaacaacagggggtgagctggtcggcagatcggacgcttcctttatataggcatcagcgtcaagattcgtgctgggatataggagtacgtgccacgagcacgagtgcacgaggtggagtcagccacgaaatgggaacacacaaaagtcacggggtcggcaaattttacacaaaaatataaagtgcatgttcttacaaaagggaagcattgcctttcatatacttgtcactcgttactatccagtttttaacatttgggacatgttcactttaatgacattttcaaccttaccaagttttggtatagttgctaaaaagaatggctacatttaatttgctgccaaattttaataactatataagaaatcttgccaaaatttggcaagttaccaagtttttggcatcaaagtgaacaggccatttatcactcatcttctatgtagaagttttatagtactatatacttagattgagaaaaaaatatttcttaatgtgatatccaccgttct

SEQ ID NO: 97640 - DNA, 640 bp, Oryza sativa
cctgcagcccgaagaaaacaaaattgtacataaatgtaaaaaacaagtaataaaataaataactgtacaagtttcgatcaataatttaatagcactattaaacgaaatggaaagatgatttttttaaacacattttcttatctaagtctcgaatacacaaaaaccacataaatgaccatctcattttatatagaaacagaaaaatgaaatatgcttatgcttaaggttttctttatgaaggaagcactacaattcactcccggcaaatatttccgatttggagttccgttcactgctggagaaaccatatttgctgggttggccaaaaatcaaattagtctcggttcctatggtaaccggactaaaaaaactccaaagggactatatgataccaaccggttcaacggcctgtcaaggggctaaggatttttagtcccggttggcaccaaccgggacaaaagatcctcactttagtcccggttggtaacaccaaccgggattaaagattatttaaatctttagtttcgattggtgtatccagataccaaaaatttaaaaaccaaaaccgttgccggtcacctctcactcacccttatcttctctgaatccactgggcacgcctcccacactttatctctcc

SEQ ID NO: 97641 - DNA, 758 bp, Oryza sativa
caatgctctgttgcaacctgtaaaggcagttttgtgcacgtcacacacagtagacgccgaactcgtcaagcgaaagagatatttacaaaaaccatccataagtcacttaaaacttaacatttcacattataagtattttattaaatacgcattgactactcaattttgttctaaagaccatcccactgcacacatgtttaaccatatcaatatatttttataaattgtgagccgtcaatacgatctttattgaatttaaatacttataggagtatagtcttgacctttttttagagattctacattgaaatatgaataataagtctaatgcaagtacttatccaagattggcttagctagcttaacctttgatggttctacatcagtgatacggggccctttcagttcagtaagtgcacattagtgttttttacaataatttctaggggtgaacagttgcaactaaataatttatggggcggctttctgtaaatttcccccaaaataaaagttgggatagtcgctagtgccaagcaaagcaaccagccaaccatatgcacacgccgagccgcgagtggttgctcgatcgaccaggtccaggtgcaatgcaatcggtcagttgggactcattcatgagccgcagtgcagtagtcgtacgtgtgtcacgtaaacagttaggtagcgcaccacttacgcgccgcgctagttggcgacaccaaaacggtttaaaaaaagagaaagcgttcaaacgacacgat

SEQ ID NO: 97642 - DNA, 1104 bp, Oryza sativa
ccgccgtccatcgccgtccggtcgcagcgctcgtcgatctgtgcagcagcagcaaaatgttcgtcgtcttcgtgttcatcaaatcaagcagcagcacgtcgtccatctgagcatcgagaagcagcagcagtagcagactagcagtcgtatctcttcaagcagcaaacaacgagcagcagcaacagcagctcttcgtatcccttccagatccagctccaatcgtcgtcggtctcgtcgcccatcactgtgagccgccgccttcatcgccggccaacccatcctctccatcgttgtcccatgctcccgccgcggatcttgtcaatgccttctctgttgctctgctgatttcgtggattttgttgttttttgcaaatggtctgcagctcttttccaaaacctcaatcaggaacgcatcaaactgccatggtgctcgtccagtcgtcctcctcaaaatgctgctgccagaaaatcagtaagcgtgcacttgtttgccatggatctagagtgcatgcttgctagtgctagctagtttagtttgcacctgtcagtaccactgtccactgaactagtagctgcaacttgcaaatggttattagtttagttagttgcaatggtctcaattgggagtatagtccatgtccatctgagatatgcatcacgtgttcttccacaggtgtccagtgtccactgccgtgctactgtcgtctactagttcaactcctttgttatccattgagttcaccaaagtctattgcatatcatcaattcatcgaagtcattcctgtcaatcaccatcatcgtcatcaccttatcatcatcaatgtcctatcatcatcgctaactccctgtcggagttggtatatcacgtcaccagcttcccgtcgaagttggtatcatcatcattcagtgaaggtccgaagaacagtttgtgaatgggcttcatcatcatcgtcattgtctctgaatcaatgaagagccaaagaacaatttgtgagggctttttgtactgagggctgaagaatagtttgtgaagcgcaagatccacttcacatcatcaatgcaatagtttggtaagggtatagatgttaaggggtattttgggga

SEQ ID NO: 97643 - DNA, 843 bp, Oryza sativa
ccagttaattacggctgattataagccagcttattaacgataaaaaaaatgtgagtaaaattttgtatacgtgtgtttagcgacttaaatattagtgctgaaaaaaactatgttaaaaagattaaaattaatcttaaaatataattttaaatataaattttaacattcatctttaatataagttgctatgtgtttctacgtgctttactacggcaattactaagtaataatatttagtgttcttgttgataataattgagcttaggagtaaaaatatattagttattaacaacaaataaactggattaccaaaccaggtttggagaagtaaattagtacactttgtaggagattgtagatgaaaaatattaggtttttgtcggctaaattttgcatcgtaactctgtaagaaaattttgatgaaaaatcaatatttattagtactaattacaaaaaagaacaagtattataaaaatgatagattaaatatgtttgaaatattgtgaaaataatacgagaggtgatgattggatatgcttacacgttgatttgtacattttaataaattatagattatgttgtataacttgcgtgagctttgatacgtaattattgttagtggatgatgagttgacatgtttgtaggttaaattttagatttagatttagttgtttgggtgtgttcgctattactagttccagaaccatccgcacgaaaaacggaacggtccattagcacgtgattaattaagtattagctttttttccaaaaatggattaatttgatttttaaacaattttcgtatagaaactttttgtaaaaaacgcttagcccgtttgaaa

SEQ ID NO: 97644 - DNA, 941 bp, Oryza sativa
gtgggcctaacacattcggcccggtgcgtcagagtgaatgcgcgaggtgttgggagcgattagtaccacctcgctggtttgagaggagttggagtcgacgggtggctataaaaggagagcctgggcgactttggggcagcacgcagctgcgcgttgagcataaagcgaactattttttcgcttttacttaggccttgtttagttggggaaatcttttgggttgggatgtacgcgccgcaaatagcagcatacgccaaattttggaggggattctcctaggagggcctctacaattctcaatccgaacatttacgtttttacgaatgattatttgaaagttatcttttttttacgaatgattatttaataaaaagcaatctagaatgttcgaaaccttaggcttaaatgaatcttcattctgttgccccataatgttttaaatttaaatttggggtttgcaagtttttcgagacgtagaatcgtttgtggctgtggccggtacgagactgggcattctgcttcattatttacttttgattacgatttacataacttatccttttagtccattatttacttatgtctttacgattcactaaactggtcctttggagcatatcaaactggctggttcataacatgaggtaattaaacgatgtcccatgacaacacaatgttgtcaatttaactgaaatgaaagatgtctaggaaatattatatagagtaaagttcatcaccggtccctaaacttataccgctgtgtcatcccggtccctaaactcgcaaatcgaccgttcaggtcctcaaacttataccgctgtgtcatcccggtccctaaactcgtaaatagaccgttcaggtccttaaacttgttcaactgtgccatcctggtccctaaacttgcagatcactcgtttagatcctccaacttgttcagttgt

SEQ ID NO: 97645 - DNA, 1952 bp, Oryza sativa
cgttgtgttgcagatatggcgaccaagttgatagcagattatgatggtggcccaccggtgaggagtatcaaagcagggtcttgcaactatatcctgtacccaggcagcgcgtgttttcaggacacgtgcaacacgttctgccaacgcatgcaggattcagccacacgacaacgtgtccgcctctggcctctgcacttcccagggatgcgagtgtgtatattgtcctaattaaccaacgttaaatattaaaaaatagagaaagtaactctttaaaaacagaacaatatgtaatgatactgatagttctaaaagaaaaatactgctacactatgagcaaatttgtagttggtgttgggcattgatgcaacaccattgatagttgatactggaaatttaggaaaatagcacaaatgttgctattatcttaaaaacaagaattaaatgagttgctgtttttgtgcctgtgaattctgtgccaaagattttagagactgatcctgaggatgttccagtcatgttgtgaatttcaattctgagctcaagaatgacacaaggccgtacctgacagatttagataattaattattatgtgctttaatcttaaggcaaacttaagaatgatcgatcttaggtttaaaatcgtcagcatgtgcttaccaagaaaagaattgtaaacaaacttatgaatgacaacggccagacttgcatacttaaactaaagctcagtttgtcaaaaagtactacccattgcagttgaaaagtcaagctcgatgatcaatggagcattcccatagccatgaaaatctcaaccggtttacccaaaatttgagcgttcactagttttttctccgtaacaatgtgggttgtaatttgtaaattgattaccataacacaaaggtgttcatcagcgcccagatcatcgacgtcatacttaaaggcatcacgtacgttttgttgggtcaatctgaatctgaatcatcaataatcttcatgttttcttcaggccggtgaattagcagcggtgatccaagccatgaatcccgatgaatacgagaccatcagaccacgatggggacgacgacgatcagagcgagcagaggaggttgcgtcagaattcagaaattggacgtcagagtgcacatggccaacctatcagttcagagaaaacatgccggcttttcgtcagaattaggttcacccatcaacaggttgagacaataatctactggtacaataatgttgcttaattaagttcagtgagaagtagctactgaaattcacaaatgattatcaagcaacagcagattgaacaataagagatggtgaattgtttcagatggccttgtagctaggcctaacgttatacttcagtgatctctcttaattgtaaatctgtcagtatcgatgagttcttgaagtacaattttattattgttgcatccgtgaaattgaagtatacattcagaacacgaggacatattcaaaacagttcgtacatgcacgacagcacgagtgtccaaattctatttcaacatggccaagtaattcatgttctactaactagctcacaaagctaactttttcattaagatggatggtcagactagctaattatcgacaccatgaacacaagaaccaagaccatgcatgcattatcgatccatgtgtattaactagtatatagataagaatcaaatacaatcttgttagttggattagtcaatggctcaatgccaatgagctacaaaaaaagggcttacatgtagttagctgctgaccggatacaaaaggctccagatctccaacattgtgttacctaacgaggatataaactccacaatcctttttttagctttgcatgtgattgtcagctagtatgaagttcaaaaaaaacaaattaatatacaattgcaaacccaaatttaattatattgggtcaactctgtaagctg

SEQ ID NO: 97646 - DNA, 660 bp, Oryza sativa
gtcggtctgaccgggtggatgccacctgtctgaccgccatgtcaccgctggttggaccgccgccttgtcgctggtgtgactgtcgtgattcagagaaaaacacactgaagaccaacttgactcacatcaacacacaatagtatcacatacgaatagaaacactctagaaatcataaatatgaaacaatctagaaattccataaaaatacttcgaaaccgactccaacccgaagtctaccggtctgaccgtcgggctacccggtcagaccggacacccagcgccgacatgcaccgttcacggctgaaaacactgtgcatcgtattttccgaaacacccacctttaacaatttgttcatcacatagattaactcaacgcattgatttcacagattttgctgtccaaaccacacctgccatggagactgttcccctttctcatgagtcatgatcttatctgaacaaaaatatcctaaagtgtgctatcatgagttcatgacatcaggtggtatcttcttttcttttttcagaacaacatctagcccccaaaacaaactgttcatgttatcgtggcattcaaagtttcagactgttcatctcccgttctgctagcgctagcagtggcactgttagttaaaggagggagaagtgtttgaaaattg

SEQ ID NO: 97647 - DNA, 728 bp, Oryza sativa
ttactttaatatacgcgctatctatattttcccataaagcaaacctcacacgcggttttatcagcgtatgattgactaagtattttttaaagaataatcaatataatttttaaaacaacttttatatagattttttttaaaaaaaacacgatgtttagccatttagaaaacgtgcacataaaatacgagaaaagtgagttgggatagtgacaacgggtgtgttcggacaccccttttcctaacccctctctcttccacgcacacgcttttcaaactgctaagcgttttttacaaaaagtttctatacgaaaattgtttaaaaatcaaattaatccatttttggaaaaaagctaatacttaattaatcacgtgctaatggaccgttccgtttttcgtgcggatggttctggaactagtaatagcgaacacacccaaacaactaaatctaaatctaaaatttaacctacaaacatgtcaactcatcatccactaacaataattacgtatcaaagctcacgcaagttatacaacataatctataatttattaaaatgtacaaatcaacgtgtaagcatatccaatcatcacctctcgtattattttcacaatatttcaaacatatttaatctatcatttttataatacttgttcttttttgtaattagtactaataaatattgatttttcatcaaaattttcttacagagttacgatgcaaaatttagccg

SEQ ID NO: 97648 - DNA, 793 bp, Oryza sativa
tttttgacacgtcggatccacgtcaaccctcgtcacgtcagcccacaaaataatatgggccaagcccatattgtctctctctctccttgctctattgtgcttctctccctcctgactgtcggcggcggtggcggtgttgagctgtgagggcggcggctgctacagcggcgtgaagcggctacgagggcggtggcggcggcggtgtggagctgctgcgagggctatggctgcggcatcggcatggagctgcggcgagggcggcggcgtggagcggctgcgagcgcggcggctgcggcggcagcgtggagctgttgcgagggcggcagcgctaccaaggttgcggaggcagtcgccagcggaagcctttgcgtgcagtcaccgacgaggagagcagcaacggcggtggagcttgctgccccgcgcagaagggcggacctcgccggagccacacgcgtccccaagcctcatcgcctccgccgaactctatgtccccaagcagctctagctccaccggcgagctcgattttatggagaagatagagctcctggaggcggcaggagagacggaccttgagctcaggctcgccggcggtccgcgcggaagggaagactagatatgtgcttgagcttcgtcaccgcaatgagtcccctgctccacgagctcaagaatgccattgctgcttctctactgctcggggaggaagaaggatagagagagaaagtgaagaggagatgagggaacaagagaggtggtcttcatttttatttttatttgatccctaggcttccacat

SEQ ID NO: 97649 - DNA, 727 bp, Oryza sativa
attcttcctgaagtccctgaaatcacaataccagataccagcgacgttagttacacacatcagtcacatcttatacatcctacaagctttggttttcccaagctgttcacaaactcagctagctagtagctactgatatgcagtgttcatccccaagtagaactcgatgacgacctatcataaactgacgaaccgaacatcataactcgatgctgacctaattaactgacgaaccaaaccacccaaaaaaaaaaaactgacgaaccaaacatcaaagttcaaacagacaaaattggggagcgcgagaatgtggtggtcgcaggagcaaggccaacaatcgcaatggaggacactgcctaatctgctcctaatacgatcccaaaacggattggattgggaataagatcgaacaccatcaatccatcatcacctccgcgatctcgacgcagccgcacgtcccagcgcaccgctggctccgaggcgccatggcgctcgaactccgcaacgccagcaacggtctcctccaggcccacgagcatcggcacgcggccggcgacgacggccgccggccagccaaatctccggcgatagggcggcatttccggtgaggcggcgcgtggaaccggagcgtaggtgtgggccgaacggggtaggttgaaagatgcaaatgggcttttttatgtgggccggaaaaaaggcccagctacttccaggagatatttacgaa

SEQ ID NO: 97650 - DNA, 517 bp, Oryza sativa
tttttaacagtgtcccatacagtgtagggtctttaactatcatcatcaacctcaccaacactgaaaatcctgttgaaaggcactactagtactagtctccaacaataataataggaaagtagattcaccaaatagttctagctagtactaacacaaaagcagactgaaagctcaagaactgatcgatgggccgtctgatctttttgcacgcaattgcaaaggaatttcagaattgatattatccgtcagatacttttgtaggaaatacaagaatcaaaccaactagagaggggtgaatggttgaaacaccaaaaacttaaaacttttagcggaattaaaggttaccctcgtagccaatggagatcagtctgaccggcgtgtgtgcgtcggtctgaccgggtggatgccacctgtctgaccgccatgtcaccgctggttggaccgccgccttgtcgctggtgtgactgtcgtgattcagagaaaaacacactgaagaccaacttgactcacatcaaca

SEQ ID NO: 97651 - DNA, 887 bp, Oryza sativa
tggggatcgtcctgcgtggtggagacagtgcggggcaccttatactttctccgtcccaaaaaaacttaatttctgggttttcatgtctaacgtttgaccattcgtcttatttgaaaaaattatgaaaaaatttaaaaagataagtcatgcataaagtattgtttatgttttatcatctaacaataatgaaaatactaatctaaaaaaattccatataagacggacggttaaacgttgtacacgaaaatctaagaattgagttcttttggaaaggggagtatgccgcaaggcggtggtgacatggcaaaatgacctgagacagcaggggtcagtgatgcaagaaaacagcagcatggctcacggccttgctgtgcctccagcaatcgacgtgtggggagatggtgggagtttgggagcaagttgggcaccggtgggaggttggtggtggggcgctagaacggtggtcgcgtgcagtgaagttcttcggatggtggcagctgatggtaataacgaggatgcaacgatatgagggctggatcgatgttttttgagcggaagcccagctcaattctagaccgacagtggccacacttttaggtgccacaaccccccggaggcgttgctctacggcttcctcctctccatctgttgaaatttgtcgtgtgaaaatcttatcctggtttctctggacgtacgacagcgatgtcctcgacgtcctgacctccctagggcatcgttgtgaaggtccatttcctatcattctcttcttcaaacgatttgtcctcttacaacagtgtttttgaccaccaaattaaagaaggccacaccggctgatatgtgcgttgttttatatgagtaaaatgcaccaacggtccttgaacttgtca

SEQ ID NO: 97652 - DNA, 961 bp, Oryza sativa
gaggacaggtggtatcttgtgccgtctttcttgagttcttgcggtggttttctttttttgaagtttgttggtttcttttcttcttttttttttggggttggttcgtgatttttttgttgttgtgatggcggctgagttgtttgtttagtctgttcttgatgtttgcttagtggtggtactgatgtgtgggtagggttcgtgttcttttttttttgcgtttatcttcgctttccttttttttttcttcttccccttttgagatttcgatcgtagcattggttagcgtgttggtggatgtagttaatcaatccccttttaggtgccaaatgtcatggaaagcgagctctttgcccttgtttaaccaagcttttgatcgcagcattcaagaattggctccatctccccgcaaaaaaaaaaagaaagaaaaaggaattggctccatcgattcagtaaaaaaacccgaatgccgcggaagttagcattgctcatccgtggattcgacgctggcacactggtttcttggctagagagaaacaacgatgtgcttgctgtttcagccaccaatttcttcccggcttgtgatttttgccttttgtatctgctttctttttcctcttttgagaaagtacacgattcctttgcctaccttcattttcagtgccgattactaaatttgcagtaggtcctactctctcgccgtggtgttggactatcattgggagtagttgtcatgtggatttatgcccatttgctgcgattaaagagagaatatgtgctacgccttaacgttcatggacctgatttcttgaggtcgctgtaactgttgcctttggagaacaagaggaagagggtgtgagtgtgtggagacactaaccgtggcttttgcagattcctcttatctgttttccttgcatggcagttgtgccatacattggggatcctctagagtcgacctgcaggc

SEQ ID NO: 97653 - DNA, 803 bp, Oryza sativa
aggaggcataatactcgactagctagtcagaactgttcttgggaatcgcgtgatgtttgcagaatttgttttgtactaaaaaaacttatgcaaaaaaaaatcccaataaattttcactgtactttctctgtctaaaaaaaactcaacaaaatctgatcaaccctttattcagatttattacactagctctcctaagttaatttttttaaggacggaggaagtacaggggcttgtttaggggagcttctagctaccgcagcttctcctagaatcagaagctccccaaatagttcagttttttttgtccagattttaagaagttgtagttgcagaatctagaaaatgaacaagaagccgggaaacctagcttttctagattctcagccaaccagttgtttctcagaattttaagctccctaaacatgccctaggttaaggaggaccggaggaggaggaactcacggagcgatcgtttcgcttattcgtggaataagcgaacgttatatttgtaaaaaaaaagtaatttgtgaataaaacttttatatacgtgttcttagcgatctaaaagcaaaggttgaaaaataaatttcgatgaaaaaaaccttaaaattagctctaaattgaaggttaaaaatttaaattttggctgataagtataagcataaacgaaaagacgagactctcgtaaccctaactaacccagaagggatcaaggggctcacgcagcgccacgtcacgtcgcccccccccccccccccgggtaggcgcgatccgggccgtccgttttgtcgtgggggagagac

SEQ ID NO: 97654 - DNA, 548 bp, Oryza sativa
aagtcctgtgactggtactgtgatcgcagtttcgtaggaagcagttcgcgccgtttttcctatgacacgctcctatcaggtgccgttgtccggcggtgccagattggggtgtgacagcaagtgaatagcagagtcctacttggaggaatcgggtttatactatatcatgcggggtccgtagtctccgagttctacttgaagactaaggtgattcacggtgtaaaaggcataccccctgaggggtttagatgaccgaatcatagcgccagcaccaccaccatagcctacaatccggaggacgtgaagcctactcgccatgagatctcgttgaaaccatctcgacaagggtctcgccaacgacaagggtctcgccaacgacaagggtctcgccgataatcccaggattattggtcttctattgtaatatgtggttttttcatatctatctcatatatataaactggattagggctattaccttacgagggcccgaaccagtataatccttgtcttttcgtttgcttgatgttgtatcgtgtagatcctcg

SEQ ID NO: 97655 - DNA, 531 bp, Oryza sativa
gactacaacgacccctccaagtccaagcgtgtccgcggcgagccccacgtcgagcgcgcgctctccgcggtgttccgcggcgaggagacccacgtcgagcgcgtgcccagcgaggaggtcttcggcgaggccgacgtcgagcaggacctcggagatgccgtgaactacctccgcggcgatgaggactacgtcggccgcgagatcaccgtcgatgttcgctgcggcgcccacgtcaaggtcaagcgcgccgccgagttacccgacgaggtcctcgtcgaggagctcgatggccaaaacgactgcgagctcaccgcggtgttccgcggcgaggaggcctacgtcgagcccgcgccgggctgggaggtccgcggcgaggacgccgcggaggcctacgtcgagcgcgcgctctccgcggtgtttcgcggcgaggagacccacgtcgagcgcgtgcccagcgaggaggtcttcggcgaggccgacgtcgagcaggacctcggagatgccgtgaactacctccgcggcgatgaggac

SEQ ID NO: 97656 - DNA, 543 bp, Oryza sativa
aaaaaatgacataacaccaccacccctgcaccgctctagcagaacatggcagcaatggcccagaaaaaaataacttctgttgttcaaagctacagtactacagccaatcaatcaatactatgagagtcaatctgcaaggagtacaaatttactgcccactttcggacagaagaacgcaaatgctgtagcactaacagaagcacctctaggctctctagacagaaggcggcaaatgctgtaccactaaaagaagcacttctaggctcagaagaatgcaaatgcagtaccaccaagcaccactaagagatatctggaatttctaatagattgggaggtattataggaggttcaccttcgacttttcttttgatcatcgcacgaagtgatcgcatcttccgaactaagttcctcatcagtaagcagttgtccaagatgtcactcctcatagcattccccttgatcatgtccttggtctctaattggagattgttcattttattgtaaagcccgaatagcacaattattcgctgtcagtgacttcat

SEQ ID NO: 97657 - DNA, 555 bp, Oryza sativa
caaaaattggttttctcactcttgcgcacatgccagcctctttttgctgcgggaaattcaaatttgataattcggtgcgtgaaacggcgtgaagtcccaaaattggttcctcactcgtgaaccggcgtggagtccggataagttacgcgcgacttatccggttcgaataatctggtgcatgaaacggcgtggagtccgaataagttacgcgtgacttatccggttcggttatgcggagcgaagttttgttttgctgcgagaaattcagatttgtttgttttggaaatactcggaataatccggtgcgtgaaatggcgtagagtctggataagttgcgcacgacttatccagttcggttagatcgtgcaggcgtcctgatcaagcgtcataacatctctatataagttaagccgccgcctacacgcaacacacgcgaaatcaatctagggtttgcctcctcctttgcaccgcgctgtcgctcgtagtctactctatcccattcgccggtgtgcagcggcgatcggaagaaaaggtctccggaaccttcgctttcga

SEQ ID NO: 97658 - DNA, 555 bp, Oryza sativa
acttgtgaccagtttggtggaggtaggaagcagcaaatatcacagcaggtgcagcaaaacctacatcttgctttagcttacatatgggggaggggggggttacagcctcatttgctttttggcgcaggaaggcaagaaacatcaagtgccctacacttttcaggttaaaatttcttctctcttggcatcccaacaccttcttcgaggagccgacacccattttgtttatgtaagtgccctccaggacttcatattgatgacctttaagccggggcaacagccgcctttcccttggtagccttcagcttcagtttcttgcagccgcccttcttcaccaagtcagcaatcatcttgagggaccgcggagtgagtggctgcttgaaacactgcaaatacaattttttgacattctcatcaaaagagtcactttcattcatgataccaatttttttggaaataatctcttgtgcaataagctcaattttacatccattccttcttttcttttctagcccttcactatgatgttgtgtggcgcttaggaggactttgggt

SEQ ID NO: 97659 - DNA, 752 bp, Oryza sativa
tgctacttttttattaaaaaaactatccgtgtcgtaaaattaatgtttcttgagaaagtagtcaaattggatttgactaaggtgaagggcatgtatgctaattgcattgcttcaaactatcactagaacatgcatgtactagaaagattggtgatgagctagctgtagaaagctatgacggcaatgggtaatccaaatagaaatttctagctatgccctccatttcatattataagtcgctttgacaattttcctaaccaaacttcaagtttgaactagtttatggacaaaattagcaacatctacaataccaaattagtttcattaaaactaacatttaatatatttttgataatatgtttattttgtatttgatatgttgttatattttcctataaagttggtaacttttttaagtttggctaggaaaaagtcaaagcgacttataatatgaaaaggagtgaatgtcgatcctatgagggaaaggagtgaatgttgatcctaggagtgaaaaggaatgaatgtcgatcctacgagtttgactaggaaaaaagtcaacttttttcgccggaccgaacgaatgagtccatctatttgggctgtttgctgctttgagtgaatgtcgatcctggtgttggagccaacaaatagatccaaattgtccgtagcctgatcaaacaagctaaatctacttccacaagtacagttttgtgccctcccatgtataattgtggtctttcatcataccaaca

SEQ ID NO: 97660 - DNA, 585 bp, Oryza sativa
aaaagggaaaaagaagcaaccacggtctggtacgtggagctagataaaacatgactagaaggaccaattagaaaaatataaaaaggacaattagaagcttaatcattataatattaagccgtctgtcatgcaaaaatggatttcgcaaatggccagctgttaatgccaaattttgataaactccaaagttgtcatcggcctagagacaatatcggcttcagagtcttagaatgatccgatagaaattatcggtcaccagcagttggattcttgatggagttggttaagtaaattaatcaattttaaaggaatcatatctagaagaggtcgactttaaggaggatgtggcatggcaatttatctattaattaggcagtcagtcagtttccttttagttttaggaaagtatgtttagtattcgatcagaacttgtatattttcttttatctttacgaaagtttgaatcgtgtacaattaggactcttattagcttaagagtataaatatgtacaccgaggtccctgtaatctatctacacatattaatatgtctatcttcagcgcatcggcacactcccacgaggtt

SEQ ID NO: 97661 - DNA, 612 bp, Oryza sativa
cttttccctagcaaaaattcaattaataaatggttggaagaaattatttgtttaaaggcaagaaagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctggaaaaaaaatcctttcttctttttctttttctttcctcctttttcctctcttcttgggccgtcggctcggcccatttcttcccgcgccggcccgctcctccctcccactcccgaagttctcccggcctccctctccctctcgggcgctgacaggtggggcccacctgtcagccctttccctaacctccggccgaccacgcctgcgccaaccgccgccgaaaccaccacccatcgccgtccgccttaccccgcttccgcgccccactccgcgccctgcgcccacgttgcccgccaccatccccactacttccactcgcgcgtgcaccccgcaacggagggattcaaattcgaaactctctctatcttctcttcattccccacg

SEQ ID NO: 97662 - DNA, 901 bp, Oryza sativa
gattttaaatcactaaagataagctatcatactctgaaggataaatggtcgattagagaattaataagtcatgatgttaatgaggaagagcaacaaaatgccgaaaggcgtaataagcaagctttccccactaaagctctaaagaccaatgagaatatcactgatgagcccaatgagtcaagtgccaccatcgtgtccaagcttcgccataagtctaggcatgagcaagaggactgcgaaggctttagaaaatggcttccttagaagggtaatcttactcattacaatattattgcccatacttatgatacatttgtgtaacacctaatgtcatttaattcttgttgaatgacataggtgcattacacttattcaatatagaaaaataggaacaaagcccctttaatgggaatcaattttgattaggagacaactgatgatcttcccttagtctaggaagacctttgttgtttcatttcacatgttttttttatgtttatgaacttatttccatttatgactatggctacaatactgagtttgataataagggatatttattaaattcaataataaagttgtgagtcttgccttcgagcgagacaaattataatcgctccattatgatactatgctagatatttgcgatgttgtacgagacctcatcaaaattgtgacattattgcttagatcacattttgaatgagaagactatgtctcattacattagaaacacatttactaactctaaagtctctaaatatagcagaggaacattaaattataaagttccctttcaccaataaaaatctcccactaaagtactatctccttcgctaaataactattctaaaagcagtagaaaaatcaaagctaaattagaaaatcggcattatgttaa

SEQ ID NO: 97663 - DNA, 1058 bp, Oryza sativa
taatacgatatactcatagatgattattcagttcatcagatatgcctaagaactaataaagtttaattgacaggatatcatgagaaaatataaaaaaggaaaagaaagttaacatttggaccctcagctatggcctcggtccaatttttatctatcaacaatgactatccattcaaaatcacacattgtccatgaacctaaagtaaagtggtttttagtcacgtggcatccacacggaacctacttgggcaaagagtgatgacatcaccatactgaattactgatcaataataaataaccagaaacacttccttttctatctcgcttacacctatgttatcttgatttgctagctagctagctagcagaccatacgtcatctaaatcatccactgcgctgcatgtggcgtcctaatagacaaatcaaaattttagaaaatatataggaggcatgtggatcctaatattttctttattttcttgagtgcttgtatattgagaaggagaagatggataggtggactggagacaagtttaagcagcagactctgctctgctccagttatccagtaaaataatccttagtaaaaacaaaaagtaaaataagccttagtagaaacaatatggctccaccatagcatcaagtctagatgcagttggatacggttattatctttatcaatagcaagcatgggtggtaactggtaagggaaactaagaatgatgataaacaatgatatgcaattacaggtggcatgtaaaggaacaaatacccttggcttcaaaccaaaagtttgcacatgagaaataactccatcgatactccaatcaggcagtgttgaaattggtgaagttaaaggaaacaacattttaacaatgtcccttctgcctcgattagcggcaacttcaattggagtcctattaaactgcaggagtaaaagaactggttgatttaattcttcatcaacaatgcaaatatcacatatattgcaaagaatttaacaatttcaacattaacagctaggattccaaattagaaaatttgaacccaatgtctg

SEQ ID NO: 97664 - DNA, 779 bp, Oryza sativa
tcctgcagccctttaataaaaaagtagcagggccttccagttatattaataaaacaggaaaaaacaatccaaagagagagaccaacccctgcagggaacaccgtggtaccaacaccagcttgaaggcatttaaggtaccaaaccaagaaaagaaaacaaaaacctcaaaaacacaaagctacaagcagccagccatgatgcatgcattaaaatggcgggctcatgccaaacttgatgcaaacatccgaagtttcaaacaccaacaactatgccagcaccaaaaacaccgacggcaaccaccagcaagtcaaacccaacccaagacaagtgcacatgagcagaagcacaatgcaccatagaaaattagtaaaacgttgggagccatagaggtggtgtcattgtgaaaatgccgaacatcaacaatacgacagccaagaagacaagaaacactacgccacaatgcctccaagctaacccaccatcttgggcaccacatgaaacccatcacacaagcatattctcgcacatgaagccttgaaagttacacttattcactcaataatataggccaaggaagcgcacagtaggaagaaataataatatcattaccatctctatacaatatacacaatgtaaaacataccacactgtacattacactttatcaagacaatgtgtttcctcctgatgcaaagtatctatttctggaatcactgatacactcgttcaccacttggtttcttcagttcagtttttccaccacatagaaaacttagttt

SEQ ID NO: 97665 - DNA, 640 bp, Oryza sativa
  unsure (1)..(640): unsure at all n locations
aactcaaaaattaacttttagaagtaaattgaaatcataaaccatcacgtgcgcatcaatcccggagaaattcgatcttttagcaacggaataaaccgaagatagcgaagaaccagcagcaaagatagcagagcagcgtaaattcaggggaagaacgttacaaaccacaaacttaacgaattttaattcaacctctatcggaatcaactccagtaaccggaacaaataccccaagactctcaaaaattcagatgaaaaataaggcatgaaaggaaaaaaaaacagggaagatcaagaaggcggcggccgtaccatggtgggagagcaatcacgaattcctccacgagcccgaaccggggcagatgatcatttgattggaaatcgagttcgcaatccaaaaggcgaggcggcgcaaaacggaatcacgcgatgaggaggaggaattcggagntgggaaacccgaagaggaagttgggttgcgagtaatgggaggattgttagtgctttagccccgcacggcttttggttttggttccatgctagnggtgcggtttttttaaaaacacccctaatatttctcatattgtgtgcaaacccagtgggtttaaaggtttgagggtttacatgaatgaccccttgt

SEQ ID NO: 97666 - DNA, 551 bp, Oryza sativa
catcttattagtgctgactccactatatcaactaactgtttttaaaaccttgaacatgattatgctgttagactcttgatattattgtatgggtcctggtgtttaactaacacttgagttcgattcattatgcgataagcatctgaatgagtggtctctaatgacttgctgtttttaacttgtccttttgtttagcggatgactgcattcatgtggggacggactctagaacatgccaagaacagatcctccacataggtgccatgctcattcttcactttattttgttaaacttttctttactttaagcacatctgatctctagaccaatttcaacgatctttgctctttggcaagcaggggtcaaaatgtgccggtgcaatagggacatgcactattctttgcatgaaaacagaagctgaaccgccccattgaagaccaatctattccatggataagacacttgcctaaagtgatggtgagtggttcttaaacaataatggataccaagtcgtgttacatgttcactgatagggtaagaagttccagcc

SEQ ID NO: 97667 - DNA, 528 bp, Oryza sativa
catatatcagtatatcagcacaaaggtatagaatgcagctagcagtggttattctactactataccttcatgcatgttgtccaaattattgttttccagttcctgcttgactactactgcgtatatatgtatgtattttgtgatcgatattgaaacaaaaaggaaaaaggaacaagatgttgggcattgttttagatagatcataagttggcctggagagcgatttggaatctatacctttgcataccgtattttcctcttcttgttgacacgaattagttttgtcggtaaagttacagacgcatgagacaaaataatgttaagtacactattacgcttctgtaatagaactgtcagtctatcatctgttcatctgtgagtttgccttggaaaaaaagggctacctgtgagaaaatcaaatcatttgaattatatccaaataccatttccaattttcgatggtatatgcatacttgcatatattctctgtcatccaaaatttggtatatgcatggtacatatgatcag

SEQ ID NO: 97668 - DNA, 1047 bp, Oryza sativa
tgttttaattcaatgactagtccaaagttttttattaatatccctgatatgttacatggatcatgtacatatatctgtaaattctccctttttctgttttggtttgtcctgctttttgttcctttttttttctctctgataattcccacacctaatatgtaatctgtaaacctcatttctattaatgaaatgactataagttagagcctactctaccttcttccgtcaaaaatatgttacatggatacctgccactattttctattgcagaatttgtgtcaatctgaatggaacagtcttaaactctgaaaaacatatttctacgcattattccgattgatttcttgttccatatacattccgatatgggtgggcactgggcagtgcaatcggttgccactgagtactaactcaagtatcgcgtaaaagaaagaggaagtctcctgtctcgtggtctcctccgctccttgcgccgccgccaagacgagtcgcagcgatctccatctggcgagcagagcagggaaggggatcctggtgagcatccacatctctttctgattcatctcgggactacttttgtctggaatttgcttgcgttaacttctcttcttgatctggaagaacctcttctcctccataatttaaacctctcagtttttaaccatagtgaacgtttctttgcttctactgcacccttgcagtagaattcagggggagttttagacctaagctataatagacttccttcctcgattgggttttcaaggaatatgcctttgctttctcctccggttcttgatttcctacctgaagatattatctctctgatcaagactagttcgagcagacaaattgattcagagattgcttcatggctgtgaccttgctcaatcttgaagcaaactaaattcgcaacacatgtgcgattatgatgagctcacaagttgcttctgtttctgacggattaccacaggcacagggtccagctgcaccgaatgactcgccgcgccagcggttctccggcgtcgcgccgccgggggcgctcat

SEQ ID NO: 97669 - DNA, 698 bp, Oryza sativa
  unsure (1)..(698): unsure at all n locations
cctgccnnggtagatgatgctccctcnaangaccnatgaaacttagctcgatgcccgcggtcgctctagagatcctctgttcataagcaagttcaatttttttttttttacccggacctagccctaattcaggtaaaatggaaaaaatccggtgtaaatcaaagaaaataaagcaggagactgtagggtgaacggtcggaaaattctgatcgacctaacatgtttcatataaaaataccattttgacgacccttttgctacattaaattgaatttaaatttttatatattaatatcgtattgagagttactcctccggtttatacaatgacgtttggaaaggttgagtaaactttataactttaacaccaatactttaataatttagttaagaaactgaacacatacataacacatacttcttagtcttcaaaagaagtttttgaaaagctcacggtctcaaaacaaattttgattttgttttataaaatattatttaaagcgtatatgctactttatggaggattttttagaaaatctttcggataattttaccttttaaaacaaatacttggagtatttatgattatattcccagatttgactaaagttgccttaacaacttccttattgtatggggggaacaaaaaattatctttaaaaccctttattaaaggaacatgtcttaatttttctttt

SEQ ID NO: 97670 - DNA, 522 bp, Oryza sativa
cgtactccttccgtctctaaatataagtgattttggttggatgtgacacattctagtacaacgaatctgaacataaagcctgtctaggttcgttgtactaggatatgtcacatccaactaaaatgtcttatatttaaagaccgaaggagtagttttttagcattatcctctaaatcgctaagaatgaatatataaaatttttgtttataaattatattatatgtttccaataaaagttactctctccatttcatattataaattattttgtttttttactagttaactttccaagttatagaaaattttagttgtgtgtcctcaaaacaaatatattgttgaaatatattcaatgctagtgttttagaagctactattttgtatacacttaactaaactgtaaaaatgtttagcaaggaaaaaatattataatatgtaatggaagtagtatgattttttaaacaactctgatccacttttaccatccgggttcatggtccggtgcaaggttttatcatggtt

SEQ ID NO: 97671 - DNA, 1226 bp, Oryza sativa
acacgtgccagggtgtggcccccccgggttttgaggagttcggggctctctggactggactgttgcgggtgtgggcccgcatgccagtgggagagattgtgtaagtcggtgggccatggggcccacggtggtctcgtgctcgcgccgcggttgatcttttcgggatgatccgagccgtccgtgcgtcatccggtggttacaaactgaaagatatccgtcagggcgcaaataaaaaggatattccgcttttcgtcgatctctaatttgttatcccaatgtagtacttgcagtaccaaattaaggcattggttaattcactcgttttctcaacaaacttcgttttattatctaattattttcccaaaacactattatgaacgttcaaaaacacacgtgtccattatctttaaaaaaaacacacgtatatatgcacacatgcacatattactactatgatcactttataaattggacaaacatatcgagtagtacatctaccacttaaataattttctttacgttgtctacttttatttttaggaatagagtacagactcgtatgcttacgttgtcgacgggacgtcacctattatttaaaagaataattactcataagtgcaaacacccgtattaaatttaggatttgaatcttagatctaggtgtgttggtagcgtcataaggaacataacgtatgctcacttatctttatctctacgctgtctattgactaagcacattaacaaataacgtagagtagtaaaatccttataaaaatagaacttaaatatatattgcacgtatatttgtggatgcgctgcgtcaccgcgcaatcctccccgtaaccacccaatccttctcccccatggcaacaacacgccgtgcgcgtcgcgtgcatgcatctgtgcagacaagagcgggccgcctctctcacgttcgcatccgccaacaagctagctcgaccaccaccacttggatgcgcgcgtcgatcgataaaatgcttgcactgccactgcacacatttgcacgggacgggacaaacgcatcgccggtccgttgctgccggccctgttgcgccggcgcgcgactgatcaggcgcaaaccttttttttattttcgatggaatattcaggtgagagcattcgaatctgaactggcatgtcatgtagcttggttgttactccctaggcctaaaacaatggacttcaatcctcttaggatataaagg

SEQ ID NO: 97672 - DNA, 679 bp, Oryza sativa
tctcgtaaagcgtctccctccccagactccagagagtgatgggatttgggggggggggatgattatgctgtacaagagtagtttgatagcaatgttagtggtagaagtgaataatcttgtatataaagcattcataggtggctattcaagtctgcagttatatacccaggcttcctggaaaggtgggggaaactaccaagctgaagtgaagtaggggcacacagaatttccagtgagtgctgaattggatataggaaagaagaccaacgtgaaagcactccatttggccaatactatggttgtgtttagttccacactaaaattggaagtttgaagaaattggaacgatgtgacggaaaagttggaagtttgtgtgtgtaggaaagttcgatgtgacggaaaagttggaagtttgaagaaaaaagttggaatctaaacggggcctattttatattgcatttattatccctctcataaggtattttagttgcgcgtcgctttttgtgatgactttttggggtcttgaggggtccttttggatccctcggttggacatatttcttcttcttcttcttcttcttcttcttctaataaaaaaaataaggcgcagtcctcctgtgtttttgagaaaaataaggtattttagttttgggtatatattctagaattcccacacagt

SEQ ID NO: 97673 - DNA, 554 bp, Oryza sativa
atgtttaattgctatgatgaatctctgttggttgcaggtacaagcaattgtatctttggactggtaccagcagcgaggttttgtgggattcggttcatgtggattttctgcgtcgtaccctctctggtgtcactattatgtgatgccaaggcagggtgtgacattcttccaagagttgttgctccaattgccattgatgcggccattgcaatcatcctccttcctcatcggcaactcggccgatgacacctccacgttgctgcttcgtacgatggcgctcatggtggtagcgtcgtcaacacgccattactgtgctctcctgcccgtgggcctcctcggacctccggggaggctggcgtcgagaagcgttgagcggttgacgacggcggactcgatttggaatcccggatctcctccatgacacgcttgtgggaagagaggaaagagagattgagaggggtgaggaggaagatgaaatgaagagaaagtcgttgacacatgggtcccaccaattgactcggcgagtcatagtcaatctgccatgtcagcggaag

SEQ ID NO: 97674 - DNA, 815 bp, Oryza sativa
  unsure (1)..(815): unsure at all n locations
gtgtgccgctntccaacanttcaatgtattttgttngctctcctctcttttctttacnncctcaacttctcccgctatcacttttcgcgtccccccccccncccggcgggatgagagcgctcgtgatagaacctaactcgnntataccaatgactaggtcccgctagctttgtccatggagagcaggaaacatcgatctcgtaccccgagagcgtgagcgcaattccgcggtaataatagctggtttgggcggataaaaaaatttcaccggtgagcggatgatggaaggtgaagtagactagcacgctaaacgacgaaatgaattgtattttatgattttatctaatctaaacaatgtcttgttcgaacaatcttttactctacctcccaaattaacccttactttactattgtttgttagtatcattttgcaccacaaaaatcaagacaagtggtgctcattgtcggtcaaggtgtcattagagcaccattaatcaagacaagaattctaaactaatctcataggattaagacatgcattgatccaggtgttaaacccttgggcagatttaggatgtcgatgtgccgttctctgaatccttcagacagatctcgatgcaagctgacagaaatgaaaaggcagattctgaagaaggaaattcattagagtaaactagtcatggttggagagtttcacttaaacttgctgaccgatgcaaagcttcaagtcaactttgcaaccaataaagggacatttttcttatgatcttatactaacatgtgtattattgccctgatgacattggatattaagt

SEQ ID NO: 97675 - DNA, 605 bp, Oryza sativa
  unsure (1)..(605): unsure at all n locations
ccggggagggggggggagagaaacatactatcgggccctggggggccgantaaaattaataatataacgggggagcgcgggccccctccccccccccagaggggagtagacgacggtggaacnncncnnnnnnnncnanaaccaaaaaacacancnncnncacccccaaagaggggaaacccagcgattttttttttacaaactaaaccgggggaggggggggggggaaaaaggagggggggggggggggaaaaaagaaaaagagagtgagggggggggcggggcgagcacaagaacggggcgggggggggggcgggggcggaagaaagagaaaagacgggggcgggggggggggtgggggagaggaagagggggggggggtgggggggggggaaagacagggcgggggggggcggaggggggagaagaaaagagggggggggggggggggggggaggaacaaaagagagggggggagggggaggggaggagaaaaaaaagaacggggggcggggggggagggaagagagggaggggggggggggggggagaaaggggggggggggggggggagagggagaggggggggggggggggaggaagaa

SEQ ID NO: 97676 - DNA, 714 bp, Oryza sativa
  unsure (1)..(714): unsure at all n locations
agatgccgnattgaccncncaatgaaaaacgttcgcccanaccccaggaannnnggtccccaaaagaattaataattaaatttaaataagacgaacggtcaaacatttttaaaaaggtcaacgtcgtcaaacattttgggatggagggagtaccacttttaaatatagttacatgataatctctcaaaataagtaggtttttccctgtgcaccagtaataaagatggtgcctgcctctgtgccactaaaaacttatgagcctccctctatgccatcgtcgaactttatcgcgccctccacaacattccgtcgctattctgtttaggtttaaccgtttggtatctctggcatgtgggcccgggcaagaaaaatatcgttcttgccatttcaatcgctggcatcaacgtcgcgcgtgcactccttggatcgttaagccggtgatcgtggccaatgcgagcggcaggtagctttttgacgtgacgagtgacgacacggggcgcacaacgtgtgattgctcacgctctcgggtaccagatcgatgtttcctgctcttcatggacaaagctagcatgaactatttattggtataaacgagttaatataccggaaagcatatgctttaagtacattaatcaaaaatttatatataatttgcaaagtgaagctttgtatgccccgggcattacgttcaatggtggaaaaactaatttttgc

SEQ ID NO: 97677 - DNA, 608 bp, Oryza sativa
  unsure (1)..(608): unsure at all n locations
aatgtggtttncccgaaacgtttgcaagnacnntcantctnttttgacaccaggcatgcggtaccccaagaatggcatacttacaaatctttttttttcatattgcctaataaataataagggagcgcatgtatggattaaccaacatctaaacataatcattttggcaccttacggtcgggactgactattgtttgcataaaactcgtgccatctctatatttttgaacaaatcagcactttgtgtctgatacccccatgaaaaaagtgccaggtacatatccggaatactgctgcttataaaaccctcctcaaagaactgtttaaacttacaaagggatagagattactgattgcacatcactcacacaacatagtgattaacgatgtgtaaattaactgcggtactgaatgactgcatctcaactttgataatgattctaagtccactaaataacttatgaatcccatcccattggctgataaatcatataaacccaaaatctgacttaaaaaactaagccgataagcctatgatgccctaactatggcagcatgacctattttaacataacatagtgagtgtaatcgatttataaagatgtgaa

SEQ ID NO: 97678 - DNA, 613 bp, Oryza sativa
  unsure (1)..(613): unsure at all n locations
aacttgnttnntttnnaattgtaggcatagaaananncactcancatgtgaaaacaagccgccggcacgcttatcttggctggaaccaatgttatgttatttataccaccctcgcacaaaaccaatgacggtgagagcccttcattatggctattatatgatcatgtattacgaaatcatggaccaggggcacatatcaaggatattatgattacagactcaaaatctaatggatgaattaagactgatgaactgcaatattcacaacatatctgcaacggcgtaagatgcacataataaattcacctctctacattcaaatgttaatatggtgaggaaatcataaaaaactatcgctcatgagacactaccaaatatataacattctataaataataaagcatgatcatgacttggaatgattgtattttaccatatgagaaaataaacaagccatcagaatacatttttactaaaatgcatctcacacctatatacatatgaacactgagtaatgggcaaattaacctaacaaacacatatgcaggcaaacaataatgatatactacactcattagcaaacaataggacactgacttctgcgagctattat

SEQ ID NO: 97679 - DNA, 692 bp, Oryza sativa
attcctgcagcccttgtcactatgctaaaaatgcatatatttttgaacggaggaaggagacctattacatatttagatttttcaaatatgttatttctatttatagtctctatttatctcagatttaaatgaaaaggtaaaatgttgggttagaatccaagaagttatcttaatactcatagtttcatgtatatatatactcctttatctttgttacatgtaaaataagttaatttctttttgatcttggtaacaaaagtaataggtgtaacttttgtgaaataagagagtaaaatatataaacctatcataaaaaaagtgatttttgtgtacgtgactctcggtaggttacaaacggacctggccatgtctgcaaaaatcgagcgagcatttttcgtataagggtcattaagaagcccgcatgtaaaaattgatttcgtaggcgaacccctaaggggccgcatgaaaaaataaactctttttttttcatgtggacctcttaaaatgcccgtatatgaaaaatcattatatgaaaaatcatttttatgtatgcgggtctcttaaggatcgatctacaagtctaaatagcctcctccttctcgtcgctgtcctcttcaactgccgccggccccatccacgccaacatcgccgctccacgccgcctgagccacagccccgccggacccgatccg

SEQ ID NO: 97680 - DNA, 674 bp, Oryza sativa
atgctgaaatgatatttgtattatcaaaattaacaattaagctatgtaaattccaagaaaatttcaatgagtgtaattaatatataatttcaaagagtgtaattaatattgcagaaaatttatatgtcattaaattacaattcattaaatagttcaaatcaaagttcagtcaccatatcattatccggtgtaatgcatgggcattttactagtacacacaagaaataataaaatcagaggtgtcagatcgagaattccagatcgacaccgctctatgcctcgccgtccccacagccacagccgaccgtggcacaggcacttcggcctccgtagcaacgccgtgtgcttggcatcctccgtgccacgccgcggcatccatgctgggcccgcgtcttccacgtcgtgatcccgtcctctatgccacgcagctgcacgcatccacagttccacacggtggggctcccactctactccgcctcctcaaccgcgtcgggcttccgtgccgcaacccgcaaggccgtggcccgttctctcttctctctctcccctttttttcctttttttttgcgtttttctcttttttttctgtcttttcgctttttttcttttttttttgcttccccctcccctcacgcgttttcctttttatcctattctttttccgatttttttaa

SEQ ID NO: 97681 - DNA, 585 bp, Oryza sativa
  unsure (1)..(585): unsure at all n locations
taacagcacgcttttaaagatattatgattcccctcgtctatggcgaaatacccttattcgaggcgtttatggcccctgactattacccgtcacccctagtgcatgttttttggggatagaggttcctataggatctctaattcncgacctcttcacgttagccccacatttttacttcttgcctggagaaatcgcctatacctggttgaaagatccagggaatanaaactccatatctcgggttctttagtccactatccaatttagccggttcaccctgcgagtttccccactcccccccacgcccgtttttattgacctgtttcaagggcgcgttcctttgcccattcaggcttttccattttaatttcccctcgtcacttcgggtttaatatccgtttttgaatatccatttttccggttgatttagttcaaccctctttctttccccttataccgaagacccgcctctcttacccaatatcctttgctctttcattcccactccttttcttccacccattttgccaccccctggttaaattttcccggaagacttttttctgactacaatacgttccctt

SEQ ID NO: 97682 - DNA, 582 bp, Oryza sativa
  unsure (1)..(582): unsure at all n locations
catgggacccacccgccagcctcttccttgtgtccatctccctctccgatgcacgcgggcatgacatcatgggcgaccgggtgcttggccaacctgacgcgaggtacttgaggcgcacacacacccaagactcttacacaacaacgaagaacctctcaatgatgagcaggtggcgaccgcgccaccaaggtggaagccctacatgtgcgccacgatgcatgttgacaaatggcagcgaggaggaggaaggcacgttggaagccgtagaacctcatgcgcagcacgatgctctatcctagcgtcacgacaacgccgtcgtcgttggagtaggtccatcccgtcggtgtgtgtcggagggggggatggagagaaggggaaacacagactcctggggatagagtggcgagcgtcatccgcggcgtggagggcctacccctcatcgtcggtggtaggggtgagcagaaaaagactgagatcgagaanattggtcatcaattcgttccttagtagtgaaagacagaatttttgttggtcaaatcgattagtctcatcggttaacccgatagatngaaaagactgaat

SEQ ID NO: 97683 - DNA, 599 bp, Oryza sativa
  unsure (1)..(599): unsure at all n locations
cggagagcgcctacatatttttagaagnagtctctctccccgtgaaatatagtgagagaggattatactnaaggaggacagcacncggtgagagaagtcgccagagaggtttttatcggcgccctctatttattgagagaggtcagcacgncgtgataaaaagagacaaacccttatattcaaacggttgtttagataccgcagtacacaaattgtaagacacattctatacgtacaggagactggtgttattaaacacggggcttattaaataaaatgttgtatttaagagcggcacncgtatagtaggcgcaccctcttaaaagaagtatagatatagacgcgctacataacttcggtttgtgaaattctgtcagccggtgggagacagcaataggtgttagatagtgtttttcccgggtttgaatacgaaccgaatatatccgcataaattagcgcccgtctagagctaacagggtggtttcgtgtccataaaccccagtattgaagagatcgaacttaccgcgcgatttagaggctcaaagaggttccgttattatagaagccccatggtttcccaaatgaaaaaaagtcggata

SEQ ID NO: 97684 - DNA, 773 bp, Oryza sativa
cgggggtcgggggagaatgtgtccgatagaggaatacaacgaagtgggcggtgatgggtgtgattgttgtgagaagcggaaatgtcgctatttatatagaagtgtagtgcgaggggggagggcgaacaagaatgagttgagattgtgggggggggaagaattgtggaagtacgcggaattggtagtgtttttgttggttagagaggcggcggaacgatgaagaattaaggaacgggaaagggggagcacccaaataaaaaatattagggagaagggagggaatgtggggaagaggagggaggagaagaagattgaggaaaggggttttagagactgttgccaattggaagattgaatgaggggggggagtagcgaaagagtaggtgaggtataatatagggggagaaaggggggggatgatgagggaattagagacctgaagtttgtatttttccgcagaaccacgagggtaaggagaggtgtttagagggaaatatgtcggggtgggaggggaaaagggcatttgtttcgcggaaaacgggagaacgggtccaattgggcaagaaggggggggtgatgatggggacaagtttttaagcgacggatatgcgtccccgggggtaaggtttaaggggaggaattttattcgaacatagagaggtgcaatgggcagggggggattcacaatcggtttggcccggggggagtcgaataaatgcgggtggggacggtccggaaacaagagggaaaagggcttggttttttaaagggtg

SEQ ID NO: 97685 - DNA, 616 bp, Oryza sativa
ccgtttcaccatatattcttcaaatgattgatgcggttacttgtagcttcaaatggtctctcacggtccatcatgacaaagccgtcacttgcccttcaccaccggatttggttcttcggcgccaagcccccttgcttgcccttcaccgccgcatggtccatcgcgaccgagcatcgcttgcccttcaccatcttgctataatagccacttcgtatcacacatcttcaatatcttcactttgtcattcttggtattattaggtgtaatgatatcacttgagcatcaacacctttgtaatccttgggacctatttctttcattcaactcaataaaattattagtcccaatgatccggttgtcaacctccacatgttgaccaaccgatcgcatgtataaaaggatatgaataaatgatgagtattaatcaacaccacaagtgtcatatactcaaatatatgttcaaatgtaaagatcccaattaaatgaaggtgaataacttggatcgattacatgcataactaaagtataggatttgctccccctaaatgtatgcatacaaaatatttgtgtgaagcaacgtatatgcataacaagatattaaacattgagagcttat

SEQ ID NO: 97686 - DNA, 700 bp, Oryza sativa
atggtctctccacctaaaggagaaggtacgaacatgccttctcgagctgcggcggtgttctctacaccctgatccaacacttcttcagctgcgacatcaggcgcctcttgctctccatgcttggtccagcaggtatatttcttcatgaatccatcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaggaaaaataaatgatgatcgatatgttgagaatgaatggagaataatgtgttttttaccttgaattttagtaaaaaatcgccccccttgccctcccaaccgatttgtgaacagtacaatggtcgggatggaaagcagttggcagtttgggggtatttatagacccaacacacctcaaacgggttagataaaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtat

SEQ ID NO: 97687 - DNA, 676 bp, Oryza sativa
catgagaggagcctccaaaatactacggtgtttaaactttccgtcagggttgtgacttgtgagttgtggctaacctcctacaattcttccatttcctccttggtttgtatttatgtgcatccactttacagaaacagttaatcaaaccccaactgagagttgagggccatattgtttaccgaccaattaggtatgaaataagaaatcagtaccgatggcaatgttattttttatgaagtttatttgctttattatctattccatgtcatatagaaaagccaggttccactggaagtgctgtttctctgttggcctactatgccttggactaaaacacactaactacaagtctaggttgtctgccagacagaaccttgtatgagtgcacaagatgaaatgcatgatggatattgtaaagaagccatacaccaaccactcctgttatctggttgtgtatcatggaatgtcaccaaatattactagggggttagggaacatgcttgtcatgcaagtgatgtagcagaatagcctttggagaatgcttgctgaacatattaatttgacagaaatgaaggaacaatagttataattgatcaagatttgttctgtcagttggtctcaatctcaattcggtgatactttatacagatatgtggaaatgtctgcatacccttta

SEQ ID NO: 97688 - DNA, 575 bp, Oryza sativa
ttaagtagctgaatctcactgagcagggcctttctcctctcattgctgtcccgggctggagcatccccaatggacagagcctcatccacaatagagtagtagattgatttctttgtcctgacgccctctattactacactgactggtgccgatatcttctcttcagccaccagaagcagcattgccaacacagtaacacgaccctccatggcatatctgtaggccacctccccaacctctctggttttctctgccagagcctcactacattcagatcctacacatggaacaaggtggcatttctgtgtgagaagatgtatggaccagctatgatgagacagcgaatgaacattggtagtaaccatacagaccttttcctgcagagaagacagaagatcctcaatggagttgtccagtgaccatttaacttgagctctggataagaacatcagtcagtacagggaaacagccattgcagggagagaatttgagaagtgagctcagtgatcaccatcacaagcaatggacgacactagctagcgtgcataccttctgctcaagagagcgatctcgag

SEQ ID NO: 97689 - DNA, 579 bp, Oryza sativa
atattcaaacatgaagcaacctgactcatgaaatcatctgttttctttgcttcaccattgttggttgattgtgcatcctcgggtaaattaccggttggctctgcatccttaaaaaaatcaaaatcctctcaccacaataacgcttctccgttttcttcttgcggcggtgcttctctttcatacccgctaaataatatgtacattgagattggcattttctgtaagaataaaagagaaataataaaggaagttcaggaagctcatcaagcaagtagtatggtcacgcttatgttttaaaacaataaagtggttcaaggttgatcatacattgtgagcagttgttttaaggtatcctgtgcgcatgtcacgagaaccttctgaactgccagattccatggagtttcgctggtgatcagtaggggcgcattgctcctccgtattaatcaattcaggatcacgatcgtgttgatctccggtgatttgtttctttttggctcgctcgccctgaaacggatttgaacgttttctttgctctctctccccatcttaaagtactatcaaaagtgggaggcaaaaata

SEQ ID NO: 97690 - DNA, 663 bp, Oryza sativa
ttaactgaaattcgagtgaaaaattgttaggaattcctccatgtttgattcccagccggtgctctgtttcaaaaacctactgtattcaattctgtggactgataaaaggagagaaattcattctgatcttggtgctatctgaacctagacattgcatattttttaactgaaacttgactgaaatcctagcatcagcctatgaactcttccctgtgtttctgccactaacatggacagacttattatgaacagaaaattttcatccgatcttctagactaacctaaaaagttattatcacataaaatcaaccgtgacgacgaggacataagagaaaagaaaaaaaaagaggaggagaaattcttttcttttctgatatggtgactttatttgcaatcttgttcgtgtggttgcagagaatattctgctgatggtggcgcacacagttcagcaatggaaatggaccatatatatacacacacacatgactttattcgtcttctttttttatcatcgttcgtagtatgagtatatttctttcctcctttccatggatctcgactttatgtgcactgttttctcttgtatgctatctgctggctttttcaggatcagagaattcagaatgcccctctcctcaagttctctcctggtggacaggctga

SEQ ID NO: 97691 - DNA, 1241 bp, Oryza sativa
gtctctttatcaaatctcccatcttcctactgttatgggctcatggcgacggcaagggcatgaacacccgcgtcaggtctgaattcgtagcatctccggccataaggcgagggtgcggaggcgtgcctagaagctgcttcgagctccttccatattttgattagctattggtagatacttcctttttcctaaaatttaagggattctatatttttttctaagttaaactaaggatccattctttaattttgttgagaagagtatgaacatctaacataatcaaggaagtaaatcatgaaaatatatatttcaaatggatgtaatgatgctcatttgatactgtaaatattattattattattttcctttattagaaacacggtataaaagtagatgctaacaatacacgtacgctcgtatctatgaacacgcacacgcgcatcctacttctataagcacctccaaaaaactggactgacatatattttgaggttgacaaaatcaccatgggcacctcgttggtgatgagtacgtcgcctaccactaaaaaaataattagtcgtaaatatgagcatccgtgttaactctagaacttaaattcggacgaactggttccgctataagaaacttggctagttgcttagttgtctgaccaaacttgagacaacaacttaggacataaatagaattagaatttttatactttactactccctccgttccattataagtgcagccataagttttcgtgcccaacatttgactatccgtcttatttgataattttatgaaaaaaatttaaaagttaagtcatgcataaagtcctatttatattttatcatctaataacaataaaaatactaatataaaaatatttcaaataagatgaatggtcaaagttggaattaaaacttacaactgtgcttattatgggacggagggagtagaaccaagtgtgtattcactataacaaccacatcccgtgaatcccgtggcaaggtcaacatcgctacatggccgcatagtttgttttcttgccgcacggtttggatgcacggctgcataagaaaggtcagagctgagcaaattaagcttaggacgccagtgacttgtgattaccggtaagcgtgctctgaccgtttccatttcttttcctttcactttgtttttcttttcttatcttacggagcttatttaatggttgtggcgtgaaagaaagtttttactgttagtaattaatg

SEQ ID NO: 97692 - DNA, 644 bp, Oryza sativa
attcctgcagcccaaatgaagatgtttttgccggttatttggtacgttattcgtgtatgagtcggtttttaaattcgttcgcttttagaaatacagatccgtatttgagttgagttttaactttattcgtttttgaaaatacagaaaggctcatataagaaatctctttaaaaaaactcgcatgctaacttgtcataattttctagaaaatatatatccaagcgaattctcacaataaattttacattgaacaataataagattaaaatagccttcactcgttgcaacgcacagacattttttctagtctttgaaatatgtttgatattcattttctaaaaatatttatataaatagacaaatatattaagtatgtttaaagtagctttggttatagctcaagttgcactcttttcactagctaagtaattgtgttgatcaaagtttgataaaataaaattcaaacacaccctatattaaaaaagcagaggtattgtattgccaatatacattaatctatattgccgatggtcttatttttagtacaaatattcaccatacaacaccgccacaatctatattgacttctgttgcgaaatgacggcggtgttgctcccatgttttcccagcctcactttgatttt

SEQ ID NO: 97693 - DNA, 715 bp, Oryza sativa
cttcagagagtcaactgatcctccttgcaagtaaagtaaagatccttagactcgattagaactacttttgcaggtagaactttccagcttccacgcccaaatcattgcaatccttttcacccgcgagaaaagaaaaaagaggaacaaatccatccaatcgcgaagcaaaagatgtctctgacaagattcactacttgaatcaaagctatatttttcacatcagcagaatctacccgccaaaacggcgtcacctgtgcccccaaaaattttcaccttttcccagcctctctctcctctgacgagtgacaaccaaatcaagattctaaagaaaaatttccaaaaaatatttctactcccatgagaaatccccttgactcaatcagactatcaatttactacccaagaacaacaacctcgccaaataaaaaaaataaaaaaccaaagcagaaacagatccctctctctcccaccgagcaaaccaacaaagcaaggaaagaaagctaaccggaaaccgcgtcgccatggaaagcaagatcctccgctcgattccactgcccacgaatccaacccaacccaacccaactcaacccagcgaggaaaccgcgtagaccctaccctccccaaccaccgccaccgacgaacctcacaccggcgcgcggggggagatccaaacacccagagagcacgcgcgcgcgggcggccgcgaactcaccag

SEQ ID NO: 97694 - DNA, 541 bp, Oryza sativa
ttctattttgataaataaattattttccttaatcctttaaagtgacttggggcagatcgagtttgaactcatatttggctgcaatcacacaaacctccatttggactgttggatgtgatatggatggatcagattcttctgggtcatgagaaggtaggcctaatctttatactcttttaaaaggagaagctggatgatggcactctctacacctaccactcaactcaagatcatttggggctgcataaatgtagacataagtgttctttgcaatatccatttcttaggaaacattacattctttgcacatgtgcatatgtaattgattgtgccttatgaaatagtgtatctaatttttagttttaatcaatattattgcttgttttaactctacatcatatagcatatatatttgtatctctcgaaagtcgaaatgcatgggcatggatgcttggaattaatatttccaaccgacaaaggggatacgagtcacccaaactagtctgttcatctcatcgagtggtccacgtggaaagcttcc

SEQ ID NO: 97695 - DNA, 579 bp, Oryza sativa
atctaatttaagtagccagaataccaactagaaccttttaatgtgtcaaatagtcccagaatattaacggttaatgctacactatgtctaatgagatgaataagtattatgatgttaccagaaaacacgtgttaatacttttgtttactttagtatgaagtgagaggcggcatcatatttgtattgagcaggatgttgtacaaacaatataaagctaattaaactaagctaattaaactaggtggacgaaaattcccttgttctgttgctgaatttagacttgtagctcaaatgtactctacagaaagggatgcttcttgaataaaatcgaaacagttagcttatccttatttgtagaaattctctcccctttgctatcagagcaatttaagcgggatcacaatgaacacgtgtcataacagtgcacagatgatgaactccagggcacccagtcatagtaagctcaaacacgggcatcaacaaacaaggaatgggcatgaaactatggcaaactacactaaatccagcatgcatatacagatgcacgcattgtcacaatttgcaagttgcaaccaacaa

SEQ ID NO: 97696 - DNA, 564 bp, Oryza sativa
ttgaagaaattttatgtacgaaaatcatgtaaaattcatatgttcgagaaaaacactatatttgtagcatgtgtaacactccatccgtcctaaaatataaacaattttgtattttttatggtgattaagatggtcttgattggtcaagttaaaaaaagtgcgtgtaagatggttataattggttaagataataagactggtggagaagttatattttaagataaattttagagattaagatggctagttgttgtactttaggataaatttttaaaaatagaaccggttttaccttatcgattacaattattagctattagctagtaggagttattgttacgcgttgagaaccgttatcgacaatttttgaagaaatttgttataggtgcccattgataacaccgggtatcgcgataacgcaaaaaccctgataagaacacataagtctcataagattccaagcatgtatgcactcgcattcacaaatagtgtctgtgttatatccgacgtccttacatgtataaaaaacaggtcaatatccagaggtgacctgtaaatgccgag

SEQ ID NO: 97697 - DNA, 515 bp, Oryza sativa
aaactcagcccatccatgtatacgagcccgtaagttttctactcatgaatgggccacaatttagtagaaaagggccaaaaattcaggcccacaatattctcagatgcggatatgcggcccagctgagcaaccagcctccgcccccctaaaccccaggaggcggcaccgccgcggcggcggcggcggcgctgagctctgctcccctcatcggcgcatccccatccgctctcagatcactgcgcgctcgaagcctgagattttctttagctccttagccgcgtgttgctgctggtgccacgcgtcttgatgtttctgtatgtagccgtagaatcttgatgcgggttgtgtaatgttcgaagatggatctaggagtatggccggatatgatgcgattgtttcgttgtgctttagtttagagaaatggtgtatttgtagacggttgctagtatcagtatgattgagaatgtaaacctttgatatcaagcaacgttatacctactgtggcaatgttcttg

SEQ ID NO: 97698 - DNA, 626 bp, Oryza sativa
aagaaaaggaaaaacaagcaacttacatctatttacatcaacttacatatataattttaaaacttacagtgtaaatacaccgaaattacatatgtaattttgaaacttacagtgtaaatacactaaaattacatatgtaactttgggtacttgcaatgtaaatttattttatgaaaaatataacggtatatatagtcccaaaaatatcaaatcacacctcaaacaattaagttaactatagtgcaacaaaacaacgatgagtaaaaaattccgtacatgtaaaacaaaaattacacccgcatatacttaaaattacattgtaattgtagtgcacttacgttttaatcgtggtataactatgttgtgagtgggtgtagtgtaactgcagtgaaagttttaaaaaaagttacgcatagaaagaaagtagtcgtttgctgcttgctcagttggtacgatgcatgtcgtagcatcccgacatcatgggttcgattccctgttctagcgacattttttttttcactcaatggcacatacacgtatctcaaagtaaatcatacggtcaacaaatcgactgatttttaacagaaaatctgtcgccagatatgtagcaattccgttattttgat

SEQ ID NO: 97699 - DNA, 638 bp, Oryza sativa
gagagagataggagggaaatgtgctaatagtagatgaattgttgtgacatgaccttgtcacatagaattgctagggcacactatatttacatgccaatatatttatattgcattttcctacatctaagtaattagatttctcgtacaattcatacttgggtatgatattctcatggatagttggggatgtcagcaatctatagcttacacggtcccttatgaaagactctattggtcttattgtgctccttgtgagcacatttggatacacattcaaatagattaagataactcgatggaatgtataccctcaaattctttttcgataatgtaatcaatattaccctattatttttctagcatgaaaatctcagatcaatccaaaaccatgtccaactcaatagttatatatcataataatttacaactcgtccactcataaattatatttttttaaagaaccactcaccatcccttccctcctctttttcatatttgtatccaataaacaccttgcccattctcttgctcatccttctgtctgtttgacagattggaccaatttatcactcgtagttgaaaggaacaagagcgatttaatgatatcttatcacttgtaattggacttcaagcctctt

SEQ ID NO: 97700 - DNA, 993 bp, Oryza sativa
tataagattaacaattaagcttggagtaattaatctgagatagtgtagtgccagcttccttggaagagtccctaaatctaatgcttgggggaaacaacattttctcacatggtttcttatagtaaaagagtggccatcaaatatagcttaattggtagagtagtagttgccttgcaaggatcactcaaatatatgtatcccagtatatgaatatcctagggcattgagtaaccctctagataactgaaatttgcaggtgaggaacagtattttttttttctttttgagggtgagagatatgagatatcgttgattttgttttttaaattaatattattgtttttctttgggaaagtgtcgattttccttttatttattgcatagaagcaaagttgtgtcgtttctcctgtagcaacagggaatgttcagtcaaattacccaatcgtttctttcctaatgctatttagtttcccatcaaacagagactgatcagcggtaattagtttggttatcggtcgactagaggttaccacctaaaagactgtattattcaaattttatatttgaaaattttgaacttttacgacttatgactagttaactaccaattattcattaaaaaaattgaatctgaaattttatctggtaaaattcagtaactgtcaggggccagtagcttcggaaacccggtttctgaaacgcttggcctaaacaattaattacagattgtttaatttcagatcaactaatactactactactcacacgatcatctagaacataatcaaacaggtttaaaaatatcttaagcagcacgattaggacgtgcgaggcaaagaacaagggaggggtagttggacgatgtgacggttccggcgacggtcggataagtttccagtgatctaatcatgctgcccaatgcaacagtgccactgaaatggacgtgatcatgctgctgattcgctgctactactactactacctggatttctg

SEQ ID NO: 97701 - DNA, 736 bp, Oryza sativa
acctttttattgtaaccgagactaagttgtcgttgggcatttaaaatatgtataacagacctacctttcgccctttactgttggtccttgttatgctttcgcctacttctcactattcgattggttttttgccatttctgcattatctgccagggtattcgccgaaaactgtgtattcgacccccgtctggaagttggcgaaaccaaaacgagaaatttgtggctttaaaagatttgccgaagatgcgatgcccgtttcggcctgtgtatcgtgaaatgctgataaatggacacagctataaggttttcaaggttgctgggtggcttcggagtcaccctgagcgaaccctggaggattatgatcttgttcattcaagacgtttggacgacatggcttcgcttttggcggaatcatcagaagaccgatcggcaggaagcgatctttcggcgccgttatggcataatttgcgtttcgcccccttctccccttagagtggtgtatgatattagcgacgacgaaccttgttcgcccgatcattctttagccgacaggggagaaaggggacacgagggcgaagatgtaatttatttgtgatctatattgcactgtttgagttgtaatcctcgatacctcccttttttttttgaatcaataaaagtgtgctttacttccttttcgctattctcgcattgtcacttcgcgtgctttcgttgggtcggaacatgtcggtccctt

SEQ ID NO: 97702 - DNA, 567 bp, Oryza sativa
gccggggatgtaaaacatttctgttgtctttaaaaaaaaagataaaagagggatttgaagaattgtatttgaaattctgaattatacataaccaaaattgatatggattcgggattgagtcggtctggtaattgcagatagtccaacattaccaataaatcatgttggctttcaaagttttaacttaaattggtcgacatggagtactagtattgcacttgtttggctgcttgctgaagtttgcggcacttgagttaggagtacaagtgtttttttaaacggaaaacggtacaagagtgcgccttttcattaaatatagaaagaggttaggagtacaagttacgaccatccataacaaatgtttgattcattgctaaaattgaagcatattaacccttaacctcacatgttattatagccaaaacttgccacaaaatctatggtcaccgtctaaatctctatcttcggtcctgccagattagtaccaatactcctactgtgatggcgatgtcatcgtttcgttacgctgacatgcgagcgtacaccgctagtagtacaagtgtaatt

SEQ ID NO: 97703 - DNA, 662 bp, Oryza sativa
aaaggaagaggggcgaaggggaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattatt

SEQ ID NO: 97704 - DNA, 696 bp, Oryza sativa
aatgctcgtctagacgtctactctgtcgatgtgagactgacttgtgatcatctgttaaattgttgatccttgtgggatgtcaatgtgacgattttttgtgatcatctattaaactgtcaatccttgtgggatgtctgctatttctgtgaagtgctcccgaccccaatagatgattgatcggtgttcggtggtgggggttgggaatcatcacccacgcacgaaaaatggagtgatttattagcgcgtggttaattaagtattagctattttttttttaaaaaaattgatcaatatactccatccattccaaattaatctacatatttcataggtataccaagaccaagaaaagctaataactctctcatactatatttactctagcaacaaactcaatgcatgcaccatccccaatatttcctagccaataataaatcaaggtattgtatatgtgttataaatacttgtgtgcatggaatgcatgcatcaatgtccatttactccaatgcacaaataacgaatagactctaataaataaacacaaatgtgtagatcatttaggaataacctcaaaaaaaactatatgtagatcgatggaatggagggagtaatattttaagcaactttcgtatataattttttttgcaaaacacacgacatttagtagtttgaaaagcgtgcgcacgaaaaacgaga

SEQ ID NO: 97705 - DNA, 682 bp, Oryza sativa
ccttaactttcaaaacatttaattaattaacaattagtataatatgtattgaattttatttgctgaaaacaatataattggattatatttcaatatatttttatatgattataatttttttgatacaaagtttatagagaaattataggtactaaaattagtttagtagatcgtgtgccgaatacgtactgtaggtaattagctagctatagctctcctgtatattgatcgatcggctcgtgttcatcattgatgatgattaatgttgcttaattaagatacgtagatgtgaggatatgccgttgaaaaataaaaagagggcgtacgtccattgtacacatggaggtcgaccaatttcaatttaatttgtacgtgcaaattgattgaaattcatccataagcagctatgaccatttcgttcctgaaatttctgcaattcgatagacagatgtactagtactacttggtttatgttgtactccgttttattttcattggatgagttggaacttggttttatttcatatggccgtacaggctagtgatgtacttaagagaagttgctttatatttggaaaaaaaaatcaagggtagtagctagtatgaaatgaatgaagatattttgtaaccaagataaatgaattggcaaaataatctgttcattaattatatagtagtacat

SEQ ID NO: 97706 - DNA, 517 bp, Oryza sativa
ctataactatattgttatctctatataaattacatataaagttgcatatattattttaatacatatatataagttattattattataatatagttctagtgaaattatatactatagttagatttgaaagttttcccctcaaaaaacactcgacagttttttagctagtcccatgttaaaatgacttacattgtgaaacggatggagtaccaaattggtgaccgtgtccctgtgtgtacgtacgtatacgagccgaccaacgcgaacaaaggaacgcatcaacccagcttcaggcaatgcagccaaattaagaccaattcatcagaaagagagaaagaaaaatccagtgatcaccaactcaaactattaactgcccccaaattaaagaaagaaaagcaacaccaccgtctgttgcaatgcaagcaaacgcatcagactttcagagaaaaaaaagaaatgcgccgtaaaggaggtcgcttgattccagtccatgcatacgcgtttttgactcggaaca

SEQ ID NO: 97707 - DNA, 1127 bp, Oryza sativa
tgtacactgctaaaatttgtaatttcaggtaaaatgctttcaaccaaaaattacaatagtttttttctgtaatttttatcagaaatgtattgtaatttgacttgtaaccttgtatccacatataagaaatcatgtaaattagtaaactagttctgaatttaaacaggatataactatatgttccaatttagatctcgtactgctagtatttgattttaaacttagctcatgattctttttttgctgcgaactaatcaaatttctcatcccatttcttattggattttgcaaattgatcaactaaatcggatcaaaattttggtgagtttctaaactaatcagtacagattatacatatcattcatgagttagaaaagacttaagtaaatcaaatatcagaaatactgcgttcacctttattgttcaaattgatgctatccatttgaagtgaatctgaattgttctcctgttctcgtggggctgcaaagctcatcatctgaagaaggtgaagaggccgagaactgacggaggaccggggtggggagggcgccgaaggtgttattgccagcagaggggtcgcgggtagtcaccgccgccaggaaggactcgaggccgacgaatgcagccactgcggcaaaaggcgtgagcaaggaggagacgaggagtaaggggatgaggaagggtggggctcaagccatggccgatggccggcaagcggaggggacctccacccgttgacttcggtattcgtcgccccgatttcttcctccactggctcttccccgctaccaatttgcgccgcgcgccaccgccgataggctctcgggttcaacattactagaggtctccctattccaagtctgcgtggctatcctggttccggcaagggctcaccactacagagccttctttgcgcctctctgcaacagccaccatcaccacccacctctgcggcgatgtgggtggaggagttgatgtgggcggtagaggcggcgttcgcggatggggtcgtggagagaggaggaggacaagcggcttctgagcgaactcgagacaggacgctgcctccggtgggcggcgaggccggctcccgtcccgtgcggctgtgggggaagaacgggcgaggg

SEQ ID NO: 97708 - DNA, 635 bp, Oryza sativa
aatcatctgaaaaagatcaaggaatcgtttccctgtgccaaatgcgcgcgcgtgtgtgacatatcttttacatttgtgtttgtttatatgttaactaaagaggagtagagtgtcaatacgtgaaacatttctggagttttagtccaagaaatgatccctgtttgggacagtgtatcattgtaagcttctatggctgtgcaatgtgtgacgtttcttcaactgaaatatatgaaaatatatgggtttcctgcctgcatctgcttgctctgactgatatagcatactacttactaacccagatttgaagtgcagctgagtttaaccacttactgtcacatggaacaaacgaaaagtgtatcattgtaagcttctatggctgtgcaatgtgtgacgtttcctcaactgaaatatatgaaattatatggctttcctgcctgcatctgctattctgcttgctctgactgataaagcatagtactacttactaacctagatttgaagtgcagctgagtttaaccacttactgtcacatggaacaaacgaaaaataagtatagggagaatagatagggagaaaggagaaaaaaaatataagtaaagggagaaatagatagggataaaggagaaaaaaaaaag

SEQ ID NO: 97709 - DNA, 561 bp, Oryza sativa
atcagccagagtacccagtccgtccaactcttcttggctgtagtccgcgagttcgttaggggctaaaggggcaagtaaagagcttcgcgttccgcgctcggcgttgaacttgtcaagggccttgacaaccttcttgaaattctcataccgatgagccttctcctcctcggttctgtatctccggccgtgctcgctcatccccagtcctcaaattttgccttcatggtcacctcatccaccacattgtcctcctcggcggcatcatcgacgacggcctcctccttgtcggaacacttcttgtcatagagtggtttccccccatggttcatttgggagttgaggtaatcgatgtagtcaagataggcaaatgtgccatctttcctggtgaaccttgccatgacggatggctcgatcacgtccctccaattaacagtcacctcctcctcctccttcctggtctcctccccggctgctacaggtaggaaacaaatgaagctagcaacgacgaggaaccgaatctaatctaatctaatggcgcttctttcaagaacaggcatagat

SEQ ID NO: 97710 - DNA, 728 bp, Oryza sativa
caggacgagaccaaccctgtcaattctctgttgctttccctgtttccatcttctgcatgggccaagaagacctcgagagtgaccagtagagtagtacagtgtagatgtgtgtgtgtgtgtgagtgacccaataattggaggaggctatctcaatcttgcgtgctctcccgaggcgagggaatcagagccattttgtctctggaagacaaggaaaatggccatcacgatcaatcaccagagtttgtgaacgaatggctgcttgcttctcttgctcaagaatactccttttgttaaagggtagtggcatcgtattcctatcatgctatcatatgtactcctttttatcaaaaataaaaataacctagaagtgaatttgatactaactagtacaactaatcatgatatactcgttccgttccaaaaaatatgaatctagaactgatgtgatatattaggacgtggcacatccagtactatgttggttttttatgggacggagagaatactcctattcaaattcattgtatagtgtcaaatttactcataggttgtttgtttttgcgatggagggagtattggtttgactggatgggtcatggaaaactggaaaagcaacagcggtatgcatggcaaaagagggacaaaagaacaagacgaaacataggtaggattgcaggatgctcaagtgagaacttgtagttgtagatgaagtgaagtgacaagccgaa

SEQ ID NO: 97711 - DNA, 1224 bp, Oryza sativa
agttagagatatgattccaccctaaatttaggatattaaataaaccagcttataaatcatataaatcaataagctaacttaaaagactaatcctgaagaaaagaggctttaggtacaattatatagtacccctgaaaaaatcgaattgacttacctcggaattttgcagcggaagaaatgtcaatgtcttatacccaacgccattgcagattgtttgcaccaactttccacgaaagaaatatttgtgtcaatgtcgcacttgatcgtagtaccgacctttttatagacagaggtgcaatatcaaagtacccttttatgtagttcttcgatccttaataacatgtgccgtcgatgctgaccgagtacaaagaaaaacgaatgctcttttcaatctgaacaggggagtatggttttatagaaaaaaatagcaatatctataataccaaattagtttcactaagtttagcattaaatatattttgataatatgtttgttttgtattattatattttcccacatgcttgttaaatataaagaactgattaagaaaataatcaaacaatttataatatggaacaaactgagggagtatcttaatgcaggagcaacaccatgctccatcactgttggcgcatcatattatgctaagttaatcttgagatcggataaggtgctgctctattacatgacgtagctctactcgacagaacaaaccatgctccaaagagattaggagtgcacttagcaatgggctttgagatgatcactctctgacttctcgctcctccggcagtgtacgccctgattggtcgtaagcgctgacgtcgtccagctctcaccaaacaaaatctgtgtgttattttgggtcgcagccgcccatattatggagtatagtcgttaaattgtgccgtactgatcctactctctgatcaggaaaggtcctttttcagaaagaaaatatggagcggaggaccccgttttggcaggttttaaggcgaacagcgcgagaagaaaacaaaagatccagtggtatcaagaatagtatgctggcatgtgcacaaacaccctcaaaataattggttcacatcatcaaaatatttcttttttctggaggaatatcaaatcttccctccttatacaatgtatgcattgttttgtattcatatacatatatgtagtaaagcagtatagtaatttttttcaggtgcaaaaatttgttggat

SEQ ID NO: 97712 - DNA, 596 bp, Oryza sativa
cggtgttatagtataatagaaaatcgaagggaatattatattttagtacggagtgacgccactgggcacttgggcagcggaggcatcatccctgacgaatgaaccatcctcgattcctctctcaagaaagccgccaggaaaagatcgaggaaagaatccaaatctcgtataaaaaagaggaaaaatatttctttttttttctgttcactctccatcacgacctgcggtgacacaagagccctccaaatccaaaacccataaataatgatctgatctctctcgttctcccctcccacgaggtgagagactgagatgtgcccgcgaccgcgagtcgcgtgaggagatgcccacgcctcgtctccgctaccacctcctctccgattgatcccaacaaggcgaggtgagctccagctccccgtgccgttcttgggtttttctccgatcctgggaagatgcgtgttttcatcttctcctggtgatgaagtgttgggttttttttgtttttttggctgcgatctctggggacgaggttggttgtgatttggatgttcttgtcctgtagctcttgtttggcttgggtggctgtggttggtttc

SEQ ID NO: 97713 - DNA, 968 bp, Oryza sativa
cataagagcaataataaaattgtgtacagatcagcgaagaactacatgaaaaatggaagtaattccatttgtttctcttgtgtggtttgtggtttgtgatttgtgtttgtgcatatattttttttccttgagaaatgcttctgtgcataaataagttgatctctttgtatcatagaagttctctctgccctgcaatgtgtatgataaatcataatcaattcgtggttaatgttttatgcattattactagtctgtatttttagttcacattattcctgttcctatcaaagaattctaagttgatcaccaacctcgttttttttgcatagatgacaatttcaattgaaactattaactatgtattgtccatacgcttctgacctcactgtaaacttggagacaacagacaaatcctattttgattaccgcagcatctgggagtaaatcgaaatgaatattcaagtttctttttatttgcattctgagatggttttctaaacctctagcacaggccaatgaaaacttcgtttttagcttaattatcccaatagaaagatgcacatatgtctctggtatttaaccatgtgtagtactagtacatttctagctcatgccatgaacctgattttaggtcggcacaacaacttaattaatcggtctctgcaacgcgtgagacacgattgatgttgatcactgcctccaattgctggccttacatgcaccttaattaaacctgtcttaaggaagtctccaacctctcaatcactgcgtacttatctatcctatcagtgccatctcgatcgttcgttttccttgcacactaatagtactagctctttttctttactttattaactgctaattaaccagtcaacacaatcaacacacagatgtacgtcagagcccagctagctttacatgctccattggaatattacactttgaagagaaatatggtaagaataatt

SEQ ID NO: 97714 - DNA, 910 bp, Oryza sativa
agaaaaggaaaaacaagcaacttacatctatttacatcaacttacatatataattttaaaacttacagtgtaaatacaccgaaattacatatgtaattttgaaacttacagtgtaaatacactaaaattacatatgtaactttgggtacttgcaatgtaaatttattttatgaaaaatataacggtatatatagtcccaaaaatatcaaatcacacctcaaacaattaagttaactatagtgcaacaaaacaacgatgagtaaaaaattccgtacatgtaaaacaaaaattacacccgcatatacttaaaattacattgtaattgtagtgcacttacgttttaatcgtggtataactatgttgtgagtgggtgtagtgtaactgcagtgaaagttttaaaaaaagttacgcatagaaagaaagtagtcgtttgctgcttgctcagttggtacgatgcatgtcgtagcatcccgacatcatgggttcgattccctgttctagcgacattttttttttcactcaatggcacatacacgtatctcaaagtaaatcatacggtcaacaaatcgactgatttttaacagaaaatctgtcgccagatatgtagcaattccgttattttgatgccaaaaaaaccttaccaaattttggctatggcatagttactaaaattttggcagggtttcttatatagttaccaaaatttgatagcaaactaaatatagccactttttgtaactttaccaaaatttagtaaggttaaaaatagcatcaaagtgaacacgcccttcattttaggtccctcaacttgccagcgaaattgatttttatatccttagaccgaaatatcagatacaacgggtcattaactgttaaaaccgtgtaatgtaggtccgacagaagtatgaca

SEQ ID NO: 97715 - DNA, 866 bp, Oryza sativa
aatgatatgatggaaaagttggaagtttgtgtgtataggaaagttttaatgtgatggaaaaattagaagtttgaagaaaaagttatgaactgaacctccattgcgttgtcgaactgtcagtcattgtctcatcaccatgcaatgtcttgttttgcatcacatcacgctattggtttttttgcgtgaatcagcgtaagtcggatacttcaacatgtcaatggctgtggttatatctaaagtttgatccaaacttcagtccttttttatcacatcaacctgtcacacacacaacttttcagtcacatcatctctaatttcaagcaaaatccaaactttggatccaactaaacacagccattaatatgtcattgtcctgtagcagtatacccttcaatgtttcctgattgatcattgcgtaatgcataacaacactgtcaacacatcatgtttagcccataacaacactgtcaacacatcatgtttagcccctttgaatcacaggaatgaaaaaacggagaaataggaaaaacataagattatgataggaatgtaagtgtaaaacaaaggattgcaaaacacaggaaaaacataggaatgaccgtttgattggaccactggaaaaacacaagaatttgaggagagataaagactcaaaggatttctatttgatgaggagagataaagactcaaaggatgaatttgaggagagataaagactcaaaggatttctatttgatgaggagagataaagactcaaaggatttctatttgaggagagataaagactcaaaggatttcttccatgaggttctacctcttgttaaaattcctccaaaacttgtatgggaagaggcattccataggaa

SEQ ID NO: 97716 - DNA, 716 bp, Oryza sativa
aggaggaaggattctggggcagtagttactggaagagaggccagaaatggggaggaggaggaagtgacgagtcctgtaaagaaatcggttcagatgcacaaacctgaacaggctaagaaagcattgttttccattgagaaggagatggttagtgcgggaaagaatcagccccaagggggcgaaataggaggggagatgctgaaaccagctcaacatgacagagtgcaggaaaaagcggacgcccaggggaaatacatggaaaacaacgccatgcagcccatgcacgtcgacggaggggctgctcagggagaggtgccatcgggagtaaaagggccaggaggtagcaaacagaaaactttcaaaagaatgacaagggagactagaggtaagattttgccagcaggctcggggacggtgatcccgggaaagagaagatagatggagggaggggaggaagtttcgggaaagcgaaggaaggagggagagctaaagaatagtgaggaacaaaacccaatggaagcgggacttgcgatccagtcctgcgggaagaaatgaagctagtggcttggaactgtcgggggttgggaaaccgcccggcagttcggggacttctggatcttcagaagtcggaaaagatcgatattcttttcttgtcagaaaaaaaattagacaagagaagaatgcagtgtctgaggtggatgttgggtttggttaat

SEQ ID NO: 97717 - DNA, 557 bp, Oryza sativa
ggctcattttttggcaaaattatgtggtgtgtatgtttcttcacatgttggaacacatatgaatcatttttttttttttttggaattgtaatttatcatctctttagcactctaataccttaacttcctgtagaatatcgagtttgatgacgacgatgatgactggaaccaagaggaggaagcacgtaagtttaaatttgaacttctattcatatcagatctatccttctctcttcctaaaatggactactggtggttttgttaagattactaatgaaagcattctctttttcttctgacagatgaagactactatgattagagccactgtctacaaaagttgtccaatatcaagttttgtttctgttcatttttctctatagtacttgctaggtgattagaggtaaatgttttcctgtcaatatgcggtatcagaaactaggatctgtctgaattctgaaatatggagtaggctgctgctactgttcctattgtactgaagactggcaagaattgatttatatgttctgggatgtgcttcgttcgatattattatt

SEQ ID NO: 97718 - DNA, 571 bp, Oryza sativa
accatatcaacacttttaccttatcttgagggagaacagtagaaccccttattctgcttgtataattctttatgtttgttgttctatgaataatagatgaaaggatgttgcctatcagtgcaggataatcagttaaccaaatctaggaagatatttcctatggttctatagggagcccctttacctgtttttagagatttttgctgttaaatgatgcctatggcgacaaaattcttatttttctcttatgttactagagaattttttttcatgttccgaataacaaagctgaaattgagatttcctagctacagcaattacatgtccagctacatcattctgaatataaatctgacctggaaggatgcgttaatgtgttactgtctgtcatataacttatctgtaactttttctacttcatttccatctgcagttgtgtaaagaaaactacaaatacaatctccatgttaagtagccttgtgttctctaaggagaaaatataatttttcttatgctgtactttatacactaatcttcttgtattttcagctgcttgtggaggctgaaaatt

SEQ ID NO: 97719 - DNA, 615 bp, Oryza sativa
accatgttgatatctcatccctttgcaacgcatggggcctgtgactagtagaagaaaatggataatgtgaagctaaagggcctacatgttggtaacaaatatatgcataaaatgatagtaataatgggttagcgataattttctttaattcaaatcccattgcaacgtacgggcaatatgatatttattgttgtaaactttgatgatttgatgctttatccgttatcactttgattatattaacacatgtgacaataacatatgggaccatccaagtgtgtgacagtgggccaggatatcaaataatcaaaacctcatttttttctctctctctctctctctcacttattaccacccagtgtgttgtcactactatactctcagcttgcagcttgaagttgtgagtgctattagccaatagggtcatcaacttttgaggttctgggaggtgatcatttttgctatgctggattagatcaagtggagtaatatttcatctactctcacttttttttccctgctttggttcatatctaatcttctcttctcatttccgctccgttttccgtacttacacgctgggaatgtccgattccgaacacagccttaaagttc

SEQ ID NO: 97720 - DNA, 591 bp, Oryza sativa
atatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagtcaaagatttgaaggtttga

SEQ ID NO: 97721 - DNA, 700 bp, Oryza sativa
attcctgcagcccttagtcgtttagtttcttttttccagatggaaatttggatatggtcttctcctatgtatccttgtgctgattttttattgggtggattagagtttgattcctttcagtttcgtgtttaactcgggaaatttagaatttggaaactacctagatacgggctacatgcgcgaggctgagatgacgcaccgtgatggatggagttgggaagcgcgttttgtgcaaccggttgcaaacccaactcatatctacaccgttcaatgttcattgagattcgtgcggagaatcttaatcttaactaattaaaagattattagtaattttaccagatagttaaatgcccgtgcttcggtacggtgtattaaaactaaaaatatttaagttcaaaaaaaaactaaaaatatttgtttttaaccaaagttatttttaaccgaagtctccaatgacagagagtaatatagtagctcataataaattattatttaatagtgcgttgcaatgggaaaaaaatactgttatgataatgattacagttattttatagttccatgggagttataagatatagttctagacataaacaataccccttctctcccaacgtaagcgacagtagctgcgccttttcccaccgcaggtcgtaaaataatatgatatggttggatttaatttttattaaattaaccatga

SEQ ID NO: 97722 - DNA, 726 bp, Oryza sativa
ttttttttaaaaatatatgatctaattcgttggctaatttgattgtttttggtttatattttaaatctacgtgtttgtgaattgtggttgaatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagccaaagatttgaaggtttgactttactctgcttcaaaatgataagtattaccaattcgaatggagtatagtacatt

SEQ ID NO: 97723 - DNA, 761 bp, Oryza sativa
ccaccgcggcgggggccgctctataactagtggagtcccccacacacgctctggaacatataattcccccactatacacaaaaaagtgctccctttcttttacactattgcgcttatagcgcgtcacgcggatcacactaattctctttaaaaagggtggaattaaaaaaaacttatgccttttaagccaaaaaaaacttttggtatacctaatcttttttaatttttattaatttttgccttaaaaaccagaataaattatttccactttgtatatcacaaaactatatatttaaaaatttgtatcacaaaaattatggatttaacataattttcatttacaaaataatagatttgtattagaaaatcacatagatttaacatcagttttatcacaaactaaacttctgctatggatataaactataaaatgtatagttcttaatatcctcataatctgtagatgccttaaatatgcagatatgtgataaatttgacactaaatatgtagttttggttaaaaaaaacgcatatttgttttgtgatagtttggtcaaatcatcgttttataaagtttactctaaaaacaaacattagaaattaaaagtcagaatacccgatatttttttgtaaattcgtgcctatatatcgttcacacaaatatgcatatatggattagaccggcctgctctccccgttacacgtctctatctcaataaacggctggatatatatagatgtaaaattaccagtggagtatg

SEQ ID NO: 97724 - DNA, 610 bp, Oryza sativa
tagagagagaaacacacttgttcttcatctacccttctcctctctctctctctcatctggttctagctagtactagctgctgcatcttctactgctgttcttagaagaagaagaagaagaagaagaagaagaagaagaagaagaaagaagctgctcctactaggctactagctaagctaggcttaggcatgtgcgtgcgtgcgtttgatgctactctgtggcagagcagacgatgatccgccatgtccggatgccgcccacgctgacgcccacgacatgctcggctcatcaccagctcgcgatcgaggcggcggcgacgacgccgaggcctccgagcagccgcagccgcagccgcagccgccattgtcgccgcgcgcggggggcggcgaggcgagggggctcgtgctcgcgtgcgccgacctcgtccaccggggggacctcgacggggcgcgccgcgtcgccgaggccgtgctcgccgccgccgacccacgcggcgaggctggcgaccgcctcgcccaccacttcggccgcgcgctcctcgctctccgcggaggaggcaagggtggtcatggcggcgtcgtcggtggcgtggtgccgtcgtcggcggcgt

SEQ ID NO: 97725 - DNA, 565 bp, Oryza sativa
  unsure (1)..(565): unsure at all n locations
ttcctgcagccctgactgttgtgtaattgagccactgacacatggaaagagactcacatgtcagcatatgtactttctgcttgtctttttcttaaccaacgcttgtaagatcttgtattgtactccctccgtcccataatataagtgattttgacnnttgactgctctgtaacacaatggtcacaacaatgactggtcgctcaattatggcaaagtctgtgtgcttatgagtttactgctagcatacaagtccaaccatcatacgtaattagatgcgaccaaccattcatttttgacggccaccaataacacagataaccttaaatcgaagtcaagaagtgaccccagcatacggtaccatccatagcatccaataaggatcagcagctgagatcttcctttgcactatatatctagagctgcacgactttttactgtggagcatttgtcatagctctagtggaggacatcacatatgatttgttggttgtgacagaagatgaaccggagcatcagctgctacatgagggatatatggcggagaacagccgtcttgtttatatcg

SEQ ID NO: 97726 - DNA, 653 bp, Oryza sativa
  unsure (1)..(653): unsure at all n locations
gcgcccgccgccgccgccgcngtcgtgctctctttcctcgcctactgcctgcattgatgacgaggagagagagagtgagagagagggtgtctcacgtgggagaaggcggcgcggctggtttatttgtgtttttttttaaaaatatatgatctaattcgttggctaatttgattgtttttggtttatattttaaatctacgtgtttgtgaattgtggttgatatatatatatatatatatatatatatatatatatatatatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttg

SEQ ID NO: 97727 - DNA, 690 bp, Oryza sativa
ggatgaacctgatgtctttctatttatgcatgcatgtgttcatttcgtaacaatcagttcaagaaatgctaattcacggcaagtactaaggattcctatttactgctattatgattttaatgcaacagaaaacaagctgttgcaacaattacctgttatgctatggtacgactctcataacaataggcagttttattacctagattttaattattatgtatagaccaatgatctcaagcaactagaccagctgctagcaaatgtatgatgccaaaaacatgcagataaggctgaaacacaacagggcatcatagattcatttagttatagagtggtacatgcccatcacaagtttgtctagaagacgatcgacttagttcaaaactgcgaatacagtcaattagaagatatatattgaagaaaggacgcatgcatatgcatggaagaactcctgaagatcataaatagagcagttcaattaaatcatattgaatgctaaagagaagaaaaactgaacaggccatatacaaatactcgttgcatgtggatcagtagaagaaatttaacaaagtatatgtatggttaatagaacttcagtagaagattaattgtccatgatcactcgtatgcatacagcttaacagagtgctaagaagtttgaaaaatcatctgtgtaactagctagccata

SEQ ID NO: 97728 - DNA, 707 bp, Oryza sativa
cctttgcctatctcatctgcaaaaatacctgaatacgagttatggttaaggaattccaatgattaacgtggagtgggggaggttcccattagcgcatcgaccagcatttttgttaacttgccgagatatttgcatcaacatccaacggcaataagcacttatttggtcgcacgcccttgtgtttgctaatgagaaaaaacttggcatttgccttggtcctgaagatgtaaatactgttgatgcaaatacttctgtaaggcttatatgacatctagttattttccggacgtgaacgcatcatatccttttttttttacagaacatcaatttatatactccctccgttttttaatagatgacgccgttgactttttctcacatgtttgaccattcgtcttattcaaaaaatttatgtaattataatttattttgctatgagttattttatcactcatagtattttaagtgtgatttatatcttatacatctacataaaatttttaaataagacgaatggttaaacatgtaagaaaaggtcaacagcgtcatctatttaaaaaacggttatctaaggtagtataaatcagtgacatcagaattatgctgatgaggtgagatgcaggttgctacacacaagtagtctggtgaggtgttagtactgcatcgtcgtccgttgacaatttcttgctgctcttctttttttaaaa

SEQ ID NO: 97729 - DNA, 581 bp, Oryza sativa
cgatgatatgacttatcatcatcatgtcttccgccaaggaaatgacatggttgcaagctgcggcaatgcggcattcctttccgagctgcacggagacggcatccgactgattggctaaccatttcttctgttctaatgctaacaatgtctgagtattgtacattaactatttgagtccgctgtcagccgatgttaaacctttcatctcagaagataataatttatagatgttttgattgactagcatatcaaaggtaatagacaatattagcgccgttgattttcttcggtgctgcgttactttcgtaactgcgtagtgcttactactccaaatttccagtaagctcggggctcgtttcctaactcatcgatctcgttttgcacgcgcacgttttttaaactgctaaatatttttcaaaatgttaaatggtgctttttttttgcaaaaaatttctatatgaaagttgcttaaaaaaatcatatggatctttttttttaaaaaaaattagctaatacttaattaattacgcgctaatagactgttccgtttttcgtgcatgaaacttgctctagcgaacaca

SEQ ID NO: 97730 - DNA, 622 bp, Oryza sativa
atcagcagtactctggaataacagaaacctggtgtgagaacagcacatattgaagtatttccagaacactagcaaagttagcttggggattaaaattactaaacatatatgtcacagagaagaaacaagtaataatatgtcaggccataaatattacagtaccaaaagaatacctgggcaatcaaatgagcaaggagggaaaatcttgtgttaacgctgtttttcttgtaatcatcgattatccgtctaattgctaatttgtgcaacaagattttctcatcgtcacttaattccagatgagatggaagaactggcaaatcatgattagtagtatcctccagcgttgatgccttcaaaactggggaaaatggatcaacctccaattccacgctatccaattcattgtttgaagtagcttctggagacaatggattgaccatctctttatcaacaccagaagaatgaaatccaacatctgctaatgcctgcacttcaaatttcggctccagttccaaggcatcatccaaaatctcactattttcctttgggagtgattgattgggttgacaagatgtttgctgcacgtcttcatttttagataggtctcctgaatagtctaaag

SEQ ID NO: 97731 - DNA, 542 bp, Oryza sativa
aatccttcttcagagactgaaagtagcacagcatcttgatttactgttggatgccgcacgccgcgtggtcacttggccaaatatgcatggttaggcaagctgtccagtctcagattccttagccttagatgtgatcttttagctcagagtgtacaatctgctggctggatgcctggattgttaccagcaacatttgtagcatcaagtccttgatgtctcttgatagtatttcagaaatttgcctagcaattgtacagaactatggctactgatgatgattagtaccgaaaaataatttcacagggaggatctccggctgtgcacggaactatggctactccagtttctagtccgttcaaacttcaaaattgtattactgcatatgattggtcagcagtcaaatatattcgacttatatgactagctagttagctatttgtccactatctatcaaggtcttgattagcaacaagttaacaactcacaactgggaaagagaaaaggttgcatgctaatttccatatggaccagcgaaggaaaaa

SEQ ID NO: 97732 - DNA, 520 bp, Oryza sativa
gcaagcaaaaactgaaaatcccttatattgtgggacggagggagtagtgcccattttcttttgtattttccaagatgttagttattaaaaactgaaattgtactgtcaatactcaaccacctataatgaaaactagaggatgccaggaatccatggaattacctttaactgaaaacattctatgtgactatatcaatgaatacaggataatgatagctgaaacaactaagtagactatgcatttgccatcatggttgaagagttcttttctttaattaaggttttgcatgtttctattccctgttactgttctgacaaaattttaaaatagaataattcttgctggattttatctcttcatatttttttcctcgataatatatttattgctcctcctatcaagtgctctgtgatgtgtaacacaccttcatgtacttcaattaccactacagacccaagaataccagccagagataactcctgtgaaagctcaaggttcaaatgaggagaccaatggcgg

SEQ ID NO: 97733 - DNA, 975 bp, Oryza sativa
aatgaaggtattgtcgttgtataaaaaacatgtatgctttttatgttagatctctcttatatgagaccgaatagatgatgtcttacgaccttgattatgtgctctcgtattaagaaaacttttctgacagaagattcccactaatagtatctttcattagattaattgtgatgatcaggaacccccacattaatttggtaaccttaactaggcagacatgcagatattgttgatttccatcatacacacatttgcaattcatggtttataagtcatttaatttagcaatactttcacaacaagaactatatatttagattataaattctataagcaaaacttcaaccaaggtctctcagtatatatatcattgcaaaaatataatcacaattgaaactggatggcagttacattgtattgatcaaatacaatcaatatgagttgtgtaagaatctacaggaccattcccaagcgagactgaaattttgagacaataaataaaaccttatgtatgatgtatagatgtatacctaactgatcttgtggtccattgcatcacaacaatatatatgtgtatggctttgcaaagtacatcaaaggcacccaaataaaagatcctgtcatgctcatgcctccactccagtctaaaaaagaaagggacaaaacaaaagttaagtgcaaccaattaaagtatatgaacccctaagcttttttttaacaaagcatttgcccactaattaaactagtggcacatctcccagagatggataacctaagctttgtcaaacattgatggggtggtgtgcatgacatctctaacacaccccaaacaaagcagcagattgattaattagttgcgtactaattaaactgcacaagagtacagctgttgtacaggtaggtgtttgatcacaagaacagagccaagttccttttttttaaatctgctcatagatgaattaaaggaatctcgca

SEQ ID NO: 97734 - DNA, 697 bp, Oryza sativa
aacggatgaccattttaggctgcacaaaatttcctaaggactacaactacgaaggcttgcagagctgtaggaaccttaattctgtggaactgactattttctatttcttctgaatcaggtgtcatgttgaacaaatgtttctacacccattgctgttaacactacatgtctagccacaactctgtaaataggactgaacaagtgccttgactagttagatctaacattctagctttaaggctagctagagctatagtttggctttacaacgttctataagcaccttagcatgctacagtttggctttactgatatgtaagcatatcagtaaactggatgataaaacagacaaaaacaaaaaattaacattgatatcgttgttattatacaactttgttggctatgctcctgccacatgccatattgagaactccggagatgtaaaacactccaacaaaagaaggccaactatcaaccaaagacacataattgaatctgagtctagaattgagaaaatcttgctttgccattctcattttataagacctggataagtgataagatgatcattgatcatcttaacaaacagaagaagaaatagctggatgtatacaatcaagatacttacatattggctgatgagaacaattgcaatgtcctcccttgtagtgaattccttaaatgcatcttcgatttg

SEQ ID NO: 97735 - DNA, 1079 bp, Oryza sativa
caaatacgcaagggaattttacatgcagatgtaccctccgtcccaaaaaaaaatccaatcctagctacgaacctggacatatgcgtgtccaggttcatagccagagtttggttttttgggacagattagtaagaaggaaaacatattttgctataattaatttttgtccctcaaggtgatttccacttattttatgcatgttgcctaaaatgttcatattttttttaaaaaaatatactccctccgtttttaaatatttgacgtcgttgacttttttaaatatgtttgaccgttcgtcttatttaattattcattatttttcctatcatttgattcattgttaaatatacttatatgtatgcatatagttttacatatttcacaaaagttacttttaataagttgaacggtcaaatatgtgctaaaaagtcgacagtgtcaaatatttaaaaaggtgggagtaatatacatcaatatgtgatatatcattacacaaacataagttaaaatttgacctatacaattttaaaaaataaaaataataaatttgactatgatataattacatgttatgttcagagtcattttttagatatagaagaactgagggtccgtttcatttctagagggacgaatagacttccctattagaggtgcaacctcaacattttgtactcctacgcattaaggttttaagaaattttataccaatgagctgaaagtatgcgagttccaggcgagtttgatccaagccacgagccaagagctttttttcatctctagcttaatggggccaatcttacacccagggtttctcaaaccgccgggaccagggttaccacacctcggcggtaagcacggttgccacgtggtaaccgtggcgaaccatacgaaaccatgtaaaatttattaaaattttaaaatattttttaaatttatttgaatttaaggtggttaccgtggtttttcttttaccgtgttccgtggtaagcacagtgaccgcgcggttacccagttttgcaaacacggcttacacctactgctagctggcgtgttggagttggactcttgtttcacgg

SEQ ID NO: 97736 - DNA, 544 bp, Oryza sativa
tatgagttaattgctttgccacaccaccaattacgatgatccttttgaccttacatattgtatagatgcaatatttgaagcggctatatgtacattacatctttatatggacctatttatcgcttaagatagataatctccaataggggaactgaagcaatctgtacgttagttcagaaccctttcctggttttttttggcctctacctgtaaaatggtaccgactattccttgctccatgtcatttcatatgttctggcaaaaaatgagatgcaaatgaaatgctgactaagataattactcgatgtagtttcatgtgtttaaaagctggtcggattaactttgatattgttttaagtgatgatttttacatttccttatgttatgcacttgtacacagtgtactgaactttttatttaattatatatgcttcataattagctttaatttcaaaggtgcccccaaacagtgtatagtacttgctaacatgtaatatcatccttgcagttttttaattatgtgctattaaaatttcaagaccgg

SEQ ID NO: 97737 - DNA, 706 bp, Oryza sativa
ctgccttttacccaaccagcatgcatgaagtacagctacagaaagctttacgatccttccactcaatggttaaaggaccggctgtccaagtattctccaagaagctaaaagatgaatgccaagcaatatgggaatctggaaggcagcaatgcgatgctgtcagtcttactggcagaccatgtaagcaccagagacacggtaaatcctctccatcagatgcagcgttacagcattctagtggatatgttttcctccatgcatgtgcctgtggccggtcacgccgtcttagggatgacccttttgattttgaggcagcgaacatgacctttaactgcttctctaattgtgaagatctgttacctactcttgtgcttccaagagagaccaatgctggtgcatttccagtatcctcttggcgtttggtgcggcttggaggagcaagatattacaaaccaacaaaaggattgctccaagcaggtttttgctccaaggaaaaatatcttttaaggtggtcgatttctcttgggaaaggacaagggaaacatggcactcatgctaccaataaacctttctccacggcatctaatgcagatcctcaggctccccctattgttgctggagaagtaaaatcggccgtgacccaagtcacagcagaaattaaatctatgaaacttgaaaattctagaaaacaacctgaagtcgagtc

SEQ ID NO: 97738 - DNA, 995 bp, Oryza sativa
agggggggcagtgtgacgtgtccgtgtaaaatgtgaaacgggtggccagcctgcacgccaaatttcgccgcgtgattggttgggtcatcgaccaagcagatcaaacagcagctgctgacagtgttactactagtagacatgagtgaattaattagtgggcatgcgtccgtgcgtgcgccctgctcagttctacgtaactgcgtagagattacgtatagaatagtgatgtttcgtccagcagagtgagtggacttgtaggggttaagcgcagcagttaaccataaacatgcgagttggcaggagtttggcagggctagttaaaaactcaaaagagccattaacaaatgtactggcatgacggatctgtcaggagatctctcggcacacggtatatggggaggtggatggagtttgttcgtaccggcatgaggccagttgctgcagacagtttgattcttgtgaccccatgaacttgaataataaactgtgtgcgtatcagcgaagagctagtatatctattgaaatactatgaaatgatgtgcgtggatactctgatatccagctggtgtgtacgtctttgtcccgaccaacaacccaaatattttcgtgttgctgtcctctcgattcagttttcatgcatacatatattcagctcaacgaacgttaacacgtaacaccacagcaagaacacacgtcagatcatatccttgacaatctccctcttgacgtacaatgcatgcattccagaacttttttcaagcagatcgatggaaaaatccgtccgtacataaattagagtcttggatcgattagtcaaaccgttgagcttgaggtcacaggagagccacacgtaccgcatgccacgcacctgccgatcgatcgagccgcacgcaacgcaggcacgggggctcgcgcgatccgcaaagtcgcgatcgatcgatggtggccgcgcgcgcgcggttaggtacgccgtgagccggcgaaacggccggagc

SEQ ID NO: 97739 - DNA, 919 bp, Oryza sativa
tgatgtccagaaggtgaagcaaggtaatttctcaagtgatgctttggacataaacatgtcaagctgtcaactcttcttagttgagaggcagtacctgacatttaactcaagaagaagagaagcaatttgtattagagaactacaaaacctgctgaatttctgggctatggtacattcatgttctcgtaccaaggtttgcagtcactttacttagaacttacctctactaaaatctgcttcacttactagaagaagtcgtttcgctgactggccgaaccgtgcttgtcggggtttgagtggcactattttcttagagatagtaacagctatgcatgaactcatacaattgacgcccccatgtgccgtagtgtattgatgcctgtgcagttggccttcccgtatgtgtgtactcgaactgttaagtggatagtaaaatgcacagcttcagggtaaataggtgtaaaaaatagtgtgtgacagacttgacaatgctagtgctattgtggtacccagcatacttgctagaaaagggtgtgtttagttcacgccaaaattagaagtttggttgaaattaaaacgatgtgatggaaacgttgaaagtttatgtgtgtaggaaagttttgatgtgatggaaaagttggaagtttgaagaaaaaatttgtaactaaacaaggccttaggaaaatggataatcattcgtcatgatcatatacgtcagatttgcaatttttattgtagcttgctgacgcaggatttgccggccagagcagtgaaaggcacctccaggtccggactccagatgagagctacctcgaaagataatgcctatccagcaggcttcgcagaagggtccatgcgaaggaatttccctaatccagacactttaggtaaccggtcacatcaaactcaaaaactacat

SEQ ID NO: 97740 - DNA, 692 bp, Oryza sativa
ttcctgcagccccgccgcgtctgccagatccgccgccaacaccgccttgcccgggtcatcgccaaggcaacctgtcgtccacccccccgccacggaggatgccgaggtgctgtcggccacggccgcctcatccggcgccgcatccacagacggagccgaggccgcggacgaggaggacgagcggcgagtgcggcggagtgggaagagaagcggagctggcgccggacggggaggacaagcggcgggtacggcggtgcgatgagaggagccggaggggatggaatggataggatcgaatgggcggagtgggaggggaagggtaggtggaggaaattatttcttccactcgcccatgctaaccgcacccaggtcacgcgcactgtaggagtagttgccttgtatagcgtctccatccaattaaggccctgtttgtttcagcttttgattcttataatttagattattaagccagattactataagttggattataataagctggcatagaataagttgtgagttgtttgtttgtctggattattgaaggcatagattattgggtctgaaaggctaaagtctataatgccctcagctatctgttcagttaatgatataggtgggtaatttttctcaagtatgtagaggtagtgggtctttagccactcaataatctgaaaaaagctcctctagag

SEQ ID NO: 97741 - DNA, 764 bp, Oryza sativa
ggagactgtcgtcctcttcagagcccacactatcggcgacactcactgctcctccttccttgagctcgtagccacctccttagctctatcgttgctcatcctggatctggtgagctcgatgctggagggacgtcgtggtggtgcttgcagtagcggctagcagcacacgagcatgtgacctcaaggatgtcactggctgtaccgtttgtactcgtggcctactattgccttcttgactaccccactacctttactatccaccaccctctttcattttatggctttggtggtgccatcaacatgtcaccactctcggctctcctatagcctccatcacttggcttttctaaacccactacctccctccctagcctgatctaaatccctaaccagagtcgtcgctttgtctttactatcggagggtcacgtgagttggtcgagttgtctgagttaattaaaggagccggcctagtgtatgaatcataagttaaatcgatggttcaaaatttgtaagattttttctctaatttcctattagataccagctagaaatgcaatataaatgtcgaagaattttgagtagtatttgtatttccgtcgaaagtgatttacaaacggatacgggatacgactggcattagaccaacaaaaattgattcagaatcagatggtcacagtcgcgggctcacatggcaaattaaagggcccgtcatggtcaccatcttgatttcttgacacagaagacgggggcaagaacgaattaa

SEQ ID NO: 97742 - DNA, 596 bp, Oryza sativa
ttcctgcaccccagaaaattaatgatctaaagaattaagagtaatagcatctgaagaaagcgcaacagtttcaataaaatgatgaagggacgcatcaagtaagataattgctcgttaaactaaaagtaagaagtaagaacattaaatattccctgccaaaaaaggaagcaacattaactgacacgggaacccctaaaatttttacactaataaaggcagacccatcattttagatcaattcttatgtttgaaactaagaactatactaataagtctaacagttttgcaactaaaacttacaataaagttgatgcgatatgatactgattgcaggaaaaaaaatgattgttggtgaccatttacttgtgacagaaagaactgaaaagggggaagttctcttgtgacaagtacagaggcaaaagaaaatcatgcagcaaatgcatcaccttctcatagaaaattcggaacgaccaccatacagtagtgcacgtcctgcaaaggattacggcagcaacaaattactcacatatggaagtctttttttttctgcgaataacatgttctgtgaaaattagaggcttactttggcggcctga

SEQ ID NO: 97743 - DNA, 573 bp, Oryza sativa
cccaagaaatcagttgattaaatatgccatgctgactttattctcctgttcatatgaaatagtacagatttggttgcatcatttatggtgacttcctaaaggtatgactccacaggcttagttaaactgagacaattcagttgtgttcacaagggaaattgttgcctcttattattatataaatcaaccagttgcacattactagttggttctttgctcagtttaaatggactctgaataaataagtacaactgattcatgttctgtgaggattactgatcagtcttcctgatatttcagtaaaatgtactgaaagtgtacaagcaggactataccaggtattcggtagaactaattttaactcggtggagtgtacatctccaccagaccaccaccttggttcgagttgtttaatactttgatccaatttgtgtgctttttatctgttttgttaataagaaatgtagttttcctacatgttttaattttcatctttgttccaattatttacttaaaaaatcaataattcaaattattgctgatgttgcttaccaatctccccagtattaatta

SEQ ID NO: 97744 - DNA, 672 bp, Oryza sativa
ttcctgcagccctgcgcgaattgcgtatgggtttggggggcaatcggtccagcccggtctaagtttcgcccgagattgcgaaagatcaacagtccaaccggcgaccggtcgattgcttgcgcagcgcgctcggagcaactttgggttgggtccagattagagaaacactttcgatcattccatcgatcggcgacgtgcaaccaacctcgcatgcacgtcgcaggtccatctctccctaaagcgaccgcacagggaagggacatttgttcttttgctatgcggcatttaatgtccgactaagacttccaggactccaggtgataagtgtaaatcagttaattagtgtcccattggattggctatcatcgactatagattcgtttaattagagcaagtttaatataatagcccactactagctccaatttatttatagccaattaatacaatagttgcttactgtactattaatatatggtcccacctatcatacatacattacgtcttggagtccgtgctgcagctggctacagatatgtagtccgctgctcttctctctcatcttttatctcattaaaatatgtttatagctggctaatagcctgctattgtacctgctattaggtgtaatgaaacttcttgtttgatttttcaaaaggaaaatactagtaa

SEQ ID NO: 97745 - DNA, 676 bp, Oryza sativa
tttcattatgtatctagcatagttgattagatatactaactaccttttgggcatgttgaatgcgtgctctgtttccaagctaggattgggtgtattagtcctaaaaaaagttaggtgtatttgaggccggttaatgcttccaaagtaccatgtaggttcatatgtttgactaataagtagctggtagttaatcatggaatttgttgaactgggataagtgactttcaagctattctgggattttcatagttaaggcattccaaatattgttaggaataaaaaaaagtgctacttcccatttagtatagaagagtgcatttcaatttctacactacaaagtacggactgtatttttgcaaaaaaatcaaaaacagaagtatggtcagtacatcactctgtcactcctgtgatgtgagttaactttgttaagcgtttacatgctaactgatgttgcagcaagtatttttactagagtgcaagttacattttcatgtggttagagggcacatgcaaaattctccatgctcaaacttcaataattggtcatgtttcgccattctcccttcttgatcctgtcagagatggagtttgaacttattattgcataaaagaatgaattggaataaacagagactgggttcactttccctgcgtgctgtgaacatgtgttccggat

SEQ ID NO: 97746 - DNA, 646 bp, Oryza sativa
taagagctttttcctcagagcaggttagtactttttagttattctgcttgtgagttgtgaatgctagtagtactagcagcttgttgcaccttgcgaattgcgatcttcttgagctcgcagcttgtgggtagtgcagctagatagagaggacagaagtagcaacagttgcagacaaaaaacctagcaattgaatcactgcaatcctactgctcctattgtttctactcatctcatcatatacaagagtggctgtagtatatacgtagtaggagtagtagtctgtagattccattcctcatcaatgaggagcctgtgtctgcagagcttgaggaaagaattcatccaacttctgtaaagtatcagtgctacatactctgaagtctgaacttgctagtagtatgttctttctccaaaacatgatgctttccacagtaggagtagaaggcaaatgtctttgttgtgttaaaaatagtagtattagcatacgaacaattcgatgaaatcatgacatatggatcgtacctactcgacaataccaaggcaacaatgacagtcttactaaaatgattgctcatcttgagtcttctggtcaagaagtcgcaatagtgggctgcattatatagtggaccacatgaacaaaaccgtc

SEQ ID NO: 97747 - DNA, 626 bp, Oryza sativa
ttcctgcagcccgtggccatggggagagaaaggccatcaaggcatcaacctcttctagatagtaaatgggctgaaaatgcaaggacatcagatccgtgtatcgcacgcgataggatttagcccatcaaagtaatccttatccgcaggaataagttcaacagccgtccctcaacttcgcgtcgggttatctatagccctcaactatcacaaaccgtgcaaaaaaaaaaaagtcccgagcagtatcgatccaattcttcttcggtttcgctaacgtggaatatatgggccccatatgtaagtgagaaggaaatatgtggggtccgcatctcttttctcttcttttgtctttcttctcctttcttctcttcttgggcgaggctggagactggtgcatagcggtcaggggcggcgagcgagctgccaccgtgggatggcgtcgggggagctatcgctgccaccgccatcctctgtgacaacagctctaccgaccttcgcgagctctctcacaaagatgtcgaggtctacgttgacatcgtccgcagccacagcagcgccgcctcggcttgcgttgggatgggacggaggaggtcgaccaagaacccgccgccgaggccgagggcgtgccg

SEQ ID NO: 97748 - DNA, 682 bp, Oryza sativa
attcctgcagccctttcctgccacataaacttccaaactttccgtcacatcgttccaatttcaactaaacttccaattttggcgtgaactaaacacaaaagctaactagaaatttatgtaaaggagagaatttaaaaaatgaagagggttagctttcatataaaagctactccctccgtcacataatataaaggattttggtggaatatgacacatcctagtactatgaatatcacatcccactaaaatctcttatattttgggacggagggagtagtacatagaaaaataaatacattaaatacataggtgagaccgtgagagataaagaaaggagaagaaaaatagagcttttttttattaaaagggtatgacctctccatttctattagaagaaaaatagagataaccttacgatatattaactctaatatgagttatatgttcatagttggctctagctgacacatttccctaagctacatcaataacaaataaaattatcacataactaccccattattagcaccctaaacgtttataactagatacgcccacttctaacagtgagactgtgagagggctcggaggcagccaaatggttggacacgtcaatagtccatgtcaacacaggcaccgtagcggagtccggttacactgctaaggcctggtttagggcatg

SEQ ID NO: 97749 - DNA, 676 bp, Oryza sativa
tttagatgtgagtgtgccagaacgatcgtcttgctctctccggtcgccgacggccgctactcgccgccgctagtccgccaccttccctccttccctctctaagctaaatcggggcctttgtacctggtcgccgaccacctctccaagctaaatcaggccatctgtccctctacctctgctagtaccgagtaacagtctccaacccaaatttcgacattatcgatttgattcagttgaatcgaggcaaggtagaatcgtttaagatcaatccaacgtatccggcgcctgtttttttaattttcactctctcttctacctaattgctgcctctcgtcggcggtaagtatctctctgtttttttttctgtatgctgaattgctgattgaggtctcctgagcgatctatttggaatcacatacctccggttttcccacctaaattgacaaagtatagtatttacttaatttcgttttgaatacggaaagacacaatccaatttcaatcaatgaaacgtgtcgtttttcaggtccggtgacctgttttttcggtttatcatcaatctgcaatggctaacaagggagggtatctaagcgtgttagcgcccattgaaactacaccaaccatcaagcaagaccacattacttccgtaagcgttttattttgtaaatctacgtca

SEQ ID NO: 97750 - DNA, 557 bp, Oryza sativa
ccagcgatgacgcctcatttagcgcgcacggagcgcataatataggtacttaagccgcacggttcgtcgtcgccgtggccccgcgcgcgcgcttaattttttcgcggcctgtcgggcgttgcgcccgccgggcgagcggcatcgccgactccgtctccacctactcggctacacgtccttcccgatcgatttgttaaccgcgcggaaacaaaagcgcgccagcatcttggttcccctgggccatgcgtggtgacactatttgcttgccttcttttccgggctcctagttacctaaactgcttattatcaaatgttaagagtgtctctctcactagccatgcaggcaaatggagtgcgtatcagctggctggcttcctttgacttggaggcatttccgtgctagttgcagttagccaacaatggatgggctcagctcaaagaaaaaaaaaactacgaaagggctaacccttcacaagttgtgtctgtatcgtggatggaatgatgatacgttgatcttgtttgaaactgaagcagataaagattttttagagaaaagg

SEQ ID NO: 97751 - DNA, 838 bp, Oryza sativa
agtgttataagactttgcgcgacaataggcaggcacagtgttaattaatgggggaaaaatgtgatctttcagtgtatcttaaggttgtcgtcttatgtttgagtaatggactgatgttgatagctagcactgaatggtattttaagaccaggtgatttcccacaacggaaagcccttctatcatgtgattgctgacagggtagagcccacagtgtgtaagctagcacatgcactggaggtactggacaatgcattatcaatactatgtttacttgttctaagagctaccagctaaatgcagataatgccagctcatagataatacctttctgaagtgttcaccttgaattgcctttttatgttcgcttaaataataccgaatgtgaatgaatcattggtttgtgctctccaaacttgagaatatgtggatttaagatctcaacctctagtgtgtatctttgcaccttcagatgttcagggactcagggtacacacatctactgacagtttacggtgttagaattttcagattaatgtcatttgtcttttggagtttttctgtgttactgactagtaactgtcgctctgtagtcagtatccttagaggatctattgtctctctctttttttttaaatgtacgatatgttgttttgttttattttgttgtctggaacctttacgtaattgtaggctcatgttcaaaagctttggttactgtcattaagtacactttagataacagtaggcttggttccaataagttattgttggttttcatgtttctaattaatgtatcttttcttacattgttttctgtcatttgagagtactgcgaaa

SEQ ID NO: 97752 - DNA, 547 bp, Oryza sativa
taaatatttgaattcaaattcaaatttgaaacgggtatgtaaactttttgcttataaactttgggtctataaactaatatttgaattcaaattcaaatttgaaacgggtatgtaaacttttgacctataaactttgggtctataaactaatatttgaatttaaattcaaatttgaaacaggtatgtaaactttttacttataaactttgggtctataaattaatatttgaattcaaattcaaatttgaaacgggtatataaacttttgacttataaactttgggtctataaactttaggtgtataaactttagatgtatagaaatactatatacagaaaatatttgaattcaaattccaatttgaatcagatataattcaaattcaaatttgaaacgggtatataaacttttgacttataaactttatgtctataaactttaggtgtatataaatactatatgtaaaaaaatatttgaattcaaattcaaatttgaatcggatatataaacttttgacttaggtctctaaactttagatgtgtaaac

SEQ ID NO: 97753 - DNA, 1016 bp, Oryza sativa
attcctgcagcccccatcttcttttgatagtcatatttctaaatctaaaaaaattatttttgataggcatatttcaatccaacaacctatcctcttaatgactttctcggatttaatgcgtgactctacattcttccacacaagattggctacatgggcatcgagaaatgtaaatattaatgaatcgcttgtttacaaggaataactggtagcatatttaaatggatgataagtagaattactttggtctgtgtgccaagatgaaatatgactatagtttaagtatgcaatgcggtagtacgtacattgcatcggtaccacactaagcgcgcattcaataagcatcaatcaaactgtcaaaaaaaaagcatcaatcaaagactccaaattaggtgcttgtcaaattacggtttgattaatgattaatccatgcaccacaatgtctcggatgctcaactaacttgacacgtcgtcatatacttgtactgaagtcttcaactctacatcacgtacaacagtagtggtgtagtaccattggacactactacatcctacagataagaggcagagccaatagcgaagaaatactactgtttgactccattagatttgtcattaatattatcatttatcaacaccactatttagtctttaccatagttgatttctacagtactagtagtaccctgttttgcctggattagcctctcacatttcatactagctactgtagtatagtaccataaatgtaaagagacagaagaacagcatagtatcccaggtctggataacactatttatcatacccaattttaggatcattaacaggctagagcaaaccaagattctcaagacgacagctcttggcacgatgggactcattggattcaccatgcaagacaagagttgcattgcattgcactagcacgagtgagcttgagactgagctcttccgctacatcttgatgtccgcgaggttggcccagatatgctcgaacacgtcgacgatgaggtcg

SEQ ID NO: 97754 - DNA, 673 bp, Oryza sativa
ttcctgcagcccttttacggacaatggaagtaaattgaatcgaactttcttttttctgttttaatgtttttttcgcccgtctttcgttattacggacaacggaaacgtttttaatttttttaagtagtagagatagagaaaatagagatatagtaccatgtcaaatataataggattcgatttttttactgcaccacatataattctttttttttagatttgttttttttttctcttttttttaccgcatccacgcggattcgttttttttggccggtctttttttcacctggttttttttgcgccccttttttaaggaatcggacagattccttttttatttcttttctcccttttttttaccacggaatcggattcgtttttcctttcttttttttgcccttttttgatgggacagatttggtttttcttttcttttttgcccgttttttgtccggtttttttagcccgttttgttttggatcggatggattttttcgtctggtttttttttacggacgatggaagcacatcttattttttaagtagtagagatagagatagagattttgttgaaatatttaaaaaataaatttttgttttgaaaatttacaaatttagaggtctcacgtcctttaaaaaaaaagcccttccagagagatctaaatgtaat

SEQ ID NO: 97755 - DNA, 896 bp, Oryza sativa
aatggaaattgtacctcacaacatactgattagcaatatccattgttataggaaatctagtctctaaattgtccgtagcctaggcattccttactggagcaacaagaatggaacttaaaagagaggtcaaggtaattacccgcaacggctgtcctaattcgacttccccgctcatgttgcaaatatagatcgaatcagttcttctgcgcccgtcgatgccagcaaggagagagtgggtctatgggtgcactaaaatgatcttgtgtaatggcttaccggagcttttctaagagttgggatccccgttgactacaatgctagtctgttgtggggagacttgagcagggtcttctccgaaagctcacaggaaacctgaaaggtttcatcatcaaccaatggaccaaccaatggtcattgtgattccccgttgaggcgttgacctgcttcacatagatgatggaaatctagatgctaaatagaaaatgtatttgaaattctgaccattgtagagatttcttcatgaggtaataaaggtttctgctacataaaaaaactgcgaatgtatgatgttcagaacctcttaaaaaaccacatgagattttctcaaacaatcaaaaagcatggatattttcagtaaaacctactagtatgttttcttcctcggatttataatcacttctacgtatagaaataatataatgtcgattctcctttgcaaagaacagccacctagaataagaaagaaagctagttatgtggattcacttgcaaaaatgttgaattgatttcttattgaaaacagtccatgacagacataagcgagtagacggctatccaaggaagaaataaagggaccagtcaacaaaattttcacaaacctaaaatacgctcattaa

SEQ ID NO: 97756 - DNA, 662 bp, Oryza sativa
ccaagctagttcttagaagataagtcccccctatagtcttattctggatctgcccttgctactaagttcctttagtttctttcaaatttaatgtaccataatatagagaacaacatgtatatataggaccaaattaggaaaacttggcaatctgatgcttgactccaatgtgatttgacaaaggccttcttgacgaaagaagtcataagaggtgcatcatcaggtagaaaatcgagcaagatcttagtcttacattattgtcaatgtaccgggaacaaataacatagaaatgttaacaaaactctatataaattaacgggatcaaatcaggtgaaacagtacattatttagtatgatcatctctttaaaacataagctgattaaagccatgaaaattaaaaattaatccacatgattatcactaccacccattaccaagcaaataaacggccggcattatggtgaacaaacaataatatatagtggttttttaaccaccaagttaagtatttcattcatcacaaaaatattctgtttaaggcaaagttgcaaggtacagttatcattcataagatgaatgtaggttgaactattgccgactgcatattttaatcctgtttttgcatgttctgcatcgatattttatgtttaatctgaatact

SEQ ID NO: 97757 - DNA, 679 bp, Oryza sativa
attcctgcagccctaatcaacaagaaatataagcaaaggaaccgtggttaaatctataaatgatagccgatcggctagatgccgatgacatatcatttatctttaagccgatgtcatctgtgcatcgatcgacagtcatgaataagtaaagaagaactaaatctactcgatcggctgtagatattcacgatatatactccttatatcgatgtatacttaaatcaagtgattgggatagatcggtcatcatgccgagacagtataaatcacttagatcgaaatatatatcaataacaggactatatatgtttatagcatagccgatcagatagatctagcatgtatcggctaatactccgatactactctatatcaggatattaaagtaagaataatatactgaacaagagcctaatatacttagacacaacaatatcttgatatagagggcagatttaacatgtcaatgaagcatatagaacaaatataagtaaatcagataagatcggctgaaactctgacgctattctaatcggcaactagaaggcaggctatagatcggtattctaagcacgactcaataggtcaaactcaactgatacaacattaagtatgaaaagaataacgatatctagacaatcaagccgctagaagtttcatagaatggtagatatctctt

SEQ ID NO: 97758 - DNA, 1156 bp, Oryza sativa
cggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtg

SEQ ID NO: 97759 - DNA, 688 bp, Oryza sativa
agatagtagccaggacgacgataggttgatgcttattttgcctctcaaattaatagagcagtgtctttttactgcagtaggttgattatgtcaattgcattcataggcaatcttcaatggacttgcatctcactccaaaatgtaaaatttgaagaggcaaagccacataactatctctaatgcaactggtatccagctcctcgtcattgtagcacttgtgtctcgcccaaccacgctggccatatataggtatcgggccaaaagtcgcttgctacttcatccttcttgccaaccaacgcggttcggaagaagccaccatacaatcacgtattcatcctctagaagaagagcaccatgggttgccaacttcttgttgggtctccccatgtcgaacttgaaccccaatgcaactccgtcgtctctcatttcctccccaaaggctgcacctggtagcccttgtctcctgccaagtcatgagcgccaacactgcactagatttggtgccgctgcctcctctcctctcttctctagcgccaactctgccgtcgctgccacatcagctgagctcgggagggagcgatgaggaggaaagaggagatgatttatacatttttttatgactagctatagcatcatgatgtaggccaacagatgaatcgatggttaaaaagcacacctagttaaactt

SEQ ID NO: 97760 - DNA, 795 bp, Oryza sativa
tactgttgttggaagcttcggccaggatcgggtctgagaaatgacaggattggaagccaatcggttgtggtgggcatgcacacggcaatctgtgtcccggtttgcagcttcgactcattcagagagaaattcatggatgtatgagtactgcgtatgcgtggtttgtttaccgttctcgcaaagatcgtttatgaacgactgccaagaagcagaagaaccagtttcactgcatccagtgtcaaatactggagtacacggagtattactcctactgcaccccacaagctgcagatcagaacctccttcctctactacagtaggagtatgctgtacacaattactcctactctacacacacatcatatactactgtacatgtaagcctgacaaaaggcgctgcagctgcaagccgcagccacacacatcgggcattcactacgttctctctcggaggcctcagtgattagtcagtgaagggctttaacattgagacatcacatccgactatcgagagcagggagaatgcagtagtaacaatggaaatggggagcttaattaactccagcaaacaagtgactgtgacacccctgcagcagagaaagagactgaagaagagacggctgatggccagtgctcgtccagtgcagagtgaatggttcatgtctctcaacctccagtgcagtgtaactacggccctttgcagatccaattcaatggtgtaacttttggcacagcctcgaaatgttactactactaccagcagccttcatgagtgaccgccacacatcagaattg

SEQ ID NO: 97761 - DNA, 1235 bp, Oryza sativa
gtaaacaagtgcgcagaaggatgccagctcgctgaatttcattacctaacggagcagcacagcgcgccgcttgaatccaccacagccactgccaccgcaacccgagctgaggcagacgcaacacagggagatggccacagcgaagaagcacaaggccaccaccagctttagcatggaactgccgctccgcctccacctcccccccgagctcgccattggcgcctcccccaaaaaccagctccttttcaagccgcacgccgcggcagcagctgtagagcggaggctgatcagccggccagatttaggaagctggaaggcagggtcagtcgaagccggccggtgccgcgacgcgaagggacggttcggcttcacagctgtcttgtagccctcccactggccactgtagcggcgtcagatctctctccgaatccaggcaaaggccaccactgcatgcatcgatcgatcgggtttaatacatcagcgagaaagaacagtggcactagcaacgtactccctctatttaccatatctttgcatcctcgcctgagtcctcccttcgtcacttcacttcactcgtgtgtgaattgtgattgctcagtgggaagcggggaactactacgtgactagtactagtacgtcagttggtccagcgccaaaacctcctgagggcctcttcggatggaaggattttttaaggattttcaagggaatactatatataggaaatatttcctttcctgacattcagtccataggaatcaacccaaaggaaaataagaggaaaaattcctttcatgtggaatcaatagagaaacaaaggaaaatttccatccactcgtatcttattttttccatttcctatgtttttcctctgcctatccgaacacatatttaccaatcctatctacagaatttttgtgtttttcaatcctctgttttacacatatatttctatcatattcttacgatttttctactcctacgtttttgcagtaccgtgatcctaataagccctaaagttattcctgcccatggagaagtagggatagtcgtaaaggctcgcatgtgcaaccccgaaaaggctgtgatacttgccagaagttactccctccgtcctaaaaaaagacaaaccgtgggttttcgtgccaatgtttgattgtccgtcttatatgaaaattttttataattagtatttttattgttgttatatgataaaacatgattaggggtgcagg

SEQ ID NO: 97762 - DNA, 697 bp, Oryza sativa
ttcctgcagccccgaaaggccaaaaaggaaatttctagagtccctgatcgctgataaccgatagtattgggtctgttcggcagccctatacagcggctgtgcagctgctaccattgatcttctataaatttcactgtagcagctggctgccaattgagctaccgaacaggccaattcttttttgttggagaaacgttattttctttcccgatggcgaatccctactgttctcgagatacgttggcaaatgaccatttgataatccttggaatggtaaaacatagagcaggttaaaaatgcaaatattaaaaaattacctaatatcattttttcctatcaaataaataaaatgagtaagtcctcaaacccacgctggttagcccatcaaattgttgagggaaaggagaggacctgtcactcagttttgaacctttgaaccgaattaacgaaatattaatttttgttccaagatgaggttcttgttggtaaagctgcgccgttttggtttgatatcaaaatattgccataccaatgttttggtagtttaaatagtaaatgtgatgatttggtttaaagccaaatatttggtaatgcctatactcaatttagcacaattctagaatgttcttcaccacaatttaaaatttggctctcaattggcatcaatccaaagacactcatttaacttgcctagagt

SEQ ID NO: 97763 - DNA, 620 bp, Oryza sativa
ttattcttaccgggcttcaacagcatacatgagtacatgacatgtgttggtttcttctagcagcatggaacagttggaagtgtttgtttagggtatgattgtgaagtgctcgacgttcaatcatgttagtgttttacgtttggagaacgaagaaatgagtgttgctgtttggtgtgtacttgtacgagaccctcacatttgaaggcccatcaatgttgctggtaccacccagcccaactattgatgataggaataagttcactggaaatcactacatctaaactatcacaaaccgtgccaaaaaaataaaaaaggtcccgagcagtattgacctaatttttctcctgttttgctgacgtggtatacatggaccccacatgtaagtgagaaggaaaaaatatggggtccgcatatccttttttctcttctctttctcttctctttctcagcgagctggaaggctgggaggccgccgctggctgagggcagagcggcggcgggtggcactttgttgcgattcgcatcattccatgcaacggcacggccttagcctccatcatcccaacaccatgcatcagcgtagccttggccttggcggtagcgggagccgcgctggtcat

SEQ ID NO: 97764 - DNA, 522 bp, Oryza sativa
catatggtactatattttcgatgaaagctcatctcttgagttgagtgtttgacaaatttgatagagtcataagttctgttttgagatataagctgacatcacaaggtttattttttaaatagttgaatttaacctaaaatttgtactgcaaccctttcccacactccagggaggacccatcatctgaaaaacaagggattagatttccccatcctatactgtagtctgacaatgcccatccgttttctgaagaagaaataaaacaagttctcgatagctgctactagctgttttctcatttcttaaaaattaaaacaatagaagttcgaaattaccactaaataagtaattaaccgatttgtaactgccgaattggattttttttccatcaaaagtgaaagcttcctatctcgactataacgctttggatttgttaaaaaaaacttgaatcgtgggatacgctatttttaaatgagaactggaacatctgagttgaatgcttgacaaattgagttgtaagtt

SEQ ID NO: 97765 - DNA, 598 bp, Oryza sativa
actgacaaatgagaaatatgataattcaataccgaaaccagctagaacaaatagaaagttatttcttaaccaatccagggaagataacctcaggcagaaactggtaaaatcaattttctcgatggggtatgagaaacatatgaatcaacaatttcagtttcaggagtcagtactttaaaatatgaagtcaaattcaacaggatcatttaaaagttttccggttctttggatttctcagtgaggaaaagacatctctttttgacatatcaggaagttgtgagcatcatgtttgtacattatttccataccaagattagcacggttgatgatatccgccgagtattaataatacacccttggctatcaactacggaatgattgaaattgttgaatgaaattacacattcttataaataagggttggcacataaatatagcatggtgaacccccagttcactacacttttaggatattttttaaatttatgttctatagcaaagctatgctttgcatgaaaaactctagttttatcagctattatcttggctgcagtggtcactagtttagttcttcaaccattataacaatgtacgacac

SEQ ID NO: 97766 - DNA, 690 bp, Oryza sativa
attcctgcagcccgctccctgtctctcccccttcctccttccctttttcttttcctactacatcataaatatttaaatttaaatttagaattgaaacggttatgtaaatttttgacttataaactttgggtctataaactaatatttgaattcaaattcaaatttgaattggatataattcaaattcaaatttgaattgggtatgtaaacttttgacttataaactttgggtgtataaactttagatgtatagaaatactatatataaaaatatttgaattcaaattcaaatttgaattggatataattcaaattcaaatttgaattgggtatgtaaacttttgacttataaactttgggtctataaactttaggtgtataaactttagatgtatctaaatactatatataaaaaatatttgaattcaaattcaaatttgaatcgggtatataaacttttgatttataaactttgggtctataaactttaggtgtataaactttagatgtatagaaatactatatataaaaaatatttgaattcaaatttaaatttgaatcggatatataaacttttaatttataaactttgggtctataaactttaggtgtataaactttatgtgcataaatttactaaaataaaaaattaatgcggtgaaaaaaaaaaggaaacgtgtacggatggag

SEQ ID NO: 97767 - DNA, 502 bp, Oryza sativa
ccgctattggaacttagcgcctagaaggctacaatagcaccctttatcagcaaccatctactcatacattaatccgtgaccatttgctattctatatttattaccttaggtgtaagcatatttatatttgtgtatattagtttatgcatcttctatttaaataaaatatcctatgctagctttttttttcctttggaaacttattccgatactagtattttgttgaatccaagctaggtagaattattgagatgcacaaccaacaagccaaaacagaggacattcggagtatcagcccaataattatcatctcaccgtcaccttttagcaggtttagtgtcacatctcctcccagataaaaccaaactaaccctaaattattgatcctaacaaagctcacttttttttaggctttattgctactagtatattcgcaaatcgcttgctcgatccagttcatcacgagtccttaattcggtgggccccactcgtcattgaccat

SEQ ID NO: 97768 - DNA, 894 bp, Oryza sativa
  unsure (1)..(894): unsure at all n locations
gggcttattttcactccagacaatagtacaacaaagactcttttatggcaacttctactgctaactgcggcaggattgtactctatccgtcccgtaataaaaggattttgaaagaatgtgacacattatagtcttacaattttggacatactctttgtccagtttcgtagtattagaatgtctcatgtccatttanaatcccttatattatgtaatggagggagtataatctaagtgcgtgattggtttgagaatgaggtgagataatctatattttttatgaatggaatggtttagtcatatgtttgtcatgacagatagaatcgttatattttctttacggagggtgtggctcatttgtcaataagagagaggaggtgggtaggattgattagtccgttagtttctgaggtgtaaaactgacccaaatcttatgggattacgaaccatcccatgatccgatgtcacttattcttaaatcaaacaacttgaaaaatggattcgcctcatctcaatctattccgttctttcaaccaaacacatactaaatctaattacagttgatcataagcatttcatacaatatgcgaatttaccttggttgtgtggtttttggtagaggcggattatgtgaaccacttccatcataaataagttaaaaataccatataatataaattttaaatccaatttttgctcgtcaaaatttttaccaccgacattagcatgtacagtactcccttcgtctataaatgatggtattaacatgcgaagtgtttcttttgtccgtaaatattaggggttctaggttatttaacagtagtatagtattgagctggggtgaaattgtcctataggtttaccagattagtaaagataacgccaactatgcaa

SEQ ID NO: 97769 - DNA, 530 bp, Oryza sativa
cgtataaaccatttcccaatgttttgaaacaagaaacaaagaaagcctgaagcaaacagaaagaatttctctgggaaatttttgctatttagtgtcgaccatatcatatcacaagcaaacagattgattaagattcagttggctgtttagtctgtatgttcagagtaatgatgaacgccatgatgccatcaatgtacttatcttctgttagatgcaaaactaatctaacatcaacgttaagaatgaatttcctggtttggtttcaagttaattatgggaaagcatcacccagtatcgaatgcaatactattggagcataataggagatcctaaaaaacataacgagattaaggagtacaacaatgagaataagagacaaaacacaagcatattaacatcaaagtttgtcccttttgagttctgacaagttagaaccaataggtaactccatcattttgttctgaaactaaatgcatctgaacttctgaagggcagaatattgatggactaatttcccataagagtaagat

SEQ ID NO: 97770 - DNA, 2282 bp, Oryza sativa
gacaataccaaaattctggtaaattgacatcattgcctggttttgatatggtaggctaaatgtaatgttgtcaaaattctttaggaattaacggcgtttggtaacaaactaattgcatctacatgtttatccattttaccaaacaagtggtataacttaaaatgacaccaatccaaacaagcttaaaacatgggttagattgaacatggttagacaggttaaggctacaactacctaagtcacaagatttataaaaggtttactccatagattcatagacatgattttttcgaatacttttataatgaaaatgtattagataccgatatcttttgtacataaccatatcctacccatttatttttaaaattttgagtcaactgattcatgacatgatggcttttggaatattttctctataatgaatgtgttgacagcagggtttacattaccgtcagtaaccgcggttaccgctcttaccgcgggggtacggtaatagaaataccgcggtaaccccttaaattttaataaatttaaaaaataatttgaatttttgatcaattttacacggtttcgtacggttttttatggttaccgcggtaaccgtgcttaccgccgggggcgcggaaaccccggcccaggcggtttgggaaaccctggttgatagtgatatacatgtctatcaacacatgatagctttagggagtattttgtaacataacctaggtgaatctgttggccttttatttatttcttttttcttgttggatattttaattgcccattcaatacaactggttgtttttcacccaacgagaacacctggggtcttaaacacacgagaaaaggcagcttttccaacccatacacatccaaaagtaagaaacctcgttcctctcgagaaaaaggtaaaaatttcaacggcgagcttttaccaccttgcatggtcgaaacgtcaaggtcaattactgatccattcacctgaacaatttgagagagaaaaaaagttggtgattcgacgagcctttgatcgtgtgatactaattaagagcaagtttaatagtatagctaattactagctttaaattacctatattcaatgtaatagctaatttgtattgtagttgtttactatactattaatatctggtactacctatcatacacaccgtacgtcttggagtccgtgctggctacaaatctgtagatcgcagcttttctctcttcctttatctttttaaaatatgtttatagctgacgtatagcctgctattgtatctgctctaatggttagctcaacaaaagtttgatggcgagagcatctaagtttaatacagtaaaatacttcatccaaaatactcctactactccataaacatctatgcgtgtttttttaaaaaataaactcggatgatggatattcaaatatacttttaaaagccatacttatatttcaaaatgggtgtagtagtactacacattatgtaaataaataaaataaagacatactcccttcatctttttcatataacattagctaattaaaaatgtataaaaaaggaaaagaaagatggaaggaaactgttgaattttaaatcgcatttggccggtacagccatggcgaagctggctggaatggccggtatcgtccacaagactacaacctcggatatttcaaccaaaatcacaatcaaatttgacgagcacatgtcatgccaacattctctacgcagacacggtggaaggaggcgccagttcatttctcgttgtatgaaacggcgatcgagttgggcgacacggtaaccagcgagcgacaagaggcggacgcgagcgctagctccatcggcaccagctagcgtgcgtggctccatctcctctccctcatcttttctttcgccttcgatttggacggggaggccgacggcgacatggatccgtatcatccttgaccattgaccggaggacaaaatccgtgcagcccagccagaataataattcccccaaaaacagagacacggccattttttctcttactatgtgtttagttactttggctgtaaagttctttttaaagtatatcgacgcatattcgaagttttatacgcagactaataataaaataattatagaatccacctgtaaactgtgagacacatttattacttaattaatctgtcatgagcaaatatttactataacatcacattgtcaaatcatatagtaattaggctcaaaatattcatcttgcaatttacatgtaaatgtgcaattagtttattttt

SEQ ID NO: 97771 - DNA, 558 bp, Oryza sativa
ataaactatttcattgaaacggcacattgttcttctatattatttctatatcgcaaaaggaaccatggtaggaatttgtgatttttggaccgtgagatttgtgctggctgggaaaaaaattgcttatgaacgcgggggagaggttggaacccacaatctgtaggtttgctgctgcgctagcacagtttttctgacatatttacgtacgtaatttaaaaataaattacattgtagatacaatcaagttacaacgaaactaattagttatatttaaaagttttcttccaaaaaaaatagaatgttatatacctatttccataaataatatattggggaagtagttttgagagtaatgtctatgtgacatggcttggtatagacaccgttaagtgatgtagtttagacacaatatcactttgtgttggaagacatgcagttcttccctcttcagttcgttaaaaaaaaaactcccaattggcaagtataatgatcgatcacaaaacccttttttgcgtgtttgtgtttttcctctagcttctactccctccatccaaataa

SEQ ID NO: 97772 - DNA, 569 bp, Oryza sativa
agatatcgcacatcgctaggatgcatccacatagatatgtgtggcataagtacaacacgcgtatatatagatatatgagtccaaccactacaagatatgagtctaaccactacaagataattgagctattgccaccaaattattatcacaaaaaataatttgtagcaatatattgtactattgcaacgataatttttctgtggcaaataattatattttaatgcaacgatatacaatcattgttttatttagtacttttgttgcaatagaaaatgagatatcgctaaaaaaaatcgtactgttgcaaaaaacatgttctatcggcacaattttaatttttgtggcaatttacacagtacatgttacttttcactatttttttggtgccacgatcaacaaatttattgcaataaaaaaattaccggattataatttaacttaatttttttatatggacacggattgagacaaatttttatgggaattatagctcttgacgagatctacaattttataggtgataactttttcatttgaaatcttttagataatcaaatctatgattcaaa

SEQ ID NO: 97773 - DNA, 2481 bp, Oryza sativa
  unsure (1)..(2481): unsure at all n locations
gaatattttcttttctgatagtagtacgcattataaggattattatcataaaaattatctaaaagaaatatatttagtgctactactaattaatactgttgttttttctcattagaattggggaataattttcttttctacgcattataaggtttatcaaaaaaatatatctttagtactgctaaaactgatattgtacgcatcagaatttggtgtgtgtggtcacttgtagaagggattgaggagaacctatccaaaccgtcagatggatcttgacaatggatgaaaggcagtggtggtggggacagtgacgcgtgcatgtgattttgggtgaaggactggaggtagtggccttgattagtttagcatcatctcctcctgcaattgggcgcttttccatcctcgagataaaccccactacggtgcacatacttctaataacatctttttacgaaaaaaaaaagatcattattcattcggcttttagaccttctgaagttctgatcgatcactcacggggtacatatctcactttgcatattgttcttcttcctacaatcacttgcctgggttcacatgatgagaaagaaccgtgtagtgcatcacttccctttacaggagaattggctacagtcgctgtagcatttttcttttcttagatgctagatgtatacaagtttatagagctaaagtctttgaccagctggcccaaccggaacccgaccgggtcaggttaatcacgctgggttttctcttggccgcaagacgcttttagcaaagcaaatattccagcacacgcatgacaagatctaatctggcacaattagcttctcataatgacaatattatattgttatgtatggttgacaacttacgtctgtgctggaagtagtagtactgctacttgcttccattttttctgtacacgttggcacttgattttctcgagaagggtacaggttggccaacttgcccatatggctgcagttgcgccacccacccgtattctgaatattcgctcacgatcgagcgtgtacttatttcttaatcatttcattacttgagaaaaaaatgcgccagatgtctggatgcataacgtttctttatcagagaatgatgatgctcgattgctcgctgactcttaggcatttgacaaaaataaacgatatgccaaactgtgcgcacagaactgatcgtgcctcggatcatcagatatagttatgcacggcagcttagctctgaagatgtagcagtacatgttctccaggaaacaaaaacaaaaaatgcagtgaatgcagctgtgaactgcgtcacagctgcagataactttaatatgtgattgtgggcagcagcgaaatgcagaccacttaaacagaggactagattcacgtttgacaggatcatcataatctaatctagtcaagcaacaacatctgaactagtaaaccgaaattactccctacttgttatgtagcaaatgcagtgctggtcagaggatgagtacgcacctaattaagctgccgctcggcgacggcgagagttgcaagaagagatcgaagccggtctcagtcggtagtgaccagcaaaaaaatgtttcggcaggcagcagatcaagagtgcttagttggtggtagttgtgtgcttagagaaagaagagcatgcaagaacctaaatgtatacccatatataggcatggttaaggcgacagagtaattaacagctaccaatgagccgcaaagatcgttattactagtatactaacactgtactcggcaggtcaaagccatatcgccatcgccaacctcccagatggcaggacaagcatgtgggctctctctctctctctccctctctcggattgacgatgcagcaacgctacgctgcgttatctaatctaatcatgcccaatcaggaagattccgatacttttttgtgcatggatccccgcgcaataattccgaaaagctccactttcccctacttgctcccgcagccagttgcacgccacgccgaccgtccgcgcgcgcgggtcgcgtgcgccattacaaaattgccgtgagacgccccccgcacccgcatccgccgcgcgcgacgtacgcgagacagcattacgcggtggagactactcgttctcgtcagtcgtctcgtctcggctcacggcgcgcgcgggcgggctcggcggcggcggcgacgggaggacatagattatgcgggcatgtgcgcgagggggtacgtacgtacgcccatgtgtgcaagttgcggctggctcgcggtcgcggacgccgatcgatgcgtacgcgccgcgggtgggcgctgcacatggcggtgtggttggttttgtttggagagtagcgtgtggttgcgccggttgcgacgtcgcctgacaatctgtcatgcgagaaagaaacgcgggaaggggggggggggggagtgttgcanaagtggacaagcgatcacttttcggggggggggggggggggg

SEQ ID NO: 97774 - DNA, 1228 bp, Oryza sativa
tggagattaaacacgagacattggggttgacaccatatacctcttgccaccgcaacatcaagtgcatctcaaaagcttttatctatggtatgttccttaaaaatgttttaaaaatacagtcaattgcaagatgtagtgatggcttattttgtgatggaggcggagagattacacaccaaagcggcacaaaatattgaaaaaaaggtatatattgaaaaaaatccaaatagtttgagcttggagcctaaaatatgaggttcactgcttcagttttgtttaccacgattttgaataagaaatggatgaaaatgatcaaaaacttcttctataaaaaactgaactctggattatgaattttggtgtagcatcagcctatttgtcgcaaagcacaaacattccaaataagggcctataccacatatgaaaattactacattcataatttaattccgggtgtgtttggcgctacctttcccaacctcaacattaacagcttttcacacgcacgcttaccaaactattaaacggtatatttttataaaaaatatagaaaaaaatactttaaaatcattttaattatttttcaactttttagctaatacttaattaataatacgttaatgagctattttgttttcaatgcggggagaatgagttacaaaactgcactatcgagcatacccttagaaatcccactgctttagtaggattgttggagaatttttaaagtttattgttacattcgttctcaataaatgatgtcctaaaatatgtgcgatcaaatcttgaaatcttatatcatttataaatagaaaaagcattagaattcaatatgcctagcaatgctaatagctaggggtgggcattcggtccgatagaaaatttcggtttcggttttcagtttttgggtcattggaaagtgtagaccgaatttcaacgcaaaaatttcaggaccaacaaattcggtctcggtcttggtcctgaccgaaatttaacaacattttcatatatgcaaagaaataatcgaaattttcaacacaaaatcaaaaaaaaattataagcacgtatgagtaaagactcttattaggttgcatgcctagaagaagtaggaatgtgaaaattagagtttaatattattgaacttagtggattataggttgcatttaattttttttttattaattcggtttttgcgatctattcgattaaccaaggagactaaccgaat

SEQ ID NO: 97775 - DNA, 687 bp, Oryza sativa
attcctgcagccccgggacgccctgtgatttatggccgagtttagtttctaacttttttaaaaaatttctaatttttttatcacatcaaaactttcctacacacataaacttctaacttttttttcaaactttaaattttaacgtgaaactaaacacaacctatgccaatatgccatgtagcggctactgtagcaatcgataccgtgcaatgctgtcgcattgattgctcggctagatcagatggctgtggccggcacatgcatggatggccggctaggggaggaatgcagattttctcgcacaaaggtccacacaactgtctcgtaaaaatggatcatgggcaaacagatggtagatttgtagtaccacttgtactaaatctaggcgtccagcgcgcaatgctgttcgattgggtaaatttaagcctttagaattgcaggttatatatgatcatagccagggttaggtggggaaaaaaaactgtcacaaccaacaagctgttaaaccgtgttaaactccccccggtttgaagaacttcaagaattccacccatcgaaaatgacctatacctaatccttctatgggtattaacgccaatgattgttgtacacttgcacgtaggatgtctgtactagagctatgacggtactttaataaataggagtattatggaaatatgggcagtc

SEQ ID NO: 97776 - DNA, 1228 bp, Oryza sativa
attcctgcagccctgtcatgtacttatagtagtggacctctcttggacaccctgaagagcacatattttttgtgtgattttgtctgaaatagtactgctaggagtagtatttgccgcagcagcattgcggagttgccaacgcctcgaaggtattcatgggcttattagattgatgggctgttttgtacagacaatcacggccccggttggctgtcagcctataactccatcagattgtgtggttttggtttaaaagaagagcaattttacaattcgaggtaccatgaggtaccatttttttattgtaaatttgatatctcttgatacctaggtactgtgaggtatcatgagtgaccaatttttacactaaatttttagtacctcatggtacctcctcaagtaccgtagaattactctcagaaggactcattttgatcggttgcaaacacgtagtctcgcagttaaaaaaaaaaccacgtagtctcgtgaaataagcctagaattgatcgagtcgagtacagttcattcagaggggaaaaataaaaggaagattacgatcgtcgattgggaccgaaattccgaacggaattgcaattgctgaggtttgttgacaggcgactgaactcaattcttgtccggtgtttccggctttccccacttccttgaggcacaactcagcccgccgtcaattccgagaacttatcaaatccatgatgaacaattgcgacgttcgctttcgagcgggcaggtccatggagtgtaacaatgagagaataaaaatcgacagtgtaaggcaggaaggcgacgcgttactgtgcacgatgcggacctcgaaacgctctagtacacagcacacgcaacgggccggagttgtagtgaagctcttttttttttccttaacgaacatagcgaagcttgagtatcagaacaaggcattttatacgcatggggatcacatgatgatattaaactacttgaccgacacagcgttcatccgtgaaattatcgcccaaaacgcaatgcctcgtccagccagtagtacatcggctctgggtttcttcattatagttcagttggatcgtcggtttcatctagacaagtatccgaagtaataatctgtcgcatcggtcaatgactatctgctactggctgatgcagggagcagagcatactctgctctcgcaacgtaccgattgacgtacatggcactcacagcaatgcagcatcg

SEQ ID NO: 97777 - DNA, 781 bp, Oryza sativa
ttcctgcagccccgaataaagtagtaatactgccagaaagaatacaaccacaaggcatataaaattgttacttttgtaatgtgaatttgtaaacaggaaggctcagcaggccttgctggaaaagtatgtctactgaataaccacgctgagagaaatactgaagaacaaatggaccatggaaccccaagaaaaaggataattcagttgtctaatggacctaggcgaatttgcattgttatcaatcagtattggcatcctttattgcctatacaaagattgtgtacacctgtgtgtgaagtgtgaacctcccacataggccgaattaaggagtgaaccgcaaattatagcccgtgttctatatttgtttagctctttctgtactgggacttaacagtatcaattcagagttttttttactgtctcaattcaatttgattatttaattctgagaaaaaaataaaggaattgaccatagctaaatagtatcacagacacgaaagtacatccaactaaagaagaagcggatcaaccatattagatattaccttctcagccgaaagagcatcggtgcatacattgcttataagttgtgagttcacctgttataataataaataagttcaacaataaataaaaattgcaaagtggtaaattaaatgcgtagtatttttgaatgggcaacttggaaagttatccatagcacaaaaaacacactttcgcatacataaacaacctcaattgacaaaaccaaacatgcctaacaggtcaggggctgcaggaa

SEQ ID NO: 97778 - DNA, 673 bp, Oryza sativa
cttcattcgaagcacacatttacaaccttttaactaatctgtatctttgttccaaaaaaaattgcagccattccagactttgatcagattgttgtcaggtctaccgatgatctcctgccgctggagctggcgtagtcctcgaccgggactgagttccgcttgatgaactcgaggcagtcggcgatcgcctgcgcgtagaacgagttggaccgcatgaacgacggcggcactgtccgccgcccgccgtcgacgtgatgcttcccgccgccgacgaggaacctcgtgctgctgctccgtgagcagccgcctccagccgacgacgaagacgacgacgacgaccgcggccgcctcaccgccagcagctggcgcacgtaccggccgacgaggccgaggaacgtgagcagcttggcccgcagccgccgcaccgagaaccggttcctcgggcacagccggaaccccctcgccggcggccgccgcctccgccacctcctccctatcctcacgtagctctccggcgaagacgcacaaccctccatctctcttcgaatcttcgatctcctttacgtgcgtgtgtgaattgcgatcgattctgtacggcctcctggatcgcgagctatactctgcttgatgctgccgctgccggctgccgctgctgctgctggtcaagtggcag

SEQ ID NO: 97779 - DNA, 674 bp, Oryza sativa
ccccatggtgccatgacacgtaccttttgtaggggggactcctgttttttcaaaccaaagtcccaagatgcaacaatgtccaatccttttctatcgtcgtcagggcataggtgcatttgtgcaaaaatggagtacgcaccagtgagagccgagccggccagtaggtcgagattctttccaaggacctcgcttaatgaacctactacggcaactgcaaatcttgttggattaatgcaatggctggcagcctgagaccaaactgatcgaccggttgaagaagaccctagtctatgtacaatgggccagttaggatcatgagctggattccaattaagacgggtataagatgaaaaaaaattaacaggggcttagaggttagagccagaggctttcgctgcggcgtccttgtcattgaatagctagttctacggcctcggcgaggcgagaggcgataccctaccctgcgcttgctttgatgtgcttcacacgtgtgttgtcacgtcaggtcaaactctccaacagttgttatcctcaccctagcgattggcagaaacgagtacttatggttttgtgagaggggttacctctctcccaaacaccctctatagcagcacacttactagctatgtacggagtacatacgtacatcttggatactatacacaggtagcacg

SEQ ID NO: 97780 - DNA, 660 bp, Oryza sativa
ctttttttttttctggccttggtgggagatgatacattaggtacgacgagggaaaaaaaaaacaacagacaagccaaccaacgaaagcgtaggaggctaggagccgttccgccactgaaagagcacggatgacgcactaaccggcggcggggcagacgtgacgctcgtattagcgacccggcacgcggcgccctcttgtccgcccagcgcgacaccgccctctgccctctcgcgagttacgtgaaagcgcccgcgggcctctcgcggtcgtccgttgaggtggcgtggaagccacgaacggtggaacgcgcgacagctcgcgctcttctccccccatcgtcgtccgttcctcgtcagcgtcgagggtcgcgctttcgtttactcacgcattccgacgaaccagccgttaacgacctcggcctcgacccttgtattccggatgatttaccttgctgccatcgctctttttgcgacctgattggagtaatacccggaccccaacggcaagaattgatagtttgaacagcatacagcaacagtcattggccaaaacctctcatcttttttgcttcctcgtactccgtttccgttctgggagaagcccagcgaaaatctcacaattgggccatgggccaggcagccagcgatatttacctgtcc

SEQ ID NO: 97781 - DNA, 679 bp, Oryza sativa
attcctgcagcccaaatatttctttgccaattttccatcacgaataaaccaaaatcacacttggttttacatagatcatgcatacgtcattagtccatgatacgtggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgcctgtaagacacatcaaagagatcagaaaagagtacagatttgaacaacctgctactct

SEQ ID NO: 97782 - DNA, 1125 bp, Oryza sativa
gtaaagaattcaactgaaatcatttctaggtggccacttacctctctgtggacattgaggcatactcccgtgcttgggaggtgtatgacgagatggagatggacaacaagaacaaaaagaaaggaggaggagatgtagagttgtagatagggccggaggagagaagagggtatagaagtgtaaagtttggaattgtaaggaaggaaagagtgcttaaaaggcaagggagtaatgagggggatgggcagcttgtacaattggtagcgagtaaatgggcaggaggggaagaaatgttggcgagtgttgaaaggttgactcgatcggttggcctggccctcggcgccctgtagccctcccctcgtgttcctgcgggtgtttctgctcatgtcaagggaatgaaatgctgttgaaaacgaagcctgccgcaaccactggaccaatgcatttttaactcttgtgtgtgactaccttactgctacgcaacctggagtacaaaattacagctagcgtcttcggttttcagtgccacccaggatgccagctagtgcttaatggttctttacacacgtacgtaatttttggatggatgaaagacatacagcaatgtttgtccaattccaggctattttctcaccagtttggctgccaatttcgggatgacaagtactccctcccttccgaaataacccaacataatattaaatggaatatttcccagtatctattcagatttactgtactagaaaatatcttatttaataataagtttatatttttgtacggagagagtattgccagtatatatgggtggaataaataacttgaaagaaaagacaaatgtagcacatggtgtgagcgcacaaaattttcaggtgagcgtacatgcacgttcttatttctagaggttttcaaaaccatatatacaaattcatttactccatctgtcccaaaataagtttaaaaactaaaataccctaccttatcaaatcacaatgtaattattctacactttatttatttctaatacaactttatctatttctgatgtaattatttcatacttttacaaactccgatacaataattatttaaaaataaacttatttgcgagaacttagagggact

SEQ ID NO: 97783 - DNA, 719 bp, Oryza sativa
cttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacggccggccggcgatgaggcggcggcgacccagaagggaaggccggcggcggcggcgggagcacggatagcaacaccagcgtcttgtgccgcgtccaccgcggcgtgccagcgccggcggccggcgaggtcgtgttggcggcgccggacattgctgctgctgctgctgcctcccgaactcgatcgagacacatcaagggatccaccagctgggatttatctacggccatcgcagccattaaatcgggaatcaaagcttgcaattt

SEQ ID NO: 97784 - DNA, 500 bp, Oryza sativa
tagggatagttggtaccagggtatgcgagattgaggtaaaagagatggaaacaaggatttttatacaggttcggaccccttatttgacaggtaatagccctactcctgtcggccgaagccggtgttactctttattcatctggatcacacaagtacaataattgggataacctatcgagctgtcgtcaacttggcggcatggataaccaacacatagttgacgacatggtagtcttcctcctcgagtatgagctcttgagatcagatttgacgctaaatccctcttgttggtctttctaggcttaaccctaatgttgatgtctgacggcatatgttggcttgtatattgtgtgtctatctgttgttgtgtctcccctcctattaaggggtcttgtatttatacccatagatacccctttgtccaagtagaactagggagaccaatatggatacaattcgagtagtccttctcgttttcatatagaactgtattcgtcatt

SEQ ID NO: 97785 - DNA, 589 bp, Oryza sativa
caacctgaaattagatgagatacataatgatttcatgaatctggatagatttttttattcacattcgtattcattgtaaaaagatacatcctgttcggtctcagtttactatatattttatgctgaaaagaatatttgagattagagtgacctttgagactctaggacgccagtgacattgaatgtatgtttgatatttttttaaaaaaaaagttacaaaattatttattttgttatgacttgtattgtttattgaagttgttttaagtatgatttattatattcgcatatttacataatttttaaataaaatgaatagataaatatatatgccaaaaccaaaagtactttaaatttagaccgtgagtgctctaaatatgtagtaccctatacacatgtatttagctttgcaagaccatcatataccatttgtacggaaacaactctcgtgcatatagcggaagtcctaaatagataagaaatgagtcacataaaataaatacagagccctcaaaaccgacgatcgtatctatgtttatcttcttagttctacttaaaaaggaaacacctaaaaatataagtacaagat

SEQ ID NO: 97786 - DNA, 535 bp, Oryza sativa
gagaaatgcgattagtatatgattaattaattattaatatataacttttttatgaataaatttgttggatttttttaacaacttctttatagaaagttttcgcacgaaatataccatttggcagtttgaaaagcgtgctaacagaaaacgaggagaatctaatcctataggctcaaaacgagagcctgtaagaaaaggatagaaccctacacgaaaagtgttcttcaaaatagcttttgaatttgattttttctatcgacgtgtaatgcgtcgcgtacgtctcaaaagtcagactgattttacttgtcgcaaaaagtaattcttatcatgtttcaaggctgtgtgtttagatctaaagtgaatccaacttcagtccttttccatcacatcaatctgtcaacacacaaacttttagtcacatcatctttaatttcaaccaaaattctaactttgcacccaaaacacaaccttcctctctctctctctctttttctcttgtcgcgtcaaaaagaagtcagaaatgtgcagctgtgct

SEQ ID NO: 97787 - DNA, 761 bp, Oryza sativa
catgcatcaaattaactggagatcatgcaccggaaatgttgcttttgggcagcatccagttgcttcaaagcaagctcatgaagatcatgcgtctactgatcgatggatcccttatttcgcgccgaatattcaaggattttcccacgcgattatgtgtcccctgtgatcctagcccacccattactctactgaactttgaaaattttttaaacttacttttcgatttttgctttgacttgctgcgatgatccgtgccacaaatcagcaccaaatcgattaaaatctgacaacctcaagtcaactggcatgaactctagtgctaataatatatcataattaacttggcagtaaaggcagcatggctctctttcggcgatcactatgctgcattgttttaaaagggtttgacttgtgcgaaattaaaatcgatggacagcgacctgaacaaagatgcaaactgcactgcaccgcgatatgctcactcatgatcgctctcttcagatatccaattagtaaattgttaatcgcatccgacctacttagtccactcaaagtctggatggtaaccaaaagcttcagcgcctgtagtgggacaagaacagattactaactaaaactaactaactaaagccttttacagttcagatatcttagtgagatcaccattgttaattatcgaaaatacttgtaaaatgttactaatgagcaggggcgaagctagcgtccaaacagaggtggtgcactatcattaaagagaaaat

SEQ ID NO: 97788 - DNA, 507 bp, Oryza sativa
cggacgacagaagcacctagagaattttcttttctccaatccaatacagatcggatctcttccagggaaatcagattttttttctccagggaatcggactcttttttttcgctttttttattcattaaacggtttgtctctcggacttttttttccctttttaagggatcgggtgttttttttgccagggacgggtgtttttttcgcccggtttttttttcactttttttttgatcggactttttttttcgtccggtttttttatcggacaaacttggttttttctgcccggttttttttcacccggtttttttgacggacgatggaagcacctcttattttttaagtagtagtagatttattttatgacttactttattatccaaagtattttaagcacaactttttattttttttatattggcataaattttttaaataagacgagtggtcaaacaatgcaaataaaatctcaaaatcccttatattatgggacggggagagtgt

SEQ ID NO: 97789 - DNA, 517 bp, Oryza sativa
atgtacatatgtactgtatatatatatatatataaaatatgtatgcatatatatgtattggcacatatatatgcatgggctatatatatatatatatatatatatatataaaccatgcagcaacagggccatgcaataaaaaaaaggtcagctcgatctttagtcccggttagtgttaccaaccgggactaaagatcgagctgaccttttttttttgcatggccctgttgctgcatggtttatatatatatatatatatatatatatataaaccatgcatatatatgtttcaatacatatatatgcatacatattttatatatatatatatatacagtacatatgtacatgcatatatatatttatacatatatatgttatgcaaatgcatatgtgtatatatatatatgaccaaaatatatttacattatagaaaatgtgtacacatgcatatagaaacatatgtagtcatgtattaattataatccattatatgtcctagctagctacgatttcg

SEQ ID NO: 97790 - DNA, 710 bp, Oryza sativa
attatttctaaattgtatttctatatggactctagtctcctcttctaatattccttattttttaattctgaatttcagctatttctaaattatatttctataaggactctagtctcctcttttaatattccttattttttaattccgaatttcagctatttgtaaattgtatttctatatggactctgctttttctttttctccgactaatgtgagaatttctaggtcatgagagcgaacgtgaaggctcctttttttcccgaattttagttagttttaaattcctatatggactctatgccctacttctaatatttcttattttttaattccgaatttctttttttttcttaattgtatttctatatggactctatactctacttctaatattccttatttttaattccgaatttctattatttcctaattgtatttctatatggactctatactcctcttctaatatttcttattttttaattccgaatttcaactatttctaaagtgtatttctatatggactctgctttttctttttctccgattaatgtgagaatttctaggtcattagagcgaacgtggaggctctttttttccgaattttagttagtttaaattcctatatggaatctatactctacttctaatatttcttattttttaattctgaatttcttttttttcttaattgtatttctatatggact

SEQ ID NO: 97791 - DNA, 819 bp, Oryza sativa
attgattagcattcaattgcagttatgggattgtccagtagctcccataattgatacattttactccctctgtcccgtaataagttcatttttagctccttccatttgtcccaaaataaataagttcattattagagtaatcattgcatcggagttcgtgaaagtagggaataattgtattgggagtagataaagtgaagaatagtttcattggtatttgataaagtaggggcattctagtcgttttggttgtgtattggtatgtgtggaatcggtgaaaattggacttattttgggacggagggagtactgcattgcatgatttcagaaattaattaatgcttattattcagcatgccatgttatcttgtaaactaatgacaacatgtcacattatgatttttctgtattcatttaacccttttccccaaactaacctacaatcatagtcatgtccattctttggactatagttggtttcttgttccaaatggacctttatttttattaagtagtgacagccttcttgtggtccattcaatctcttgatgtctaattggtaatgcataaaagtggtaaatcaggtattaccacaaatagcaatgctaaacttccgcattattgttcaataaacggtgtgatcgtatactctctaaaatctgtaggttgccttttttggaataattatgtccagctgcatttagatgccattattgtttgaaacttttgcctcttacctcctttttattatttaaaaatttggatttttattcataccaaatgatgacttgtatttatgtatattaatatttgactgga

SEQ ID NO: 97792 - DNA, 692 bp, Oryza sativa
ctaattaaacaactatatcacaaacattacaagcaaacaaggaaaactgaacttagaaacctatcttgcaaaacccctaaaagtacatgtatcaatcagactgtctgtgaaactaatagaataaacaaaccttgacaattccacattatgaaggattagtattcactatgtacctgcatatgtgctgcaaagtcatggaggcataagctagcaccccagaacaattgggttacattctcctcgacttctcgtctcctcgctgttgccttgccgccgatgtgccgtgcgactgcgaggaaggcagcagcaaggctccggaggggcctgcgacggacgggggagttggtctcgggtttgcccccagatctggtggcgcgccaacgccggagacgatggggccgtgggcaggggtggggggcttgcgcctggccgcgcgtggtagcaaaggtggtcaggagaacggcgccgcggctggtagcggcgagccgtctgcggtggcgtttcttcgggaggcggtgggcactgtggaggatgctggcggcaggcgcgatggaggtctgtggcggcggatgtggcagaggacagcgatgacctaagcgtcgacaaccagccctcggcagggagaaggcggatccgacggaggtggcttcgtaggtagcagcgaccctaggagtggcggttgacctgcgagt

SEQ ID NO: 97793 - DNA, 2621 bp, Oryza sativa
aatttattaattttcacctttagctgatgtagctcaccaattatagaacgatcaacatattggacagaggaagtaaaacatatattcggaagcacattcatagggatataaatatgttgttgcgtgtgtgcgtataagtctaccatgtaatcgaaaaaaataaagaaatactgtattacgtgtgtagtgcatgtgagtttacggtgtaataaaaaaattccatcttaaaaaaagaaaaaaaatgcaaaacgctgcataataaaactagtactactagtactccataaactaaagatgtggacatcacggagaggtgggtcccacggttcaatcagggaggccaacacgcacatggccacatgggccatggccgctggtgttagctcacggcactcgtctgcgcgcaacacgtgtccccttcccccccgcctatctgttgcttggcggtctccatgtgggccccgcgcccttcctttccgtgtctcggataagtgggcccacgtcactcgtcccaccaccacctctaacccacacagggccccacgcagactagacaaaaccatagttattgagacgggactggtaatcgaaccggtgaggctgtcggttcaatggttcactggttcacccggttggatcggtggtctaatccggttcaataaatactaaatacattgatcattcagtgtaaacacaaagagccaagtagtctggtggtggaggagtttaactaactcccacgtggtcgtgggttcgaatcccacccacgccaaccaccaccaggccggttcaaagcggttttataccccggtttaatagcggtttttaagcaaaaccgggcggtctaaccggtttatagccggatcgattgcatgccggtcttttacctggaccggaccggtggggctctggttctggttttttccggtccgaccgccggtccggtccggtcttaataactgtggacaaaacacaaacaagcaagcactgtagaagctaatatcttgggccggccaactgctcaaaagaaaagaaaaagaaaaaaaaaagaaaaactgatattggtagtcaaagtttattgttcatgctgtcttattcataattggtgctattacgagagaagatttgcaagtgttcgcccatttgcacggatgctttggacagtttgtctgacgaaaaacagctgctgcagctttgcctgttttgcgagcagagctttctatggagtattatccatcacattcatatatactcctctgctactccctccgtcccaaaaaaagacaaaccctggtttccgtgtccaatgtttgaccattcgtcttatttaaaaaaattatgaaaaaaattaaaaagataagtcgcatataaagtattcatcatgttttatcatctaacaacaataaaaatactaattataaaaaaatttcatataagacggacagttaaacgttggcacgtaaacccgtggtttgccttttttttttgggacggagggagtatgctgcatttctctctgcattatgtgtgtgttccctgatttccatgtcggaaatgccagtgacacttgcattcatctgccatcggtttttggaacaaccattgctgtctgtctgaaaaatgcagatgcagagcttatcctgaacgaaacgacgcagcagtttttgggtttccagccgctgtttcatcaagtggccgagcaagcagaagcagcggtttgtgaatgaaatccacgcgccactcatattcatggctgatcctgaactgaattcaatgtgtcccacagcttagcactagcttatcatgcaccgatcgatccagtcagtggcggagccaacgatgtcatcaaacccaaacgataatatgtatttcttacttattagtaatggcggagccacgttcaactcaagtggtgcacacgaatcccagatccaaaatttcttacttaagaacactaaaatgtgcagtgctacattgattttttttctaggcttttaatgatgagaaaattccctatctagcatcagaaaaaaaattgctcttccctctatagcacccaactttcaaaagttccctatctatgcaccatcaaaatttttgttccctatctaacacttccgttactcccgttggcctccaccgtcaaaacaatcatggacccaccctcaggaatttttttcgtcgctctttctctaggacagagcgcgagcgcgacctgctttccccaacccgcgtgcgcctctcagcaaaaccctagatcgccgtcgcccccatggatggagaccccccgggcggcgaggacggcgaatcagccgtgcagcgaggatggcgaccccctgggcggccattggcgccggcgggctcccccggacggccagcgccggcggcacgggaggccatccctaggcctgctcggccggctaatcccaggcgggcgcaggacaggcagctcatggccacggcggcacatgcaggcagctcccaggcgggcacggacagcaaccccctagatggtgcgggcaaacagtccggcatggcgatgaacacaacctttttcttgcttttgccctggatgtgaatttggatgatttggatggttatggttatctatggatgtgaat

SEQ ID NO: 97794 - DNA, 645 bp, Oryza sativa
atccagggctaggatggacggttgagatgactccccaatgacggttggagggtattaccgaccattccaaccgtcataactgtcattctcaagctatataaagccctctcatcctccatttcaacacacacctcaagcaagctctctcatactctctcaagattagtttaatattctcaagctagtggagtaggaatagaatagaagtctgagtccggaagtcttcagaagagttcggatatggctctagcagctctcctttcttctttttgtaagacttgtactttatttagaatattcttctgtatacaactctagtattgtgctactttctgagtatataaataccaactttactttatatctaagttatgttgattatactgctagcttatctgggagatgcaatggtgcggtataatgtttgcttatgcaattactctatgccatgacgatgatattagagtagtatctggtagtttaggcgtggtgtctagattactgggtatcattatttggggttatatgctgtggaagagcggtgggccgctgatagtgacagctcagtatgggtattcctccgcgcgagtatataatcctaagttaatttcctggggagggtattcctccgtatttagccccggt

SEQ ID NO: 97795 - DNA, 698 bp, Oryza sativa
acgttcaatactttaaatgtgtgtccgtatacttcaaaaaattttgggactattagccagctacaaacatattttaatgagataaaaaataagagagaagagtagcggactgcagatctgtagccagctgcagcacggactccaagacgcaatgtgtgtatgacagtgggactatatactaatagtataataagcaactattgaatgaattggctattagattggctatagatgaattggagttagtagttggctataccattaaccttgctcttaagaaattcgtaacttttcgttcatcacctcttttttttccgtgttttggtctgtcaatgcgctaatttggttgaatcggactcgagttcagcagagagataaaaattgggttctccggagagataaactcaagttcgagctcgacacgggagcgatttccacaggattttcttaaatttcttgaggggaagatagagtagaagatatagatcaaaagttctcaactaatttgagattatctccacgagtttggttgaattggacgcgggatcggggtggcgtcacgtgttggctggctctggctcgactggagcttgaagaagctactgtagtgatagggacataatttagacttctgctgggacttcttttcgtaggcccgattgaaggaggacgcaaactaatagaagggctgcaggaat

SEQ ID NO: 97796 - DNA, 686 bp, Oryza sativa
tttattgttatgtattttcttcgtaaccataaaaggttaatttgcacgtcataaatagatatatgttatgttgagttttggttatctcgttgccgcatggaccccgcattcctatggtaacctttaatagccgtcatcggaactacgacacggttgatcacatccttgtgctagtcatgacgttactagcctacacgtggacaaaaggatatattaacagggacgacacgactaccgtgtactccatacatctctaattcgatttatatagtttatactacataactacccgcgtgttgttgtgagagtttagtataatagcaataaatacaaataatatgtgagaactagatgacataagtttatataagtcgatgtaatttacaataatttaaaaagtatatagaatggtgttcaaatgtaaaagtaaagtgacgtggctttacgagaaaaaaaaaagagaacggttgtttggactatagattaatcatctaagagctaaaaataattgtgatgatatggttttatgagatgagaaaatgatgaagataatttagaccacagattaattatttaagggctaaaacaattgagatgatatgtcttaataggagatcaaaaaagagagataatttgggccatagattaatcatctaagggctaaaactaattaatatgatatggtt

SEQ ID NO: 97797 - DNA, 617 bp, Oryza sativa
agcataggcaattcagcgttgaacttaacttcaaaagatgttcaaaaaggtgaaattctctagtaatcagaaaatcagaataaccataatacaccaaatataagaaaagaggaacacgagggtttcatgaatgacatcaacaacactatagatgtaggatactgcctgtatcaatgtgcatttacagattgatttgatactatttacactgtaaagcgtaaacatgcaattcatcgctaatttttgaagtataagttacgttatgtttgttgaaaattaagaaccagcccaagaaaagaactgcagtcgcattactacttgcacgcataaacgcatttgcactgccacatacattcaactgatagcactgccgcatataatgtacttcttactaataaaaattatgggttatgacaaaatacatctcttggaaactgaataaggtcaattttttctccaataatgaactggaataaggttcaagcaaaggcaactaatagcacaaaattatgaattaaatatttcatcaagttcacagaaaatattaaaacatctaaataattacagagacaaatgtgatttataacagctggaaccaatgggtacatacctgatct

SEQ ID NO: 97798 - DNA, 580 bp, Oryza sativa
tgctgagtagcagtctaatccagtgatttctcccttttttttcttcttccccagggtttccttcaccgttcggctgcgcattgccttcccatcggagctacttgcctcaacagtttggtcggccgcatgtgctcggtcgggaggccctagggcctccactttatctgcgaaggtgatccaatgaaagccttctagattacctccgatcccatcgctccaatccctatttccatccgacctctctcatctagccttcgcctcctccaaaatccacaatatggtgtgccgctgatatgattttcccctccctcctcactagaaatcctttcttccattggtgaccatggtaatcctcacctcctccacccttaggtaccttcctggacgctatcctcgcatctttgaccaatagccacgaccagggtctgcatcacggcacggggacctagcctcacaatctgaggtgaagcaacagccatggctgctattatgcgagaggaccataggtcagtacgagtggggcttctctcccttctgcttgtgccatgctgattaggtctttgttctgttttggtcgtat

SEQ ID NO: 97799 - DNA, 1653 bp, Oryza sativa
cattatgagtcatatattgagattgataaactcattaattattagcataatttctcgttgtcgatgttgatgtatcattgatgttttttattgttttgatacgtatcatcattagttgaaagccataatcgtaaccaaaagttgacggtgacactatcgatcaaaatgctagatctgccccaggtttcgtaacagcctgcacacaggatttcatatatatatatatatatatatatatatatatatatatagacacacactacctcccttctaaattagttgtgtcgctttgatttttttcttgtaacatttaaccattcgttttatttgaagaaatagtgcaaatataaaaaaaagaaaagagatacttaaagtacttataataatgaagcaagccgcaaataaaaataataatattttcataatctttttaataagacgaatgattaaactttataaataaaaacttaaagcgacaagtattttgggacggaggtagtatatagctttgcgtgccccctgcgtcgtccgatcccatcctctcgtttcattcaataatctactgacacgacacagccagtgtaagattaaacacacatttgtaactatatactagtgtatatatatccttactggtgctagtgcctagtagtaccggtttggttcgtgcaaaccgtgcagcggcgctgcctcatccgcgggcgcgtttcggcgccgtacgcgatagcgacagtaaccgggcgttagccgggacagcgacgcgccatggtaaccgggtataccaggccgcggccggcgcgtgccgccaaagcttagctgttaagcggtaaaatgaatatcttcttcatgtcactaattaaccagcgatctaattatatgtactagagcgaggcaaaaattaattaaattaaagagaaaaaaagacagtgtcacatacccggccctttggttacctcggagaggaccgtgacaggatgatatacttgcagctggtaacgtcaccatcttggttaattagtccaattaattaattagcaacctaattcaaagcaaaaccgacttgtgttaagaagatggatggagttaattaaatagattaactgatccgacggcgcgcgctcctcttttgtcagcgatcgattggcacgtcgcggggcatgtggcccgcatgcgcatgcggcggccggatagatcgatcgtgtggttgtggttgtggtcgacgcccacgtcacacccccccgggccccccaaaaaccctgcctgatgaccgcatccagcacaggctagagcttatccgtagcgcgtgcatcatatcagcggcgcgagtcgtcgatagcagtagcacggccgctggacgcccaaaccgcggctctgcatgccggccggcctcactactctactattaaccccttcttatcccaaacctaattgctacgctacaccgctactctcgatcaatatatgcatatcatgcacgcgtacgtagtctctgagcattcgatcgacgttgtttaattgtgcgagcctgtttatagaaaaattaccctattgttttagcctcaagctttagcttaaaatgaaagtcaagacctaaccaaacagttgtgttccaaattaattaaagttgaatacatgagtttattaacgcatata

SEQ ID NO: 97800 - DNA, 709 bp, Oryza sativa
caaatatgctgttgttgctctcaatgctagcaggaagatgaaatttgatactttggatatgtattgaattagtggatagatgtactgatattgaattttaagacttgtggaatgtgaaatgcatgtgacattgcaatcatttgtggaatgttaattcatttgaatctgattttgtatgtgctgaaatattgtatctgggctgaattgtatgggctaaaaaaaattagttgagttatgtgggctaaaaaaattatatgggctggaaaaatatatgggctaaattgtaggggctggaaaaatcatatgggctgaattgtgcgggctagaaaaatcatatgggccgaattggtgtgggctgaaaatttgtacaggctgcactcattaaaaagaagcaaataatatgctgggccaactagaaacaaccccagaaaaaaaaatatttgtggcccatgagctacatgggctttagcaggccgaatcttattttgtgacgttttttttcaaccatgtcaactgccaagtcagctgccacgtggcaagccctaggattttgtgacaataaagcaatgtcatatgcttgtgacaatagatgtacaaacgtcacatactaaatttataacggtggctttttgacgtttgaaattacgtcaaccgtttgtcacaaattgtaatttttgacataaatttacatattatgacataataaaat

SEQ ID NO: 97801 - DNA, 643 bp, Oryza sativa
ttcaacctcttggaaagtctcttttcatccaattcgtatgttttcattcggtccgtccaaatggtttcccatatgttttgcttttttttttttgtataggcattcttgccaacatcatgtgttttaccatcgttgtgtgattgtgtctgtgatagctaacagttacgaacaccatgattcttttaagaaaaaaaatcatgtgttataccatccctattgtttcaaagagggttaaatagctcgcagttctacataaaagtatggtgaaacaacttgtaatgaaaagcattcccaataagcatgatcaacaggcctgggaagcatgatagagatctgcaagttaagagtagtatgataattcaatgagctatgcctggctaggcatggttgaaaaaaaatcctatgtgtttggaatgatacaggcggcagggaaaagagtacaactaagaaaataatacgtactgagaggattagttccatactcagtacgtacttgtatggaataaattagcctcaatctccatgtgagggtttaaccgaaagaccttacagtctttacagtcttacatatgctaacccgcgaaacaatgtccacttacatcccagttcagagtacaagcaaaaatatccaatctgaaccaga

SEQ ID NO: 97802 - DNA, 537 bp, Oryza sativa
tcgggtgatataaaatgtgttatttgatatgagtcactcgcctggagtgatatggaagtttaattccgggtgaagatggatgttgtggtgtgtgagcccgtgcatgttgttataattatcggtggaaagtgtatatttacacttaaagtatgcacgggcctgtgctagtttcagtggctttccccggatataaggactacccccttatgccatggaaaatgatgtaatttgcgcccatccacaggactgagtaattagacttagcctagtacattgtcccactgtatgaaagactgtagggtggctctatgagcaggtctggggtggacatgtggaaggggcttcggccaggttgacatgatccacaacggtggaacccgtgaaagcagcgaccgtctagccttgcttaggcccagcaagtgcctgactgctaggacggatcaatatcccactgggcagtaactagtagtaagtggcactctcgaacggctatgttgtcctcagcccttgcaaactattgacatcatgtgggtaaag

SEQ ID NO: 97803 - DNA, 620 bp, Oryza sativa
ttccattacatatgtgtttctaaaatagaaaataatgcattaaaattatttaaagtcgaaaaattaatgacaattacttcgaaaaattattgttgactgtagtaaattaagtggataaaacgtaataagcaaatatatgatttaaaattaataaaaattctaataatcatatatacttagcatatgaatgatattaaattgttaaaaattctaattaacatatgtatatacatacgacatgcatgatttaaaattaataaaaattctaataattatatataattagcatatgaatgatattaaattgttaaaaattgtaattaacatatgtatatacatacgacatgcatgatttaaaattaataaaaatttctaataatcatatataattagcatatgaatgatattaaattgttgaaaattgtaattaacatatgtatatacatacgacatgcatgatttaaaattaataaaaattctaataatcatatataattagcatatggatgatattaaattaattgttaaaaactctaattaacatatgtaaatgccacatgcattatttaaaacttttaaagattctaattatcgcatatacctagcatatgcatgattta

SEQ ID NO: 97804 - DNA, 637 bp, Oryza sativa
aaaaatgattttagtcatgatttttgagcaactaggattattgtggttttttcccaacccatgaaaaatggtttcaccagtagtgcgacctcacaaaggatggatctggcacctgatggtcagggatggaggtggcggtggacggagcatgggggtagaaggagacaacgctcggtggccggatctgcgtcccccaaccttgtggatggtggatccgacgcccagtggtcggaggtggtgacaggcacacatggttgaagccttgaaggagacagcgcccgacgaccggatctgtgtcgcccgacctagtggaggacgaatccagcgcccggcggtcgaaggcgacgacaggtggccggattcggcgcccgacagatggggatggaggtggcgatggcgctcggaggttgggcgtggaggaggcggtggacgacggtagggtgcgaaagagctggcggccgacagtagagggcgaaggaggaggcgcttgcattggggtggagttcgtgtgcagaggggaggaatgaagaaccaaagaagtggataagggcgagagtagaggagggtctcagtagatgaagcgatttactttttctcgaataacctttgacgggtagaaacatttaatacctatcat

SEQ ID NO: 97805 - DNA, 1799 bp, Oryza sativa
aacaggtaagcccagtggatacccgtcggcatacccatgcccgacgggcatgggattttgcccgataggctttgcgggcatgagtcgggcacgggtacgtgggtctcgggccgggcatggttttgctctacccgtactcgacccgacccgttgccatccctaaatagaatgcatttagttaattgttcaaatcttaaatcgttaatagatgtaaaaatatcagaaaagttatactgtgaaattatatagtatagatttatcatgaattaaaactctttcatcaaatatatatagttatacggttagaaaagtaatgcggaaggagttttcatgataaatctactaataatatagttttacatatattaataaacggaccagtaactattttggcaggttgattaatatattgttaccatatgctatactgtcccgtttgtaaatcagtttaaacattggcccgatatagatgattatcatccgtgacggcaaggaacctgatacagataacttttcgtatcagtgacctttggttcatgatggtactctatccgacactgacgaggctttccgttcgttatagatgagttatcccagtggtagtgtttgtattgtccctgtttccccaaaaatcaataacgggattacgatgaatctcgattgagcaaaaagttgggaatggagggaacaatataaagttaaactaggtggagtagcgactagcgccggaacgcgcgcgtgctaaaaaaaaaatcaaatcatgcatgccctgcaggcgctccgatcgatccgcgcgcacaagcattggacatgatgacaagatgcccctactactgctgctaccacattctcttttccagccttcattctatcgatagtgagtggggaattcgagatctattccccttcaaatcaaatcaaatcaaatcatgtcaaatcggtcccttcaatacatattccacctttgttgcatacacctgcctgcttggctaccaatgatatgccaaaacagatgcatctaggcatctagcataagcccgtgcgtgcttaacgtatgaagtagaactagcttcgtaaccagaaatcaacttattggaatcgagcaaatccagtgaaggacagattatccgccctataaacagtctgatcgaacaatacgtggtctagaccatgttatgtagtcctccaatcataagatatagcaactagtaccgaatggaatgtatcatatagagtgcaaagataggatggtttcttaggttgtgttcttttcttagagcaagtttaatagtatagcccactactagctccaattcatttatagccaatttaatagccaattcatacaatagttgcttactatactattaatatatggtcccacctatcatacacacattgcatcttggagttcgcgctgcagctggctacagatctgtagcccgctgctcttctctctcatcttttatctcattaaaatatatttacagttggctaatatcctgctattgtacatgctcttaggattagggttaggaacccttaccccttgacacggataacaaagcaacgaattagctcatgattaattaagtacaccctccatcttagaataagttctttttcccctcccatttgtcccaaataagttattttttgcgtaatcatttattagagtttatgaaagcaggagataaatacattgggagtagattaagtgaagattaattgaatattgataaagtgagggtattctggtctttttgattttgtattggtatgcgtggaatgaataaaaa

SEQ ID NO: 97806 - DNA, 1010 bp, Oryza sativa
cagcaggatgggaggccggccagtggcggcccggcgcggggcggcggcctcaccctccccccatccagatccagctggaggggaggcggcgggatgggtggccagccaacggcaggatgggaggctggccggtggccgggtggcacacgacgatgtggattttgatttgtttgagtttttcttgattttttgatgatttgtggatgttgttgatttgtgaaagtatatgtgaatgtgtttgtgaatgtttctatgaataaatttgtgatgatgtgttgtgaatgaatttgtgattttgtgaatgaatttgtgatatctgtgctgtgaatcaatatgaaaggaggaaaaaaaagaagaaaaacgaaggaggaaaaaaataaaaaaaaccctaaagatggttgcgtctttagtcccgtaaagatgcatctttactcccaggtaccgggattaaaaatagcgatctttagttccgtattcttagtccctgtttgcaacccgggactaaaggggccgggttacaaaccggggttaaagagggtttctccagcagtgtcagaggacatggatccgattgttgggcgcggtctcctccatccccgtgcgccggtttccgcctatgaccgccaggcaccgcatcctccatcccctgagtgccagccaccggatctgtgattttttttgttgttgcaaccattgttgcattttttggggtgattttcgacacctatgacggactgacgggttcactgcttgatcctatttgagatgtatctcatgtctaatgagtggtatattcatttgtgacgagtactaattatcactagtcattggagtctcataccacttacaggtcttagcccgtcagagatgaggtggagtcatcactgaccactcatctctgacaagggcccctacccgtcagatatattggtttaggaccgtcagcggtaacatggactggcgtagtgtctgttgtaggagattctaggaggccaaaacaaccgtttttt

SEQ ID NO: 97807 - DNA, 609 bp, Oryza sativa
ccccagctgtttttatggaaaaactattttccacaaagacagcttgaatctgataacaaaccatgctgaatctgacaaatcctagcccccagccatgaagttggaaaagtaaatttccgattatacggcttggttaatatgcatccattgagcactcttacatgactaggttttacatggtcgttcggctcatagaatttgacaagaccttatctgctatgggcgtccccagctgaaattcccttaggtttctcggaggcttgtcagaacagcgtaaagggacgataggaccgacctcaagacgaaggcgatataagaaaaggagatcaacggaaaaatattgcacatataaacacttgcagaagttgacgtagatgatgagacaaccaccacactgagcaaagaccaggtgtatagttgtactcaacaaatcgcagaggtagtgggagaattgctacactgctagtcgaagaccagttgtagtcataactcgaccactagaaattgaggtgcgagaactgctacgctgctggtcgaggaccagccgtagtcgtatctcgaccattagaagtcgcggtgcgatgattgctacgttactggtagaagggc

SEQ ID NO: 97808 - DNA, 699 bp, Oryza sativa
atgtgaaatataataggaagaagaaaaaatttggtttttgaggcatcgctgtgtaatcctataatttatgagtgaattattgaaaacaaaaggatccaggtccagtcctatctcctccattgtgaccccgtcccaaacatcaacacacaatccagctaaaaaaaagaggcaagacccttgccgaacccttcggccgctctcattccttcctcgctgaagctggtcgtcgaggcgaaggccgaggcagatgtggcagggaagaaactagaggtggtggtaaccagcgggacttagggtgcccggcggccagatggggcggtgatgttctctaggtggtgggaggaaacggcgccgtcgacgggaatctatgacggcttcattcgggagcccttctccctccaaatctgcctgcgtgaccttggcgaagcaagagctgatggtgggctcgactccgatggccccgctgaggatgagaagatgccgacggagctcgatggagactgaagatagccggaggtcggcggcatcctgaagacaatatggatggtggtcgtgcattagatccagcggtggagcaagggggcccgcacccatcgtctcctatactcaacaccaacggcgccgcccatgctctgcaacctggctcctctccagcaaaccagccaccgaaatccttcccccctctgatggctcttggct

SEQ ID NO: 97809 - DNA, 816 bp, Oryza sativa
acatatacgagattagcagtatttatgataaatgaaagcatccacaaccaaacttctaatcatgctagaattgaagaatgtaaggtggttgtgattctcgtacaaggatgtggtactaattggacaggactctaaggattctttatgtgagcaggattcctgaggaattttgagagtgaaactttcatgctcattagtggagttttcatccgccagagttgatgtctcaaacttgtccatggcttgcaggttctccttctcaagagatgcatcgtgcaagaacaaggttgtttcttgacaaatgtcaagaacaatatttttatggccagagggacaaggttcaggctcgataggaggttgtgatggtggttctttggagtgcaattcaagggtctcgccagaatctttttgaatgaaacgaagatcatcatgctctagaatagattcaggggactcatgaagtagaaccgccattacttcctctatcggcgtattctcagggaggatgcccgtcaaggtataatcgctatgaggatcatccctgaatttaggagcgcaacccggagcttgaatttcttttgaatccggcgatggctctagggaggactctttagtcagacccggagatagtgaaggctcgggaaaagaaggttcctaccttcctgacacaaatgcttctggatggggtttaacacactgcctgacaaaggaggtattttctgatatgcaatcgagaatttccttgccttcggcgggagtttttttgcatgaatgaccctccagcagttatgtcaaggtagaatgcagactccctat

SEQ ID NO: 97810 - DNA, 599 bp, Oryza sativa
ggaatctaggttaatctcaaggtcctcggtcgagaatatcaagtcgttcatttgcattgaagttggcggctactgtcagggttatggataccacatatctgatagtagttgactaagcacggcggagcccaccacataccatgtcttatacggaatcatacctagtatatagaaggagttacggataaggaaggatgattagagttctatatggaaatgacaatgactactctgattgtatccatattggtctccctagttctacttggacaagaaggcatctatgggtataaatacaagcccccctaggaggagaggggacacgccacaaagcaacaacaacaacagatcaacatagatcgatacaagccaacacacgccaagaaatgccactggatatcgacatcagagataagtctagacaaacctaatatggtgtctgcggaggctaaaaagagggatctagcgctatctctgatctcgctgagtgcggattcgaggaggaagactaccctgtcatcgactatgagttggttatctagccgctaagccgacgacagctagatgagttatcccaattattgtacttgtgtgattca

SEQ ID NO: 97811 - DNA, 1028 bp, Oryza sativa
agtcattaacgtgaacaatcttgaaggtaaatagatagttatttttatattgcaactctgcaaacatgcgtcttgtagcagatactcttcttttttaatctgagactgaatattaaatattcaatttttttgtctaaataattataatattattataatggtatttgatgatgacgattaggaacagtgtgtttattttcttctttctctatataaataattatatattatctaataacgatgacacggatataataaaaacgtctcaaaactcatttctacacatgagacgttccaaaacgtctcaatgttcttgtctaaacgatttaattttgtgctaacctgtaaaacgtcttaaactatgtcctcaactaataaagcgtctccaacatcgtccctatttcaattttacttataaaagagagatgacttttatagaatgacttaagtgaaacgtcttaaaacaatggttttgctgtagtgatacttacgtacaaagagccatggatcgagcggggcctaacaaatgtagctcacagtcatataacatctcaagacacatgcacgtacttagaagaaaaggatatggtatgactactatccgtccaaatccgatccgttttcacccctatccgtgggcacttggacttggatgaggggaacatgtgctagcacttctttttgtcaaaaaggtgcccaaatctacaaaatcaatattgagaggaaattaaacaattaatcacttgttgctacttattgattcatttgttattgtttatcaaattgaaaaatccataacgagtgcatgatatacctttatttctaaaccttttgccgatgatacttctaccactaggcatgccattcagactcaatggacttccgtgtccgcggctagcagcggcaacgtttgtaggctcgatcgttgaatgcaaaccggaaacacggccatgaccacacccatatccatcttgtccctgtcctggctgtccatctatatccatgtccttgttactccctgtgtttca

SEQ ID NO: 97812 - DNA, 706 bp, Oryza sativa
gtagaatttaaacatgatacatctggttccactggggcgccagggtcaatttttataaattttttcaccgatataatatttatgtaaatattaaaaatttaaaaaattccaacttctttggtcctttttccgtgccatgacttgaggctctgttgggttggcctttggtcgaaaggaagaccagggcatgtttcgtgcactctttcagtgtacgagatacagtaaaggtatcaacagtatcattctcccaatctccccttgttcggttctgtgatgtcatataatatgtttcctatatatcattagaacgagaaaaacaagatgatctacgcgtcaatgtttggagtcatttctgcctgtccgtaccgttgatgtagaacacgcaacaacaacaacaacaaaacaacagctggttaattttaatttacatcgtgtgacatcgacaaatgggccggttatctgaactctgatgaagcgaggaggtgtgaacggtgaaccggacagccacgatcgatatatgaaaaaaaatggtcggatcggattgtgacgtggttgtaacgaagcgagcccgcgtgccgtgtgctgcaaccggcgcgcgcccgcgcgtcgttttcgctggccacgcgatacccccggagctcacgctgtactacgtgcttccatgctggtgcaagccactgcctcagcaactacgagctcaaggcag

SEQ ID NO: 97813 - DNA, 752 bp, Oryza sativa
tcagctgtctgagggccagatcaaatctaatattgatcggctcgaggctcacaagattgagctcttggcacagcttgaagaatgcaacgccgagctggatatagaacacaaaaagctagccgacctcccaaagtctatcgaagagcagaaggcaagacttaaatcggctatcaagaatgttgctgatctgaccaagtctttgaaaatcatccctggaaccgatgctcaagacgcctaagccattgaagaagtagaacagattaggcaaagggctatatcggctatccagcactatttgtctcggtgactttttgtgcaatagatcttagaaatttttgtaatcggctaagatactctagtactttactgtcttgacaatcctttgtgccgactaatataacttctaaatttgctcaaaaatttgcaattttccgctcaaaaatttgcaattttcctgtatgtgcccccctaattttacaatgtcaaaacattgataaaattataaaaacaactaagggcgatataaccatatcggccattgtgcatcggcaaaccacaaccgattacaatatggaaacaactaagggtgatacaaccatatcggccattgtacatcggcaaaccacaaccgattacaatatagaaacaactaagggcgatataaccatatcagccatctcaaggcgatgtaaacacatcggctatcatgtatcagcaacatcagccgatcatgcattaacccaacacttggg

SEQ ID NO: 97814 - DNA, 574 bp, Oryza sativa
tctttactatgttttttatatctctcctattataaaaattaaaaatgtttttgtcagtacgtcatccgcgtatgagtcggttcttaaatccgtttgattttagaaatacaaatccgtatttgagtcagtttttaaattcgttcgcttttaaaaatacagaagaaatcgtacaagaaatctctttaaaaactcacatactactaacttgagacgttcggacacctaattgcagctcatgattttctaacaaaatatatatccaagcgaatttaacacagtgaatttcatcttaactcgatataataataagattaaaataatcttcacccattgcaacacacgtgtattttttctagtaaaattaaaaattttaaaaattctcatctggagcgttgctgggctcgcgcggcccacatacggcgcagatcgatcggggctgtggggcctgcgcgggagagagcgcatctagcgcgcgaggctataaaacacgccggattctgatctcaccgcccggcaagcacgaacacgatgacatcggatcgggtcggtttctctcttgctgtcttctcgatcg

SEQ ID NO: 97815 - DNA, 626 bp, Oryza sativa
tttagaataagtttttagagaaagggtttatttgtaaaataagttttaagaaagggtcgaaacataaaaaattcagcagcgtaaacagagaaagcgctggatgcatatgcccacacgcgcgcgccgatgcgtgcagtcgatagggcagcagcgctatccgtacgtacgttcaggttcagggaccctgcttactgcgcgcatgcatgatacagccgtccggaccaacacagcacgagccatggtcctgaaaggctgaaactgtgcaatgcagctgccatatagatgtgtcatgtatatatatgcggctgttaagctagctgtgcacgacgcgggcgcatatatacgtgactccacacggcatgtgacactgttcactggaagtatgtggtacgtttactgtgatgtggtcatggggctatagcttatgtaagctagctactatactatagctctctaccccgacggccgtgcatgcgtgttgccattagactcgcagatctggccatgctttgcgcgctacgatcgactactaggaacgtacgcgtacgcagtaatgcatgcacgacggggcacgcagtacaccaatccatatatccatccatgatgcgtgtgcatgcttatattga

SEQ ID NO: 97816 - DNA, 661 bp, Oryza sativa
ctggaaagaatttagattcccagttcccacgtcttcgcagtcttgacaaatggcaaatagacatgttcattattaggctgaatacattcaagttttactatcgtctacgttgttagactcaaagggttggtcccaaaaaaaatggatttctcttgtacactatatagaacaaggtttacatgcatagttcaaatggatgcatccttggagtgggatgatgctaggattagttatgtttttgctgttctggctggttgtatctctggaattatatcctagcttgcttatattttctgttgttgaactgtattggtagctggtaaccgataatggtttgtcagatttctatagaagctgggccaagtggccttctatctttaaaaatggattcatcctgtacataaagaacaaactacccaaacaagtataccactataacggtttattatgaatgaatactggatactatactttaatactcttttgagggaatgcgaatactaccacagaactactccatgtaagacaggcgctcattaacttctctctgcaacaacataccttatcattttctcacaatagatagaaatgcagcaatcacagtagtggacattattccacaagcgaaagcaggacttcaaccacagtatccatgcttggt

SEQ ID NO: 97817 - DNA, 791 bp, Oryza sativa
tatagctttataacttattgcttgagttctattatagttttcaacctcgccaattcatggatgagaattaggaaatcttgtcgtccgaaaaacaaaaaaattatcacatatatattaatcatgcacatgttcttattgataatcagaaccaaatattttagtatacatgcaacatcataacatccatatcataacaaatctgctgtaagcccaagtattagtgttctggtactgcagtttggaaaacatatatgtatatgacaagaagttaacaaaatgacttttgttcttaggaattctgtaaacttctggttgttccttcagaaggctagtttcataataaaaactactacctctgtgccataatacaactacttttgccatttcttgaggggattaaggttgaagagagaaatggttgtgattggttgagatgagggagtaggtgaagaaattaaaattgggatggttgtgattggttgaggtggggaagtaggcgactaggcggagaagtagtagtattttgggacaaatgtcaaatgccaaaggtagttgtaacattggatgaagggagtaccaagttcaaatcatagaaagtatcaatatacagccaattcataacagctcaaaagcctcttaaattttggccagtagacacggtatggatcaaaggattcatccactgaattaatgccaaggattatgtagcatttcaatatattagcacaactcatacatatatgagcacacaagtatgcagatgcacgtggttatgacagaatgatggagat

SEQ ID NO: 97818 - DNA, 587 bp, Oryza sativa
ttttgaattttaaaatttagtaaatgaatttaaaaatttgcttacgcaattatcacttcttccatagtataaacaaaatttcgacttcaccgttcctatacacttttttgtggtgcgtagatttcatagactgcagtgcattagtgccagacaccgtttagcacggaccattccatggcccatcctctgtgatgggccatgttattattactctatcctgccaaaattcccaaaatttgatgttgggataactgacgtcacatttgatgatggagtatatcttttgagatgaatagaatttgatctttggcaaataaaggccgaagtagtaccaatgtaccgtgcagttgagtgccgcgctgggtttttcttaccgtcggttactgcggtaaccgggtttatcgtcgtggacttgtggtcgtgtaatgaaaacaatctgatatactaccttcatcccaaaaatgtaataacttttaactataaatctggacaaaatgtttatatttgagacgaagggaatatctgctaagttaaaagcaattaaataaaaaaaactttcggtaaaatttctctggtttttcttggtt

SEQ ID NO: 97819 - DNA, 621 bp, Oryza sativa
gggcacgatgttcattagaaaatttccacgtttacaaagtaccttctcccaaaagtcattttatgtggtacctcaaagttacgatgaactctaacaaaatttgcctagaatataattatgtgagattgtattataaatattttattgcaatgaatgtaacggtgtgaattagatggtaaattagataagtattttaaagaaaaaatataagaaggaaaaacctacatacatgacctaacaaaaacactcaatcaaacattatcccatagcgcacatggctaccaatcaagcctcgtcttacaagactaaatattgtgtgtgtactactatttagattttgtgttaattgtagcatatgtatcaacttgcctgcagcccatttgtcgaatggttggttggcacgacacaacttttagacgggttacaccgcgacaaacgagggtgatgcgattgctcgcgtttgatcagttacgaagtgggatgcaaatgcaagcgataacgaaaagggagcatcgcttacgaaaatcgatcccaaccaatctgctgcgcgcgcgcgcgccgccaaggccactcgcaagtcgcaaaatcatataccttcatcggcgtacgtgagtgagctcg

SEQ ID NO: 97820 - DNA, 1819 bp, Oryza sativa
cttcctttgggattaaataaatacgatacctttataatactttcgggcgaaatgctacaatggtatatccgtgcgcttgtggatcctttctgtaaaccatatatataccaggaccatttctagcgtcattgctagacattcatatttctagtaatattgttaagaaataccaacaggtgttaacagcgaaatttggcaagatagactcggatttcgagttggaattgaaggggaatcaaagaagattggatctttccaaatatggattacgcatcggttgggcattgcatcggttggaaatagagttggagtctgatttagccgatttgacaagtagccgactagcctgacttgggctcggtttgggcctcgattgagatgaccgtcattgtcgtttagagatagagctcatttaaggcaattgtatctattaattaggatatttatatcggtttgagttagagatatggtaagagtccatggtatggacttgtttgtattttatctttaggaaagcttgagtcgtgtccataatggacaagttttgtactcggggtaaaaatataaaccccagaccattgtaataggggagacaatccaatcaatacaactttcagcgtatcgccacccttttcttttacttttcgacgagttcttatttcaagttggggcatcggctacgatctctcgacaacaaaatagttataacacaacaaatttaataaagcgaatgtaataatttaagtcaaaatacatttcgcaaattatgtttcaatatgctcaaggagagcgtgactgaccttagtcaacgaacagttttctgctgccacaaacgatggacctaaattgcgagatgggaacctctaaaatgatagcaactacaccaataacaaaacaagactaaaactctaagaaagaaatgatcacattacataaaaataacatttttgggccctttaagttataaaaaattaagcaatttaaacgggtcaatttggacctcgtatggccaagatacgaccatccaaaatttagctataatttaaatggagacttccaaattatttaatcattattgtactattaaattatgtgtaatacatcagcgctcgaggagagaaaggaccgagcaactgattgtcgagacccatgggtaaaacaggtagttcaccaaggactgggttccccgagatggtccatggtaaaagcagagataagaacattcttcgagtcggtgagggcgacgcaacttcatcgaacgacgtgctcaaaggaggggatggtgttcctgaggtcttgataaaccctgagctgcactcaatacactcacggctatgattggcctgatctttcggggagttgatgataactgtaatttgggagaacttactacaaccgtacgagacgctattgtgttgtgccttagcgatcgatacaccactccgtgggttgttgatcttgctggtgcaaatcaaccttatgactgcaagcaaatcaaataaacaagtaagaacaagataaaaaaaaaggtaatctgaattgctcataggaattgaatacacacaataacttgatatggaggcatgctcaaggaagagatcgacgaggcgtaattgacggcgacgacgatgcagcgggacaatgcttcggtgagtcgggaaaggttgccggaggaggaaggcgatggcatcaccactggtcactggcgagaacggttttctagcttgttttgggctcgacgaaggggagcctggggaacaggaggtggctgcaacaccaagggtggcagcgccggggtgctgcgtttcctccggtcgaa

SEQ ID NO: 97821 - DNA, 1413 bp, Oryza sativa
aggaattaagttgaatatatatagctatataattatatatatatttatcttgcgatcttgagtcttctgacattttccatccaagttgtaggtctgatgcatggcttatttcaagatgtagtttctggtttgcttactaataacatctcttcaggtattcattaattaggaactactatactttacctactggaaggaggatttgtttaaatctataaatttgtgctggttgcatcctcaacaataagttacactgatctctctgaaccaagtacttcctctagcagataatatatgaagttagattttttttttcaaggtccaatgcatggcttaaatcataattttatattagataaatattataagatctaataagtttatgagattacaacagtacttattggtgacggtcaaaatttgaaaaaaatcttattacaaatgttaaattaatatttgtgaccggtgggagcatgtatctatcttaattatgtgttttgggatgcttttattatatttttctgcataataaaatattttttgagctcttttcattctaatccccccctccccccccccaacctgtgtgtgctcctaaaaagattgttccctcttatgataagtaatactccattatttcaaaattaaactaacgtatgccatgtaaaggaaaatagagggattatatatacggttatgcttctaacttcacacaagtttataactatactagttaggcacttcgtagtagctcacacataattagacgggaagatcttggatgaattgtattgttatggctgtagatttgcatttaacatcgttttgcatattaaaaacccaactgttctgaatgttgggtaatttagagctcatctattataagctatgggcttaattatgacaagttggcatatattaagtatgaactattaaaacataaaaaaaaatctgtaagtgatagtctatactgaagtagaacaaaataattacaattttcaattttataaaattattaaaacaagaaaaatgatgtaattgggaccccaaaaccgcgtacaactacgtattattaacaatttttttattaaataatgccaactctataattgagtctccaaacacgaaacaattcaatttttattaatttcaaattttagactcctcgaagcccttgagagcaaaagagctgcacgttaactcctcacactacttaaaaaaccatttttccaaacggtcggttcctatttttgcgtgtggttgagccgctcatctgccctaaaatgtctgcaaaaatcgctattttttcatgcaggtggcgcaaccgcatgcggtaatttgattttcgcgtgtgggtgcttatgtcgtcctcacgcaaaaacaaaaaaccaaaaaaaaacaaaaatctcaaaa

SEQ ID NO: 97822 - DNA, 671 bp, Oryza sativa
ttaagggtttcacccattgttcccaagatatactgggcgcacggaaaacagaacggtccattagcgcatgattaattaattatttactaattttgttataaaaatggatcattatgatttttttaaagcaactttcgtatagaaacttttttaaaaaatacaccgtttagcagtttgaaaagcgtactcgtgaaaaagcgagaagtggtagttgggaacacaaggtttcgaacgcagcctcagatgcataaatactataaatatatccatcctcatttgaaaaaaagaagtagaaaatgaaatatgctcaagacttttggattgagcgagtactaatttgtctagcaacctctagaaataaactctctagagcaggtacaatagcaggctataagctagctataaccacataacaagaagaaaagagaagagagagaaaaaagagggctactaatttatagccagctgtaacacggaccccaagacgttatgtgtgtatgagaggtgggatcggatattaatggtgtagtatatttttatagttaactcttgtatgaataggctacttcctccgttttataatgtaagactttctagcatcactactaaaaaaagtatttttccaagcggccaaaagtgatttttgcaggtggggggttggaccgcctgta

SEQ ID NO: 97823 - DNA, 984 bp, Oryza sativa
ctgccatgccctgttttcagtaaatgaattaatcattatgagctaataaaaaaattctggagaaaataagaaattctgtagactgcctaaaaagattctgaaaattctgaataccacatagaaagttctaaaatttgcttgatttttgtaagctatttcatttttgagagctatgcattttactcacctcacattcaaaagaggaaacagacttgagtgaggactgacatgccctgttcggaatttatactagggcataaatcaattgctctctatatgttagcgtagaaaggtgcggtctacatttagatagtcctttgtactcatattgttgatttgttgtgctaatgatatgcacttctgcagtactgacttcaacttcttgtgatatttagtcctagatcatacatgtgcacaatgaggtacgacatacatctaataacttcagaaagttactgattaatctttaaccattagctccggtaatttcagtctggacatgtgcgtgatagtggatttgcatgccaaaattggttctgtaactcttgcagccttattttccttgcttgaaggctaactattcatagcgtggattagtgcccaatgcagagcactgccaataatgcatttctccctctcgcaggtaatggagctactaatagccttgcagtaatgtgcttttgttcttgcacttatggagaatttggatttttggaactcttagtttctgtttgtatgcaatgtaattagtcttcagtgtacttatcctagttgatcgtgctgatggatatgatgttaaaaatgagtaaatcaggtgttgcgaatgggtgaatgattggtctccattgacattttgattgacattttgttagcagctcaccttggaattataattatttttaggaaaatacacccacatttacgacaacttgtaagatgggtgtagtttagtcactcattttataaattgctcaaattaatcat

SEQ ID NO: 97824 - DNA, 506 bp, Oryza sativa
gatggtgatggcgaagagggatttcgccaggtggctcgccgcctgggcctcgccgaggtctgcaccagcgacgcctgcaccttggagtagtactcgatctgcttgtccaagctgatgcactgatcctgcattaatgtttaacacaagtaattaaaaccaattttcaactctaaaacaagttgaaaacaaattgactatatcactgtcgacagaaatatgtaaaccatttgtattatttttttaaaaaaaatgaactttatatatagtgcgttgacgactaacatgcatacatataatcctacgtcctggtaatgtatgagaaaagtttgttattgcaattacgtgtacgagttgaaactaattagaactaccttgtttgtagagttgaaaactccggggccacgtgaagcagagttgacgccattcacgtagttagcactgctgctttaccatatggcgaggttcggtggagatgtcgccaacccaaggttttcagctgcaatgca

SEQ ID NO: 97825 - DNA, 581 bp, Oryza sativa
cagcaccggtagcttggcctggggaactactagacgtgtgaatcggacggtgggccgtggggcggtgtgcttggacgaacaagcacgctggcccatatggcccaacgacgcagatctggaaggcccaacataagctggaatcctggaattttgatgggccacgaaccacgtttggaaaaagttcactgccggtctctcatctaaggttgagtttcgatcgagtctctcaaccgcgaaacaatgtactaacgcaatccttatctttaccgaacagaggaaatgtagtcccaacgaagacggtttcaacgtgccatattgatttgttctttatctaatgtggcgtctatgtgaaacttatacgataaaacaacaacaacaaaaaaaagtgggtcaacgtacatgtaatccatagagaagaaatatagtgtgcatatggcgggactatatatttaaagtggttttagaagatgaggggcactatccaaactcaaccgttatatgcggaagagtaaattgcactagcggtccttaaacttgtaacgaggtttcacttaggtcaacgaacttgcaaagcgcatatc

SEQ ID NO: 97826 - DNA, 685 bp, Oryza sativa
ttggatgtgttcctcttcctttgtaacttctcttaatgagatggcgtgcaattcttttgtgtattcaaggaaaaaataaattcattctgaattgaagatgcacaggaaaggaaagcaattaagttaatgtgaatcaaggaacacagtgcatttgaataaatttaagtattaagagtatatgtattggaacctcttaataattaccaaatgtttattgggttctgctcagcagtgttttctttgacaaaaagtttgtttttatacccacaatatataaattatgaagcttctgcaaaactctttagtattgagtaagctgttgcgaacagatagagcctcagccattattaaatgccctgtgcttatttgatcccgtgcatatatcaacataaggtgtttgtgttggtggtgtgttatatgtgatatttttacgagtaaatatgatcttcactagctgaaattcagttcaatctactgattaaagggtccatctttgggatcaaatttatgatttcttccggtttgaacattgtttttataaactcttgtagatggtactgtttggtcctcccacacttttagtgatttatgtcacagtgtgacctaactggccaaccaattacatcagaactggagggcattagtcgcgttcctccaccacccccatcaacaaccttcactgttg

SEQ ID NO: 97827 - DNA, 950 bp, Oryza sativa
gctaataaaccgaacgcccacccctactggttgccatgcttcttcccatcgctcgccacctttatccaccggcaaatgcacgcgccaccatctcgtgtagggccatcgtgagggagagagattgtagagagaaggggtgagggagggaaagaagagttggccactgacatctggggcccatgtgggtcctgtgctaattaagatgggttgaccgtagtcaactcgtcatgtcagctaaaaccaataactctattgcctaaggatctcgtgtacacctatattgcaagttgagagatgcgttatactttgtattatggtttcaaggacgcaatttaaactcgtcgttaagatgatggacctaaagtgaacttatttctttatgtgaagtgttgggtgtaattgggttgtaagttttgcgtctagtgtttttggcccaattaaagccaaacacggccaagactactttcgatatcgaagccgactgatacctattctgtcttgacaatactagcgtcgaccttcaggaggccgagaagaatggggattagagaggatagataagagaagatgggagaatcaccgacaggtgagcctcactttagtttttaatttctctaattattgggctatccattggactccatgtggccaaaaccattctaaaaccactgagagagtatagttttgcatatttaatagttggaggagtaaatatacccagttttatagttgaggaataacaatcggatctgatctttaaggagggagtataaatagcctttttcgaatcttgattacttgaatctgaatggaccaattaatcattaccagcgggctgacccacgcccatcccagattcccaggcccatataagtgtgacttttagcccaacaggagaaatgaatttcgggcttctgcgcctaaaaacgagagaaaaagaaaaacatatg

SEQ ID NO: 97828 - DNA, 615 bp, Oryza sativa
tagtctgtgtgactcgtgaaccccagaaaagatgaagcatatatatatatatatatatatatatatatatatatatatatatatatataggacactcatatggggcaccatggtgcccgggcaccatggtatctaatgcacaaaatcactcaaattttttaaaattttcaaattgtgagtatatacctagttataataatttgattcatacctatacttatcaacaaaacaagtcaaatttaactttatttcacaatacatgattacatacctaactaattatatgtatggatgctatatacctagaatcaaaatctaacaaaaacaagttcaaattcagttcaaacttgctttaaactagttagtaaagtagttaatgttaatacctaggtaattgaaaaagtttcatactcatttgaattgggtatatactcaatttcaacaatggtgcccgggcaccatggagcaccaaacaaatttactatatatatatatatatatatatatatatatataacacctttaatttgggaactgatccgacgaactcgacgaggtaggaagatcggagaggggacatatgcttgagcatgacacagtacatgaagtaaggaa

SEQ ID NO: 97829 - DNA, 540 bp, Oryza sativa
tacatataaattttcctattatcgtaacaactcattatcactattttaaaagctcgctaactaccaatacatgaaattgcgcataataaaataagcctaatatattattaatacactacttagctaagtgtttatgtctcacttatttccaaatccacatataaatattctaaaaatatcactaacgggtgaagccggtcatagccgtagagactttctttctctattaccttgaaaattgggtagttgtgtcccctcaagatcagcccgaagcacaattttaatgtctaatttactataaccctttcatagagtcctatgacacactgggcccactcaactcggccatttgtatgccacgttagagggtaaataacgggtccaccaatttaaatgaaaatcgatggtgagattatacagtaccatgtgatggcctaggagcacttatagcagcgtcatatggcgacttaggaatattaatagaaagtttaatgaacgtttagtatataatagtttttcttgctgcgaatagtagtaccg

SEQ ID NO: 97830 - DNA, 705 bp, Oryza sativa
ctatgaatttaatataaatttcttggagtaagtgcatagctaatttctgcatgagatttcaagtttaatagtatagccaactactagctccaaatcatctatagccaatttaatagcccattaatacaatagtttcctcacaaatatatactacaccaataatatatagtcctgtctcatacacacacaacgtttagaatccctgttacagttggctataaatctgttgcccgctttccttccttctcttctcttctctcctctatatgtgcttacagccgacttgtagcttgctattgtactcgctttgagagccaacactattcacttttctttatctttcccttccacataagtttatactagttggcttacggtaagtactataaaatatctttgtcggaggcgtagttggatatggctagaaaagagaatcgaggtggtccaaagttaaaaaaaagagagagtaaatttaactagtccaaagcgataatattgagaaagaagatgaaagaagatgaaagaaaaaggggattggagaaacaaataaaataaaatcatttggattagtatactagagatagtgtagatgtggtgtatcgtttatatcacctcttatcttacattacatatagaaaattagggattttttaagagtacctttgggtggatgttggctgtctatgagatgagatcgtacggagg

SEQ ID NO: 97831 - DNA, 542 bp, Oryza sativa
ctctttgggccgaatctgacccaaagctcttactctttcagcccgtgcaaaagcgtccacttcttatacccctccactcttctcctgaaaaaaaatgcatactaggtcccttatttttacatcggattacaaagtcatccctcaacttagggtgtgtttagttcacgctaaaattggaagtttggttgaaattggagcgatgtaacagaaaagttggaagtttttatgtgcgtagaaaagttttgatgtgatggaaaagttggaatttttttttaaaaaaattacaactaaacacggtgttacaaaaccaagtcactctagatagttttgaccggttttatccgatatggcagctgagtcagcgtgagaccgatatggccagctaagtcagcgtgagacatgtaaaccccacgtgtgagagtaccctctctctcccttcctccttccccatctctctctctctcccacttttctcgtttcaagaaaatttcatctgggcaggccagccgaccgggcgatcgaggcgggagaggaggaggtcc

SEQ ID NO: 97832 - DNA, 638 bp, Oryza sativa
taaattttagccttagctttagcttattagggcaatgtttcaaaaaaaaagtatagtagagtgagtatatgcgtgtagacaatgcaaccgttatgtcaacatcacatatacattgagctatgatcactgaacatctctcatgcatgctaactaccagctcctaactgtctccaaactgccactggggattaatgtactactgtcttctactaaccacccggaagcctgccatgtgttttcagttgtttttttttttaattcagctatggaatatctatacaagacaaaaaaaaaattaaaatattctagtattgtttaaccttcagcttataagcaaccaaaatttagattttaaaacctaattttaaggtttattttgttatagtttattttccaactttggttttgaattaataaaaatacatataaaagttttcttcacacattattgtttagttttatcaataaaacgttacggcttataatcagtataaacaaaacgcgacgtactcttttaagtttcgtgtagaactcaaggctgaacagaacctagtttgtttggagacagagactgaagctcgcttatatacaagtcaaattaatgtagaaattaaacgtggcaaatagtagtaagtgat

SEQ ID NO: 97833 - DNA, 682 bp, Oryza sativa
aaaaaaacttaataattttaagagtataaatctatcagaattttatcttttttttcttcacatgtagatgaatttgaatattagactttacacatcctctctccgtcacataaaaaataaatctagtacgagatgtgacacaaattagtactataaatttgaccactgaaaaattattcgtgtgtttcaaaatatattggggctaaagaaaataaagttaagcatagcggacctgttggagggacctgctcacaccagataaagattgctcctttaaattcttttagcctctggatcgactggtgaagatgaggagctgagagatgcatacagtgtagacatttcatgtggcagaccaataatcaattatagttagttacttatagttagctagctagagaaacgacgaataaagctgcgcgcggccatgcatgatatgccatccggcgacttcgaattcgtactccacagcatcgcgaaaagagtcagcatcatatcagcagcaagaatgagctggatagatcgagctagttgacatatatgcatgtaagcatgcaggattaacctagccatgatcgatggtccatccaaattaaccgcgctgctactgtacatgcatatgatgcattgacatatgaatacggtgatctgttccatcctactgtaccaagatatatatagg

SEQ ID NO: 97834 - DNA, 843 bp, Oryza sativa
tagttgctttaactttcagttcattatgcaacaaatggcatgcgtatgatttatttagttatatacttgacagtagcagctggttttagtagtacttgttaagtttcgccgcaattagcatggcttttcagacagtacaagctactataataatcggcccaggttgatgcttgccaggtaatgcataaactttatgtcaaaggagattaattagcatatgcttttaatttaacagaatatggaatcacaatcatagtcctaagttcttcatttcttgcaacaagagtcactaagatgcttagatccaaagttgggttgatatttttcagtcacatgtcgcaaaacttttgtttatgtaaatcctaaccttgtaaaagcggcatggaaactctagaacaatggtggcggtgaagtgaaaaggaggaacaggaagttgcctgcaaaattttgtaaagctagcatgacaatgacaaagtaggagcagaaaaggcaagaaccaaattcctattctctgcagttccaggcttccattctattccagtctttttagctgagttgctgtacttttatgattctaagctagcacactactgcacaaagaataggacatattcagttctgttttttttcggagagaccaaacaagactctacttcggctctgcatcacccaagcatgtaactttagagcgtggaagctgctggtaggtttcatcaaagttatagtagaataattttcatcttgtttccaacaaatgccatgttcctgaacgttcctttcacttcaacgatcgaagtagtaatataagcaatcaaattgggatcaatcaagagcaaagtcttc

SEQ ID NO: 97835 - DNA, 708 bp, Oryza sativa
caattaaaagaaatatataagtctttatgcatacaaatacaaataagcctcagacgcttatacataattaacaaaaattgtcagatagaagatataactgcaactatgtaatgaaagatataaattaaagaatttgtcaaagtatagctagaatctgaattctttggtgatcactaaaaataaacactaggcactgctcttgttcacatatgtttgctcactcaacttaatttaagaacagaaatcacaaaatagttttagttttcagtaattcagtttgagggaaactgggaccgagaggaaattgcaaatatgaataagtggatgatatatagcaattgtgcgctttgtgcttgttgagcaaggccctgttctattcttcaactccaaactctaacttactcatttttcatatatagcacgtttttcaaactgttaaatggtgtgtttttaaaaaaaaatctatataaaagttattataaaagcaaataaatttatttcttaaatttataatagttaatacttaattaattaattaatcagctctcccgcttgtgaatacatcatccttctggccatcatcggcgctaccccaaaacccgtgtcggcactcaacagttcagcacgcgcgctcacacatgtactcctacttgttgctactccaggcttccgttccaaaatataaaagattttgggtagatatgataa

SEQ ID NO: 97836 - DNA, 748 bp, Oryza sativa
tgagatcattcatcaaacacagtttcctcacttgaatctgatcgctgtgccaaatgttgcgataaaactacatgtccgtgcacaggttattaataatggtacgtctttatgtttgatgttaggaaagacttctatagtagaaagatacttaacctacacctgtaacaggatcacagaaagcatgcttggtaattcttcaggctcccagtgacctaactagcaacacaaattcacaatagacaaaaaaataataatctccaagccactccagatatgaaattttggtattataataatctccaagccactccagatatgaaattttggtattataacaaactataatgtgacaacatatccctgatataaaaaagtgtaacctttaggtcagttaacaggtcatcacttcgttttaaaaatgtgacacatcatacgacaccatatgaccataatagtccatcaagcagtaatacagtccaaagtgcatgcaggaaaagattttgatacattgggcaatacttcttaacaaacagttaatacagctgcttccaagtaaattttaataaaaaggtaataagttgcaacagaacgataaagaaaacgaaataacaggtaacaaaaagaataaccgatcatcttaaactacatgacatcttccatgtcccaacttaagccttaccttccacttgtgtaagggcatacaagcatgcatacaacacatcccctagactacaaaaagaaatgcact

SEQ ID NO: 97837 - DNA, 672 bp, Oryza sativa
agcccatatgtccacataggagaaaaccccggaaaaaggagtcgaagcacctctcttcacagtgcgggcacgcgtagtgtagctttaggtggaccccatcaattattttcctgaggccgaccccaccacgacgtttctcttcatcttcccggatcaatctctcctgcaccaaaccaacctccgctccttcccctctctctcttcctctccctccctgaactggcacatgacatcaactcccctccccctactctcctcgtcagggtggaatttgtggacgtgggtgcctccctccccttaccgtgacggacacttggtgacgacgaacttggcgctcccggtggctcaaatcgagagctggcgtgggcggcgaggtcccggtggctcggatcaaggggcggcgcggccaacgagctccaggcggctcagatcaagaggcgcggccaacgagctttccggccccacgccgcttttcctccgccgcaccatttctccctcctccccatccgacggcgcatcgatgcagacagagctggacgggagcaatgattctagcgcgggaacaaagatgcagagcgagggagcagaggattgaagctacgacctccacagcgcaacgcgaggtgattccctgtgtcacgcgtcctcctttcgacgagaaaactcattgcc

SEQ ID NO: 97838 - DNA, 549 bp, Oryza sativa
aaaacagtagatcaaaattaagaagaaaaagtgctttcttgatcaaaatcaataaaacaggagttctgggctagctagttgctaccaaccatgatcagccccactgtcttcttcattgtcaaatcttcgtgctgaagccaagggtggagctcggaggacgtaggagatatgctaccggcgtgaaggctgacatcagtatacaaaggtcaaagggggcaagcgctctggatttttcacaatttggtcctttcaaaaaatcatttcgcaaatagatacctgaaaatacttatcccaaaaatggtcctttttgagcgccagagtcgctggcgccgtcctcctaccaccgtggcaggtcggcgctgaggtggcagggggagcgtgccaatgtggctgccccccccggcccccgcattttttttatttttcttttattattttgatattttttcatggttaggaatataccagaaccaaccatagaaaaaatgaactcaaatggacgaaatacgtgacttgtagaatttttcctctctagtgtagatgagagag

SEQ ID NO: 97839 - DNA, 522 bp, Oryza sativa
tgaacatctatatagatatttgagatttataattttcattcaacgaatgcctaagattcttaagccagtaggagcatgcttgggagttgggtaacccaactataccagtgaaataatagccccccattactgaacatccacggctagatcagtggagtaaggtgcattactgatccaaaaaatgggtattgtcgtattgagcattgcatcagacattgaatttcagattgaaacatcaatttggaactacaaaaattgataaatcgattataaattcgtagcattgatcatcaaaatctcggaatagaatatcaaattgaggtggaagtagcagcctctttacaagaattcaagagcacataaggcaactatgtcaacaagagctcgataatttgtgcagacaatctgatgaacaaagcttgaaatccctagattttaataaaacgtaacacgtcggcttagctgtccatgaatcacacttgagcacacaagaaaaacaaatcgcaagatgcttcaacctac

SEQ ID NO: 97840 - DNA, 1440 bp, Oryza sativa
ccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacaatattaatttctctcatcagctgattgatcgatggttctgaatttcctttttgatcgatcaatattgttaatattttctctcaaagtttttcataactattcgagtgacatacaaacaatgagagaggacatttcttcgaaagtttaaaatattttccctatttcttcagacaaccaaacaggtcgatcgtcctacataaactctcgatcgctagtcgctatgcatttcttcagagtatattcgatcgagcagggaggagccgtacgataaggggcaaggagagatcgataggagggtaggaagcatgcatgtaccggacttgcttgcacgtggggagaagaaggccacgtacgtaccacacgcgcgtacgcacgtacgcacgaatataattaatgtagtaatgtataatcacacatacaattaattaagcaggggcccgtacgtacgtgtgctcctccttaatctgcatctcctatatatgcatgtctccttcttcttcgatcgaattagctacgtactgctggtagcttaattagctaactgcttaattgtcctgatcaatcgaattgcagtcgttatgcagcttctctctttctccaagctagcttacaccattggccggctccaaccttacttacttcctttgacccaatgcaagtcgatttctgcatgcacgggcgcgtgtgtacagatgctgcgtactacagcttcaatattcagtggccgaaaagaagaaatatgtacatggagagtgaaagttagctactagtagttggtaggtactgtatgcgtattcatgcgtggtcacttattccttccaaactcaacgacccaattaaggacgacgcatggccgattcagaaaatcgatttgttggtgttaaagtgtgtctatcgttgttataatatgttaattatacttagattatgatgttataatatatagataaacaattttgctatagattttatcaggggcggaggcaggcctagtgcagctagggcttgagccctaggcctgcctccaaaaacttgcttaaattttgttgattcaccatgtaatttttttagaaaactaatactccattaatcgagccctaacttagctctagtcttacactggtggagaaaccatctttggtcggttggccaaattccacaatagtcccagttctaataaaaaccgggactaaaaagcatctttagtcccggttgaaaagttgaggtgtacttttttatctttaatcccggttggtgtgttaccaaccgggactaaagatcatttttagtcccggttcaaaaag

SEQ ID NO: 97841 - DNA, 672 bp, Oryza sativa
tgattcgattgggatgcatggtttgttgatttcgttgagttgagttcttttcttgatgtacttgcaatggggtagaaggctagatttgcctggccagcgtcagttgtcgagattggtttggcttaggacattgtcggagatatgggcccgagggtatgcaaagtgaggggaagttaccttcacatccagccgcgtggctctacagcctggccctacccccgcacctcgcgagtcacagaggcggccggggggcctcggggtgccacgtcatgcccctcaggccctcgcgctgcccctccccgaggccctcgcccaactaccatgtggtggggggagcaagcggggaggagacccaggctgaacggccatcaatgcgcggcgccccaactgtccctcaccgcgtttaatgcggtaagggcggacgtgcggtgccgcctgactgacccacgtcaatcgggtgtgaccagtctgtgaccggcctgttgtcggccacgtccgattggacgggtggccgtgcccccacgtcgcctctgtatccggcggagtggaggtaggtatgtcccgtcccattggggcgtcatccggggttccctccacgcgaggaggactgccacaagtcttcactcatttaagagggaatgatagggctgtcccccgtggcaagcggggggc

SEQ ID NO: 97842 - DNA, 742 bp, Oryza sativa
gatctcttaaacccaaaaaaaaaaaaacatcttcactctagatcataaagccaaaatgaattcatgtaataaattctatgcaaaggttattttatgatgtgctggagttaagaccacaatcttgatagttgcagttgtgaacatacacgcaggtatgcctagagttgggagcatgtggaacaatgaccacattaacatagaaacagtctgttagctaagtcacaacacacatgaaatctttcttagagaactaaaaggacataaatatcttatctgagtacatccagttctatggtcaataaaacacaaaatttagaattttcaggcaacggtgtcattacaacttttcttaattaccataactgccaacattaaaaaaatagtcatatccaaatttctatcttacaatttgcatttccccccagggtcagggcgaccttgtttaactcatttcaccctttttgtaccataagagcttgtgacttggaggcaaattcgaatgtcgaatatgggttgtctccactttgaaatatcatattgttatagtggctttcaagattttttatagttttgtttcaattcttcacatatttaggcactcagtagagaataagagggataaattatatgtcttaacagtttaacacttgcgctaatggtagaagaaaaatcataaggttccgtaagcaactattgcaatacatgcaactgaaaaggaaagactatataggccacaatgtca

SEQ ID NO: 97843 - DNA, 533 bp, Oryza sativa
taaaaatcaactaaattaaaaatacattgtttaaatcattttagaaattattttaaaagcctacaagctaaaccctaattatctaggaaaattttcaacataaaattgagctagataaaattttattaaatacttgcttgttcctctattttctagaattttctgggaattgtttgagcaagggaagtatttttaataaatgaaacaacatttcacaaattatttttaagtaaaaagttccaaaactcctccctgaagccgttgggccattttggcccaacatccctcccacatcccgtggccgagccggcccatccggcccaacccgccaccaccgcccctccctcgcgtggaggccgacaggtggggcccacctgtcggtggtgtctcctacctccggccggctgcaagccgagcccgagccggccgagccgccgacttctgcctccgtttccgccccgatctctccacccctagtccggatttttgaggggtttttatccccacatcttcctctatctttcccctcaaga

SEQ ID NO: 97844 - DNA, 662 bp, Oryza sativa
ttgtcatgctgttttactgtattatcctgaagaaaaatctattttgttattttttaccttcaactagtcctctggtttggttgtgaaaatatgaaatgtgcttttgtcttactaagaatcaacttatgactttatacgtgtgctacaagggacatgtttaacactaatgaaatcagacttcatatgacctaaaccgtaaatattagtgacaatctgagagaaaaaggtcatctgttagtattggagcttaggtcagtaacggaagctcttcaatttgcctcttgataggttcttcaactgaggtgtttcagattattgtagaagaagttccaaagttttaagactctgaattagcgtatgaaattatgcgagtttttagtggcttctggtcaacaagaatatcagtatcagctcacggatcataaaataaatgcttagacaaactgactataaatggtaaatgagattacaatgtgatattctttgttatactaagtgaagcatgaaaattcaccagggtccttaaatcagtttatgtatagagacagtctataatctgacatttagcatgttatttgaccagtaccaggagcctctagtggtgtaacttgcaaggcgtgtgaaaattctctatgtcggattatatgcttatgatcgtcctt

SEQ ID NO: 97845 - DNA, 780 bp, Oryza sativa
ttgttcagagatcttccaggatgatgctaggctgatattagatacaaattcaagaaactagctgctttcaaatatttgcatgtcaaaatggatccgatatttactcttgagtattccgaaccaaacaccaccctagcttgagatcgttggatcgagattgaactgttgaagttccactgctctcatcgtgatcattccacaaggattcaagtgccaattattgcttatctcatgactgctgcgaaaattagtctcgcggtgcagctatttacttgttggttaactgcctatatatctggtatgtgcataactgtcccatgggcaatttatttctttacttgttatattccaaaaactttgttagcaaatattttttttgcagctgctgttgacattgttcaacaaatatttgctctactttctgattagcatttaattttctcttgtccaggaagttgacttcagatggccctgctttccattttcttttaaaattcactttgcagaagcaaatggagggtaaatttgcaggtgagctaacttatatttcatgaaaagtgtatgattggaaaccatagaaactattccacttgttaccaattgcataagtggaacacatatttttgggtttcgtgctctcctttaaactcacagtggcatcttttatttcttttaatgtagaagtaacattataaattggattccttgcatctttgtttgagcatgagaacatatttacatgcatgtgtgcttattaaatttggagtcaatgcccttttt

SEQ ID NO: 97846 - DNA, 588 bp, Oryza sativa
agtcatcctcctcagacattcatgtataaggtccatgtcaggggtgcaatccctcttggcgatcaaaaccttccctttctgcgacatttttttaaaaagaaaaggtaaaggggaatagattctcatggccatgatgaacttccaagcctcctgttcatttcctggaacgaacctgtccagcgatgcattatgattactggcaatatattgcccggacactgatcatgcgcagttactactgttattgcatctttcccaggggaggttaagcagcaagcatgtgttcaaagatctcatcattttatgtcgaaaaagtcctgatcatttggaaaaaggaaaatcattgaaagaaactggccgccatacctggtctggtaaatgacgacggtacccgtttcttggtctctttgtaaagttgataataaccatatttttttttctaggggtaatctcttgtacagtatggttggtccacgcccgcctgctattctggtaaacctgtaggcacgctcacccgaccacagctctcgtgggtgagcaatgtgccggtgacataccataaaagaatagaagagagaccttcgcttg

SEQ ID NO: 97847 - DNA, 661 bp, Oryza sativa
tccggaacaccagtgcactgctgcaataagaaattgatgggcatctggtggaaaatgttgtctaaaaatgacagttatttgctaaactaattgatgaaaacagcatttattccctcagaacctaaagtttagttctcagattatggcagtaaaacttttaaaacatctacttcctctgatccaagatataagatgtccttacgcagttgttccactagaagcagtggagtttgtcaagaggggagacaattgtagcggtcactaggtattaggtaataaggacagtttagaaagtaaatgcttaggaacggcaaagcaatagctatttgcagattgaaacttgggaagtaaagtcacaaagtttagtttggaccagaggtgggttttttcccccgcatgtttttttctaaaatttttaatagaggcttctttcattataaaatatccagcattatactccctccgtaccaaaaagagtgtcattttagcttttggatttgtcccacaaagagtgtctttttagctgtgttgtccactagacctcttaataccacttctttttcttctcgttttagccatccaaccattagtactcccttctcctcgttttctccccctcgtcgttctctctgcattaatggaggggcatggtagtcttttg

SEQ ID NO: 97848 - DNA, 581 bp, Oryza sativa
atgggatgggcatttggtctgaccgaaattttcggtctcggtcttcggtctttcaggcatttcggtctttgaaaagtgaagatcgaatttcaacgcagaaatgtcaggaccgacaaattcggtcttggtctcgatcctgactgaaattcagcaacattttcatatgtgcaaagaaataatggaaatttccaacacaaaaatcacaaaaaaaatcataagcacgtatgagtaaaaactcttattaggttgcatgcctagaagaagtagggatgtgaaaattagagtttgatcctattgaacttagtggattgtagattgcatttagacatttttttgttaatttagtctatttggttaaccgaggagactaaccgaattgaccgaacaaaattcggtctttcactacttaggaacgaaatgatgaccaaatttctcggtctcggtctcggtctttttctgcacacccctatccaggtatctgattatgggcgctcctccccaatcagtatagtacctagccattacaagttcatggccaccctgtcatcatctccttacgtgtctatgctacattgtagtcg

SEQ ID NO: 97849 - DNA, 3574 bp, Oryza sativa
aaagaaacaaaggggaaaacttgctgtaaggattaaaagcccaattaatgattagccgggccatgtcttgtagcaatctttcccaacaatatgactatgactaagataattgtgatagttaaccggtgtagcaagagttatatattttttgcctcacctagacacatagtgttaaccaacctgtagttacctgaattctttcgtatttaattagacactccttgccaaaacataatttaatgcagcttctaaaaattctaccacctgagttctttcgtattttatatcatgaaataatctcctagaataattcaatgatgttgtattgatgtagtctatctatatacttttccacgtattatttggttgaggtatagaagaactgagaaagcatatttagtgtgcattggaatatgcatgagtgtacaaatactcgtaaggttgacatttttttctttttaagctaaacatttaagaaacttttaatggtcaaaagtttcaaaaacctaaaaatcaaatactttttgaccggagggagtaaccaagtcagcgcatgccacgtctacctacctgaaagttcataattacaccctatgggttctagattaaatatacaagaacagaaaaaatgcaagatttgcgtccattttagcatataggtttgtgtttcctacctttggttattctcaataaatgcaaggttttcttcatattttgccacattttcttgtttaaatttcctacaccattcatcttagttttttcatcctacatagccaatcaacacctggggctcaacaccttggggcttcatgcatgtaaaagtaactttgatagtttacagcccctactactgcatcattttttccttttgctgaatgatatagtgtttattacctcttctttgtttgttccttagggtgaaacgtcgaacggtgaacaattggggaaaaaaatatagtaattgcttctttcaccaagacaacagtaatagcagccctcaatctgataatggcttgttcgtataattcgtctctgcttgaaaagctcctgctagatgctcctgagaaaatggagaaaagaaaagaaatgaagctataaatcctttggtacacatagttttcaaactggcagaatgtggaacaagaaaagagatacttacttacctggcaaagttgatttggcaatgtaatttacacttcgagaagagtacaaacaacgaacagtttgaaagatatcaaaacagaattggaaaccaattttttaaaacttttttttgtttttttcatcaataacaacagatagaaactaatatggatggaatggaactagtagacgagttgtttttcttttttttttggagtggttgctatagacaacggtctaaatgacaaacaacgaacagtttgaaagaacagtttgaaagatatcaaaacaggaccgagaaaccaattttttaaaaaactttttttgtttttttcatcaataacaacagatagaaactaatgtggatggaatggaactagtagacgagttccttttttttttttggagtggttgctatagacgagggtctaaatgacaaataacgaacagtttgaaagatatcaaaacaaaaccagaaaaccaattttttaaaactttttttggggttttttcatcaataactacagaaagaaactaatgtggatgtaatggaactaaactaatgtggatggaatggaactaatagatgagtttttttttcttttttttgtggagtggttgctatagacaagggtctaaatgaaggcttaagagaagaacgatgggttgcttgcagtgaaaatgaatggctagctaggaaggaatggaattgcaaagggagcctaccattgtagtagtctctcatatttgtagatgagcagggcatcaacagaacaggacattgtctaggtgacacaagcaaggaatgatattctaaagctaaaaagccagataatatgtcggaagcaacgaacctatggcctataatgctaaaagagataaagaaaaagaaaaggagaaaagaaacagaaggggtaacttgtcatgtgtatctaaagcccgtttaatgtgattaggcagggccatgtctctatagactacatcaatctttgtaagtgatcataagcagaataacagcaacggttaatcgggaggcaagagtttttttttccagctacctgagttttgtcatacaccttccgtttcttaatatttaaccagttttaatttttccatttaaactatgacactattagttacctttatatcgttaaaccaaagtgaacaaaagtttttatttatattagtacataccttactttaataacataacatcatttttagtacttgtgtgtgtgtaatatcaaagttcgaaaataaataatgcactgtgcacagggtgatcaattcttacgaaacagagataagagtagtatttaatttgacactccttaccaaaatgcgcttaagtgtaaaaagtacaatctcaagtgcaaggcttcggctataactgaaattatatatcatgaaagaattttcaaaactgttaataatgttatattgagtatctacataaatttttacctgtaaatttgtcgtgttttttcagaaaacattagttgtgttattatagatgaagcgttacatatttcagttttgccattgctaaattaccctcggtatatttcaatagtagaattagttttgacatttcggtagtgatgataatataaactaggtgattcttcgcgttttgttgctgaaattactaaataatttttaatattttttaataatcgagctaagagtaaaaagaaaaaattaatgaaaaaagaaaaaataatgaaataacaatcgagtagcagtaaaaagaaaaaaataatgaaataacaatcgagctaggagtaaaaaaataatgaaatctaggatttatcagtacttttcatgaaacatagtgaatgatgatgtgatatccttctttcttacgccagccaagtagcaatcagaaaaccaatcaattttccttacactacgacaattcacttgaactaccaacatcacgagtgactcatgccagtcgtatatgcgtcatttcttctcatccttgtctctaattgttaattactcgctacccgtagtaggccttgagtaggatttaagcatgagttccgaaccatctacttctccttatccttagggtgagtacaatagagcgatagcagcaggctatacaaatgccacgtcagttttgatgctgagctggcgaagtgaaagttggagagagagcgtacgcgagcgactaattagtcgccggcatctcgcgcgttccaggacacatccacattaatattagggtgtgtttggatcccagccattgaataccatagctacagtattttcgtcacgctacagtgttttctgaggcggacgaaacgtcgccatactcctgtggcgagccacgccgtggcgtggcattccaagccgccaaccaagcaaccccttagtcttttgcactctatacggctcacgccgacgtcctgatgctgct

SEQ ID NO: 97850 - DNA, 1223 bp, Oryza sativa
tttgaactttatcaagaggtttcgagaaatcccatagtaggattttacctgcagaaagaagtgtaatgcattagaacaatcataaaaataaattatatagtggtattttttttaaaaaaaaaccacaacacaataatttgaaaaatgcttcatgataataaatttgctgccatttataacataagttacatctttttttatttttagtatcacatacaaacaagaaatccaactacattaaacgtgatggattagttagctctttctctctctgtttttcttttctcctcccaagtctgaagcagcatggtaatgcatattactcactttgtcccagtaacattaaggatatctccttttaacttgttttatgtttgggcatacatcatacaagagtcagaacagggaataatattccaacctactcatccacaaatgcacaaacaaaaggtgctaacatttctttgattgctggacagttctctagttatttagcttatcctgcatacatctttgcgcactgaatgaattgcatattttcatgattgtccaaacctaaagagagccacatgctgcgagggttgattaagatgggcgaaataatgctgtaagatcagcagtgtgaattatagagtggacacagcaaatggtctttgcaagcatttcactatcatactaatctgtcaggtcaattttagattatggtaacaccagtaagagctttgatatattcaacacgtcttcctttttgttaaaacaaactcatatatagatcaaaatataataactctgccatcgtaattccttgtttccttaaagtttgttgtagacttcaaactgaacatttcatacatatgtacatactacccaaattattggttatttctatactcatcaatcacgccaaaaatgacatttgtagacttggattgaaccgagaaaattcaactcaaaatgctaactgatgttaggctgagttcggtacaccattttcccaacccacctctctcgttttccgcgcgcacgcttttcaaactactaaacggtgcatttttttcaaaaattttatatacaaaagttgttttaaaaattcatattgatgcattttgaaaaaaaaataactaatacttaattaatcacatgttaaaaggccgctccgttttacgtgcaggatgggtttccatcctgcacacctgaacacacccttagtatagaactgatgg

SEQ ID NO: 97851 - DNA, 1282 bp, Oryza sativa
attcctgcagcccagatacgacgaccagaaaaacaagtcatcctatagagccgtcatcctatagagccgagggtggtcgaccgacctagaacaagggccagcaatcaggctggtcaccaccttagccggagggcctttggaccccttggaagggtcagccaccaagttaaactaggccagccgaccacgtccaatgccttggccattaacctaatttcaccaagacaagcctagccggagggcctttggaccccttggaagggtcagccaccaagttaaactaggccggccgaccacgtccaatgccttggccattaacccaatttcaccaagacaagcccaagtgaggtggtggaccaaccgccctatgagtgggttggctggccaagcctaatccaaggagtgacttcggccgctcaatcgggactattggtgacacctgctgacctaagaaagaggtccaacgggtgccacgtatcccgatcggcatactcaggggtgggcatttgttgctgaccgagattttggtctacgtaattcgggtaaaaaaaaacttcggtcttctaaaaatgatgcctgaacttggcactgtagattttgcgatcgacaattcaggcacccaaaatttcggtccggtcttcggtcataaccgaagtaaccgcatgttgttgagaaagggcccggagcatggtctagtggaggatgggaggcaaagacgggagatagcatctgtggatgacgacttgtcgaagatgaagggcgctggtctagacttgctgaggattagagaaggtggaggcaagctcctcgtagtgtgaaagaagctctaggggacttagggctgagtgttccgtttcatcggtttaataaaagttcggttttctagctatgacaaccgaagtgtttatagaaaaaatagaaagccgaaccgagtaaactgagtaactttggttctgttgttcggttttaccgaacaaatcgtgggaacacgttggcaagaattccaaagcacaagatactcaaagaaatcacttgatgacacatacaatggcagatcaagagacaaggagtttttctgacctcacatagcaggagtcttggaacttggagaggtttgggcaactagtagaccatgaccgagctatgtggtaattgtatgcgcagttgcacagggtagtcgtccaaaggagctgggggcggcgagcggcacggacccgtgaaacggttgcggcggtagggtagaaatccggccacggcttcgcacgattacgaaacaacgatg

SEQ ID NO: 97852 - DNA, 556 bp, Oryza sativa
ttgtgaagaatatagttctgtcaatagctcaactagctttcgaggaaatttcagtagtgcaccagtttgttcacgaaggaatggtcattactaacagttaaatgatttgtgacattgatttatgtgtcccttactttatgttatatgccacctttattccagaattagtatgatttgatagaataaatatatatggtttattaattaaacaaaagaaatagaaggcctgcattacttatactactcgtagactactgtaaaatttgcatacacatatcttcgctagtaggcttgaagtaggagtcgttgcattttacatgaaaaaattatatatagttgagctcatcaggtcacatattgtatttaaaaatgaaacaaaacgaaaggttgcgttaaagctccattgaagtatatgctacatgtttagattacatttacatactatacaagtaagcaccggcatgggatatctcatcttaattggccggcaagcgtcatctgtgtaggggagcggtcccgtcacggaccaaaggtcattgatatgagaagtcatctg

SEQ ID NO: 97853 - DNA, 814 bp, Oryza sativa
atcaagaatgatcagatacatttggctccattcactgatctggccccatttcatcacatcattttcataacagttactgtatatcaatatggtaaatcaaatggtgacagtagccttcttcatccttgaaaagcagaacatctaaacatcatttttcagcatctatatggaatatggagtacaattttatttacagatggaaacggtcatctttggtagaacacaccattagcaagccatgagaatggtaatcgcatacattcttacttactaagggaaaatataatcctcgtataattgtattttagcatttccattctagtactgatcaactcggcatatcattcgttcatggtcgactagatcgccattgacacccaagagatgcatattcttcattctttttcaccctttcccaacaaatgtttgacgcaaaatgtagtggaccatgaaggtgtaatgataacgactttgtgaatttgatcggaattggtagtttgacatcattcctgtcgatgtccctaacacacatgttgttgatgtcgcgatacataaggaattggaacaggagcaagggcaaattgacatgggaaatggggagcttaagtgaaaaataaaatgcaacagaattcttttgtagcaaaatctatgtgacaatgcgaaagtttctgagcctcccaagagatgcatgccattacccctagatagttttgtagcaggatcgaacacaaaaagtcaaccacaagagaaaatggcgagggcattcgaccggccaaagtgtaccactgcgcgactctgtgtggccgatccattg

SEQ ID NO: 97854 - DNA, 714 bp, Oryza sativa
ctgccatagttacacaactttattgctgagcgccttcatattcattgttggctgatctgactgctgccgactggtttcttcgcctccacggctgtgcaacttcatcacttttgattggtatcactatcttcactaccaccaatatttttgccacctctgctgggcaatattatctctgtattggtcgtcttgtctctatgccaattgcgtcagctaccatcaatgaacaattgtgactacgtgctcaggggcttactagttcaaacacaagtatcataccttcaatttggacttgctctggatacatgcaatatggattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgttacgttcttttagggacttaggcactttttgcttaggccaaagtgcgcgtgatcaagtgcccaataccttaaaatccttttataccgcagttactc

SEQ ID NO: 97855 - DNA, 678 bp, Oryza sativa
aatcttgagaaatcaaaacaccattgttttgttttgctttattcacacatgaagcattgaccaaagaacttgcacaaaaagcaactttgtatttttttcaaaacgttctttgtcaaaatcaactcatcaacaacacgagcatgtaaagcaaatccaatcgcaaaagaagattccaacgttttagatttttcaatctaaaattccaattttttgcaattaacagaattggcatctcgcaaagcattaatttcagaaaataaaacttcacaagattaacaattatcatcatcagaaatcgaagattttaatctatcaatttcagcatttagaatctcaatagtgtgatccttctcatcaagcacaatagaacatgtttaaagtttcttagcaaatttgtaagcagcatattccaattcattataactaagcttttcttcactatcagattcatcaacatcagaatttgcattacgagcaataaaagctagatcaacaacttgcttacctttgctctcatcttcaccttccgattcatgaaaagctgctatgatttcatggattgaccacatgaagcattgaccaaagaacttgcacaaaaagcaactttgtattttttcaaaacgttctttgtcaaaattaactcatcaacaacacgagcatgtaaagcaaatccaatcg

SEQ ID NO: 97856 - DNA, 583 bp, Oryza sativa
agcccgcccatggttttgcactacatgcgcttttgcttgcaaatttttacttgcatatgatcattggccgtcgtctcgatcagcgctagtagctggggatcgaaaaacaggtggcgcgcgcactagcagtataggcaggggcaacatggcaatgtgcagggttttcagcgtagtgtttctcacttgtcagtgtgagtgtattaacgatatcaatgatccatttgcatgggactagctatagctcgacctacttgctgcaaggacaaataatgttggtgctgctgcgtgtttgcatccagattgatgttactactagctagtatttgcgcatctgatgtcttgctacatgatgtactgaccctcgacctagaatcctggagtgatggctttttcttaaaacattattatcattgttattgttattatggttgttgccttgcaacttgtcaacagagaacagactagtgctcgtgctcgatcgattatatatatatatcaatggctggatcaataaatacgtgatagatcgatcaatatgtattattctctccatcccaaaatataataacttttagctctcaaa

SEQ ID NO: 97857 - DNA, 903 bp, Oryza sativa
gggggcaaatccgcccgtttgaacgcgagagagagagggaactatgggggaaaagggagaggggatcacggggagtgatttccccctctttattgcacgcggagacggcgggaggcggcgggattcacggcggcggcggcgctagggcgcgggcgaggcggcgggagcggcgggaggaaggggatgacgggtgggccccacccgtcagcgagggtggcgggcggacccgcccgtcagcggcgcgagcgcggggagaggccggatgggccgcggggagaggagagggagggggagggagatgggccgagccggcccaagagggagagggagggaaaggggactttttagagcttttctttttataaaatcattttaactttgtttatttcttaataattattatttgtgctctgaaaattccactaaatttatttacgcattttaggcttttaggaaatatacaaaaatcctccaagccttatttgacttttaactttgcacattttaattgttggagctttcacacggattttaattattctaggcataatttggaggatgtattttagagtcgttttgggacgtgacataatgccactgctcatgagaaaatgaaataataatatcacacacacacacacacacacacatatatatatatatatatatatatatatatatatatatatatcaattgtttagtcactagaatcactatcattgtctgagtcattatctgattctattggcccttcatcttcactactgcaatcactgtccatggcaacataactctctatgttctcatggctatttggtctatttaaaaaatccatatcttctggatcaacttgctcaacaatatttgattcatgaagcaagctttcatcaccaagcttctgt

SEQ ID NO: 97858 - DNA, 723 bp, Oryza sativa
aggacttgacggtgtgaaaactcatgttaaatacattggtaaaattcatgaaaagtttgtgcttgcgctttttttaactagatttgtgaaaatgcatgtcaaaaggcttgatgtcaaaagggggaaattaaattacaaagtcctcataaaaattgtggtaaatttgcaagaccatacatcgatgtttttaacattgttaagtactccttcagatggaatatgggcaaacacaagatttagatttaaaaataagaggaaacataaagtaagaaaactagggatgaagttatcgtttgagttcaacatgaggcatgaacatatataatttctccaagtttaaaaaataggtaattttgctacaggacatccaaaacttgtgaaatttgctaatagacatcaaaaacacgtgtcatagctgaaagacatcctaaaaaggtggtaatttgctggaggatactttcagctcaatcggagaaacaaattcttaagaaagacaagaatgtccctatgaacacatgctttaaacatggtgttagagtaaacatttaaaaattatgcaactctaaatttgtcatcaccagaagtaaatcactagcaaatatcatatgccatcttcacttcaaactcggcttaaaagcttttgacccgaggggcattctcgtctttttgaagaatttctctatcaaattgaactgaaagtgtcccgtaacaaaattattgttt

SEQ ID NO: 97859 - DNA, 612 bp, Oryza sativa
ccatgttaagcttttatacattaatgaaataattcctatgcgttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggctcagaccgggaaggtgttgccggtcagaccgg

SEQ ID NO: 97860 - DNA, 697 bp, Oryza sativa
cagggcgagtccaccggttttgaacaaggcgggtgccccccgatcgccgcgacgcgcgctaaaactatttggccggcacatgaatcggctctgcccccggcatgcagctccactcgcgcgcacggcgcctttgcgtccgataaggagatggttgagctttgccaccgcgaattcaaatccggcttccaaggggatgattactccgagcaaactgatgattcgttgtacgacataaactaactattggatttttcgcgcaattttgcacaaaattagatttaagaataattgaatttgacatacagttcttagctcatgtgtttcatagatgtaattgcatttcatataaaatagattctaaagtataattgaatttgatatgtaaatactattttatgttctttacttgcattttgtgttttgtccccaaatacacgacagtgtacaatggacttcaaaaagcatgatgggaaaaacatatacaacttttttacttatgttttttatacagttatattttttaactatctatttttttatcaacatggtaatttctactatttgttctaaaatatagcactttaaccatttaattttgtcctaaaatatatggatatcctcccacttttcaattaatgataataacaataatttaatttctccacatgctttctcatctcaacgaattgggctgcag

SEQ ID NO: 97861 - DNA, 602 bp, Oryza sativa
ttaacaattaatttactatcattcatatcctaattatatatcactattccaatttttaaaagttttaaatcatgcatgtaccatttacatatgttaattaaagtttttaacaattaatttactatcattcatatgctaattatatatgactattcgaattttcaaaatttttacatcatgcatgtggcatttacatatgttaattagagtttttaacaattaatttaatatcattcatatgctaagtatatatgattattacaatttttattaattttaaatcatgccgtatgtatatacatatgttaattagagtttttaccaatttaatatcattcatatgctaagtatatatgattattagaatttttattaattttaaatcatatatttgcttattacgttttatccacttaattcattacagacaacaataatttttcgaagtaattgtcattaataattttaaagcattattttctattttaggagcacatatgtaatggaaaataatattcagtgcgcttatcagtagtcccggttcttaatcctaaccgggtttaaaaagaatttggaaatagcgggaaaatatctttagtccc

SEQ ID NO: 97862 - DNA, 518 bp, Oryza sativa
ccaatcgtactaattaaattatattaattgcttgatcgccatgtttaaagcagcgtgcctgtacgtgcatgatcgacctacatataatatttcctatgttttaatttagtgctttagtttaattacactcttttggggatcttaattaatttcgagaaaaacaaagcacactttggcagaaattaaaaatatatatacctggactggatgaaattaagaggactcgaatgtgaaaataaaacaagtttgcgtggcctgtccttagaacagaatacatgatcagaaaacatgcacaaccacgcgggaaggaacaggaggcccagatggatgcgtacaggaaaaagtacatactagtaagtgtgcatctttcttttgcctgaaagcgacaattaaattgtttcaccaaaaaaaaccaattaaaattatcagtaaaaatactaaaatagctaagaatatatgtatgctcatggaccatttctgtggaaaaagcatgctggcttgcacgaatcaaatttaat

SEQ ID NO: 97863 - DNA, 631 bp, Oryza sativa
atttgaagttgaattttttaaaatcataaaatctcttaagagagggagacccctataagaaatgatactttcttaaccacttgagatatgtgtggtggagaaaacaagagaaacacgcatgtgctcgctcgttccgccaggccaagcgacgcgtatgcgacatgcgcgtgaatattctgccaaaattggttccccacccttgcgcagatgtggcttctttttgcagttttattttgttgcaaaattcggctttgtttttggaaacacaccgaataatctgtgcgtggagtctggataagttccgtgcgacttatctggttcggttacgcagtgtggagatcgtgcgtggagcggcgtggagtccggataagttatgcatgacttatccggttcggttacgcgacatgaagatcgtgcaggcatcctgatcacatgtactaatatctctatataaatcgagcagcctccttctcgcaatacacacgaaatcaatttagggtttgcctctttctatgtactgcgtcgtcgctaatagtctatttcgtcccgctcgccagcgtgcataaacgtggcggtggcgctagggttcagccttgtgacgaaaaaacaggtggataaaaaaactgaattc

SEQ ID NO: 97864 - DNA, 738 bp, Oryza sativa
acgcgaaaagctgcgaacgagggggaatggatctgaataaaatgcggaatagcgtcaaatttgtcgaattggaggagaaaagagaaggctttggagggccagtcttctcaagttatagcggaagcctgaagacataagagctactaggaggttctgtttgctgacctggtgatgactgtgtaaaatatatgcgccttttgggttgctagtttcagacaaaataagttaaggtcaagtttgatattgttctgtaagtgctactgtttagataccgcctgtgattcagattggatttacggtaatttgttttctatttcttctttatgaaagccttctgaatgtgcctggagttggggaacaggtctttcaggttaggtgtgtagcaatgcaatcagtttcggtggtgcagtatatatttcgtgtccttatgtgattctgacaggtgtttttttcatatgaaatattcccagttggctgctaatgcgcaatgcattaggagagataaaaatcttcatgtaacgcaaaaaaaaaaaaacaaagttttcatgtccattttatactggctacactgaccaccgcaccatgtttgacagcttgaaaatgtctaatgactaatgtgctctgatcgttaaattgttctctttcttggaaaactccttcccaacgtaaataatcgcgtgctctgccggtagatcagataagtattcagcccttttggagtagattagatcagatata

SEQ ID NO: 97865 - DNA, 567 bp, Oryza sativa
ggccctatgagccatttgaaaaaggttaagatatggtgctcgtcatcaactgcaggagatcatgatagtatctcggctcgtaagctttcagaggccatccaggagtacatcaatcctcccttgtatattggcgataaccctaaactatcaatctgcctgcaaacattctccggcagcctcctcaattctctcgatactccctgtgagctcacttcgctgaaactacatggcgagcttcgttcgttgccccgttttgtcaaatggcatacaggtctcgttgagctgtgcctttcatcaattaccgtgacacgggatgttctctctgatctgtataacctaaagtgtctgttatacctcaaactgatcagcgattgccttgacgaatttgtgataccacaaggggcgttccgtagtctgcgacgcctgtgcttcaaggtgcaagtctctgtcttcccgaggattgaagcaggagcactgcgggacctggtgtcactccagctgctctgcagacacctagtaggtttggctggtattgaaatcgaagatcttcgagaacttaaagaagta

SEQ ID NO: 97866 - DNA, 1313 bp, Oryza sativa
tggccgcctcccctccggatccagcgtcgcccggctgccgcggcgcgagcccgcctcccccccgccgcgcgagggccggccgcctggctggccgccgcggcgcgaggccgtcttcacctccgcccgaccgccaccttatgagggtcccgccgatgcacccggccgctgccgccgcttggccactgatagaagagaggggaggaacagaatggggagaggaggaggaagaggaagagatgggaggaggaaaagataaggttagggaagtgataaggaatagaatttattaactcctcgatctcgcgcacctcgtcctctccgccacgcatgcgcgcatgctgatattttgttccggtttaggctactaaccgggactagagataaatctttagtcccggttggtaataccaaccggaactaaagataatagggatttttttcccggtgttaccaactgggactaaaaatagatctttagtcccggttaagaacacaaaccgggattaaagataaaaaactagctctaacgttttgaacctagactaaaggtaatctttagtcctagtttttattgcaaccgggattattgtagattttggctgaccgaccaaaaatggtttctccatcagtgagataaggtgctttatttctttccttttatatttttcgccaattgggcatttttttcactaattgggccgttagagatttttttttctcttgctctgtattaatgtactcctatagttttatatcagtatagtcaagttacctttttttctgcttaatttgcgcgatgattgaaaatattccttcgacagctgtgaggaaacatatcttatagctatatactactgtagcggttgagtactccaattatatgtttgaatcctaatatatccttatttacatagatatggacgtgttttcaatttcagaatgatatatagtttagtgatatcacagatttacgaatttattggtgcaacagtctcttgaatatatgttaaaggagtgcactcataaatatatgtgtgcatgtattctatttatgccataagtaacaaaattcttctgtagtgtgtgtgggaagtatttttaacacctagtacaattgcacctagaatatgcatgtgatataaattggtaaataaaaatataaaaacaatattgacaagatatattgtgataatataagttaattagtacttacaaaaatatgcaactacaaaaatacactttgcatgtttgcatataccgtaaattaagtatgtaaccaccttgtccaatactatgatatgttcaccaaatga

SEQ ID NO: 97867 - DNA, 665 bp, Oryza sativa
  unsure (1)..(665): unsure at all n locations
agttctgtaattagttttgtcactagtatccgaacaccccatgccacatcccatgaaacatccgttgtaacacgcaaaaactttacacccctgatctaaacaccccctcatttgcttagaacaggtttgaggcttttcttttgtcaagtacagcacattgctattcagttagtagaacattgtcaggtaactatctgcacaaatgcagtacagggacgtcaggtactaacattcataatttcaaactagctgcgccaatgcattacagggagaaaagggagaacctaaaacacattctgaagatgatggaatcaagtacatgaacatgagcaatttgtttacttaaaagccgtgggaatggctgaggattagggcgccacgtcatcatttttttttcagaaaaacccttgctctttccgctaatagcgtgtacatccccgttaacgtggcccgtcggatcacaagctaaggccgatttgaccgtccacgtgtcccagcatgactacccttccaccatcgtcagatcgttggattggaaacggatggtctggattcttcagccagtacaaaccctaggccgccgtncttttcttcccacgcacggccgcttgcccaccttctccaatcgcgccgaagcctcaccgttcttcttccctcgcgtgcgt

SEQ ID NO: 97868 - DNA, 646 bp, Oryza sativa
gttcggggagaattggaggttattttgagggggagttagtgctttttatgactttcttttggcatgatttaagggggagtttatacctcatggttttatcaagcaaaaatatgacaatgaaaaaattgataaaagagagctttgtttatacatatggtattttcttgtgcatgccagcaatactttgaaggtttatttgtctctagcatagcttgtatgtattctagtcttttcatgagatttaaattttgcttttaagagagatgatgcatgacacttaaattctatacttgaattaagcaaatatgcaatgttgatgtaaaagcatatggtttgatttctaaatgctatatatatatatgttttattgaattgttattcctcaaatagctttaattgctcattgcgaaaaagagaataaaatatgaaaaaatgaataccgaatccttggaaacagtcttgacgacaaagacgtattcgatgtgagtaaaataatgggtgccgaatccctggaaacagtcttgacgacagggacgtactcagaataaaaaaaagagaaaaatatgagaaaaaggctccagaaaagaaaaagttaaaaattctctttgtatgttgtgctcaaggttatttaagaaagagtgataaa

SEQ ID NO: 97869 - DNA, 824 bp, Oryza sativa
cggtgacgacggcgtgagcatggagctgcttgaggtgcgcgagggtggcgcatcggtggagggcggcgacgaagtcgccgtgggaggagaacggtggcgccgggggcatcgtgcggcggcgccgtgcggaggtttggacgtttggtttgcctctctgggctcgtcgcacactcgcaccgcgtccgtgggcttaagctttggatgggtttttgtttttttgttatgttgttgttctaagaaagcgtcattttttttcttgtgacatgtgctctattacaaatctcaagcaaacacaaagaaaaattgtaccgcgatttgtgataaaaccggagaatgcccagcatcggtctaccggggaggtgggaaaatcgatcgctcgccctcccccacgtgagcacctgtttggcccacccacttatccatcatctttattccacaaaagatgtttcacctagtgtacttacaatgttttactatgacatagatctaatgttgcagtgaacgaaaccttccattgcaaaaaaacccccacatattttggaaactccttattaagggaatttggtttattttttttgttccactgaaaaatgtttcacctagtgtaccacaatgtttcactatgtatagatctaatgttgcaatgaactgaaacattctttcgctatttgctgaaacattgtttttatataaggtgaaacaacatctaatttaaacgagtgaaacattttcgatctacttagtgaaacaattccaatatacctaatggaatatcgtgcaacctttaaaaataattcaataataagctaattgggctgcaggaa

SEQ ID NO: 97870 - DNA, 561 bp, Oryza sativa
agacggcggccacgcagtcgtgctgatgcggcccggcgaagcagtggcgccccggcgaggccatgcgacggcgggggtgcggctcgcgcccatgtggcagctatgctttgctagacggcggaggagctcgtcctggcggcggcgtggctcagccgggcggcggcggcgcgcccgtgcggtggtgaggtggccacgtaatggcgcggtggagcgcggcgcggcgaggccgacggccggcgggggtggacggccatgcagtggctgcacgctcccccctttttttttgttctttttttaatggttttctgttgggttagtcccacattgttaattgatgatgggggagcacgaattaaaaggttgttacagttctcatccatcagactgtcttttggattgtgtaggcccaggacctaaacttgtgcctccggttgggtctgtggaccagacgcctacggttggtggaacaggctgcgcactctaacattttcttcctcttctgttgactatcccgggatggtgtgaagccttcctatcatttttcttctttttttcttcttc

SEQ ID NO: 97871 - DNA, 622 bp, Oryza sativa
ccaaccgggactaaagttacgatctttagtcccggttgggaactaaagattccggggggcctgacatgccctgacagcattcgaaccggggctaaagatcaaatatgcccgttaccctttgaaccgggactaaagatcatctttagccccggtttttattgcatccgtgactactgtggaaatcggccgaccgacgaaagatggtttctccactagtgacagcacctgatttttgcacgcctggatcgggtgcggcacctgatcggtagtctcgtcctataataaaagcaacttttcagcacaaatctagacatacaatttccatactaattgtttttttaaaaaaataatatttgcatttcaaagctcccaaatatatacacgtttctttgctcagaaggaatagcaaggaagtatccttacgaccttacctacatctaagccaacaaacggacggcaaacgtcaatgttaatcgtttgattgttttctgaaactatatcctcaatatgtgaagtgaaagcagccgtatgataaaattgaacggtcatgataataaatttagaagagatcatctgcaaattaacaaaaattactgtatagttaacaacttttaggcggcta

SEQ ID NO: 97872 - DNA, 781 bp, Oryza sativa
  unsure (1)..(781): unsure at all n locations
ttactatagggcgaattcgagctcggtacccatgtcattcgtgtatgagtcgatttgtaagttcgttcgcttttgaaaatacatatccgtatttgtgtaagttttaaattcgtttgtttttagaaataaaaaaatgaatcatctaataaaactatcttaaaaaaagtcacatgctaacttaagacaatcggactcctaactaccagctcatgattttctaaatatgtatatatccaagtgaattcccatagtgaatttcatcttaactaaaccatttaaaataataagattaaaatagtcttcacccgttgcaacgcacgggtattttgttagtatatgaataaattaaaaagagagttgacagggtggtaaaaaaattattgccaataaaagtttatcgagatttattgaaaaaagagatacaatgaacacccaattaaaaatagaaaacaccttactctaatttcagtttattttgttagaactattttctaaacctagttccatctaaactctggatccgaataggactctgaatcaaacggaatacgattccatcttgtgaatacgaccacgggtcgcgttcgtcgcctccgccgtcggcggcggtggcggaggcttccagcgggcaaattttgagaaaacctcttggggcatcgaaatttctgaaatacattgactgattctgcannaaatcgagggagaatgtagcatgccgaccagcctcgatgaactattaaaaagctaattctactgaagcttgcagactacgatgagctat

SEQ ID NO: 97873 - DNA, 566 bp, Oryza sativa
accaatgtatgactagatgaatcacctttatctctgctagacgttcaatacctatctttgttataagaatttcctagttgtagtcttgttatcttgtagaaggtttttaagttgcaatgattgacaattaaatcttttactatatgactaacagaacacttagcacaacttaggagctagtcccctccagtaaaaaagaatgcctatgtatgctgttttgaattctgaatttcacacttgatgtacctataatcagtgagaaatcagcatagccatatgtataccactaaaaggatcatgatattacagttttgctgatgtgtggcaattaaatgaacagccaaatatgcattttttgagacataaaattgtcaaaataagtattgcaatcaacctactgtgcaaattcttttttccccattacattcttacgcatttttttcccctgataaggtgtttttaactctttgtacactgcaaacagatgggaacacttgattcttttcagaacattgtatgatagtgtggtaaactcgtaatgaaaaccattggcaacaaatggcatt

SEQ ID NO: 97874 - DNA, 536 bp, Oryza sativa
  unsure (1)..(536): unsure at all n locations
aaattattgacaaaatccatttcataattctggacttatttgcgagactaatttattgagcctaattaatccatgattagcctatgtgatgctaaacatgtgctaattatggattaattaggcttaaaaattaaaatttatcacgtgaattagcatttatttatataattaatttttgtaagtagtttatgtttaatactcaaaattaatgtccaaaacatctgatgtgatagggattaaagttagagttatagttagatatataattgccaattcgatctcaaaattgtctcgagttttaagctaggttgctggattggtgcagagctctatgcctctatctcgtttgtccattttggctgttacatcttccgctcaaatgatttntatttacccttcgggcccctaaatttttaaaaatttggcccttttttttggcctaaattttggcggggaaagattttttaaattcctgtagtcgacacgataaatggacatgggatggaggaatgcatggtcttcagtcggactatcat

SEQ ID NO: 97875 - DNA, 613 bp, Oryza sativa
tatatatatatatatatatatatatatatatagccatgccttttctgtcagtctttgctactgatataattgcagtgatgaaaagtgacattgctgtggagagagggttgaaggtagcattgagcaaaccctaccctaagtaattattgctttgacgagaagaaatttcagctagttgctgtaaccgcgatatttgcataaaacatgaaaaataaaaagaagctaaaaaaatggaaaatcacttaaatatgtgtagaaattggggaagaatatataggacacttgcaaacctagcttgtggatgtaaaatacaaaaatgaagctcaatacattttttctatttcccaaacaattatcgggtttgccctcaaatataattcttttccttactctttttaaaaaaatttcttcaccatctaccattaaaaaacaagaactacatccatagttttttttattttttccataaattgaatttgctcaaaatttctcaaacccgtaacacgccggtaaccgatccccttccccgcggaaagcacgataaccgtgattaccgcgcgaatacgcgaaagcctggacaccgggcgtatacctaaatgggatatagaacatg

SEQ ID NO: 97876 - DNA, 580 bp, Oryza sativa
tattatttacatgtgtatctaataaatttagttcatagtagtataatttaatttcaccaattggacatgcggtatatatagaaactgttgttgaaaatatttttttaaacatggtatttagatataaattgatataaaatattcatttatctatttttaggctactacttctcatgtttgacgtcaactttgaattgcatgtagacatatgattgctaaattatctctctattgcttgatttctagattaataggtgggttcatctcatttctctattgtttaccattaattttaaacttttcatatgtattattgactgtacttagaaaccaagcttcttagtagagttgatgatgacacaccatcgatcaaaaatcctggatccccccctgttctccgcctcacataatctagcttgtgtgacatcactactagagaaatcattattaacgacagaaaatatggtcgttgaaagtccaaatgtggtcgttaaaggtcattaacgaccatattttttgtgatcgtcagtggtcgttaaaggctccgtcgttaataatattaacgagcacgctaactttt

SEQ ID NO: 97877 - DNA, 558 bp, Oryza sativa
  unsure (1)..(558): unsure at all n locations
tagaggaaagctacactacaagcccagccgttgcccacgctggtttgtggtaagtacaatagttcttagagggggcccaaatttcccccccccgggcccgggaaaaacccaanggttccctttaattttggncccccattgngggtgtgactaagcaaaaccatgcacccacagcccaccatttagtcgcattttagttggataattatgaccatgaagcatggccagatgtctcgagcacgcagctcattctaatactaaaaaggtctaatactgtaattatcccatcaactgagctagtggtaattaagcatagctaagcatatagttctagctaggtcacataagtaacatgagctagtcgatttattacccaatgttgacaaaggacagacatcaagtaaacatggcacaggagcagataggtgaaaccctgatcccatgtaattagcaaaacatgcatatttatttgcaaacagtaaaacatttgtaaagtaggctcaatatgctcaaggggaatatgtgacttgccttgcttcttcacaacaaccttctgaa

SEQ ID NO: 97878 - DNA, 578 bp, Oryza sativa
ttgcggtgaagcaatgggcgggacacgtgcggtgactgacagttgggcctatggacagttaaattgaagacttgcatcccctgttccacatgtcagctggtacatgagcccgtcacatctggtcgttttgtttggagggacagcgataagaccaccttgtgggatgggccccccacttctgcatgcacgcactatgaacaaaatcgtttacatatgttagcgacatggaccttgatgggttgagctcgctttccatttatgcccctcgcgaagcacggtaggaattgatatgttcatgtttgaaagacccatagattcataggctcgatgtgtttacgtgcgcgagtcacacgcacgcgcaaacctttcacgactctacgcacgtctcgcaaaccacaacaatgtctgtacgcgtaaacctttggtgcgtaggcttggtgtgataggatgtcaaaatcgcttcctcttaatgagtataaatttaattttgaatgaaaagaagtgaaaaaaactctcccttaatgtatgcatatgggaaatatgattgaatctcatatgcatatattgaaggtctgttt

SEQ ID NO: 97879 - DNA, 716 bp, Oryza sativa
caaggatgtacagtacgtgcgctgctagattgcgccttcgtctcgtttcataccggccggtgacgcggcagcgcgagcggccatggcgctctgcatgcgcaaggggaggacggtacagttgtatgggccaaaccagagtaccagacacgcgccggctgtcgcgtggcgtgtttccgcggaaatcgtagtagtaggtgtgcgtgttcggctgttcggttttggcggcttgccgtcgacagtgatgtgcccatgcactgcgcgacgcgcctggtgttttcagatgtattttctgtcctccgtttttttggcctctcgtggcgtcgtctatcacgtaaactaggctcgcgcgttacgtcgtgagttgttacttgttagcttcgcgtttgtagagttcaacgagaggacaacacgaacttgcaagcagttaaggcagaccaaaaagaaggataggcatgcgggcagtcgggcacgcacaccagtcgggagtatttatcaagtatcatggcaaatgaaaaggaggtatatgcttcgtcagagccaggtgagcccggtcaggtagaaaggagattagcactttaactactgtgataggattggacgaatgtaaaagaataattaaagggataccctctccgttgtaggttaccacaccctttgactttgattaaaatcaaactactttaaattcgactaaatttataaataagtagtttcat

SEQ ID NO: 97880 - DNA, 651 bp, Oryza sativa
ccggggcaactgacgaaattaaagtgaaacatgcattttaaattttaatagcaacttggcgcaaaacagataattcaaagtttctaccggattgatcgatggcgcaatcgatcgagttatccatatctttgatcatctaatccatgcatgtgaaatgaattaagaaaaacctataaatggattcacggaccaacccacttgtggaaggagaagaagatattattgggttcaacgattgactaggctagtgaagtctgaagactactagcaaatgaaacggattgcgatcaatcgagctgcctagtaggctaaaactagtatgtactgtaatatctacgcaactagcaccttgttggattcggtttaatttcttgttgattagcgagcggattcgcggaaaatgcacacgcggtggaaggggaaaatgggaatcaaatcaggactatacatcggagacttgttgccccttcctctggaccatatggcagcatgcagcagctacagcatccttaatcgataagaaatcctataatataatttcacactagtaatttggatttgttctatgaaataattgaccgaagatgagccatcatacaagattttctttttattacactagttacatgtttgtacgttaatcatgatggg

SEQ ID NO: 97881 - DNA, 607 bp, Oryza sativa
ggatagttccaacttgcaagtgtaaaaagtatatgaaattgtaatcatcatgacacatcacagtctttgaaaagtgctcatataagtagggatgtaaatgtgtacattaagtcagtgtgcgcgtggtgatcgtgtacgtttgtatttccttccttctgaaatataaggattttggatggcacatagaaatatttatcttgtttagattcgtagtaatacgacgtgtcttattaatctaaattctctaagacgaatgaagtataatgtttcttttctttttgaaaagagaaaattatatacgggctctaaggccaaataaccatgtatcaatgacaacgatgttggtatctcatcatttttcgacgtcctaaatatttatcatcgaaaacaagtttacaatattatacccttcaataaaaacatatttattttcgatattattctcttcaataatttttttgacgtttatagatttggtaaagcataaaaaaattccaatatcaattttatatcaaaataagcttaagatctaataaattttatgatgattataggttttttaagacaaatatatgctgaacaattcttttggtttcaaactaagcat

SEQ ID NO: 97882 - DNA, 672 bp, Oryza sativa
tcctatatgtatatatgtagtatcatctacaagtgattcaaacttgctgtatgataaccgaatgatgttatgcaaagttcatagcaatgttctcgatcaaaatagacatggagaagactgcagtatttacttgtatttttttgtaggatcatttacatcattttgttttagagtactgtctaagaattttgtgttattcggttattcatgaccagttgctactggatagcatgatatgttcatgtgagttttttctttgttgggctgtgtgcatctgatatatgcagatgatggggtgtaatttaatttcttaatgcttttcattatgtacaaaaaatatgcctgtgttcttcatgcacctgcatccatgaattaaaaaaatagtgcataaaaggttctagatatatgacaccaagtggtgttctatgcttctgttattgaattgattagcacacttaaacttgtaattgtttctaaatgacgattgagcagttatctctctttttttttctgttttttgtccactttcttagctagacagtttcagtaacctgattattgataattctaagtggtccagttttgttcagactggcttcaaaatatagtactctagtgtgcagtatcgttcgtattgtttgatcaccatatattgcgagttttgcattatgt

SEQ ID NO: 97883 - DNA, 653 bp, Oryza sativa
agttatgcacacaattaagcaatttcactctacccatgtatgatggcttgtttcacaattagcatttggatatgatttaaaataccatctcaggagaaagcattgcaagaagatgtgttgtgcggttgctatctaggactaggagtttccctgttctctcgtgtcgatcgagcaatgcatgcagagggtagggtgagagcgcccaacatgggaatcaaatcattatggccaccacggccaagattgaacagatactgtaaacaatgaaaaactggcagctttttcgtctatggtgcgtcgagtcaatgagggagatcaagcgtaggagtagctataccattgtgcagcaacactcacctgcaatatccaatccactaccgtgtcgggaatttaagctgcaattattatcctccgctgcccagagagaaagatgtgcatcgtgcaagcttgtagagcttgtaggagtactccgtatgcttggaaagggaagaagcactgcagcagtaatcctactgctgctggagaaatgcttgcccaacagcacaagggtcaattcatatcatgccaagagatcctttcgatgatggccgggagattttatgcccaaacaaggcaaccgggcggagcgtgagaggtggagagcgtatagtggc

SEQ ID NO: 97884 - DNA, 542 bp, Oryza sativa
tgcctcgccttgtctccctaatactgccactcgtttcgagctagcagcttagagctaacacatctctggaaaagtattagttcaaaaaaaaactctagaaaagtgattatgatcccatcaattaaccaagagttggttataaatcaaaacgggtggacggtgatggcaacacacccagggacatctaggaaaggagtccacactactaccctaatgttcctacttcctagtgacatgggagatctagaaaaaaaaacaaagggtatttcagctcaacgaactctcaatgctatccctctctgtgaagataaaagaagaggctagcccagatcatcccttagagcatctccagcagggacactaaatatagcccctaaacagattttggatgttgaggctaagagcatctccagcaatatctactattttacagtccctaacaatttaatgggggcttcccccattaattagatacctacacaatatgttgcactccagcaacaaatccttatctcgcccctgatgtgattccatcttctatt

SEQ ID NO: 97885 - DNA, 682 bp, Oryza sativa
taaaatggagaacaaacccaaccctaatagagtttttacccacgggtaaacgggcaaacgggcagaattgccatccctagtaacaggcctataaaggagtagtgtggtggcggttgatacaacatataaaaactgttaataaaacaccaaatagaatcctaatgacgattaaaatgaggaacgacaggcaggctgtaaagctgacgggcaagacggttgcttgaacttctagaaagtaaaaaaattaaaagagagttcaagtaggaatacaattttgaaacaacttaaattcaaaaataaaaaataaattctgaaattagaaaaataaaaaagatttcgattaggaatacatttataaataactaaaattggtgataaaaaatagactattgaaaaaaaagaccatctaaaacacatgatgagataaaataaataacagacctataaaggagtagtgtggtggcggttgatacaacatataaaaactattaataaaacaccaaatagaatcctaatgacgattaaaatgaggaacgacaggcaggccgtaaagctgacgggcaagacggttgctggaacttctagaaagtaaaaaaattaaaagagagttcaagtaggaatacaattttgaaacaacttaaattcaaaaataaaaaataaattctgaaattagaaaaataaa

SEQ ID NO: 97886 - DNA, 617 bp, Oryza sativa
  unsure (1)..(617): unsure at all n locations
acagaaagaaactcaaagtgcacctgcgcagaatctgtcaagcttgcaccctctccaatggtttgcttattagcaaattcgtttgtaccagctaggggtgatggctgcaaaggccgtggaggcggaggtggcggcaataatgtttgacctggcacaatttctctgggaggtgggccaggaggaggtggaggtgggggtggcagaggtaagccaggtgctcctgctatgttagcaggcttaggtggaggcgggggtgggggttngggatgaggnnngggttaatanaatgnnncagcnagnatgngnngtcaacnnaggttctttgaanngaggcaangngncnatatggtgggggcggtggagggggtggcagggttgaaggacctgcttcttcagttcctggcatagaagatgaagcaccagcgcttgatgaaggcagtgggatccttggccctgaatatcaaccaagaaaaaaactgagaattgctagaacatcctacaggtagatttttttaaagggaaaaatgatgatttaagaaactactagcacagaaaccagggatattaacctatggaagatttgtacatggaggtttgccaggtggtggtgctccaga

SEQ ID NO: 97887 - DNA, 1063 bp, Oryza sativa
  unsure (1)..(1063): unsure at all n locations
atgattatgttgggaaaactttaaaaaccttatgtggtgatcaaactgggatatatagagtactgagaaatttatttggaatattgtctagattcgtatagataggatgtgttgattttatttacttttttcaaccatgtatatatttttatactgtactccctccatccacaaaagttacgcatattatttttgtcaccaagacctaggagaaattaaattattttggatgttacaaaatcaaggagtgaatgcaagcatgcaaccaatgaatatttagatgactctttgggttctcgtcaaacatttaatttatctcttcatttaagtcttaaatgcataaagactacgaatagcaataatttatttagaaaaacttaaatgtaaaatatgtctaacttttatggatggatggagtatgatagtttgatagagctatacatgtataagagaaagtataatatacgcttgtactgcctcttgtataagaggagtacgagcgagtatatattttagtttgtttgaatcttcaacattttagttgcacgtaaaataagataagtcattgacataaataattgagtatttgtcattacaaaatttagaaatgagtttattcaatttttgaaagaaacttttatataaaaagctttttagaaaaacatactctctctccgtccgaaaataagtacgtacactgtccaaaaataagcaccaaaactttggggcgaagagagagtatcatcatttaatactttaaaaaacataacgaggaaaatatttttttcagttgaaaaaagaacgcagacttattagctatggcattctgtttctgtctgttagggaaaaaaaaaaagaagaagaaatgaaaacagggcaactggcaaaaattcagggactaaagagcaaatccgacgctctacaacttgtacaggggcctaacagcaaaaatcgcacanaaacgaaaaaacaaaggaagccgtttgaaagaatcaacgacccgcgcacacggcggcgcggcgcataatccccacaccaaaagaatactaccttcacccatcgc

SEQ ID NO: 97888 - DNA, 542 bp, Oryza sativa
cctgcagccctccttgttgtccttagcaccgccaccttgatgaaaatctgcagtgcatacattaaaaaattagggaaattataaataataataggataaataagctggcttggataaggttacatcaacctgacttttttgacacttctgcacttctccattccaactcagtattctttattacaagtgcctgatacaataattacttcttcaacttgagaagggtaaatgaaacacatacaaacttacatactataatcatcaaactaaaaaaaaaaatcaacaatacagtatgtctttgttcagaaggtgcatgtgatccttctgctttccagaattctgatatgtcaacatcgtcaagaatttatcttaccttctccatagccatatcatgagaaatatttaagtctagagagtgattctctcttcttttgttgctgttcattttaacacctaaagtcaattgattctatcaaaacatggaggagaaacaatgacgggtcaacagaaatcaaattatggtagattgatagaactcacct

SEQ ID NO: 97889 - DNA, 1290 bp, Oryza sativa
gtaattcaatcattcaagcaaacataacatacatgttgaagttatggttgtgttctttccaatgtgcaatatgtaaagattcgtttctgctcaaacatgatggtcctaactagaattatcaagaatattacacacgatgtggaagaaaatacattatgcattttcgagctctaagtgggtcgatgagcaaaccatgccaacttgttccatgttagttgtccgcaagatgaatataccatgaacgaattggaccagaaggcccacaactgtaataagtgtaagcaatggtggttttgcatccacgccactatgatgagttgatagcaaatttgacaagataattgttgagcatattgtataacgctccatgatttacctatactacggtgtaacgaattgagagaaccatcttcaagtttcaagtatcagtgtgcatactagaaaaattgatatagcctttcaactagaacatgaatgcgggctactagaaaaatgatgcggccaaatgtgttatgtatggaccttcgatgatttatctcaactacaggacacaagatttcaaaggtgtgtttgctttggatacagtatcatttgtgccatataaggaaaatagaacatataaacaaagaaacgagtccatgccaaaacaagaaaggatcaaagaggccatgcattaagaggtcattagttatggttttcttaactttttctttgcgggcctatagcctagcggttaccgtgctcaagtagcacctataggtcctaggttcgactccccacaagagtgaatttcaagcctggttaaaaaacatcactcgttggcacctcatagaaacacgtgttaagaatcaacctatgaaggacgggccctcgtgtaggaagcaaaggcctcaaagcatgggttaaggagcgatccatagggggcgagtccacgtgtggggggccaggattcgtggcctttctcggccagtttggttgaggcttcttcttaatgaaaagccgtggggcggtcttttcccagtcagttgagttctttttttttcttttgaaccaacatttgttgtaccatattcttcaagagaggtccttgagccgtgaggttgcttagcaagtccaggtctgcaaggctccaaattaaaagccgccatttaattccaaccaaattaagccggtaccatcaaacagcttataactgctatgggactgagttcgaactataaatacatactaagtacaaccatgaatgtcaagtacaaccaaattcgcagctcaaatgttaacattcaacat

SEQ ID NO: 97890 - DNA, 1071 bp, Oryza sativa
gtttataaacagggcagtgaactctagattctttaccatctgttagatgtaaacaattcaacaacataacattttgtacatgaaaactcggccatggcacctttctcgatcatttgtggcgtcaatctcctaaatactaaagtttcaccaccaagctcatcatgttaattcctttataagataacatgttttctttttgcatccaacagtgatcttgtgccaatttggtggttcaaagtgatggcaattttctaagcagcgttcacaacatctgagacactccccacttccactcacctaggaatggcaccttcagtgcctctgtttgaggaataaagcaacatggaggatcacacttatgtaacctctttctaaatggcaacataacattaagagtgttagacatcattgtacaatctcatacattacgatccatacatacagggctttatagggccaccaaagtcgcgcaacgcgcgacaaagtggctagttaagttctaaaagctacttcccgttttcttaaaaaaaaaaagctacttcccgtttcaaaataactggatgagacattagtaaacgaacatggagcagccttctttgtgcaatgtcttctattatttgcgtagctgttttgaattatatgctcgaaatttgttagaagattattttggttctctcgagctacggtttggaaagtttctcattttccggacatgttttcgaaaatggaaagtgtcagtcggacattttttttcgaaaattttcgaaaacggaaatgaattcggaactttttttcttggaaataaaaacaaatacagtaaggctactattcgtaggaaaccggcatcgtaaactttccggaaacaattttggaaactttctggaaacgaaaacttttcatatacagttgattagctttagccttctctactctatgttcagatttttcatagtattgaggtggttagttgaatgaagattttgattttagtacggtactttagatgttttttcttttgcctagttactgtttcattatttggccatgccatactaattacaggtatagatg

SEQ ID NO: 97891 - DNA, 949 bp, Oryza sativa
attaccgccagataaccaagatagggttaagagctagcataggttcactgcataatgtaaaagtatacgtgtatcatggctgattttactattgttttgtaaacacggagtaataatagtatttgtcaaggtttcttgcctggatgacatgatgttggaatgcaaatggttcagagagatttctatggaggctctgatgtacagagtatttcaggcagtcagtttcaacattgtgccagccagagtatagaatgggcatggctagtgaagagagtcgaggtgatccaaaatataacaaatataaagttagctagtgcaaggtaaaaaaaagattggactaggccctaggggtgatccaaagtaaaactacagcaatagaagatgacccaaagtgctcaagttattttatttaatgaaccggtacttactgtgtcaatttcattgaatagagtaggagaaaaaccgtatagtataaacgggttatttacaaagaaggaaaaacacaaaccctaagtaacaagactagagagggcccttgctcttgccaaggtctatggttttgcttccttttgatcttggcaactaggtatgttgccggtgtctgaacacccgctagtttgctctttccatatttctcaagaaatctggaggataaggctgcgcaagccttttttggcactcccggggtggaagccaggtccaagtccaaccaacactcgttcgtgaaccgtcgcatggttactctaatttactagatcgatttgattgtggagatccaagttgatatcaaaccccaaatccttctcgtacatctgcatctgcactccgtcatgagatgcaggaccgtttccaaggcactcaaaattaaatttgaagttggtgtctatctaacaagcccgctttaaacccaagaattttactccgccatggtggaaattaattgctctca

SEQ ID NO: 97892 - DNA, 682 bp, Oryza sativa
tagactaataacaaaacaaattatataatccgcctgtaaaccgcgagatgaatttattaagcctaattaatctgtcattagcaaatatttactgtagcaccacattgtcagatcatggcgcaattaggtttaaaagattcgtctcgcaatttacacgcaaactgtgtaattagttttttttttatcaatatttaatactctgtacatgtattcaaacgttcgatgtgacgagacaaaaaaaattgccggtggatctaaacacccccttattttccgttgacttggcgtctatcccttttatatccgagacttagggactgttcagattgatgtcattttcaaccatatcattttttggtaaaattgctaaaaaaaatgtctacgtttagtttgttgccaaatttggtaaatacatagccaaaattttgatgaggtttattttggctacaatctgaacatgccattaattcgttgtgcaagaatatgttattgcttctaattagtaaaactgtttttactaatactccctccatttcaaaatataaggctcaaccaccctcaatttaaaaactaagaaataattattatcatcttatagtttgaatcaccctaattataaatataatgtatgcatctaatagaatttaagatattgaggatggatgactaaaataataataat

SEQ ID NO: 97893 - DNA, 639 bp, Oryza sativa
catcgcgcgccggtagctgacctcactccgccccgtggagatccaaaaggttttttggtggtggttgttcgtctcggattatcttctggccgcaccgcacatcgggggcagctctgctctgtgagtcccctccgatcctttttgcttcgcgtcgcattattattattatttttttgcgtaattttggttgttgtgctttatcgcgtgagttggtaggtagtatcatgagccaaacgatctgttgtttctgattagtactagtgtgtgactgattacgatggatggcaattggcatcggtgtgcattttggggacgagaaaaccgggtgattgatggaatcgaacgcgttcaaaaggatttctctgcgattagcccagatttttttttctgaaattctggcattcccgtgacagaacattggtttttggtgttttttttttaaaaaaaaatggaagaaggtagcagaatcttgtagataagtgatgggggagtgctctggtaattatttgaagtttgacagaccgaatgctccctgatgactgatgtttacatgaccagtaaccacacatgataggagcaactgataatattgttcttggtatttgtgataaacttcttatagagtactaggtgaaatga

SEQ ID NO: 97894 - DNA, 2180 bp, Oryza sativa
acgtacatatgttttttcctttatcatgatttattataagtatatatgtgcttatggtttatttttcttgtggcgaacagtagtaagtaataattactttatttctttcttcaatcatacgtacgtaagaagtatttttttgcccaggtccacaataatatatttgtcctcatgtatatggatatatgaggaaggtgttacttttttttaataatagatctaatctaatggtataaaatattggaaccacccatttaagtgaaaatgtatgaattgatatactgtgacggaccggaagcatattggattctacccttcaaattttattagctatagaataggattatataagtaggagggagggatgattagacgaaggaagaaacatatacgtactatgtatatatgtacttgcaatgtgggctagtgggtgggagagagtatatgcacgtaacgtacgtacaggtgtgaccatatgtacttctaatttctaatgtctaggttgttgtaagattaatttaatctaagagtttataatattggacctaccaatttaagttaaaataaacgttacatatgtttttttctcaaaatttatatgattttctctaatttattagagtgtcacgtgatatggtttaggagcgattatagaagtcccatgtggcccaaaatttatatgattttctttaatttattagagtgtcatgtggcgtcttaggaatgattataggagtcccacgtggcagcttgagaatgtttgctagaagtttaatggacttttagtatataatagatagataataaatggctatatatataatgggtgtaaactttattttaaaatattgcatttctaatttaggtatgtatatttggaaagagcgatatgatgataaaatttatatatgtttgtaaagacctagatttaacgctggtgtgatattttagttatgagcttagtagctagttgtccgcgaatatagacataataattaccttacatggttacagtgtacttatattttgcattaacccttctcctctttacaaagtaccaatccaaaaatacgacatatatatgtatgcatttatattccaaagaaactatatacaagggaaaaaaagatacaaaaggaaggagagcggcgtgtttttttttgttgcgatacatacgtacatcatgtacgtacctatggggaggtgagaggctggtgggaccatagttgtagttgcggttagctttaagacaaatctaatatataatattggacccaccaattttaatgaaaatcaatgtacggatgttttgcttttttctcagattttctagggttttctctaatttattagagcgccatgtggcaacttgagagcgtttgtaggaagtttaatggacttttagtatataatagaagatttaaacttattattgctaccgcaatctatagacatttaatagagagggagtttatagttgcgcgatgctcaacttaacatactagtactattaaatagcatacagatgtcgccatcattagtgtcggttcaataaaacctaacactaactatggttttctgcacccaacactctcacactaagtagaggtaacacatgccactaataagaagacattagcgccgggttatatacaaaccaatattgattattctacgtacaatcaatatcgatttataagaatacccgacacttattggttaatcatcagtgtcggttcaagtcgattatagtgggatgggctagcctgcgaaaagtcatcaatgtcgggtcctaagcattcgtgccggtttgggatatgtacttaactttttcatacaaattcgaattatgataaagtttatatgaaaaatgtagctcttgacaatatctatgattttatagttaacttttttagttgaatacttttagatactcaaatccattattcaaaaatcgattagaaaggctaaaaaggaaaatatccatttgctaatagaattgatgtggatgtgagttggttgaaatagatgcacgtggtagggtgtgtccaattcggtggtagattgctataacaattagttgttgcacttgtacataatgaaatgatagaatataaaatgtggagtacaaaaggttaggctccttgatccgaaggaaaaacatagaaattttggagaat

SEQ ID NO: 97895 - DNA, 596 bp, Oryza sativa
tgctttcatgtcgtttctgttgtttgtttttacctcaatcagcgagtgctgtgcttcagcatggcatctgaagatattgtaatgcgggcagcagggcaattgatgccgtcttcctaaaagatctggttggctagttctgaaatgtccgctcagctgtgataaaatgctctttatgcaggagtccctttctaatgtttatcccagattgtgtgccatctgtgttatgcaggcagtctggttggtggaacctgcaatcaaatgattctttccctcgaggtttttgccaaattctcgtgcggtcgtgcctcgtaagcttggtgaaagccttctgtaaatttggatctgatcgtttgtttgagctagttggttggcttcttaaaccgtcttttcccctctgttcttatgctacgataatttggttttaatagatggccaaatttcagctaaaagtgtttttttaaaaatattatttgctacaacattttggtcttaataatggccagcattcagcataaaatgtgtgaggtcccccaaaaaatttgcccccacgcaggatcgaactacggaccttcagtttacaagactgacgctctacc

SEQ ID NO: 97896 - DNA, 726 bp, Oryza sativa
cattttccatgctgtgtccatacgattaaaagcaacctagcttagcttctggaaaacacgtagccactgagatcagaaaggatcaaaagagcactttgttttttccttcttttttttttctttttagatgaaccaagagtactttcttacctctccttgatcgatcggcgaattagtagagaaagtgtccaaaaaaaatatttagtaactcatgcacataagtgcgatcttatgtggactagtcgagacctcacaattggaaactattattttccagaacacgcaaaagattttgttacattattccattacaaaagcacgttacaagccgttcatgcatgcttaattggtgtcaaccttataaggccagagtttgttgtcaacgtcacctcccaattatactttattaattctcatcatgttaatgtcatgtcctcggttatctttgaaaagtgtgaggaaagttacgtacttcctccgtttcatattataagattttctaacattattcatatttatatatatgttaataaatctagacgtatatgtatgcctagattcattaacatctatatgaatgtggacaatgctggaaagtcttataacctagaacggagggagtaaaagaacacacaaaaaaaacccaacgaggacattaaaatacgctccggtgttgttgaacaagcaatcgattccaacaatgacaaagaaaaggatttagcggtg

SEQ ID NO: 97897 - DNA, 683 bp, Oryza sativa
cagctgtaattattcggtgaaacccacccagtaatgtggcctaactagcaatagcatggcaacaagtaggggaatctgtcacttttatatacctaaaagacactcttagaacactgctagtcatctgtaacggctatgattctatcactacaatttgggggggggagtagctaaattttagtatccaacactcctatattccaaaaaaacaaagagatttggcacagctcaaataaaaaagaagcaaaactttcaagaagacagtgatagagcatatattctgctacagaaatgtgtgcttaaaattccaatcatgcataccaaagcttacagctttatacgaggaaggggaatattagcaggtcctaacaaattcaagaggataaaaagtagcaaatatgccatcaaaggatcaatagggctgcaatattatactgcatagataccataattcaaaattcatttctatcattgttgcaatttgaatttggtttcattattatccagataataccctcaaatgtagaaaatgtacaattactaaaacatctttgtgcatctttcaaaaacaaggagctagaccatcaatctgctctaaaactctctaatagttgaattatgtatgctcaatcaatgccctgatcactttcaaagttctgagaaagagggaggatgatttgaag

SEQ ID NO: 97898 - DNA, 705 bp, Oryza sativa
acatgaaggtatactttatcagtatattccataagtcgtaggatatgaggtatgccttatccataaccctgacaagtttgtactgcatatgtttttttacaaagtatatcacagtaaatcaaggaaattgctaaaaaccttgtcgcaagttctaattcaataagcagtactaaaataccatatcattgatcatacgtaccaaatattgtgctcgtgttgtaaaaaaaaaaatttaccctctttccatatcgaatacccaatcttaaaatccgaggcccgtccctggtcgtgggggtaaaacaggaaatgggcggtgaaaaaagttaccggttacgtgaaaattgcagtgtactggcatggaaactgtgcttactatacattacggcggaaaatgacgtgtatacattgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattacctccgttggtgttgacgggagtcgggctgcaggaat

SEQ ID NO: 97899 - DNA, 681 bp, Oryza sativa
tgaagtctgaagattaaacacaaaaactaacggtattttgcaaagcatattttcacgcgtcccttcattataaaaatgtattatttaccccccaacccccaccatacccctttcaaatataaccataaggagaaacagaaaactaacaatcactttgcaaagcagtacatagcccttaaacccatttttcatgcaaagtatcttgtatacattgtggactgtgtagcacaaaatgccctcacacaagatgcataagtgcagtaggacttatgcaggtctccgaatttcataaaaaacatcatagaaacctacgaaaaaataaagagagaactctaggtatcaagaggatttggcttgttgtcacagtcactttagctctttctacagagtgttgacccatttgtttgacacataaactagccaaaaaatttcagtcagtgggaactgatttggtcaccagaagaagcatgataaccaactgaatatgcacacattattacataaggtactcattaaaagtacaggtatacacaaaatgggggaacattggaacacaatctaagaaaatcaactaaaactaatcactatattataagctacaaacatataaccaagataaccaaagattgttcaataatatgcccacaatagccacattgcatgatacaatttccaacattc

SEQ ID NO: 97900 - DNA, 981 bp, Oryza sativa
aatatagatgtgaaagttctttttaaaaaaaggacatctaatctaatggtctacaatattgggtcaacaatttaaataaaaatcgacggtgagattaaacagtgccatgtggcggtctaggagtatttgtagaaacgctatgtggcagtttaagagcgtttctaggaagtttaatggacttttagtatataatagatagatagatagatagatagatagatagatagatagatagatagatagatagatagatagatttcatgttgtttcagttgagaaagttaatttctagaatttccaaagttggtaaaaaaagtatttgagacatgttgtctattatcttgtcaaattttggtagtgccaaatactgtatctattatgactaaaaatagtagtaaaccaaacatgtacacatatcataatgagatatggtgcactcactttgattccaacagtagacttagttacccttcgtttatactacataaaaagaattatttattcataaaaggggtagcatttatttagcaagggcaaacaaaaaagaggctctgtagaattacgtataaattttaaaacaacttaaacgacttacatttggaactattgggagtatctatactactataaaagatattagtagtggtggttattctgtcaccatcactatttgtattttctttttaaaattagtctttgttatttttaaatattatacaatagtctaatatttatttgaatcaaatggatatattatgtatattcaaataagcaaacatgtctataacaacttattattattattattattattattattattattattattattattattattattattattattattattgagttaattgtactttggttcaccttttattaccaaagtttcactttgagccaccctctaactaatattgtcactttagactaggtaaaattacctttgttacggtttggaccacccca

SEQ ID NO: 97901 - DNA, 613 bp, Oryza sativa
tgttgcactgtgatgtggaatctaattatttagaatctttagtaaggctgtgttcgctatgggttgttcccaacttggaacagtagcacggaaaacggagcaatccattagcgcgtgattaattaagtattagctattttttttttcaaaaatggattaatttgattttttttaagcaacttttgtatagaaactttttgcaaaaaacacaccgtttagcagtttgaaaagcgtgcgcgtggaaaacgagggagataggttgggaaaatggacgtccgaacacagcctaagacttttctgttagagccaaacaagaaacttagaactaaatgctactattatgcatgcatttgtaaatccatcacaatgctgtcggtatgatttgttcagattactagaagcacagatacaagaaggattcaatatttcatattgttttgttatcattccttctgatagcttgtcttgattttcctgataccctgctctattaattgtatgtaattaatctgcactcatagagaagtacagtgtgctccaagtgtttttaacaactaaaaacctgtgctggtgatttgtcctgggttgtgcgctttaataattctttattgtt

SEQ ID NO: 97902 - DNA, 688 bp, Oryza sativa
aattcctgcagccctccggagtgatagcattggactatgtccaaacgctagagatctggcagatcagtttaccaagggggtaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcacttatggaattgagtgaaacctaactgcacaagactgacaattcaaggcatagtccattgttcagttgtggtcaggtgtagctctttttctaagtgaaagttcaacttaacagtcttcaccgaaacactggtatataaaagctgctatggaatagagagcattctcatgagccttgaaatttggtggggattgttagattta

SEQ ID NO: 97903 - DNA, 667 bp, Oryza sativa
tcatttgattaggccgtccacaggaattggatgagaaagacatactcgaaggaaaattttaaagaggttggagctcttgctaactttcattcaaaatatctacaggattatctattccataggattttcaatggaaaaggatataattcaatcatttatgtaaaagtccttcatatgaatctttaatatataattggaatatttgtttttcctggaccttatcgttcaagttaagattttgtcgaacttttaaaattttaaaaacaagtgtattgttccatacattttgctatcttctttatgctaattggatgatctcctataaattgcagcgttaattttaggaggccaagaaatttagaaatgactccattactcagacaaaaggttagaagttccaatgttaagaaaaaaaaatgtcactcaaccatctatcacattgtacgtcgttgatagtaattatgaataatttaatatatctcatttgtatatccattatcaaaatgggaaaaaaatataaccttgaactttaattcgtgggtaattttattatcctttagaaaatcctaagtggtatcatagggcctgttcggcgtgcctagatggcagccagcagctacagtaacaacgtacaatttctacgtagttgctgctgctgcagcagcag

SEQ ID NO: 97904 - DNA, 683 bp, Oryza sativa
ttagtggcacttctgttagtaacaaattaaggccttatgtgcatttgaaaaaagtaaaaaagaaaaatctcgaatgaaaggatgaaggaaataattgtttgccgctggcaggtgagcaggagctttgacctcctccatggttttaaatttttgtgctgaattcactatagcttcagcaaaatttaagtgtatctgacttatgactgatcgttgtgattgatgttaattcctcatgctccaaataaaactatctagggcatgtgcgtgcctttcgccctccgaagctccaacactactgcacattattttcctgccctcaaaattcatataacaatttaacaatcagatcttatttgtcatgcctccatatcccagatccttgctgaattttataagttaaattatagtattctgaaattttgtattttctattaaatattaataaaatgattcacctctgtaaggtttaacagttagaaatatccaattaaaaaatttggtccggacctgtgccaaactgaagtttagttttttctctacaagtgaacaaccaaacataggcaaataaatttcataaaatcctatagtttaaccagtagtatacctctagcaaaatttactcatcatgaaacaattcaaatatgtttggtgataacccacatcctcctcccgtgtcacctctc

SEQ ID NO: 97905 - DNA, 640 bp, Oryza sativa
tgatttatgtgtaagtgtgtcttaatgcctcgagagagtggggctggtgatggatcgagagtcatcctgtcagactagcaacataggtgcggtataaccggtgcatatctggctctcacacagaatttcgtcagaacttcattgaatttgagggtagcttttaattccgctaaaagttttcgttttttggtgtttatatcattcatcccatctgataggcttggttcttatatttccatcccacaaatatcttgaatactcttttttttttatgtgaggagtagaatttttttttctcttgtgatgatgggacacaacagatgcaatagctcaatttccctgtataaatcagctgagaatgatcacaatgtacctccaaatgcatgcaactacagtccttcaatgtccgagtatcacttgtaaaagatcattgacaatttgacattgcgatccattttttaataaaagaaagcacaaaagtatagtgtcttgtgctcgcggctatattcatctatgagaaatcgcatctttttcttttcagtccttgcttggtgtacatgattttacaaatataaatatagcttacacttttcgatcgaagaagaagatgacacagcgatgtttacataatcgtaatgaa

SEQ ID NO: 97906 - DNA, 634 bp, Oryza sativa
gtgccaatatttttttaagtatacggacacatatttgaactattaaacgtagactaataacaaaacaaattatagattatgcctgtaaactgcgagatggatctattaagcctaattaattcatcattagcaaatatttactgtagcaccatattgtcaaatcatggtgtaattaggctcaaaagattcatctcacgatttacatgcaaactgtgcaattgtttttttttgtccacatttaatactccatgcatgtgtccaagcagttgatgtgatagaaaagttaaaagtttgaagaaaaaattttgaatctaaacgtggcctaattcttaacgagccatacctacgtacaacatatccttttataatccttttatagcttctgaattacaattcttatagagtactccgtttccattagcacgttttttaaattgttaaatgatatatttcttatgaaatctttattttagaaggtgttttaaaatatcgagcaaatctattttctaagtttgtaacaactcaaataatcatacgctaatagctttatcattttatatgtcttatacttaattctagattcgaacaggaccaagcagtaaaacatctcacttttgtattttttaaacggtca

SEQ ID NO: 97907 - DNA, 676 bp, Oryza sativa
tgtaacaggatcacgagagcactctcctaccatgtatactggccattaaaaaaaaaactttcgactataaatttattatcggtacaataaatttcttacctcgtgtaccggctagcaacctatatccggattcgtagtcatactaatgctacattttgaaacgaatgaataactatatatttaagcacggacgatatctaaatttgaacctagtaactcaattactagttttttttaaaaaaaatactagtaattgaatttattttttttattactgcatatgtagtgctagtgcgggtgctcttcctgcagttggccacttggccaccgcccggtcaacctggcatatttcttttccttcctttggctttgctcgcctagcagaaaaaaaggatcaaaaggcaaaaacaggtctcatcgatcgcaaccgatcactccacttttaattatttcatccattatctcctttagttcgtttctcttttcttttccccctttgacctccatttctttttcttttttgtgtttcttaattagactagccttcaaaactttccttttttttcccctctcttttttatctagtgccctgcctttagaattccagttagggagggatcattttgactggaaattctagctggtgttcttttcttatcacagttggtttggatca

SEQ ID NO: 97908 - DNA, 632 bp, Oryza sativa
atgtgtgggttatccagtcaagccccacgtgtggaaattgattttcacaggtggtgggtataatcgaaatataaaaattccacaagagatcgaatcatgacgacaaaaccaagacattatatttgcctaattatggactctcctcctcgatctagtataattacaatgtattagggtagccatgacgatcgaccggttaggcagccggtcaatttcccttccctatgctatagttgccatgcatgttgttacaacatgtgtacatctctatttaagagagagtctaagataatatttgactctaattctattctaacatatattgttacaactaaaaaatctaatttgtaactgattttgtatatatattcaacacaaactataacagtgataaatttgatggtataatactatacgtagaccgacataaagatactcatgtgaaaaaaggaattgcattttggtagaaatacagtttgtttggcatctacatccaacctaaacaattttaactccagttagttaaaccacatagttatctagctaaacatgatgtttgtgagtgcactgacaccgatatctactctagattttgaatcatgataacctagggatacaagggctgcaggaat

SEQ ID NO: 97909 - DNA, 672 bp, Oryza sativa
tgatgccatttttttatttgatcgtgtttggcatatgaaacaattaaataaagaggccctacaatcccataacaattggttttgttccctcctgaccagggaatcgatcataataaatgaagcgggacgtacagacaagcaggcgcctcgctgtcgacgggtatgtcgcctaccactgaaagcacaacgccatttaatcctggaaaattcgctcccatggggagtcgaacccaagacctcaggtgctactgagtctcttgtaaccactaggctacatgcccttttgcagataagtgtaatactattgaaatcacttctataattttttttctagatttttagttgcgtacacgataagacttgtgtgcacatacacctattcttatgagcatcttggaaagattgagccgacatatataactaatttggcagcaaatcaaacgaagtcattgtcaattcttgctaaaaatttggtaatgaccaatttttgctgtgccaaaaaaaaaatgctaacggcaatgagccaatcggccaaacaagcgtatagcaaatttgcactgaggcctacctgttacataatagtacccctacatatatattctccaaactgttccatagggaccataaaaatagtggaaagtgggaggacctgggtacaatttatccccactg

SEQ ID NO: 97910 - DNA, 866 bp, Oryza sativa
tacactatagatatttgtcaaaatataaacaataatatagtgcttaggagattatcttggtagtattctttaaaaaaatgactttgtcccggttacatataaattcctcttttgttttgggataaaatttgactcatcgaaattatgtgacgaagggagtataagcaatataagtctatctttaattagataaagtagtctattagctacgttttaacgaaaaataatttcattaatatataataaatccataaagtcatctatagcacacaataaaaaatgttagtaaaattttggaaactgaaatgctaaattctaaaaacgaatcacatatagtacaaatatatatgaaccaactccatcattgtgacacaattttttcttggttgtacagtttcaaacaattttagtatagagtttatacgttgcaaggataatcagaagaaaaacataaccaatgtccaaacctattattaaccaaaatatgtttaaaatggactcaaaaaaatatttcaacaatatcatcctaacatttgtaataaaaactaaagcaacattaaataaggtgtctgcgcgtatgcgcgggctactttcctagtttgtaataatgattaatcataacatctttaatgggtgcatagttgatggttacatcagcatatcacagacacacatacaaatatatactatatactcatcactaatatatataactttgaatgatataaagattagtcggatcatattaatctttattaaaagatgaggttatttgtaaaccgtgtgatttataaaattatatgcacaacatttgttggatctttctaaatataggtcaatgatctatatgtaattttttttcctca

SEQ ID NO: 97911 - DNA, 694 bp, Oryza sativa
gttagagaaattaaacgagtaatatgcaagtttaggtactgggatgacacagtcgaataagtttgaggatctaaacagtcgatttgcgagtttagggaccgggatgacacaacggtacaagtttagggaccggtgatggactttactcttgaaggagtttccattcttaaatagtatattttcatatttgaatataccttttgtataatatcagatatgtggtattcctggtagttagaaatataagtataggatgtattcataacctgtaaaactgacacacatatatatcaacctttaggaaactttatattctacagttattgtgaatccaacaggtgagaatacagagaagccgagaatctaaacaaaatgttaatttttttggggggctttaattctgtaagaagttattacgggtagtagaaatactattataggccctgttctaatgtaatgaaaaggatggattaaattttgtattaaagtggcacgttttttaaattgctaaatagtgtgtttcgtgcgaaaactttctatatgaaagttgttctaaaatgtcagattaatccatttttcaagtttgtaataattaaaacttaattaatcacacgctattaacacctcgttttgcatgaaacacttaattttcatcttcagtagattcaaacaccacctatgtcgctatgtgtca

SEQ ID NO: 97912 - DNA, 682 bp, Oryza sativa
tggacgccacggcatcacctgccggtgttgctcacgagtgcaagagagaccaaagatgattaagaaatgccgtactcacttaacggccaccgttcttcctctcatcgccatcaattcagttagtgaagagaacctaattgcagaggttaattgctactacctacttctaatttttttggatgcttgactagagggagaaagacttacgttgttcacagttgacgatctagtagaacgtatctgaactttgtacacaatctgtggttggttctgaaccgaagcgcggagcgccacatttttatcagcttttctctccctgcatgttgaagaatgttcagtccaaaaatccaatggcgtgagcatttgaaaaagatgaatgatcaagtaaatgtacgggagaaagccaaaagccgccatgaatgggaaggtgaaacgagcaaaggagttcacctccacgactccttccttccattcttcatctcttgctttcaccttgtcaaatctcaaatataccaatgaacatgcgtgcagcctgtacatacacagtatgtgggttgttgtctgcaaatcctcaactgttccggcgaggcagtttcgctgtgttgagttgagtgactcgaaagtcaacatgaggggagctaatctgcatgtcacaatattctcgagcagatcataggatcga

SEQ ID NO: 97913 - DNA, 563 bp, Oryza sativa
catggtattcatggacgtaacaagctcattattgatgaaaataaaaagaaattgcagattacatccaatatagaattatacaaaacttcctacatcaaataggttccagttatttgtttccattatgaaggtttacttctacatggcatgctgtttcatcaaatatcaaaggaaaagctgatgtacagattagacaaagcatctgccaaatgaacattagtcctagtgcacatagcagatgatgcagcacacaataaaatcaagaggtctactaaacaaaatacacttctacatatgtgtgtgcgcgcgcgcgcaagagagagagagagagagagacctggagggatgtacccatgcaccactcgctgccaggacgaaaggggtttcatgtaatgcagctctcacagaagtatcattttctgccaatagtttcacatcacggagaattgctgaaacaacagctggttgtgatagaaactcggatattcgaggaagcacgtggtccttgtaaaattcagccttttgaagttccctaatagcaaagtatgataccaaaattgact

SEQ ID NO: 97914 - DNA, 534 bp, Oryza sativa
taggggccttattggacctgattttttagtctcaactctcaaaattagtataggggctgtgtttagaacctctactggagatgctctaagggaaaatatatggaatggagcctctgcaaccctaattagtgtggatccatcttatatatattgtcatcacataatatttcatgataggaaaaactataagctatagaactttaacaccgctgaggtcgataacatagcacacctcaaagtttaggtggatcaaacacgttagccacttgccactaggtcatggctgatcagtgacagtacatggtggattggtgccgccctgatgcttagaccattgctaagattttcagcccgtgtcaaaagacaaaaaaagaggtttctatttaacaaatactaaataaacagagtacattttacttcaatctatataaatatagaaaaattgcatgaatttcatgtgatcaacgtcaactatagctataccaaaggaacttactaactgacaacgatggtgatgatcatgactaagtagga

SEQ ID NO: 97915 - DNA, 671 bp, Oryza sativa
ttgaaatcctaactttcgtgaagtgaaaaacgatgttgggactgttctggccactaatgatgaaataaataatttgccaagtgataatttgatgggaacccttttggtcaatttatatcttcatgaaggagaattcaatttcattgtgactttctagtgtttcacgtattatagagagagaaaccaggagagaaaaatacaagaaaaagagaactactccccccgtcccaaaatatagcaacttgtctacctacattttcttctcaaccgatcacaaccttttcccatttaatttctccacctatttcctcttctcaaccaatcataaccttcccctatttcattccaactaattccttaacacctgtgtccaaccttcaagttcttatattttgggacagaggtagtagttaatagttacttcctctgtcccataaaacaattcattttggctattcatttgcatagccaaaatccctcgtatcataggtcggaaagagtatgttcatgaaagatgaaattcatctgttttagtggtttagctgaatatctaaagtttagtatattagttggaataaacaggccttgtatattggtcattatgtttttcatttggtccttggttgacaacaaatataaaaaaattcatggatgcttggtgcgatatataa

SEQ ID NO: 97916 - DNA, 545 bp, Oryza sativa
gaggtgggccccccaccaccaaaaaaaaaaaaaaaaaaaaaaaacctgaagaaagaagagaggagaggaaagagagggaaaaggaaagaagaagagaacctcgcggggtggcatcagcccacgcaggccctcagcattcagtgtcattgagcatgtaggctgtgcaccacctgtgctacccatgagacgatcccaggtgcctgtggaacgcagagcaagaacaccactccctccctttccacctgcatttccatcttgatcatatggaggagaaagtcttagtttaaagctagcctgtctttgacactttcctactccctgtcaatctccattttaaacaatgaaaggcccggtctcaggccataactttggcaggtaacagtgtaaggttagaatttaatgatgccatgtaagtttcatatatatgtatgtttagggttgccatctatgtaagacaactgaagattgttttttacttacactggtcataacaacttttaagaatccagttcaagtgagttgataaaaaggtcaagtccataata

SEQ ID NO: 97917 - DNA, 921 bp, Oryza sativa
aacttttttataaaaacacactatttaaccgtttgaaaatcgtgctaacagaaaataagtaagttgaagtttcgagtggagaaaaaagaactagggcttacacaagggctaacagactcatcttttaacccatgcttatccttataagccaaaatgtgaattttcaatcttaaattttaagttgattgtggagttttttttatcgtagtttatttttccagtctttgcttttatatcgctaaaaaaacgtatataaaatttttatttataaattattttctgtttgtaaaaatactactttacttattccgtcaataagtggaacgatagagtactaacactattatgaaagctttgattgtaacaaacctggttacgccattttttatgtccaagacatttactattccaaaaaccgtaactatggtcaaaatcaatttatattcactgcacggatttacagacgagatgtcaggcggagtatattccattccagggtccgtttattccattccacaagtcacaagttacagcttcgtgataattgttgttttcctgggcgcgagtagatgcagcctccgctggttgttggcgcgcggacgcggcgtgaccgcgtgagtcgcggcgttttcaagcccaatgatcgctgatgcgagcaatctgaccgtcttctgagttcagatatagaatcgccacaagtggagtagacgatggctcagacatgggcgccacgcacaactagcacacgtagcacaccacaccacacagcccataggtagatgtgatgtggctgcttctgccgtttgctttgctctgcaatcctgcatgctctcccagccgggatcgcgtgccatttgcaaagccaccaaactttgcctttgcctgctcctagtactagttgtactactgtgatctgaacat

SEQ ID NO: 97918 - DNA, 559 bp, Oryza sativa
gtgtgtttctacccagtcatgatcaatcattcacgaagtcagaagctcagagcagaacaagtaaacctcaaaatccagctaagggggtacagagaaatacaggattcacgtcgaattttccaaaatgtaaaatctggatgcttactagacgaccaaaatgccgtcttgttccatgcacaacggtaaactttaccttggcaggcaaagaatttaaccactggtcctactaatcgaagactagactggtactattttttttgccaggacgtacaaaggatgaccggccaatttcattaagatagaagaaaagactagcctggtactgcccctataattagccactcaatagcatcagcctttttgaacagcctagcaatcatgttcccaatcatgaattcaaacagaggtagtacggtcctattattcataaacaggtattactattaggacggaattaacatatattttgttcactgagccaaacactaccaccgaaaataacatttttttttgctgacaaatatgaaatatagagttcatagaaggtgatctctttaat

SEQ ID NO: 97919 - DNA, 660 bp, Oryza sativa
aggaggtataattttgtgtgtgtgcatgaaaagtaaaggggaacaggatgttggtgaacagtgataatgttcccacgttgaaacaggataatgtcccgcactgaaagaatgagatatttatattgatgacttcacagatggagcacttgtgagagatgaagcagaggccaaaatcttcaatgcataagggtactccaaggaggtcacaaaaatcaaggactgagaagaagaagactccaggattgctaacaacgttgacatccatcttttccttggttggctctagctaagggaatgacctcagcctaatagagtgtgtttttctcttcttatgtaattcaggtcttcctgaactagaaattctcctctggtatcctaaactatgtgtcctcactgttgtctctgttctgtaaaccagaatatccctttagggtgttaggaccctcaacattctttgtagaacagtttcttcatctcagtctgccatttctcaaagtccagattttagataatggtgtaatgctaagaatatctgttttttccagttctcccagaaaaatgcctaggcttagcaccagattatgctgtttgatcctgctaaaatactgatcctttatctcttgaggcatttaaacccttccctcaagactcaacataaat

SEQ ID NO: 97920 - DNA, 695 bp, Oryza sativa
tagtaataattatatactaagtctaattcaaataaagtatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgccccaattccgtagtcaataattacatactaagtctaattacaaataaagtaatcttatattaaaactcaaataatattagaacactacacaatcttatatgataagtccaattacaggtctaataatcttaattaattgcattacaaatataacaatcatttatattattacgtcacttgcctgct

SEQ ID NO: 97921 - DNA, 730 bp, Oryza sativa
atgaagtatattgttggaatgtaaaaatttattggatgagactattatatttatgagtatgtgatgcatcatattatttgtgacaaatttacttttacatatgatataaaaagtttatacttatttattagttattaaaagttcttttatgtagcatatgtgttttcatagtaatataacagatttgtttattacttcagaacacatatgctaaaaaaatcatttaataactaataaataagtattattttttatgtcatatctaaaagtatatttatcgcaaataatatggtgcataactatctcataaacataatagtctcatataacaaatttctatgctccaacaatatgctctattaatttatatgcttctttataccaaagggcaaaatggattttttcataagaatttaacgatcaagtaacggtcaactagcggaaagggcatggaagggatctaaactaaaattcagaggtatgtaagggattgatcaaaattcaggggtacagaagggattaggtgaactttcaagggtacacaggagattttctcttaaagttatgttaggcttcttgtttaatatatcttgcttgttttgatatcttagtatagagtggtatcggaatattagccgatacatactagatctatttgatcggctatgctataaacacctatataatctttgctttaatatatatttcgacttaagtgatttatactgtc

SEQ ID NO: 97922 - DNA, 2122 bp, Oryza sativa
agtcaagagacaagacatgcatttaatgcaaagattataatacttctccaccggagctaggttaggttgttgggcccatgtggtaaccccttgaggtataaaaggaggtccaggcctagtgatggagggggggacttccgagcgaactggcgcttgggtctcgcaaccccaaacacttgtgttctacactcaatcaatcaagcacaggagtagggtattacgcttctcagcggcacgaacctgtataaaccccttttgtctcatcgtctttgggggatggaaccccctcaagatcacacagcttcgctcaccaagccctcgaatctcacccgctgcccccggccgaactcacaaaggggggcctcacggttccctggtggaggagttctttctccgacaaaatttatttccaaaatttgataacagtgttacaaatgtggcgtgcatgcgatcaatgtgtgggaagcaagtatcaaaattaattaattgaaatacagaagtatgcacgatatgatcgacagtggtgtgtatccccaaaaaaatttagcgtcaggcctatgtataaaaaagaactgaggaattatatgtaccagtgagcatgcacgtgcaaggcacatttttcaccatttatgatcttttcaagctgaatttatcaattgtcaaattagaatcttaagatccatctaatatatgttgtttgtttccatctaaaatattaatgtaaaaattagaatgtgtcgtttccatcacaatttcaaaatagaaacataaaataaatattgaggttctttttgcacttccatcaaaatagaataatttgtagaagtatctttgtatccatttccattcactgtccaacattttcacatattgatgaatcattgaataataagtggggaaccagttcattattgaaaggttaaccttcattatcactactacagtattaaggtgctattgcgtgtttaccaacatgtaatactatatatcttaaaggtgctatcttaaaggtgctagagtcgccgcaagcccacccgatccacgtcatcaaattttgcacaaaacccctcattattttcgtatttctaattgagtccacgtgatcaaagccgttctttcccacgcgtggacaaaatctggccgttcgtttcctagttagtataatgcaacctaattgactgaggggttgaatatattggttgcgcaagcatcacatggagtaattctttccatgtgcatctttcctatttcttcgtagacttatattctgtcatctcttggcaataagctgtgcttttcacatccaatgctcttatattcactccgtctttcatataaaagcattaattgaatgtttcatgaacataaatataccattattagttcataattcgttccattgtcaatgacataaaagatatgatattcataacattttggctctgttcgaaaataataaacattatttcgttagtcacacacatccagttaaccaaatatgcttagcacacaacatatcagttatcaccactaatggcttgttcctatgaaaaaaatttagtgtaaagaaatacatggtctacaatccacataattgatataatctcaaaatgagcatgaacaacattgctcctaggggaaaaaatattactttcagccttttaggttataatcttgacaggttaaagcacttccatatttcacctgacaaaattatcttagtcaaaagatgtttgaagcatttatacatttcacatgttaaattgagctatgcttctagaataaaattgatcaagcaaaacacaatgtacatgaaaaaaaaatcacatataacattgaattcaggttcctatagaattctaacctcaattttttacagggccaatggcacatttcattgagcaacttatctatgtgcatctatcttgtggctgcagcagtgcacaaaaaattgagtacagaccatatttacgataatggctgctcaaaatttcttgttaggacagcggggataccgaagtatttcatcgaacatgtaggcatgtagcttttgtaccaattttcaccatcatcttttctatctgccataacccgtccgggagaaacacaaaactgatcaatg

SEQ ID NO: 97923 - DNA, 3059 bp, Oryza sativa
ggtttattggggataagatagaggaggtagagaggaattcgtttttgccatcaatttgggaagggaagcaacggattcaccggatttgatggaggagacgccggctctcgggaagaacacggtctctggagcttgaagacgcactgtagcgagagggaggcgaattagacttttcttcctgggctggctgaaaacaaagcaaaagaaagaaagaggaggaactcggctgggccgacttgggctgcacagcacgcgcgcgagggagagacatgttgggctgaaatcagcccaacggcttaagaggagatttaaaaacttttttcaattaaaataatcactgaaatgatctttgaattgttaaaaatacttccaatgctcaaatagtttcaagaaaaatcctgaacatacttaaacactcaaaggacttaaaaaaattataatcagaccatttaatgattaatttaatatgtagataattactgaaatgttctttgtatggttaaaattaggaattgagctccgaaaaatccgagaatattccagagagtataattaaccatggagaatttaataaaaattaaatccatccatgctttatatttaggaaattttatttcccatatttaacttcacttgtaaattaatgaacatttaatataaattctaataataatttattaaataatttataaatcctaagacgaaaatcaggatgtgacattcggcgcctggcagcggcactgtgggcgacatacacgcccacaggaggaggaagagggaggcaatatggacttgtgttggttgagctgagaaggaaggtgggctgaggagggaatttcggcccaaaagaattgtttgtgaatttctaatagaatttgaattgtatttgaagggaatttgaatgggaaaggatgaaaagaatttatatttggatataatttctgaaagatatatttttttagtttatttgagtgcaatatcttagaggtggcatataatagaatttatttgatgcaatcaaatgagaaagaaatatatatattagcatggatactatgattcctaaaattgaacctattattaggaatgtgggagggaaataaatggaggaagataaataggacttttagcctcaaaatatatggcatgggttgcaaagaattgtttgaggctaaaaggaaatttagatgacaaggataaaatctatgttcttagcacaagagcaattattcacaatatttgtaataaaattattcttgtgccgagaagaaaatcaagctacaggaattaaattggcggctggatcaaaaggaaggattacgaataggtttggaatcaaaggatgggtcgagaattaaattccaataaaattggaattgctttggtttaggttctagaggaatatgggaaggtttattggaccataattcataaaagtaaaaagggttttcaaactaaatttgaataaaagaattttagtcaaaggaaggttttaaaccaaatcaagaaatacctcaattcaaccacatgtattttaaatgaaaaacacaaaagaagttaaataccagaaagagattttatgcaaattagttttagaaggtccctctaattatattttcctaggtttaggaagttattaagaacataagactcagcatgatgcagaattagaaaatggttaattttcggtatgttacagatttccccccattctattctcatggccctgcgacgctcgcgtgttgcgcatttgtttgctccctcggtggtaagagcccaacccctctcccatctacatgaatgattcatcgctaagtgtgggggctaagttttctagccttatcctagccttaagttgagccctgggtgccgtcgaagccagggaccccctgtgctggctctttcgtagcagctggctttggtcctaccggctggccatggtgcctggcccggctcaactgtggacggggattgctggctctggagtttttcggctctcacactcgtgcggaagtaatcgtccatgtgggagcaaaagagattggaaggaggtcaccgaaaggaaagagcgaacaaaatgtgtagtgtggggacgcaggctcgtgggaacctgacctcatttgctaagtggtcgcagcgtttgctaagtggtcacatgcttcccaaatggttaggaacccatggtgggaggccctcttcgagctaacggtttgaaaggtcgcgacatgcaagcatggtttgtgtttgcttcattcatacaagcgattctttgctataagtgtggggggctacgattcctagctccatcttaggcctgcgacgagctctgggtgccgtccacgtctggggccctctgtgctggctcttccgtagcggctggccacagcgcctagcttggcttgatcgtgggtgaagattgttggctatggaaaatttagtcctcgcactcgtgcgaagataatcgtttgcatagaattattattgtttatatttatctctcatctcttcctcgcggtcccgcggtacccacgtgtcgcgcgatggcttgcctcccttggtaacaaaaagtttgtattcgctttatacatcgaaacgattttttgctaaaagtgtggtggctacgattcctagctctatcctagccctgcatcgagctttgggtaccgtcgacgcccgcggccccctgtgctagctcttccgtagcggctggctttggccccgtcggctggctacggtgcccaacttagcttgatcgcgggtgaagattgctggctatggaaagttcagtcctcacactcacgcgaaaataatcggttgaatagatgaagtagaacacgaacagaggttaacaaaaagcaggggcaagcgaggtacacggtgtaacgtcacgggcccgagagaatctaacaacgtttgctgaatatatacagaaaataagttcatagcctaaggtacgggctagtgagttgccctcaggctagggcgaaaaaggcgcatgggccttagttccagctaagaaagaagaagagattggacccacatatcatcagactaggaga

SEQ ID NO: 97924 - DNA, 944 bp, Oryza sativa
ctccaagactctaaccagtctgaaaatacatcgtttagcataagtacgtagtgatctatggcataagttttcagaaaatgcactgagcatttttctgtaaatttttgtagtccggagaacaatctattggattttttatccataaatgaatgaagctgatacctgatcgagggaaagttagaaacatcaatcagcaggtcaccaatttttgtcttagtagcaggcaataataatggcatcgattgtcgtcgctgaccaccaggatcgtcaccacgatcccccactgcatcggatgctcctttccggctgcaccttagtgcgttggcataaacgaaaaaacctgattgtgttgacaaatctgttgtggagttcccatcatttttcattgtattaagatgccgcctcctatttgtgcagggttctaccaacgtttaagtcaccaactgaaatagaatagaacatgtaagtcagaaactgaaataacctggtttagaggaaggattcagtttgtactgttaaggatttcctcttaaccagactggttttggctagtaatagggatagcaagttcagcctttatctccattctcctaagtattcatgatttggagcttctacagacgtagcatattaaatgcttcagaaaaccacttatctggaacatatctgccaacgagcgaggagggagagagcagacccggcgagcggcggagaaggcggcgacccacagcggcggcggcggcgcgtcccgcggctccgagcggcccgctccctcggcgatgacggcggcaccctgctcccagtggagtcgagcaacagagacggcggcgacacacggatccgaggcggcgacgggcgcgtgtgaggaggcggcggggtagggcgagcggctccagcgggaggcggcgccattgggcgcgcagacactcgcgagcggagcggct

SEQ ID NO: 97925 - DNA, 2243 bp, Oryza sativa
ttcaattacctaagaggagtgacatggggttgccattccctcataaacatcatcaccgatattgacatttacaaatttaaccaatggaagattcctcgggctttcggttccacccaacagacgaggaattgcttgtcaattacctaacaagagtgaaatagggttgtcatcccttatacataccatcaccaatattgacatttacaactttgatccatgggagattcctcagggtttcaattccacacgacggacgaggagttggttgtctcccaaaatgtatcgagaaaatgcctttacacatagaaatattagataatgtctcccaaaatgtctttgccacacaattttgcacatatttctaaaatcacctcaagccatatctaaaatgtccctatgctacaaatattaaggtgatctttatcatgtttctaggcgaggagtgtagattatgagacttcttttagaccatttgaaattgtctcagcatggagagttgccctttttgtgtgtttccttgtgtgtttgtcctaccaaagctcacatttcttggtggcacactgtggcacacttaacattgtagcacacatgcacacctttttgccaccccttgaataggccactacttgacagcctcattggttggctgttgctaaggctgattttcagcaacagcccatcggttggctccttagactatagcatcagatgatagaaaaacttatgctgataagcatcagcctagttgtgctgatatacaacagcatatgccaaccgatggtggcctgaataggccactataaaagaccatccatccttgaccaccatcacactaaaggaactcaacaatagtgaggattctatcatattctcacttatggtgatgtggctcattttcttggccagcttgccaatggatttctagtttcatccgacagatatcgtcgatgttgccaaaagattgctgatcacgacgggagtgttgtcatctcattaacatcatcatcgatattgacatatacaactttgacccacgttttttattgaatatccatgttttggtcatacatactttattattgactggacagatccaccggttgttgaccttgaaccactggcaatggaaaattctattattgatgacattaatgttgtctttatcaatgaggcaacgaccaaggctatcctaatgaggatgatgttagccacaaaattgatacaaaaattctaaacaataaacaacatgtgtaaccaagagattgatgctcatggatcgtagcttcatttgcggccagaatcaacaccgagcatcaggagtgaattggtggatggttttcatttcctttaaaaattaaaaataatttattcatcgtagagaggatggccaaaggcttttcactctctttttgtttgtggagtggcataacaaactaagttgggttaaccagtatagcttaatcgataaaaccataataaatcagttttaagtttgtggtttccttgtttgcatttattataaggctatcaatttgtacttatgtgcatgtagtttatgtgtatgtagtataccgcacaaactcagaagataaatcaaaattcaacatgtaaacaaagttggagaacaaaggaggtgatgcttgaatttatgtaaagaacacggccgtgttcttttctccaacaaaagttggattaaattttggatactcggggcacatttttcaaactgctaaacggtgtgtttagtgcgaaagttttctatataaaagttgttctaaaatattatattaatctatttttaaagtttggaataattaaaactcaattaatcacaggttattataacctcgttttgcgtgaaacacttaatcttcgtcttcaggacattcaaacaccacctaaatatagagtttgggtaataaacagaatcttgtgtgaaaaaaaatgtgtaaagaaacactttcaaaggagtttgtgcgaaaaggaaaaaaagaaaacccattcccttctcacgcaagaaatagctacagtaccatcaccactaggctgctactgctagtgctagccagcgtcgtcctcctactactcgtgaggcgagagggcacgtgacgcggtggggcccacctgccagccaacccagcagcagcagcagcagcagcagcagatggcagcgaccgtcacgacgaccgcgcattgaatgcgggagggagacgcgtctactctttccgtttcgccccctcctc

SEQ ID NO: 97926 - DNA, 998 bp, Oryza sativa
tttcatttgcccttgatatgattccagatttccaggtacacttctatttggcagcgtgcgtcccaaatgcacagctgagtggtggatcaggcatgtttataggtcaggtctcatgtgacggcgactaaaaaaatttcagcaatattcacttagagggtgtttagatccaggggcttaaagtttttgcgtgttatatagagtgtcgcatggggtgttcagccactaataaaaaactaattacaaaatccgtccgtaaaccgccagacaaatttattaagcctaattaatctgtcaataacaaatgtttactgtagcaccacattgtcaactcatggagtaattatgcttaaaagatttatctcgcaaattactcgcaaactgtgcaattagttaattttagcctatatttaatactttatgtaggtgttcaaacattcgatgtgacatggtgaaaattttgattgtttcatctttggcaagcttgaaaaatatatatggcaaatctatacaaccttagtacataaccatacaaccccttaaaccggcatacataatactccctctatcctaaaatataagaatctaatattgaatgtgatattttctaatactacgaatctggacattggtcataggtttttatattttaggacggagagagtatctcagatggaacgctttaaagggctagcagaggaaagaaagttaagagaaaagaggaaggtaaatatactgcaaacaattaatcagcagtactacctccgtcccataaaaaataatctaggattggatgtgacatattctaatacaatgaatctggtcagaggtatgtccacattcatagcattaaaatatatcacatataatactatgttagttttttatgggacgaagggagtaccgatgaaccacgacaacaacagatgagtcggtgaattttactgtagtacagtacatttcaaccgtgagatttaaggtcctgttcgtttctactgaaa

SEQ ID NO: 97927 - DNA, 3600 bp, Oryza sativa
gaatgcttaaacgcagtaatacattttaaaattggaggggtattttttaaaattggaggggtattttttaatataatatagtagcactcagtaattctcttacatggaaaatgaaggaatagttttaatttaattataaacaatggtttcaaccgatacctttgatatttgccagaattttatttttatttacagtggactctcctgtagcagaaataatttgctccctccattctaaaatcaatcaatttttatttatttcatgtataaaagtagatttattttggggcgagagagtatatgttttatttgaagtgatcgtaactacaattgtgcaatataaccttttttttgtattgtcattttctaggtttttttttataatggaaccaacctgcttatgttcaagtggtagacttgggctaattattagtgataagcattgaatccgtcgatagctagatgtatgtgatcttccgaaggtgcttaaaatatgtctgtctagttttctcataggtgtgcacgcgcttgtttatagaggatgtctagttttcttataggtgtgtgtgcgcgcttgtttatagaggatgagtgtgccgtgtacgcgtgtgcgagcgcctctgttttactatatttcttgaggaaaaaaaaagggaaattgcaatatccgaaaaatgctatgggcttggctgctcgatgaatcggtgtgccaatgcccaaagactccaatgccgaagagccaatgcagcgcaccgtttgttccatagggttcaggaggctgctgctcatggatatcgctgaagtgtacggcgccaatttacgccactcgtatcgtacaccgtcgtataccggtatatatacgatcgatcgtacgtacgtgcgcatcgccgtcggtggccgtacgatcgacgtcggcgggggcgaacgaaagcgaccgaacaaattaagagagaagatagatatgaatatgcatgagtagtggttttgcagagagaaataaagggaaaaaaaaggaaatgaaagaatcaaaagagatgagatagaggtcgcaagagttgttgccggcctttgctggaaacggcccagttgatcaaaagagctttttttttttaagagacagtacaaactgggttgatatatcttgacactgataaagtcacaacccattgtcaacggatatgtcatactgaaagaataattagtcataaaaacaagcattaatttaaacccaagtatactagtttcaccacaataagttgtgttatgtgtgcgtgtctcttatcatgcctccctatcccttaaaaaaaaccaactccttttataaatttggacataggttatgtttagatttatgttacaaattttttttaaaaaaaaagagtagagtttaaattacattgtccaccaatattgcttataagcgtgtttcaatgcaactttaatttcagaaaaaaaaaaatggaaattttcattatcattttgttacaaaaaggattgtactccggatttcatattaacatatatgaacatttcaagaatctcttccaatgcatgcatacatctaaaaacggttttctagcctcgagccagcgacggacacaccataggattttcggctttttgcaaaacacccaaatagttttgcaaaacacccatcatatcacagtgtatatattaaatttatttgggtaaaaaggaagatggacataaaagaaggaatatctaggcacaaatcttatttattgtagaaaaaatcttaattaattaagatcacattccattaatatcctaccagtatttaagtttgtaccctttatgcaaaaattttctgcatccgccactgtggctgagcatgattttgtatcacaatctcgatggcctatgatccaggcagtgcgcgcaaaccgcggcatagtgcaatttgcaacctgcaacttgcaaattaatttcatgatcaacgtgtatactgaatacatacacaggataagtgatcagctgtccgtttcagagagaagcaaatggttctaggagctactactgtaatctcatcatcaaggactggacgtatacgtgctcgatcgccgcgcacagatcgatcgattgttcagataagatcgacgagagagacacaaacacaacgtacgtcacacgtagcatcgcgcgtatcttatctttgaattgacctgaattgaatttggaaggccctgagccggcagactagagatacatatctccaaattaatactacaaaagacaaagccaagccagccaagcagagatgtactacgactagctacagatggttaattgattggttcgtcaatgttcatctatacgctaactaatcgctgcatatactgttccctctgtctctagaagtccaatgctaaaggtaaatatgaacgcacatacatccagattcatttctagaatagattagacttttttatagaggaggtagtacttatcaaattgaagttaaattatagaagaacatgattactaattaacatgatacagtacgctcgatctgaaatacgcatgaatggcagcaaattataactaattaagctaactgatcatcaaattaacttacactgcgattaggcttgcaaaattgcgttggatttggccaagaacaagagctaattaacaaagctgaagcgctcgccttcgatcgtcgtcgccacaggccggccttacatgaggagcaggggccaagatgtagccaagaacaacttgccaattgatggatggatccatggccagctagcttagcttcatagatagatcgatcgatcggcaagtcatccttggctgcaccatggcctccgatcccaatgtcaggccgccggcgattcccggctagctgcttaatttcatctttggcaattaaccatagctggcacagcgaataatgagaggaggaagaagaagaaggagaaggagaagaatgatgagttcagatagcaatacagcacgcactgatggcccttatatagactagactacgcgtgctctgatccttccttctaattcttaaatgggattaattaaaacgagcaatttaattaacacgataattaaggtgtgcagtgaggttggtgccgaatcttgagcagggacaggtcctggaatgatctgggcgtgtgtgggggccaatggagaacatagttcgcaatgatcgatcgatcgatcagcacatgcagatgcagcgcatgcaggatcttctgctataaaaggtacaactgagcgtactgtgcatcgtcagcgaatcactgcgtgatttgatttttcagggtttcgggtctagtaactcggggattacacatgtatatccagctggcacccctccatgctgtttctttctctctctttttcggttttttccacctttttttcagattttttttaattcttcagcacacatgttttcaaatctcgattcgaaagtttttcaaatctgattgaaagttttcaaatctgagttgaaagtttttaaattttgtcttacaaatttaaatttcaagttaaaaattttcaaagtttgagttgaaaattctcaaaatttgacttcgaatattaaatcttgagtcgaaa

SEQ ID NO: 97928 - DNA, 553 bp, Oryza sativa
tgtaaacatattttaataacataaaagataagagagaatagcagaaggctacagatctgtagccagttgcagcgttgactctaaaacacaatatgtgtatgataggtgggaccatatattagtactatagtaagtaactattgtatgaattggctattggattggttatagatgaattaaagctagtagtggactatactattaaacttgctcttaggaagtttgttcatggtaaacgagaaagtagctcccagtccaaccttaaataacgcaacccaagagaatataccaaacttctactctagaatatgtcctgataattacaaacacatgtttagaagaacccctatttatgaatgttcggccgaaatcgtaaaccaatgaattgcccttacaatttagggagagttgcgattcatgtggtaagccctgttatcatggcaaaaccagcaaaattggataaaattcatcgaaacattaatttttttttagaatttctttgaacatggtcgagttattgcggaaaagctagctggcgcgcgtttccgaagtt

SEQ ID NO: 97929 - DNA, 682 bp, Oryza sativa
attcctgcagcccgaactatgcgagcatcacttttggaggagcagaatgtcaattattcctttacctcctcagcctgcctttgacaacatggtcgacctttctgctacaccatatttagttgagagaaatggtgataaaccttctagacagtccacaccacccaagccccgtgatggcctacggaagaaggacgaaaattctgctaggtgttcacccctgttaagaatatgctaagtggtaagaaaaacaatgcaaaaccttcctgtaaggctgatggattgaagggtgtaaatatcctcaggatgtctcgtgtagctaagaggaatttgcagagagaaaaagacaaggagaactacaggcgacaccctacagaagcttctgagaatgatacagaagttaagattgaaaacaatgatatggaacttgattttggtgaaatccagaaggtgatgcacctgatgacaatgatggatcagacaatcctggatccgcagaagatgaaaaactttccactcaaggcactgatggtaatgaagagaactgcatgagtaatcagatggatatgctcacagatgaaggcccagttaaggctgaaaccatgataaaaactgaacataattgttcagaaaatcttgatgtggtggccactccaccaagtatttgtatgaggaaagcacaacg

SEQ ID NO: 97930 - DNA, 700 bp, Oryza sativa
tggagctcgaattgaattcctgcagccctgcgctaacctctccagatgaccacagatccgaacacacaccacacgttcgacaccacgacacacctccacgtggcggcatcccgcacgagcgccgcgctgtccggtgtccggactccggacgcgagcaccggccgagagccgcgcgggaaaaaggcatccgaggtcaggagcacgagggtacggggagaccccccgccacgtcggaccggacgggcccagggccccacccgtcagagaggacgacgtggctgcacgcggtggtgggccccacctgccgcccgcgtcagcatctcgtccttctccatccatcgcggccgcggggagcagtaaaaaaaaaaatgggtctcgccgggaggaagacgacgacgaggccgtgcgcccgtgtcgacgcaacgcacgcagcgctatgactttttctctttttttttttgacagcagcgcctgtgattcttctgcgagcgtaacagtggagggtgaattcaaaatttaaaccttgccgcaaaggtaaaaaacgcaaaccggcaaaaccccattgtgatctgtgaattcttcaactttttttctctgtgttcggagctctcctcttcagattctttccctggttcatgtggatggatccgattcatcacccatcaagcgtggagacagctcgttcgtaaacaataacgcc

SEQ ID NO: 97931 - DNA, 653 bp, Oryza sativa
ttgacatgaggcctagcgccctgacataggtaggagtggcaatttccaccagagtcgaggacgggaaatttggtcccatgggtggattgggacagggccccgaggtaatatggggtggggatggcgacatgatttggaatcataccatgcacctatgttggcccgatagccctattagaggagttcacatacatttggagaaactctaatcgtgttatcatcttgttcccttaccattgccgcatgccaagtggatacacgactcagcttctgctatgctcggtgactccgtttcattgtcgcacccaattagaggtgggcactcggtttatttggtgttctataagttcagtttctcaaaatttctacctgaatatcctcattagaaaataaaaccgagaacaataaacctcattcaatttttgttttataccgaactttatggtataaaacggttagtatgcacacacgtacaaatgtgcgggaattattaaattgactcctgcaggaacatattttttcaggtctattatttagttgactttcatttagttttgaatgtacaagaacttattaggatgatgatgaatcatgccatttaccatttccgtaggtgatatagtatggatatagctgccaattatgtctctttt

SEQ ID NO: 97932 - DNA, 3899 bp, Oryza sativa
gaattgtagattttctttactgaaaactgcaagcgacaagttctgttccattggtcaatataatctttttggtgatattctgcaagatgtttagtcaaatccatgactattatatccagactagaaccaaatttataccacaaaatatagtatttattgctgaggtcgtagggtttatttgtaataaaatgtgttcttttttattttatgtatgtatgactacctgcctttgtttaatttatttctcgcatgcttgttttctatacatatctaactttcatgtaacctctgtttttttacctgtcttgttgccggcagcgcggcaacggcgcgcgccacccctagtgttgatataagatgaagggaaagaatccaaatacttcctaaactttagatggaagatcgtctaacaccctgagctttgaaatcggacatccaaccctctaaagtttgaactttgtcatactatccacttgcccttaaaatagttttggatggtggttttgcacatatcataagcttaaacaaacaactttaaataactaatataacatatttatatatcatcagttgtcagtcatcgatttatctttatacaatcatatcttactattattgtgtaggtgtttgtttttcagtgagagctaataagaagtaaaaagaaatatttaagtcatatttttaagtgtaagccataatcagaaagttttacacgtcaattcattagaagatgaaatactcatactctcctactagaatgtttttagaaaatactcctattataagttttagggggtgtttagatcaggggtggttttagcgtgtcacatcgggtattatatagggtgtcgcatggagtgttcggacactaataaaaaagctaattatataatccgtcagtaaaccacgagacgaatttattaagcctaattaatatatcattagtaaatgtttattgtagcactacattgtcaaatcatggagcaattaagcttaaaagattcgtctcgcgaattagtcataatctatgtaattagttattttttagcctatatttaataatacgtacatgtgttcaaacgttcgatgtgacagggggaaagtcctcggaaaaaaacacacggggcatcagttgtactgtctgcaatagggacgctccaacactggtgatgaacacatctttgaggacattgaattcctggacctggaggctgatgcagagccaaggtctgacctgtggttggcagatttgcagaaacggttgccgaaggaagggaacttgcaagaggaggagggataggtttatgtgtggaaaatgagcatggataagcagctgaggacaaaggctggaagagtactgccaaccatttatgctcattgatacagtctgcttgtacgaattgaagttgctctgcaagtttctgaagagagccaatagcccaagactaccacacacaagagccaaacgctgctctgaaaatttctgaaaggagatgactagtacagctgattgacatacacaacaggatgaagattaagattttcgtggcatatttttcaaactgctaaacgatgcgcttcgtgcgaaaactttctgtatgaaagttgctataaaatatcatattaatctatttttaaagtttgtaataattaaaactcaatcaacatacgttaatatcatctcgtttttgcgtaaaaaaattaattttcatctttatctttaagagaaaaggagaaaagaacatcaccgcatagttccaggcctattattgcacagaggttgctgtgcttctcaacgattgccagaagagatcttcagaaagaccccaaagtctagaaactcttccaaacataagctaaggatgtgtttttatttgagtgtaaagtttttaaagtatatgaacgcacatttaaagtattaaacgtagactaataacaaaacaaattacaaattccgtatgtaaactgcgagacgaatttattaagtctaattaatctgtcattagcaaatgtttgttatagcatcacattgtcaaatcatggcgtaattaggcttaaaagattcgtctcgcaatttacatacaaactgtacaattgattttttttccacatttaatgtcctatgcatgtgtccaaacatttgatatgatgtttttggctaaaattttttagatctaaacaaggcctaaatgatacttgtgatggaaaatgcatcaagtttattcacagataacagaggaacatgcatgaagatgaagtgcacatttcaagaggcagggaaaatatcagactactttcatcctactgaagtcagggtgtgtttagttcacgtcaaaattaaaagtttggttaaaattgaaatgatgtgactgaaaagttaaaagtttatgtgtatagaaaagttttaatgtgataaaaaagttaaaagtttaaaaaaaagtttagaactaaactcggccttacctgatcttcagaaagaccccgaagtctagagatgaaaatcttctaaacataagtcaaggatcacaatgcgatgaagaatgcatcaagtttattcacagataacagattgatgaacatgcatgaagatgaagtgcacatttcaagaggcatggaaaatatcagactgtactttcatccttctgaagttagctgatctgtaggaaactaggaacatcttaaggttttgattggaattaggattagtcctagcttagctgtcatcagtggcattacaacagaagcacagaacaacaaccgtggaactgcagcattggaacctagtactgcaaagtctgtcgaagatattatcagcgacacctgtataacaaaagcgtggcacatgagacatggatacattcgcgcattagatgcgatgtcgaccagtcaaccatgtcgatgatataaactatagagatgaatttatagtataaatacttacagatcgcatgaacttcgttattaaaaaaatcgaggtggtcaggtgccacattgccaatgctgcaattccaactgtcaacataaaactatatttatttttatgaagtgtctgaaagttcaaacatgcacatgtgcagatgtctagtgattttattattatgcaaagtactacaacctgtatttcagtttatcaaaattattcatcaaatttgccaactgagctccccttgcggtagaacatatccatcgaagttcaagttgtagtcttagtataggtgcttttgcattttttttctaggatttaatctgatgaggtagtatgctggtgcttgcactttctcggagacttaatctccggaggcactgaatgcacataatatttggtggataagtttatacccatgttaaacgaggctactgttcgaatttgagtgtatgttaggacttagatgcataaagttagtgtgtgcatatgtcaacttaactcgacaaaggaaataagccttacatttgacataaacccctcgttggattactttgagattcgttcaaatccccccacgttaaccctcttccttttcttcttccctcctcaccgatgcacgacatgctcgaccttgacgcctcttgtgctatcacttggatggaagtgtcattaatattgacggagccctcccccctctattccttctcaagccagcagatgcccatgatccgacattttccccatcttcggctgctcataaccaccaccaccgactaccgcttcttacacaagcttgctttgcccctaccgcgctcctttatcccaatgggcgctgacatcgccgttgacgcctcactagcatccattgtccaccaccccccttgtccaccacttcccatgatcatgcctctaagaccgacgatctcctccctcttccccaatccctaccctaaatctaatatggaccctaatc

SEQ ID NO: 97933 - DNA, 1138 bp, Oryza sativa
agggagtacatgtttctcagttgcatgtaattttgccgatttaaagtacttgtgatttatgaaccttcctgtgggaaaaaaaattacactgactagtttactcatttctcctcccacctttgtattaaaactagttccatgtattaacaatgactatttactcatatccacgtcatttctggtgtcatagttcatttcttattatgaagaactcgcatgtgagaattattgatattagcagtcaggctttatcttttcagataatatttaatatgaatttattttatgacttgcccttgggagaaacttacaatgccctcccaaccttttccaggatctttaatatgattcattttaaggcttactcttgggagaaacttacaatgttcttccaactttataggaagtaatcacaacgttacggttgaattagaaggcctaggtggtggtgggactattgatgtggaggtaaatccttacctcttcttttttttttggcaccagtatactctagcaaaggtgcatgtagtgaactaattgtgacctctcagagagaaaaactaagtacctttctaatgacaagaatcttactccctttgcacagcacagcaagttgtacatatatggagtagttagcatcttccccttgcacaatcttaataagtgggaaatcctttgtgctatagttgtaagtaaaatgaccatgttgctcacatgtgatgctatgcaatatatgtcgcggtttccctagcaaaaaacagttctgatgatatattgacagccacctgttatgttgcatcaatatcaatggtttcatgctttgacgaaactgtaggctttattttgttataattgttaatctaagctctaagtataacatatcaggtcaggtataagagttatgatgacattgagcgtgaaaaacaatggtggagaataccttttgtgtctgactttcttgtgaagagcagcctaggatctgctcttagaacggtccttggatctgaaagtataaatgcaagtcagtttgtgcaatctgcatttgggcaactaagttctttcacttacacatatcttccaaagccaccatctttggatattagagctgaggcccctaaaagggctgaacaatctgtag

SEQ ID NO: 97934 - DNA, 1180 bp, Oryza sativa
agtcatatattaaaattgcattagaatcaaaggaggctgtggaattactgcataaatgttgcacaacatgctatgtgcaacacaataatacgcgttgcggacataatgaacatttagtgagttaataagttagtccaaaccaagaaggcaaattcaaagtagatgagctggtgtaaggaccaatgacataacaccttagttaagaattgtgttatggcttttagagactacatatagctcaatactttctcttagattcatctaagcttgattttttaaaatttttaaacctttttaatttttaattttaaaaataaacccatccaaaacttattttcaaaatatgaaccattttggccacgttggccaaactggcgtggcaaaacaatattgtcacgccgctcctgttggcgtgacaacgttatttggccacgcgctctcgatggagtgacagcacaaaactgtcacgcccgctacagccggcgtggcagtgttgttttgccacgccaggcgggctggcaaggccatatggttcagattttgaaaataagttttgcatgagtttatttttaaaatttaaaatagaaaaggttcaaaaaattaaaaaaaaatctctaagcttttaactttttgtgctcacagcaacaaattattctcaggaattcagttgatgccatgtagtatagacaaaaaaaataccgatggtactttgatatcttccagtacgttagtaaatgagctatataaacaattatttattttgtatgtttttacactcttcaagccattgttggtaaaaaaaaaaactgactgtgaagtaacataaatatgatgtgtgctagtagcataaattgtaggagcaatgacaaacatgtaacaaaaaaaagaatggtcttacatgtgtaacagtacatgcaccttacttactgttaactactaaaagcaattactgtgaattactggctcatgaatagtttttggtgatgaaagttgagtgatgcatttcatgtttctatgataagaactttgtgtgctcttagcatcatgatagcatgtggtgctactttggcggcagattgatgtgaatatcacatgagaagtgctttgttttttttaacatcttaccatcatctgcaattacacatttactgaagctgatcaaaatcacacagtgcaatat

SEQ ID NO: 97935 - DNA, 2418 bp, Oryza sativa
gccagctcgagctggctcgagccaggaaatgagccgagctcaagttagctcatttccacccctaatcgccgctctcatacctaagaaaggagtgacggcttctcctggatgagggagacaacgcctaggttcctccctaggcacgccgcacaccgtcagagagaagagagagagagagggcgacaatatcctcaaagttctttctgtataggggtaggtagcttgtggaaagggagcttagaagagttgcacgacggtgcctggggaggcagatcatggctgagatggagacagaggcgtatcaagaggactgacagcaaagagaactgcatgtactgacggttacagcccagtcgatggcaccttcagtcgaagaacgggagctaatggcttaagcaagggtcgaacaaatgtgtccaacattaggctcctttacttcccgtcgagatggtcggatatctcacacgagattccctgcgcccgcctcatcaaagccccaaccatgcgtgctgctacggcgctcgtgtcagtgttgagggtgttagctatagcatggtgatcccctcatcgtgaatgtcgatgggtcgttccctttgtgaagatagggtccacgggacggtctcgatctcactatgagcttgcttctcattgctagcggagcccacgataaggtctagcttgagcaacctctgtcgagctctaggcttccaatgtgcaagccataagtatgagagagagagaagagtgaaaggaaggagggagaagaagacatgtggaccactggaccctatcaaacatcgttattattgtttttgctggacatagcgcataggcaaaaactactctgatatgagttaagacggtaaattaaacggctctataagttaaggggtgtttcttctcggttttaggatcccgttcaaagatcattttggagttgcatattagcggtgtgtataacgggatggtttattagcgtacaattagttaagcattaaattttcaaaaataattttatttgatttattctttaaaaatatatagattttttaataataataataccttttaacgacttagaaagcgtattaacagaaaaagttataatttggatttataatttagaactcagttttagagttaggcctgtattttagaccaacgtaatagttagcagggtaaaaagtaccgggtgatggtgtatgcttatgtgtagttacaaactgctagtactagtacaccgaatggtctacaactaaatcgaaattgttaattggcgcagtcgcgctagataaataactagcgcgcgttttaggtttggcccatcgttagcaaggcccaaggtccaagaacacttttgactttttgtttttcggtccgacagtgcaaatgcatgcaagtgatgcaaatgggcagtcgggcaagtgagtaaatcaatctatagcgtgattaccgctttaattcttcattattagttctagtattgtaattaggtgacgtgattaacacgagcattcatatctgaaaactttcaacccggtttttaaaactttcaactcaaatttaaaaatttcaactcaaaattttgaaacttttcaactcaaaatttcaaaaactttcaagcgaaaattcaaaattttcatctgaaattttaaaactttcaactctaaattttaaaactttcaacttaaatttgaaattttcaactcaattatttgaaactttcaattcaaattttcaaaaactttcaactgaaaattaaaaattttcatccgaattttcaaaactttcaaatccaaatttgaaaactttcaattcaaaattaaaaactttcaaatcaaaattgaaaactttcaactccaaaattttttaaaaatcaattccaattcgagaactttcaagtccaaaattcaaaagtttcaagttcgtatctaaaatttaaatcttcatgttagctagtatttattagcgttaatcatgtaattaacgctaatcacattattagcatagtaggaggggggcacttaagcgggttgatcagaggatttttatttttgtcgctaacaagaacgagaaacaataaatcacggattcctagtctactccacacgctcgcgacttgatcttccggcgcgagcgcgcgcattaggagccccccaactaaatatacacaaccaggttgttattactccagagtactacagagttcaggatagtgtatgatcagggtattgactgatggttttaaaagtttgtggagcttaaagtatttaaatgtatattgaagaacatgaaagatttaacgctctattttcagatttgagatggtcgctgttttttatataaaagtagcttttattaatctcagacgattacataagagatggtccatgtttgatatggtcaatgtatttgggt

SEQ ID NO: 97936 - DNA, 526 bp, Oryza sativa
attcctgcagccccttgacgagctcacggcgaggttctccatcgtcgtattcccagaccacatgagggagtggtcccgcaagtgcaagttcagggtcgtcgccggtgacgacgatggcggcggcgagctccgtatcatcggcgtgagcaacgacgaccacctgagagtattttcctggctacccagcaacggcgactgggtgctcactgctcagtcaagaacaccctgaatttgtccgtggccacccgcgggctgccgggccgcaaggagatgtgtacttcggctgcggcatcgctggcgtaatcgtcgggggcggaaagggggtacctcatgctgtctgtcgccgtcggaggaagcgtggctccggaccatggcggtggaacgggagcaccagcggaacgcgcacgccggcgtcgcgttcccgtatgagctgccgtggccgccggtgttcaacgcctacatcgagcattcaaaaacaatttagtttagaaaccccttcacagatcaatttattgattaattaggg

SEQ ID NO: 97937 - DNA, 596 bp, Oryza sativa
aacaaccttgagagagttctgaatcttatccggtatctgcacgaggctaccgaatccccgcgcaggcacgggttcacgattactgcttcccatcaagaaaccgaatctggtagatgattccctcggtcactgaaacaggaacaaaacccaaatctttgctacatcaatctttcagacccagaaagcagattgatgcacccggctacaacaagaagcaatcttgcatcgaaattaccccaaaaaaagagctttgaagtaagaggacacaatataatggagaggtaagtgcaagatctaaccagagagaaatggaagaatcagagctcggctcaggtggcgactggctctgaaatggaagggcctaaggaaaaagagaggcttttcttgctcggaccaatcatggagttgaacggaggaacaccaaaccacgggaagggacgaggattggtcgattggaggaagcacgtcaaatcccgcaggattgctcagactgggcccacatgccaactgtattcaagggggagtgggctacggcctgaaaatgagtaaaatgggccggatactgtagcttagtaaaagcctcatatggtatatta

SEQ ID NO: 97938 - DNA, 962 bp, Oryza sativa
  unsure (1)..(962): unsure at all n locations
ccaccatttcaaaaagattacatgagttggtgattgtttccatgctgagtgaagaggtgatacctagacaaaagcataatatacaagatcataattccagtgtcaagtgatagactgatggtaactcaggtgaacagtctcaaaggacaagtttgctgaggcaggtttagattggaagaagtttggacaacaaggtgttaatcctcccctgttagtgacatcttaaggtaccaattcaactgagatatactgaaaatcaaggggtcatagttgtttttaggccatcaacaaattatctttgtttctatgtgaccaggtatgctattaaaatcaaggatggtgtaaatattcagtgcaagtattctctgttgaactcaaatattggtgttacaatggatatttgttattccatttctgcgaaaataagcatgccagagaaatggagcgcctgacggtcttacacgagcagttggggttcacataaagattcattgtcagtgcagctaaactttgcatgatatatcagatgcggctatgaaatcgtgagaagagataatctgtggtatctgatcaggttgctatcatggtgcagcaggcaagtagcacagtggctgattatgtgttgccaagctgaagattctgttcagtgaagtctaacagtggagctgtggacgcatcttcatatctgtggctccctctggtgttgtaagttgtacatttccttacaatacttcatcaaactagttgcttaattcatatactttgcctgaaagttaacatggaaagcctaaggaggatatgtgtnnnnnnnnnnnnnnnnnnnnnnnnnnnacaatttcaaccaatggttttgaatcgtgatttatacggttccagggcagtgtgcccaaaaggcggttagtaacatcacaacagccctcaatttttcattccacagccaccacgattttatatacacatga

SEQ ID NO: 97939 - DNA, 617 bp, Oryza sativa
actcttacttatgactttttcgccctgcccacaccctcttaactataaatggcttcacccctgtctagtagccagacgccgacaaggaataaacgacgaaaagacatcacatcctggtgcctgatccacaagacgtcttcgcactcgttgatcagatgccgaataatacttcaaacgaaggctgaactcgatgcctgcaaatatggagatatccaacgcacttctccacccaaggcatagtactgatcattgcaatcttaagtttaagagtaaatttcacaaaactacaggtattttaaccaaattatcacaaaactacagatttaaggagttgtatcacaaaactacacatttagcatcaaatttatcacaaaactacagattttaggttaagtatcacaaaaatgcatatttaatattgaacttatcacaaaactacaacttttagagtttaaatccctagcactattgttatggtggagctataaacattattactttgtgattaaattggttctaaacctataattttattataatttagttactaaacatgtagttttgtggacacttcatcttaaatatgtagttttgtgataaattcggtgctaaatgtg

SEQ ID NO: 97940 - DNA, 501 bp, Oryza sativa
agcggaggccggtggccgctccgtgggcgcgggcagcggccgcgccgcgcgggggccggcggcggcggcgagcggggcggcggttgtggcgagcgcctcctcctcgtgctccttccgtgcggttgtggtgtggggaactagggatggaggagatgggttgtgtggggcccgccattggccagccaaatagagtggccaaatttggctagtggagggagggttttggccagcatccggttggaaaggctgttggagcatgatttttaactagaatgtctaaaatttggcttggagagtgggatggagaggttgttggtgatgctctaagagcatctccaacagcatctccaaatcgaattctccaaacacccatatagccaactttccatctaatttagctagtcaaactagatactcactccaacagactctctattaatcctctccgaaataaaatcggacccacgtgtcagcctcacccccctcttcttcctctctctc

SEQ ID NO: 97941 - DNA, 797 bp, Oryza sativa
ggccaattcgagctctgtaccctggaaaacattcctcctttttttcttcctaaaaaatatcacagaaaagtttttgttcttcctttttgtgccactaatttcagaggtgtatccattggtgggaactctgctatttatattgaattggtgactgataagttctttgaataaaaacatataatgtatcttctgcatttgctcaagatactgggtgtgattacttatgttcaaccttgttatatagcattcaccttagtcattggtataccatatatctattcatgtcctactattatagttattaacctgtcaatcactaattgcagtgatgatatttctcttattaggcagttgttgtaagtattgaccctcgaagagtatatgtcaagaatccggaagaggtgcaattcaaaactgtaaaggtgtccaattaaggtgcaattcaaccactcatactgaatctccatttgcatttcaagcattaagatctcatgtacttttttcaggtccattaggagaagaatatgcatggtaccagtgcacagtaagcaatttgtttccatttactgataattttgcgttactctcttatccatgcacataaggggtatttttgtatattcatatgaaaagtttttcccagtacgcaggaatattattacccaaaacgcccataccaaatttcagactgattaaaacatgtgctttctttagatatttggtgtactaccttttaggcaacattaaatgactttatgctggcataatctactgttgcatgcttgcctttaataaga

SEQ ID NO: 97942 - DNA, 625 bp, Oryza sativa
ttacttggtataaaccccaacttttgtcagaattacttagcccaaagtgaaaataatacttttaagatgggcctaaattaaaactttggtaggaataggtgatcagcacaaattactcaatttcaaacaatcctataccatagcataagaatcagatctttgccatacaactctaacagtaataaagaaaggaaacgaaagctatcgcattagccctaatcaaataccacaggagattgctgtagattatgcgtaggtctcctgcccctttatagaaaaagagggggagattgttgtaggcaagatttggagacaaatctctttgtttagactttttgttcatctagggaagttaaaagtcaaaacaggccatgccagggcatcaatctttctggcctagcttatgcatttcaccccgttgctagtgcgctgacaggtgattaaaatgagccaagaagaatgtgctgattaattaattaggaaatcgctggttgcctagcttgttcactttagtggtgcacacattacattagccactactcactgtcactagcgcgtgttacctagtaaaatgctaattaatgacatcacgagagcagaaagtggactacctgatattattgtg

SEQ ID NO: 97943 - DNA, 585 bp, Oryza sativa
atataaaataactgggttggtaaattttcgtatcgaccaagttatcgtgtgtgtctcgttatcgacagatacattatctactactaaaaaaataattagccgtgaatacttgctcctttctcattagtcacaagagttgaggcgtacaatatagtctttgacattgaataaatattttgatcattaatttcttcctaatataggtacaaaacaagaagcattaacaattaaaagtatttttaaatattaatataatgatattatgtcatacatgaaaatagatagggttaattagatacatgccattaaaaatttgctggtttcgaaatatactattactatttacgtatttgtaacaatgctactgctatttgtaatctcaattgcgtatttgtaacgatgccactgctacttatttgtaatttcaattgcgtatttgtaacgatgccactgctacttatttataatctcagtggtgttaatacccacaaagataccgtattttgcatgtattagacgaaaatgcactcatcttttacctctcttctcttccctcgtcttctacctctctcttcccgctgcttt

SEQ ID NO: 97944 - DNA, 600 bp, Oryza sativa
agtcgccattacccgttctagagactctctcctccgtcggcgaatcaaatcccccaccgaatccgatcgaagcagcgagatttcttcttccgcaatccaaatcgccaccgatggcggccgccgccatctcccacctccgccgcggcgcgccgcgccacgcccgcgcgctcctctacctctcgacccgccgcttctcctcctcctccgccgcgggggtggctcccctcgccgcggtcgccgcctcagcccgccgccttctctccacgtcggtggactccggcgcgtcctcgacgggggagagctacaagccgccgctcttcgaccccttccgcgccgccagcctcgcctcgtcggccccgccgctggagtcgccccccatcgaggagctccccgatgacgcgactcctcccccggaggaagagcctgggctacccgcgcccgagaaggatccggtggcgacggcgtgccagcacgagttggagggtctgaaggcctgggtggagacggtgaggagcaggaaggagtcgacggaggagaaggaggcgtggagtctgctcggccgctcggtcgtgagctactgcggcaccgccgtggggacgg

SEQ ID NO: 97945 - DNA, 560 bp, Oryza sativa
atcaatatgcggtgatatagtgccgttctcctccagtcctgtccacagatataagggtttatatttttttataaaatttcagaaaatagtaaaataataaatatgatggttagaagaataaagtagtaaaaaatgatagatgaaaaaataaaccagtataaaagatagtgagtggggaataaactagtaaaaaatggttgataaggtataaagtattgtctcaaaattataaaatcttttatattatacgataaatttgaagggtataattctttatatttcaagacggaggaaacaagtagacgccatgtcatcttttcgggtatagatatttaatgtttatgataagatctgatcaggattttaaaacattaacaagagtatatatgcaggcgaactcggtacagaaatagaaattctgaacgtcctcaaaaaagagtttaaccgcttcttttaaacttagttgctagacttagctatcataatctgaagcaaaaacgggccggggtatccgtattctgcaaaccatttccggtgagctagtgtgatgagatcgatga

SEQ ID NO: 97946 - DNA, 873 bp, Oryza sativa
gcatgaagaaaaatccaagctcgatcaattatctaaaggtccaatcaaatctaacattgatcggcttgaagctcgcaaaattgatctcttagcacaacttgaagaatgcaacgctgagctggatatggaacgcaagaagctagccgatctcccccagtccattgaagagcagaaagctaggctcaaataggttattaagcatgttgctgaactgaccaagtccttaaaagttattcctgcaaccgatgcgcaagatgctcaagccatagaggaagtagagcagattaggcagaaagctatatcggctatccagcaatacttatcgcagtaatcttactgtaataggacttagagcttctgcaatcggctaaacattcttcatcccttaacatccttctgtgccgattagtatgactgtgagatttgctcaaaaaattttgcactatatttactgcattgtaacagatctatgccccctagttttacaatgtcaacagcattgataaaactataaaacaactaagggcgatataacaatatcggccattgtcaattggcaaacctcagccgattacattataaaccaactaagggcgatataataatatcggccatcacaaggcgatgtacacacatcggctatcatgtatcgacattagtagccgatcacgagttaatccatacactcgagtaatatttcttcaagtatttacaattaagagctcggccataaacttcaccatcaagcccttgcagcatatatgctcccttagaaacaaccttttgaatctagaacggtcctccccaatttggcgaccacttgtcgaatttattatcacgagtaccaatcagcaaaatcaacttccagacaag

SEQ ID NO: 97947 - DNA, 565 bp, Oryza sativa
tttggtgttagatacatgtttgtgtttgtaaaacggggggagtacgtaggagtagtatgaatgatcaacaggttaaagatgaaatgaggaggcagaaaaaaaaaacaaaaaaatgataacgattcaaagttaattgctcctacttctttttgtgggcaggaaaatcattcccctttggcattaaaaataaggacaatttgaaccatgccacataaattttacaaaatttgtgatatgccacctgatccacgtatcattgacttatgtgggtcctacatatcattgagatacgggtggcatatcttaaattttacaaatatagggtggcatgattccaacaaacccttaaaaatactgtgcccacaacgctttgttcactttagagcttgatcacgtaaaacacattgtaaattatttttccaaatccggtctccgtattcacgaaacggacgtacacggtcaaaacatattgtaaatacacggcaacaccaccaaaataatgatgttgtagcatgcatgcatgcgcgtcatgttggctcgagccaaggcattcgatcgtatatgg

SEQ ID NO: 97948 - DNA, 522 bp, Oryza sativa
tccaaatatccaaccatttgaagatcaaaagctgcttttgggtaagcctcaaaaaataactaactcaacaaccattcttctgttggaacaagtactatgaacgcatttcttttcaacaaataatatggtctcagcaagaaccaagagacaatcgaaacagtccacaactaataagagaccctgatatgtagtctattttttgccaaaaaaaaaaggagagatgagagctaaatggtgtatatgctaacaaacagtatttaggctgcttcaactccagtactaataatggcttacattccactattaaacatggtttgttgcacaatatcatgaagctaaacttaacataacaacttatacttgtgaatatgtactgctaaacattgacttgaaatagctcttggtagagttcgtctcctagtttccaaggtaaatgccagtaggctctactcagccacatgaaaacagaaaagtctacttcagatataccagatgaattgccttacactcactctcaaaagt

SEQ ID NO: 97949 - DNA, 746 bp, Oryza sativa
tcttcaacaaaaggtaaaacctcgtcctggcgaattatgttcttaaggaatagtgcttccatcttcatgacattctaatctcgtttatataattcgccgagttatcatatatcttatataatctctagcaatatcgctatctaacccacaatcggctaacatctattaacagacggcagccgattgggttaaatgttgacattgatctagattatataagatatctaccattctatgaatcttctagtagcttgattgtctagatatcattcttcttttcatacttaatgctgcatcaattgagtttgatctattgagtcgtgcttagaatattgatctctagcctgccacctagttgtcgattagaatagcatcggagtttcacccgatcgtatctgatttaactataattatttctatttgctttactgatatgttaaatcggccctttatgccaagatattgctgtatttgaatatattagccatttgcttgatattctatgcctgttttaatatcctgacataaggtagtatcgaggtatttgctgatacatgctagatctatatgatcggctatgctgtaagcttatatagtcttgttattagtatatatttcggtctaagtgattcattctgtctcggcatggcgaccgatctatcccagtcacttgatttaagtatatatcgagataaggagtatatatcgctaacatctacagccgatcaagtaggtttagttttctt

SEQ ID NO: 97950 - DNA, 503 bp, Oryza sativa
atccatccggtctatccggactgggtcaattaaaaaacacgtggtttttcgctcgtgcgcatatagaataaaggagaaatattattttaggataaaattggttacgctcggaatctgtctggtatgtccggaccggatcgattaaaaattaagtgttttttagttttgcccacataaaacaaaggagaaatactattttaggaattggtcacaatgctcggaatccgtccgcttctgtccggaccctcgagtcgattaaaaaacatgtggtttttgcttgtgtgtatatagaataaaggagaaatattattttaggacaaaattagttacgctcggaatcggtccgatctgtccgaaccgggttgattaataaaaactcgtggtttttacctattgtaaacatagaacaaaggggaaatactattttagcacaataatggttacaactcttggaattcgtccagtttgtccggatccacgggttgaccaaaaacacgtggttt

SEQ ID NO: 97951 - DNA, 572 bp, Oryza sativa
ctaggctggtatacatgccatcattcgcgcactccctagcaggcactaagtgccgccatgctgtctccaacccctcctaagctcctccacgctgcatatgtgaccgcacctcccccatgcctcctaggctagcagtcgttgttctgccgtcccaacaccacaagacatactgtagaagctcggtgcatctgcccgtagctgcacagccaacttctcgagctcctcccttcacactaaagtcttcccaatgctccttgatccatgctgaaggctttcccgagctcctcaaccactcccgtgttcctccccaataacgcaaggcatctgtggaagtcctcccccccccctcccctcccgtgctctagttgtgcaacttcaaggtcccccaacatcgttttcacctctgcctgaggacaattctgaggtcccccaaccgtggtttttcattcaaaattggttatgtacgtggaaattgaatttccttgtcaactaggaatcgtgaatttatatatcctacactacatagttggagccaaaagcttaacaatcattgagccacatcatctataaaa

SEQ ID NO: 97952 - DNA, 522 bp, Oryza sativa
ctagaaacttccttttccaatccatccaaccaaacatgggataaaatttcccttcatataagagcaagtttaataagagagtcatcagttagctataagccaatgacacgtcatctaaaagcaatcaaatagatagatctttgtatcaaccagctgcataacacatactccaatactaatcattcattttattatatggaggagggcccaccatcatccaatgcatgcatgagagtaaatggctgatgaagataatcggctaagttttctaggcgcctgtgccaaggctggcgattgcataagcgcccgatcccctctctctcatcttgcctctctccaccacgtcagacgaagctgagctgtacaggcttatagctgactgaaattttgttattatacttgctctaaactaccaccacatcctaccaggatattatatccatttcccaatgggtataacctattagccaaacggagcctgataggctagctttggcctatattttcacccaaaaacctatt

SEQ ID NO: 97953 - DNA, 670 bp, Oryza sativa
ccccccctcggggggaatcagaaggagggcggacacctcaccctcgggcccgacgtccccgaaggtgccaggccacgtgggcgattgtgtctgcctcaagcctctggtcatgatactcccggtcccatatcaccgacagtatgtatgtatatatatatatatatgtatgtatatatatatatatatatatatatatatatatatatatatatatatatatatatatacatatacatatatatatatacatatatatatatacatatacatatatatatatacatatatatatatatagatgtatatgtatatagatatatatatatgtatatatatgtatatgtatatatatatatatgtatatgtatatgtatgtatatgtatatatatgtatgtatatctatgtatatgtatgtatgtatatatatatgtatgtatgtatgtatgtatgtatgtatatacatatgtatgtatgtatgtatatacatatgtatgtatgtatatatgtatatatatatatatgtgtatatatgtatatgtatatatgtgtatatatgtatgtatgtatgtatgtatgtatatgtatatatgtgtatatatatgtgtatatatatatgtgtatatatatatgtgtgtatatatatgtgtgtatatatatgtgtatatatat

SEQ ID NO: 97954 - DNA, 826 bp, Oryza sativa
acttttaggctttgatatttcttaaaaactaattaaatattctaatgtgacctttcataataccatagcacattggtcgagtttatttgtataacaatgtattttacatggacatgttcaatctattatgtcataaaagtaaattgaggcttggtacaatattggtctaaatgcttaattaaacactcacataaatgtattttatatataaagctttattcgttttcatgaccaattatcttatgtgagtcaatgttattccatgagggactcgataaaagttataaatattaatttaattattctagtggaacactcctttatatatagggtcgttgtagtggtgactatttcctaattacttagatgtcatgacacttgtcgatatggttcaagtatttaacatacaatttgtaatttacattatagaaattaataattgactcgtgttttatttggcttgctatcatgtgcataaatatttatgtggttaataataaataatgtattattgtgattattacttagatgtatatatatttagtttaatttttccattgtgacaattttatagtttggcgagcaataacaatcataacatccagcatgatgcaaaagttttaaaaagttcaaaattttagtgatttttattgtcggtaattttcaggacgttatagccaaccattccatagtgtccaaatgacatgagaattcccaaagtctaaagctataaaaaccacctaatgttgtcctattaatcagcgaagcatctacgtaaattcatactagtggaaccatgaatagggtacccactagttggggtttt

SEQ ID NO: 97955 - DNA, 663 bp, Oryza sativa
aattaggaacagtagcttttcgtaatttctcggattaattcgaaattgaatctttaaactagtataacttgctcattttaactcggatttgagtgaaacttgaaccttaaattcatataaattcatatctttccaatggtatataattcactaattaataaaatatatttataattataaaataattaataccaagaaattagatactagttaacttaaaaatgtgctaacaaataaaactaatattttacagtaaagtagatgtaagaatatttgtctccaacatgtcttgtcactgtaacaaatacacaaactaatttaaatgatgtctcatattaatgtatatattaatgtataggaagatagtactatttaatggttgtataattaaacccatgacttacgaattatttacataaattttagcctcatatttagtaactaaaatataaacacataaagatgaatcattaacttgtttaggagaataataacagagctagatgtgaaggaatcaccaaataatttaatcaatgcaataccatatagaatagcatgtatagacctaaattggttaccacttattagtaacccaacagaaccagtgcttaaacttgccccatcacatatataatatcactcatagaaactagctaatgtata

SEQ ID NO: 97956 - DNA, 676 bp, Oryza sativa
aatacttgagtacagtggcaggcttgaacttctgacaactgaatgcggatactgctgcaaattgtactaagtgcatgaaagtatttatactcattggtagttactgataatgacttaattaataatgggctaattcgagtatggtcaacaggacagatgtgagacctgatatttggcattttgctctacgcgaccccgtttgactgaataattcgtggtgtcaatgattaatgaattgactgaaaagtgttgtggagcaaccttccccacttatttcctaaagtgacgtgagtgtgtacatattgctcggtttctttgctaagttgatcagatattgcctgtcttctgtttaaactagaacacctacttgacactatctgttcactattacttgaatgcatggcattatctcagacctacctgttatgctgcaacaagaaattaaaccttctaaatccatattgaatgaaaattgtagagtaatcaacgcttctctaaaagactaaaacttgaagtagctcatcccccatttttaacttaaaagaataatatccaccatcttacatatcatgccattgaacgcattataccgttcctatgagtaaataggaactcatttctaatataataggacacaatacgggttaactatcttaaactcttctgcacgagttaa

SEQ ID NO: 97957 - DNA, 511 bp, Oryza sativa
tattggcgctaaggctcaatatgatactccttgccgtcaccccaccccccccccccctcctccccggtggtaggcaagtcgctgacgtttaagggtcagcaccaacctctttagcactaaggacctattcaggctctttggcactatggatctatctgtaagaaaaatatttatatcctgacccttttcataaatttatgttaaaacataggccctcgatacaaggatcattggcgccgagggtccattccgagaataagtttgtccaaggatctatttgtaaaataaattttaaaaagaaccaaatgtaaaatctagacctacaacaaacaatagcgagcatatacttagcgcaacgtcatcaagaaaggcacttatgcaagaacagggataataccaaatgtcgctaagtgcattctccatgttcttgagtaagtgtattctccctgtggttacttacagaagaatgagatcgacctaaccaacttttagttctagattattatgagtc

SEQ ID NO: 97958 - DNA, 614 bp, Oryza sativa
aacttctaagtttagctcgatatcatgtatgccaatatgtttggctcttcatttcatgcatacctttttgttcctatatcattggttgttctagaatgaccatatcacccctcatttttttctccaatacgtaggagatctgtttatcatcatattaacaagaaaaaaagatgggctataaccctgagtacagaaccaaacacgcacataatgagttctaggaaccatacatgttgcaaaccaaaccacaacacaagaccacaaccacaaaccaaaccatgatgtgagactaaccacccggctcttgagtagtcaataatgatagcccctgagggggggccccccccgcaaaaaccacaattgtgctttctccttggcaagcaaaagagcatcggccaatttaggagcagtcccataaaaaacacaatggtttcgatgcatccaaagcgtccaagaaccaagaatgactatagaattcaggccatattgcaccctcaatgattatgctccaccacttaatttgatcgtcattcaagggggaccaaaagaattaggacaaacctctacacgagggagtacaaaactgtttatgaagacacatttgtgagaaagtg

SEQ ID NO: 97959 - DNA, 585 bp, Oryza sativa
aacaccgcacgtactcacttttggggaaaaacactctctaagtgtgtttatttgccagtggacaccatggccattaaaataatatatttgtgccgacatggcgattggggcccaaaaattttacacggagtgaccaaactacccctggcgataggggccccatctgtcaggcttatcttctacctctggtcggggcagagtcggagtcgtcgccgcttgaccgccaaatccggctgctccttttgctctcgagtaaaattagttgaggggaagtcctccctttatcctcctcaaccgtttccagcaagaccatgacgaggaggcggaggaggtggagcacggcgacatctagtgccactgccgcaggaatatgccgtgggcgccgtcggaccacccgcgccttctagagttagaggaggcaccgctggtatgcacagcttcaaatcaaccccaaatacagcagctccaagccctacccagcgcacaagccacggtagcaaagcgagcaactgcactgagggcgtcggcgaggggagcaccagtagccatggagcaagcaggttctcgatgattgacggagcgagc

SEQ ID NO: 97960 - DNA, 537 bp, Oryza sativa
catcataacaaaggtaaataggcatggctagataaaacagtgataacgcgggaatttaaataaagctattatgcaatatatttaaatcaaaataattttataaactgggattcaatatgttataggatgatgtgacttgccttgctcgctttcccaaacgttggcttcaacttccacgaagagcggatctttcgaagctgcagcgtctacacgaccaacggaaaagaaaaggcttttactctaataaactccatataatcagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattcaaaaatggatttattgcgtcaacctaggggaggggcgcgcggaccgggtccacaggggtggggcccacgcgtcagcctcacggtccacggtgaaccgggcgcacccgggcgcgcaccg

SEQ ID NO: 97961 - DNA, 623 bp, Oryza sativa
ctggggtttcatttgattaagccgatatcgaggtaggatgaatatcgactgggatttgggtgtttgctagtcgtcattagaattggatagtatgacgactaggttaggtgtctagccgatattgatagacaatacaatggctagagggataagaagattgtgaagctttagcggggtggaagtgttactccgataaccgtgagtggccacggaacggctaggatcacacagagcccgagagctaactgtgcggtgtgctatggaggtcgatggaatagtgaagctccgaccactatacgcatcgaggcgtggggtgccaggagcagcacttcgaccttaggtttggttttgccgggctttacaaccgacggtccgacgtcggggtcggtagaccgcacgaacgttcccatgaaaggcgtaaagttccaaccggcggctttttagtggctaaagggtattttgggttaaaaagaaatatttgaaaaggcaaacataaattcaaacggcatttgaataaattaagaaaattcaaataaatattacaatagcaaatttagtgccaaaaggtaggatttgaatttatataaatttaggtccaagtttcattggaatcggatcttgat

SEQ ID NO: 97962 - DNA, 691 bp, Oryza sativa
tggtagtagccaatccattttacatgacaagacaaaggagtcatcagatttgatattcccatttataatcagattgcacttatttctctctcaaaaaaaaaggattccactgtctattacaaccatttcacactaccaattagagtagaagcaaaccggaaaggaagataaatattagtaatttttatccttttttaacactgaaacacaactgtattatagatccaaatctggtaatatgctttttcattagtcaatgaggatgataattttaacagagctagcttgatacaaagacatgactcaggaaaagagtaagttgcatctcctaggcaaggtggtgggtgctcaacctcatggcacactaatggcacaacctcaaactgacctgaaatctaaagtggacatgaaccttcaaattttgcattgattcacttgggtgctacatagaggacaccaaaaaacttcaaagctctgtcctgaccagggtgctaccatgatagaaattagttggtgatgccagcatgttgtcggctagttctaaaatacatattgtgggcagttttctccacatatatttagtcaatctagcctcactggctcacagctccaaagtatattagtttgcccaccacagcttctgtggctcctagcagtcacttccttttatgtaattaacacataacagatg

SEQ ID NO: 97963 - DNA, 565 bp, Oryza sativa
tctctctgtgtttttcttttttctcttcctaaacggaacaggaaacggaaaccgtgaagcagcccagcacgtgggtgtataattttttgccgggcccaccgatgggccagctataaaacgtccggtgctctggcagcttttgcgagtgacgtggccgcctcacctgatctcctctcgttggcgtcactgggatcgggcgccgagatctcctctcctgatctctgggcgctgaaacgaacgggcagatcaggcgcgcggccgtactggaatctcaccggctcgtcgccggtgacctggagcaggttgttcagggcgtggtggtattaattggggtggaattatggtcttcgcctaatcccttcctctgttgtcgtctcgggctttgtccagaccagattcagccacgcaatctgtgttcggatttatatgtctctcgcattcatcaaatgcggttgcaggtgctcgcccataagaccataataagtactatacgtacgtacgtacagtcgagacggtccatacctcagtcgcaaagccagatgcgtcggccatgcgtatgtaagct

SEQ ID NO: 97964 - DNA, 722 bp, Oryza sativa
ccaaggatcggccaatcctgatcacaacctcttgccacaccacaacatagacatacgaagtgtcacaccttaactattgagttcctgaagggagctatatgaccaaggtttaggtggaggttgctcatggcctcaaagaacaatttttctaagcttgtcctcaccaccaccaccaatggatgccccagccaccaagctccattgggtcactattttacattatagcatcaattactctggatcaacaccaccatgatctttggtaaggcaaatttccgccaatgtgtcttccattgcatcggcaagctcttgatcatgtagacaatgttgcattcgttcatctgcttccatccagtctttaagacaaaagattgactcaactgtctcggctgtcaggcatgaccttcgttcttttctccctaatgattccagtaacgctgaatgcttgctcggaagaaacgaaggaggccggaaccagaagaatatctcgagcaaagtgagctaacacaggaagagttcgctctttctctttccaccacccaaggagatcgacatcgtcgccaccaagcgtcggatcatgcttagtatgattggtgacgaggtagtggttaagctctgaatccgggttccatgttgatttgttctctgaggatggagaggcttggtcgtttcctatatactgcttccacaaatttactgcacttgactttcttgctttcttt

SEQ ID NO: 97965 - DNA, 583 bp, Oryza sativa
aaagttgctttaaaaaatcatattaatccatttttaaaatttaaaatatttaatactcaattaatcatgagctaatgactcacctcgttttgcgtatcttcccaatctcctcaatccccctctccttaaacacaccctaatagtagtatgagtagttgtgatagacaggagaggaaataatttaaaaatatacgtttttttccgtggaatttgcatgaaaatgctgaatataagacgatttacaaaagagtactgttacacgtactaaaattttcttacaaaacttttactaataaatttctcaaccgtttgatttaactagatgaaagttgtaagaaatctagatttactcatagcttgacaaatcagagtttgtaaacattttgtaagaaaaatttagtacgtatagacttttcctttataaaaatataccactgtcgcggtttggtttagcgagaacgcggcgtcgcacgggggatgtgcgagaacgagagcggtatcgctgtttagataagcgaggacgaagtgccggcggtctcgcggcttgagtaaccagagcgtcagcactctcgcagtatgcgtt

SEQ ID NO: 97966 - DNA, 635 bp, Oryza sativa
ccttggtgttcgccagcgagcacggctccacctgccatccctgtcgtctccgccacgtttggctccgcgccacgccgcgcccacgatgccggagggaaggagagagagtttagtactactccatatgacatgtggggcccatgttaatttttaattttttattttttattggattgccacgttagcgctacatgtataccatgtaggacaaaactgttccgatctgccacgtgtacatatataccatgtaggacaaaaccattccgatctgccacgtgtacacgtaggatgaaaaccattctatattgagtagggggtaattcgtccggttttaaaagtggttttaaaagtttagggtgtgaaatatctggtcaaaccgtcgggatccaaaaaacacgtatcgacgaaacaaagtgcatctaaagcactcctctctcaactaagtgcacctaaagcactcctctctcaactaacgaactatgattgaaacctcgaagtaatccctctcaactaacaaactatgattgaaaccttgaagtaaaccctaactttttttcttcgtctcaacccctcatctatttatataaaaacttgtaaaacttttattaacaataggactcaatcccttaatttcc

SEQ ID NO: 97967 - DNA, 549 bp, Oryza sativa
tttgttagaaagtcaatacaaaatgattatcttcttgcaaaatttgtttggaattacttagtttcgtcaatatgcacaccagtaaattttgagtgttgttccccttaaatataagcctctttagacttgaatttaatactgaataagatcgctgaaccagaaatgtgtcaatcatgcttacccagctagctagctgcctgtacggctgcaacttgtacatcataaattcataataattaacatggacatattttgtaacaaacaaatgccttagaaacaaaacaacggaattgacctacattcctcttttctctatggaaaaaaaacatctacagatcttctctttattgttttccagtgcaataagtgtgataacatgttgtcccaacttcaaaacttccaacgacaaagctaaacataccaataaaggttgcaagcttattgcaccccttaagatcccaccctaaatagatgatgggtgatggatgacacagagttcatgacaattattcgagggcataattaaatattggaagttgatttaaacaa

SEQ ID NO: 97968 - DNA, 570 bp, Oryza sativa
atagtaatgtgccttcacgtttctactaccgctaaccgaggtggcggcataaatagattcgaaccctattacacataaaaataacgggtcaagtagattctactaccactaaacagcaccgtattgaggctcattacaacaatatgcacacttccatcctataagataaggatacacatcatatcaatctggataactgcgtgaacaaatttataaccaaaggatattacattccgggacggaggtggtaataaatagtcacatacagaatccactgcctggccctgaaccttataaaacaccctgctgtactgccatgccaaagcgccattaactctctcaggctatctcaccataaacaggctgtacgatcaagcatccattccgatctctagaagaatgatgggagacagcacaggcagccttgccttgtaaaagagcgtacaagccaccggcggctcaggacatatcttgctgcccaactccaccgtgtacccggaacgacgagctgctcctgacggactgctactcctacaacaacatctgcgatcccatcccaccggcagcgct

SEQ ID NO: 97969 - DNA, 516 bp, Oryza sativa
gtaaccgcgcggcggccgctttggaactagtggctcccccgaattgtagggtatagaccttgtcgatcaactgaataatgtgtagaatattagaagcaaaattggttatgaggaatagtttgtttggcaattttgatgtgcattgcatacattgtcttgtgcatttcaatctgtcatccatatgtttgcctgtagaactgccagaatggtttttattttttaaagaaaagcaccatttggctaaaacatgattttcaaatgcaagtctactatcatttgtcttttttatcaatagcttgctaaattatcaaaactataacactagattggcatccttaatcaacttaaatgtctgttctgaaaatatcacaaggatggcttgacaagcaagtaaaactgtaacgccttgattaagatctctgacagtgtctgtgtctgaactctgcaaatattgcatacagcacaacttttcttttatggggatgctttaggcttttaccttaagtatatggacat

SEQ ID NO: 97970 - DNA, 657 bp, Oryza sativa
ccccaatggaaaaaaaaatgggttgaagaaggcaaaagaaaaaaaaaaaggtgccggtggggttaaggcccaaacccaagggccaataagaataccaggtcccttcggtaccattaaccctaagaggttcttcttttctggccggggggaagttttgtggtttgtggttcgggggtgggcctttttttttcctttttcggccctggggcttcctaaggtccccggctggtgaatcgccttcatcttcttccaatttgatcgaaacccaattggttaattggggaattaatttggtaaccttttttgaagccaattttgggttttggaattgaagggttaaaattgaataccttgcaggacaggaagggccattggctttgcagggaattttccttccttcctcacaaatggtttctggattttgggaaggaacaacggctaaattgccttttggccaacggaaccccttggttccttttggtttggcaaataacccaccggctttttttttaataattccccaagcttggaaaaaattttaagtaggttcccgtcgacgattgatttctcgggccggtttcttaatctgatggtgggcaccggcacccctggtgtcaaatcgctatggtgcttcgacctgatgcgccagcagctgtt

SEQ ID NO: 97971 - DNA, 567 bp, Oryza sativa
gtgttgaccaagaggtcttggtcatctatgctgcaattccaagccagtccttcctgtctaccgtatagacagatggtgtaacaatgtagtgctcactccctctattcttttctagttgtccaggctatccagtacacatctgtgacaagctgttacgctttttgaagtatgggctattcctgctctgatcttccctacatggatgtttttgaagaccgtctacagattcagataatatagtggtgcggccatctgtgtctcaggccttgagcttgatgtattttatgatgtccatgcaggtgatagggcaggtcatagattggtgatgagcattcatatatgtgcctgtggttctcatatattcggcactcaccacgggaaagtgctatgtaacgtcatgtatcgcggtccattcatacttatggtcacccaatcatctttgagttcgcattagcacaaatatttagtgtgttttcttaagtaaggagtaaatgatattccacagtttaatatgttgctcgagctaatggattcttttttaatacagtcagttctccagtcaggctt

SEQ ID NO: 97972 - DNA, 559 bp, Oryza sativa
  unsure (1)..(559): unsure at all n locations
tatcatcgccagagaggtatacaggattcttggtttcccacagtgcgatatctatccaacagtgcagcagctccagcttcctcttccangcatcaggtatgtcacgtatgatgagcatggttaacatcgaggatgttgtccatcgttcctcttgttatatggcattataatatctgaaggatgggttacatttaaatatgtcgtatgggcagaatgaacggtcaaaaggccctagcccttcgttcaatattgggataaaaaagctatgtgtagagttcagagggacttttcctgtgcganactatggcttatggttcatgttaggcatgtttctagaggttaatatcgctcgtttcccatgttttgtgcgtagtgttcgataaatatgtttatttcagtattagtttgtattcatattaaaatggagattccctgttcatatagtttaagcatgactcgtcgaacccataaatttatttgtttaatgaaggtagctagctattcgaatttcttagtcccaagccgggtagaatcatacgtctcaagatgcgagccttga

SEQ ID NO: 97973 - DNA, 546 bp, Oryza sativa
ccataggggcgtacttaaaaatattcagtacttagtgaagtctaaaataaaaataatgtcccgggcgaaaatgaaaaattcctagagtatgatgcctcgtgcaaagcaggtggacttggggagcgggacctgctgctacatccttcattatccatctatgactttacccttcaatctatcatctcactgagggaagtgtgcgaaagagtgggactgagcgagatgagtatgattcgcgaaacgaggtgtgcacatggagtcatgattaattgagtattaactatcatagatttcacaaatcaataaatacgcaatggtctggcatgcccactattgaaatatgtcgcaaagaacacaccgcatggttgtacgaaaagcggactcgcgaactacgacagacaatctctcctatctgcacctaacgaacactcaggcttttcagcctgacggaggcagcggacatggccatcttttcatgcatgtgtgaggcaccagaggtgatggcgaaccggagatcaacaacggcgggttactacgagtagctga

SEQ ID NO: 97974 - DNA, 619 bp, Oryza sativa
agttatcttaatcttttatgtttatttctaacaagtgtcatggaacaattagtgtaaaatttttgcaactaccgtgagtcctgttccattacaattgttgcatcatacttcctccgtttcataatgtaagactttctagcattgtctacattcatatagatgttaatgaatctagacatatatgtgtgtttagattcattaacatctatatgaatgtggacaaacctagaaagtcttacattatgaaacggagggagtaacttcttagtgttttttagagttttccttttgaattcgggcttaggatcgctttgcgttataatctgaagtatttagtcattgccgcaagtgatcgctgcgatgcaatgcgagcagagttgagcgaacagtctgtcatgtaagagtacctgtatctgagcacaaactaaccatgggcgcgtcatgcttatatctaggatgtactcaataatttacaaccccaagtgtatcgttttacggtctgatctcgtgcatatatcgtgcatatgctctctttttgcttctatgtaaactccttgtttcaataataataatacaaggataacgcagtaattaatttattgagattgctgtgggcgtt

SEQ ID NO: 97975 - DNA, 612 bp, Oryza sativa
ctgcagccctgtttgaaatgcatatgtacttgtaccattacagaaattcttaaaactgctgtcttgacagctacttatcaaacagccccacctgcatcatacgttcctagtggtgcctataactctgcctcagttattattttgtggcccactggtccaacaatttgaaaaaaattatattgaactaaatatattgaacagtagtatgacgtcctctttgcttgagttccatattacagctcacagtcctgagatttgtttcaccgattctttccatgcgatgtgcacatattcttattcaatttaaaaaatgaaagcagattatttttaacaagtaacctatcacgttagcttaacattgtatatttgtggtggaattatgtaatattccgatatcgcatttgaagttttgaacatgtgtgctcaaattgagggacacatgactgtagtgaaagcaaatataaatgtctgagcaatggactatactttgtattcattactacaagttatgtccttttgcaggttgctaatgtcctcttacattacttgtcaggataaatgagtttggtgggacaaaacatgacccactaataccaacgtatggcctctaaa

SEQ ID NO: 97976 - DNA, 501 bp, Oryza sativa
ggtttttcttgcccaagtgatgaaagaaacgtcctgacgtggaattcagtctcttggttgcacaactcatctggtgtcctaattaaaatagaaatgattatcaccatgaggttgagatcacgccctgaaggattggattgtacgttgttcgtgtcatttactcatttctgtgtatatatccacttctagatgcttcttctacttccctcatatataacgtgtaaatacatatatttcttttttttccaaaaagttaacccttcatatatagtgcaattaatgggaattttacgtttggttggtgacatgttttgccttttttttttttgtcttcctgcaacagtaaagcataccatgcttggttacactccaaaagattatggtaaacgttagccacgatcatcacgcacgctggactttgcactgtacagtttcgtcatgcatgggacagatttaatgatggatttgaacgtcaacctttgcactctcaccaacaatgga

SEQ ID NO: 97977 - DNA, 602 bp, Oryza sativa
aaatatttctttcacaattggtgccgcgtagcaaatacctctttcacccgtgtcttgcaaaaagacacccattaattcgcatgctacagcacctccactgccagcccctgcccggcatcgcacggcacggcgacggaaagtgtcggccatagacggcgtccaggctgccgtttccctccgtccctgacgccctgacactgctacagtggtctacagtactacatgttcccaacccaaaagtcaagctccgatccggcacttgcgaacgaagccttagactaactaatagtgccattagatatatatatctatatttagactaactaatagtgccattagatatatctaaattttagaggatactggaacttgaatgaggtcaaacaaagctgcagatcaagtgatatgaatttcctaagaattatttgtttttatgtctaataggaaaaggaattaaagaattccctggaaaggaaatgggaacgagggaccgaaattaaacttcttggtcgagcacgaggcgtggcccagagcaaagtgcgggcgcgaacgtgcacgcgcgagccgaagggcgaggcacggcccacgtaggcaaggtgcgc

SEQ ID NO: 97978 - DNA, 648 bp, Oryza sativa
ccaaatttagtttatatacgggttatatatagagagagaaaatgagaaatattgttagggagtaaggggaaccgccttcaatagttcagaggtgtaaaatgagctaaaaattatttaaggggttaagtgctctgttaaaatagtttgagtgagtaaagtagacttttttaatgtgtatttaccaattagctatttaatttagactttaatatggtactaaaataaataaaaataaaatcaaattttatataaggcctgaatcagaaaggatcaaaatggtaccttaatactcattcggtcgtgaatttcataaataattttatccctaattgaaatacttgatgtatcggatggtttgatagtgggatgatgactaatgtgttaatctaggtatgtgaagtggcactgattgtagccggactggcaaacccacgctacccaatcaataggtgtgtccgtccctcctgtatccttcttgagaagtctgcccctgcagctgtttccttcttgagaggacaggacgagagattcagattctttcggtgaatattcacatgacaagtgcctcaagagatctttacttatatactgcctccgtttgaaaagatctgaaaattctagctatatgtttagataagttacttacaa

SEQ ID NO: 97979 - DNA, 593 bp, Oryza sativa
ccgtgcgcgtggagatgagggctccggcgacgacctcgacggaggaggggtggacgaggtggacctcggccgcgcgaagctaacggcggcgacggcgtgagacggcggcgagcctatcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatgggggaaccggacgtggccgggagcggcgggattctaccgccgacgtgggggagtggggaggagacaaagccgggattcggttttcgaatcccggccatctcgggcgcgggcgccagcgggagagggaggggaacgggcccggggaatgcggcgcacgcgcgggcgtggtccacgtggcccgggagagacgtaggcgtgggctcggcgtccgttccgccggtggcggcgcgagcgggatcggcgggaggagggaaacgggtccgacaggtgggccccacctgtcggcgaccccgagagggaggaggcgggcggccggctgtcgggcctgggcctcgg

SEQ ID NO: 97980 - DNA, 695 bp, Oryza sativa
ctgcagccctacattgaattatcttttattttaacctggggtaggctgggttacattctcataaaattaaaaaaatggtattccttgcatatgaaaaagacctcatttatgcattcttgagcaagataggttatgtgtgagtgtttagtgctcattcatattcatgcatatcacatccatcatatgtgctcaagttgactaagtgctagttggaaatttcaaaatatcctttttagccaaaagtgaaaattttgaaaagtatagcctttctatgagaatctaattggaaatgattttaaagtatgtttgaaatgtctcttaatacttttgtatttcaaagaagaactaagtttcaaagaaaatgaatttcaacccaaaatgtagttctaagtatcttgttttggcttttaacttcaaaattttgtacaattaattctaaaaggaattttaaagtgattttaaaagtaaaatgatagtgttggtcatttcaaacatttttggtattcaaagtttctctaaaaggccaaccaatcaaaagaaatttagattccaatcttgaccaaaatactatctagaccataaatgtccacctattagcacttagatgacttctcattgtaggggttgcataaatgcatcatactagctcaaatgagtacataactttcattcatattcatttcactccaaaacca

SEQ ID NO: 97981 - DNA, 694 bp, Oryza sativa
atcaacaatttgggtcaacaaggtaagtagatacgaacttcgtgaaatgttagaacagcaagataagcttgtaatagaaaaaatgtactaaaaggattaactaaattatgtcgatgcaatgctatgattcagacattgagttattagtagagatagagagggcaccatggtaaaaactagaagtgaaattactgacttgagataaagagatcaacacatcctacttgggaagatcaaacaatgacaaacggttggctggtaagctagctcaaggttgcagcgctctgaatcccatctccatcccacatgatgtcccttataattaaccttggtaacaaatggagtatggaacctctcgagttatctaaattttttatacaataaactcaagttgactgcctgactactacaataaactattgaacgtacaaacaaaatatatttcgtaagatccaaaacttaactgcatccaactgccaatggccaaaagcaccaaagaagcgttttcgtagtaaattagttggtatagacataccaagcaagtaagacactgtcctaaaaattaaaatgctaaatctcctgtaaaatatccctattcaataagatccatgcaaatctaaaatgcattaactccattctaacatctcttccaccacaattttttttccccaaatatcacattcaactgtctaaa

SEQ ID NO: 97982 - DNA, 508 bp, Oryza sativa
aaacagcacccccacccacgttccttgagctaaactccgggaagactgatgtgtgcaaagacagggcagtggtggtaccacagtaccactcgctttcatcgcaagtttgtaccagctccgcattgactgccgcgtcctgagacggcacgtacagttgccgagcgagcgtgacgggcctgcacgagatatatggcgatatggctatggccgcatcccgagcgcggagtacgtacgaaatgaaacagcaagggaataaattgagcagccggcagcgatggccggctttgacagggacgcgaccgaggtatgcgacgacgacgtacggctcgacgccctcccctcccccccgcgcagcggcaaccgcgagcggacaagcttccccggtgacacgtctacatcggtctccgtgccgggccggccccacacgtcagtcgtgataccgcggccgcgaccgcgatggatcgaaatgcccaatgccagcaatacttgcaacgcggggtttggattg

SEQ ID NO: 97983 - DNA, 849 bp, Oryza sativa
tattgtggttttttaccaacccacgaaagatggtttctccagtagtggtagtatcttgatttccagtttaattttcatatatactagcccgaaagtatgctagtgaaatattgttaagcatgacaactagaaatataggatgggagaatctctgccctaactaggatgtacataatcattacacagtttgcactatcatagaatccatcaaaaggccaaatactcctaacatgataaacaagaaaaaaaatcatggtacaacaacctaaaaacaaaaataaaagggtttctcccatacttatatctcttcatttttaatatagacctctttgtgaaaggaagtaccaaaactaatagagtatggtgtaagtatatttttgactttccatctttttttaaggtatatacctccagacttacactttgtggtatatatataccttgatgtacctcctaacaacaagagaagtcatgtcattgctaatcataaacttgtcttctgtttacttcaactgatttgtttttttacctttgaaataggagaggtatatacctctctaatgtggaagaaaacctaaaagatataccttgtggaccaaatgataggccattcgcatgagtatgatagttgcattaattgcatatgcaacaaggttgtattgtaggttcagtctgtaaacattcaaacttggaaggttcatcattctggcataaagacatggaggaaagaagggaagccatgcacatcacccttctatatattgtctacgttcaagtcctggacttgacatgggtactcgcattaacagttaattattctttcagtggtagacgacatacccattgaca

SEQ ID NO: 97984 - DNA, 657 bp, Oryza sativa
cagaacttaaaagttgaaactggatggatagaaataatcaaaggacatattatgttttttttcccttctgtccaaacaagaccaaaaacacatatccctttattgaaggaaatgttccacattgttaatttgtcaaggagaacacaggcccacagcccacatatccaactaggggataaaccttttttctagagcgaaagtaaggagtctaatgtagcaaatcagaaaggtaaaaggccatcggactaccaagttggaagacaaatgagttactgaaagcatacggatgccaatatatattcaccataagaatatgtgcacaatcacataatcccttgtatgacagtaatatctacaattctttgtatgacagtaatatctacaattctttgtatgacagtaatatttacagattaggagacagcacagaaagtttgctacgtttatgtcacccaacaaacatgatcctaatatcctatccacaagaggttatgcaaccaacaacaatcatgatcatataattgttgtcgataaatcatataatttcacatattcaactctgcaatttaatcagctaccatctattttgattcaacctaaacatcaaccattttaaaataaaatgatcacctattttttttagaagaaactaattat

SEQ ID NO: 97985 - DNA, 682 bp, Oryza sativa
caccatgtacttcatattttacaactacagggatagaagattgagaggtatggactgtgttctagctgccatctatttttattttgaattatgagagaccaagccttctgttccaacgtacttaattcattctagataacaatcgcagggtctgtctaggaaggattatgagaaggaattggagcttgcggacagtgagaaaacaaaaaagcttgaacagaagttgtttcgtggtctttaagattcactagtcctcaaggaggtaggttctcatagtctttccacgtcaagatccagtttgtgttcttttcaccatttgatcttgactaaattacgttttaactttacatgctgctaacgggcaaaaatctgtaatggggctagttttgattcctagcactaatacacttccgatttacttgcaatgatgttcaggtgcaaacactaactcatctcatgtacacatatgcaatcgatgtattagtttagtgctacgcatcatatctgcttgtgctagtgtgtgcccttgctaactgtagatggacccattccttaactgagaattagggcctgcataagatattatccattggctaaaccttatgctcaagcttcagttttcataggtaattttctaaacttctaaacaagttttatgcacattacactgtattggctaaaa

SEQ ID NO: 97986 - DNA, 747 bp, Oryza sativa
catcgaaatttcacgaaattcgaccggttttcgtcggaactgtgaacctgcaccggagtaccaaagtggcaagacgtgatctgcaaaggcagaggatgctgccgtgtgaagtggccaagctagctttcctggtcaaaacaaaaaagtgaacaaaagctagttacaacacctgcatgtatatttataccataaaaatgggaaaacgagttgaacgagattgcacgcagttacaccggagaggaagaaaaggttgcaaaattgttgcacccaaatttggggggagtgacatgacacggcaggggaaattccgtgaaatgttacacagcaatgtgcacggcaaaatttttgaacaagttaaaccaccctctgcctacctagatttagggttatggaaaatttaattcattttccttcttgttttcttgtaccagttcctttcaagtttgtgtgtgatctcagagtttttttttttggttgttgaatgatcattggatatgagtcagcggtgagagcgaaaggttagttgggttcgccgcgtaaatcaggaaccatgtagctcaagactaggggaagatgttgaagaagaggtgattggaggtggacagatggaaaaactttgagcaaatgaggaaaaagcataaatactacactttggtcttgcatggtgaggtcatggcaatgtggcatacaacaaggatgacaaaaaaccaaagttgttagtactgaggagtgaggatgcgtccgttt

SEQ ID NO: 97987 - DNA, 878 bp, Oryza sativa
ctacacaaggaataaaccaaataacatatttgcaaacgaaacataatttgtaaataaaacattgatatacgtgtttttagcgacttaaaagcaaaggctgaaaaataaactttgatgaaaaaaatcaaaatcagctccaaatttaatgttaaaaatttaaattttagctaataagcataaacataagcgaaaagattacgcgcttggtaccatgatctaaacatcggaggtcaacatttaattttccgttttaagtttggtaagcattcttaatttccttaatttcttcagtgatgaagtgtacgtaggtactgtattgaagagagggaattagaatatccccatttaaaatacgggcccattattaattttgggctttgacagacggcttgcgatcgtgccatatatatgggttgttatacggatcgccataattaaggaggtttcgccaatttctactctctaattaatataataagacccctaattacacaatgaagtgcatgtttaatcagtgtaaatgatcttttcagcggtatgtaaattaaatgacaatcaagtcgatatcagtacgcactcttatctgtgtgactgtgtgcactgtgcaccgtgtttaatgaattaattcttggtttaacaataaatcatactatacctccatctcaaaaatataatgagttttgatcgtatatcttatgtccaaaatcataacttaagttgttatattaattttgagaaagaggtagtacaattttaacttctgtccaaaattttcatgtgcttttgtactgacttgcattgtctacgcatagattcatttcatattgatgtggtggcctaataggccaagtaaacatttaattttgagactctgaatg

SEQ ID NO: 97988 - DNA, 634 bp, Oryza sativa
ttttttttttttttgggggggggggaattgtgatgctctaaacgtgggtgattgactgatttgagatgcagttgggttcgaatgggtaaattttatggttggttcttgggccaattgattgtctccgtgtgatttggttctgaacttttggtgggattggcgattcccaggagttctttctttttctctctcagtagcattgttgcagggatgtagctgctcgtgcattattgaacagatcagatgtcgtgttttgtgattagatggaaaagttcgaggttgttttgctgtggagtgtatttggttgtagtgttgcgtactgttgtatgggtaggaccatcaggatctggaccacttgctgttcttattacttgggagattatgatatttgttgctatcaggtgtcagaattttaattatgaatgttggctgttgactactccagaatgttggctgtgcattatattgtggttgtttctgatcgagaccctgattagatttttatagtcttgacacatgttttataagtggggttagtggtgggggtggggatgatcttggtggtcaactttctttattataaaacgcacgcactgcttggaaacaccatacacgatgccttttcccatataaa

SEQ ID NO: 97989 - DNA, 535 bp, Oryza sativa
aaatggacaagaccacgggcaaatgagactttggaccgggataatataataaatcaagtttagggacctcgatacatgctttgtaagtttgtggatctaaatgaaacctgcttacaagtttaagaaccgcaagtgcaatttactttaaaaaaattaggtacattctattctgtcacttgggacataaaaaggtgctatgtctgaaacatcgatgcctataaaaggagcgttaattgtaaagctaggatagtcgatggtggagaagctaatgacaacgttaagctatgatgagcttttattagctatcagtaggtttttattaatttcagataatggattaattaaaaccacgtgacctctacgggttcaaaaccaaacaaaatgtaacttgacaaaacctagtattatatggacagtttttagtagccgatggccgtggtgtttgcattaaacctaagcgaacacctctgcacaatcgatgttcacgtggttaactattcaaatatgacctaaatcccgaaccaaccgttaccac

SEQ ID NO: 97990 - DNA, 608 bp, Oryza sativa
ttttggtcatgtaattaataacaaactaaaccaactaatgatttatatttttacaacgtcttaataataatcgcatcacaaaatccacatggtaattaccactagcttgttcgattaaaatccaaaaatgtatctggcgcataaaccaattgtgcaagggggaattgattttgccaacaccaaactctgaactcatgcattaattgcaagaggtgtgtaaatctgagtgtaatattatccaaggaattagaccatgcgttcttatccttattggaaggacatactgacggtgctatatgatcccttaaactatactgcatggaccatatgagatttaatttttaatacacttatgaatgaatgcatgcatgcaatcctatcatttcttctacatcatgcatgcatgcatgcatgcagtgttctttgctgtacatacacttgtacaagtacacgtctagtcatctatactactaactcaattgaaaagattatcatttcttctcctcacacctgctcctcccctcctctagaatggcatttctcctgcctctcttcctccagacacatgggggccatacatctcactcattgtgcccatggtctaaggt

SEQ ID NO: 97991 - DNA, 662 bp, Oryza sativa
ccgaaatgcatgcgcgctgcttttcttgtttgctcttcgattgcattcaatcggttgtctcacatttggagctaagatgatggattctgttcctgttttgtttgtttggttgttgtcaggagccagactaccaagggaatttggattgccaaggctgtaggcattgagccgtttactgttgtaatggatttggagggcacggacggcagggaaagaggagaggttgagtgttatgtgcttttattataataatgtttatacgaataaaaaaccttccataccatgtttccttttgtaagattctgagtacaactcttccatgccatttctaactgcgtaaaatatttgatgttttatcttgtggttaattagtagcagtagtcctgtgtacctgagtatttaggctgtggaaaacaaaaaggttgcttttctagtacttgctttatccacatgtggcgttgtctcccttaataagttttttgctaggaccttagggccttatttccaaaatagttgccatgtagtgggtgtcattagaactcggcctgcaatgagctgtaaatgctgttattgttgttgtagtacaattacttaatcaccctgtacagctgattcatgggagcatctattagaaatgcaaggaagtcatgcattcatactaa

SEQ ID NO: 97992 - DNA, 588 bp, Oryza sativa
gaatcgggatggccacccctaactatacatgactctttcggttctaatataagtgtaacctagaccctttgtagatcccatatcaaaatttttcaccctgacacatcgaatgtttgaatacatgcatgaagaattaaatataggctaaaaaataactaattgcacagattgcgactaatttacgagacgaatctctttaagcataagggctcctgatttaacgatatggtgctacagtaaatatttgctaatgatggattaattagacttaataaatttttctcacggtttaataacggattctgtaatttttttttattagcgtcctaacaccccatatgtaatacaagtacctgagaagacagactaactacgattcggcaaggaaacctatgccgaattgcatctgaatacacacattttaacagaaggcaaaatgtggagcaatgcaagcccacgggttaacgggcctgccaaaatacaaccaagttaccagaatgtgcatccaccagccaagcaaatccaacggctgacaaaatcgactgatggattaaaatttgggatcacctgtatattttatcgacaaaa

SEQ ID NO: 97993 - DNA, 1110 bp, Oryza sativa
attaatatagatacattggctcaatatgttcaatgaaatgtctcactttacccaaagttactgtgatttaatttctttgcattaagcagtatgaaactaccgcatcatatggactgaaactgacactgacaaacctttcaaatgtattgttctgttctatgttaacattaacagaggcatagagctttcccaagataaattgctgacttgagatgccttctagttagcagacgagttaattagtactataatactactaattatctacctgtacaatttcgttttcctggttacatggacatgtgtgccgttgcagttactgtaaaattgccgtcagtttcagcatgttgcagccttgcaggacaggaaattatcagaatcaacagagatcatgcaacatcttatgtctgctgctagccccaattaataatactgtacagtgatgttgtcacgctagcttgatctggacttctggaatgatcataattcaggattaacaggaacttggcggagaacaaagcaatgcattttctcaagcagagtaaaagtaatttctcacaacattggaaattccagattcattccgtcatctctccagcgctagcttacacatagccctatcatttttatacagcttatctaccattttcttaaaacaaattatttgctttacacggtataaaaaaagtacatattagggtggcatgattccaacaaacccttttttaaaactactttattccaccgcatcacttagaccactcttttttagctatatgttattttcaaaatatgtaataatttacgaaaataattcgctcaataatctaaagggaaactattttaatccctcgagaggatatcccctcgttcaaatttaacttctacatttcgtaatgaaaaaaaaacaaattgaaccgcagctagttaacgtatattcagagtcaaatttgtttttttcgttgcgagatgtgaaagttgaatttttacttgcatgtttatggagtgatatgttacatgttaatacattttctcgaattttttcaattttttttcataaccatttaagtgacatacaaacaacgagagtatatccactcgagggatcaa

SEQ ID NO: 97994 - DNA, 867 bp, Oryza sativa
ggataattttgttaaagaaaatatagtaataggtacttttcaacatagacataagacaatgcagaatttaggaaaatgcagctagagggaaacaaaacttcaacctgaacaaagatagaaaaaaaacataacggcacaatgctggaaaaggccagaaaacgaaatcctacctaatcatcttcttgttttctgcataacagtcattatggcatggtacgtatagaaaatcaaaactactattaaagagagcacttaagacatgtcgacttaagtattctggcatgtcatggcatgttcccacggcacgaacacgtcgacttatgtaggaaaatgcaagatgaatagatagaacacgtcgacttatgcaggaaaatgcaagatgaatagacagaatgacacaattttgcagaaaaaaaaaggcaagaaaatacaacaatagttagtattcgatcctgcaagtggtatcagagctcgttttcttctttagatttttaccgatctaaagtttttgcaatggctaataagtttataagtaagccccatgttttcgatggaacggatttttgttattggtgtagtaagatgcaatcttacattatgatcttaatatttggagaaaagtttctaatccttatgtaattcctaatcaaattaatactgttgttttaaaaaatgaatttgaaaataattgcaaagctcacaattttcttttgagtgggatgaatctgatagtaatgtaaattaatgtggatggatctaattgtgatagtgaagaaaagcttagttatgatcaattagaacatattgctttcaaatttgctgagaaacttaaaacatgttctaatatgcttgatgagagggattgca

SEQ ID NO: 97995 - DNA, 838 bp, Oryza sativa
aaagcttatgtatatgctttattgaattgttattcctcaaatagcttttatttgctcattgtgcaagagaataaaaaatatctatgaaagaaaaaaaaagaataccgaatccttggaaatagtcatgacgataaatacatattcgatgtgagcaaaaataatgagtgccgaatccttggaaacagtcttgacgacaaggacatacccggaataattgagagaaaaaaagtgagcaaaaaggctcaaaaaaaagtttaaaaattctcttgattgttttgtactaaagttaatttgagaaagagtgataaatgtaataggtatatatgtatagtgtttatttttcaatctatgtgcttgtgaatatattgcattataaatcatttgaaattatgaatccttattgctaatttaagcttaattgtaatatctttgattcatgtttatattatgatgcatgcttgctaactggctaattaatttatcttctttgtcttgcaacacacgatcatggattgcttttggtgcacttcaaagctctcgaaaaaaattagaaaatagaaaagaaaaaattggttatttcaagtgacaatcatgacatcattgcatttgtactttattgtttattattttttttcttttgcattcttgatgaaatcattgtcaaagggggagaaatatgcaaaatgaatgctttttgaaagggggagaattgaattgttttgattgtaaaaatagtcgattttgtgctttgattataaattgatgggagaaattctttcttttaaaaagggggagagtttttcttttcacttttgtgatttttgtttttatttttcaa

SEQ ID NO: 97996 - DNA, 579 bp, Oryza sativa
aacaatatagatctaagcggtcgtttgagtgattaaataagtgaacatatttagagtttttttttcttttgaaacgatgacatcatgaaattagaaccgtctgcgtcgagccatatagtagataagtttccctctagttaaaacaggttgtagtagtgtcattacttgcaagtaacaactattgaagaaggtagataaatcagggctagctttcttggttaaagagacaagtttcttatgactgaaaataaatgaaaaaaatatgttgagaagtcttcgcagttcacataatagaattaaccacaagctatcaaatctcactagatacggagatcgtttatgcttctggtgtaataataattgtaccctcatttccattgtgagtgaagaatcgtctttgtattaattagtttaccttaagaaacacttcaaaacatgtcttatattgtatttatatgagtcgataagttatgtatctacgtttctcagagcatatcttaacaccataccttcaaatttttattttagatgtcaaccaacatctaaaagggttattcggattaatgccattttaaacca

SEQ ID NO: 97997 - DNA, 547 bp, Oryza sativa
ggccagtatagtgtcattcccgtgaaggcagtcgaaggggttactggtatgccaacggccgtgcacgtcagtagtaaagccatgtggatgttgtcgttgtggcaatgccgtcgatctcatccattaatgttgtatgatttcatttgcaggattgtttttttagttctaccacccttactttcttctaaagggatggttttgttctgtaagcatgtgtttgttttcgggattaggtgggatgggataaaaccatccctgattttggggttgggatgattccatttacttgtttggtttgtaggataggacaatcctaatttttttgtttggttgaagggatgagcgagagatgggatgggcgccgtttgctatcaccatcagcgagaaagaggagagtgagcagagatgtgtgacgacagccttgtgggagctcagcgggtgggcggatgagtgcgacgatggctagcggcgagaaggagtggcgcaagattgcgagcaggcggacagacagaggaggagcacggatgggcgagcaggggtgcagttg

SEQ ID NO: 97998 - DNA, 659 bp, Oryza sativa
  unsure (1)..(659): unsure at all n locations
tggacgatatattcgcctacctacctatcatatgtctgtgtgggaacaatcttaacagatcattttaactttatcggctgcttctcgctacaagatatccgccggtcatcaactacttctgcgttactagatgtatgaccttctacatctaccactctgagaactcagacagcggcttgatgatctaaacattatgatggtttccatatggagggctgcgttagctaagatgcatctactacatcggactctagaaccatgatctctagcctgcttcttagatgagcacaataacggtgccatcggggtttcagccggtgagttatctccaccttgcatcggctcctaaggatgacatatacctattatggggatttgaccgatgaccctaaagggggcactgtctaatctaagcttgtggatcgtatgacatcggacatcatgcgatttgagcttcaaccttcggatcgacgctcatatatcatatcattatccgccgactgggtcatactgcattatactgcaatttgatcacactgtcatcatgatgcgattgcctttatatcattatctacattggacatatagccgattgctcgaaccctatcgctatgcgatggtattgacctcngctattatcagttatcgggttgaactac

SEQ ID NO: 97999 - DNA, 646 bp, Oryza sativa
ctgttttaaactcatagaattatcccgaatccatccgtgtcagtttcgttgcaatctgagcaaccgttgacgcgaccctaattttacccctagggttcgtcgttcaccgaaattccaaaaatccctaaaattaaatctttaaaatcctttccacccatcgttgcactttatgataccatttgttatgtttaactttgtttttctattatttattgtgatggtgattgttgcataaatagaaaacgctaacattggtcctacgactacatcgagcccgaaggttgcaagacatgcaccctcccttgaacaatttaatcccagtagttagtgagttattttggtaccgtacttgtcctttggagtatgatagactgcacgaatgcttctaaattatattgctattattgcattatattttctgttgctattatggacacattaaagagccttagagtctaaaacgcttaggataaaatttgaggagcacttaacaaactgttaattatttagcatgctattggtttaatatggatattattatcgcatatgaaaacatgcttatggaattgttaatagctatatgctaagaactgttgacaccgcttgtgagtgggtggtacacatgatagagttcatgtgtttggtt

SEQ ID NO: 98000 - DNA, 853 bp, Oryza sativa
aaccatatatcaattgtatttatcgacctttaccaaccatatatcaatttttattgggtgtagctatatttatggtgctatattttttataaaaaaatagtcggcatgtatttacattgtaagtccctaaattacatatgtaattttagtgtatttacaatgtaagtcttaaaattacatatgtaatgtaaatttgaaaattacatactaattacatatataagtgaggtgtaaatgaggtgtaactactgcgtaagtggctgaaaaaaagtcgactgtagcatatggcgccatatttctagcaactccgtataatatatagctcatgcatggaacccaatatatcttactactcatctgtgttgacagtacgtatttgccaaagtatcttttgtcggacctgttttatcatgtgtttactagctgtttaattctttgacgggcacaaaactttaaaaacggaccatttaatatgcacaattaaaattgttttaacccgttgcaacgcacgagcatttatgctagtaatatataaaaatttaattcttgcttataaactaaacggcgggattttattttattatctaacaaactgatcgatccattcatcaagttttatctgtatttcatataagaagcaatccataattatgatattagattcccttctatcaactgagcatattgaaaaactaatgcgaccatgcctacgacggatataaccattgatcatatcatatacccacaggtggtctcgttttataacaagtgccaaattaatctaatcaagaatacgacactacctcataatgtatgcgtttatatgttcatgaccaatccacttatttggggc

SEQ ID NO: 98001 - DNA, 539 bp, Oryza sativa
actatagggcgaattcgagctcggtaccccgtcggtggtgagaggcggcacgaggggaggggttgttgcagtggtgaaaaaagaaggaagaagggagaaaagaataaaaaaaatccatgttatcgttcacgtggcgtgccacgtaggcaagaccagggtcaaacgcggctttggacgagaataatacaataaaccaagtttagagaactcgatgtgcgctttacaagttcatggaactaagtaaaacctcccgacaagtttaaggaccgctggtgtattttactcttggttattcattcaacgcttctagaagtacgatattttccgtattggttatttgttccaccaatgttcagttttcagtcggcacaaagcgaaaggaataagaaaccaaacatagcagtgacactgtttgagcccgtgacatcacagactttggattaatgtcaatttatcatcgttagtttctgacaatcactctgatgagataagcctctaaacttaaaaagaaaaattctaaccccaagtatccgacagct

SEQ ID NO: 98002 - DNA, 624 bp, Oryza sativa
tcgccttagcattgtgaatgtcatttgtttttttagggttggtgaatggtgatttggtgttagggttaccgtatggttgatgcgcatctatcatgaaatgggctattacactacgttttgatcaagataacattaacatctctaattattgtggtcggtgaaacttcccggcttcccgctagattaccattattattgggtagcacaatagcgaattagactcagtttattatgggtagccttcgagagttccattaactctttaaggcgttttacgctgtaaagtgtttatacagattaccgctcatacacacagacctggattgtagatttaccatattccagagcagatggcttcattgtcaacagcaatgttttgctaaagaaaattttagaaccctatgttctttgtagtaactaatttagaaatttttgttttgtacctaattagttctgtaattttcctgatcaaaataattgtagacttcatgtttccagtcattaacatgataagccagtttatttggtcaaaaaaaattcaatcctttcttttcaagaaaagagagatatttaaagatctggcccacttttttggcattctttggaacagttgctgcacttttt

SEQ ID NO: 98003 - DNA, 714 bp, Oryza sativa
tggccgcgccatttataccagtccaggagttgtcagtaacttaagaccttactggcctggttaaaggagccgcttaattagcaaggcgtccgtgcatatttcaactgaagtgctgctctaatgatttccagaaataacgagacaaataatacaagtttaccggcctagctaggctttggtaataagcatcacttgtatatgctacagtacacaagagtataagcatatgataaacctagataagcacactaattaaaatttaaacatatctttctttccgcccgtactgatgaagcacatgaattttttttcacctattattccattcctttttatacaaaaaaaaatggaagtgaacgtgttcaccaatgctacgatgattgatgagtccccaagaacaaaactgagcagcatataaagctaaatcagcaacagtgcatgtaccaccactgtatattactagcttctgatatgcatggcagcagcagcagcagcatgccagcatcacatagagagctgtaatccaggggacacaagcaacctacaactagctagacttcgcgagcaactccatcccgagctaagcagcaatcgcacgaacgaacacgtacaaagccatgaaccgtatgaacaatcagagagaacataagagaaatcaatcagcacgaaataatagcaatggtacacgcaccaacaccaccagccccctcgggg

SEQ ID NO: 98004 - DNA, 600 bp, Oryza sativa
tacccctactttatcaaatcccaatgcaactattccttactagttactttatctactcccaatactattatttttctactttcacaaattctgacgcattgattactctaaaaatgaacttatttttaggagaaatggaaggagctaaaaatgaacttattatgggacggagaaagtataacaacaatatcatctttaggtggtgtattgataattcataccaccttcaaatgggtgccttttatatgtacagccaaaccttaaaaacttttgtaactaatatacaaaatgctattaatatttattatgtaaaaatgtcattaggaaaagccaaactaatgttcccttggaacaagcaaacaatacacaataaagaaaaggaaaaattccccatttcatccgtcaactatgtccttggtctgattttggtcgctcaactctcaaaaccatccacatttcatccctgtgctaaaccgggacaattttcagtgatgtggcacctatgtggagtctacataggcaaataatgaaaaatttcaccataataatcaaaagtaaacaatagaaaaagaaaatactagaacccatatatttgttttt

SEQ ID NO: 98005 - DNA, 567 bp, Oryza sativa
catgcaaagttaaaatattgcaatagtaaaataaaaaaattatgcgtcaccaagcttgtgtgatcaatctctcgagtggatggcggcattggcctggttgcttgtccatgtcccatgttttttttaataggcttaagaaatttaaacctagaaacatgatcccagatataatattatcttggggccaataaagtaaacacaaagaacacaaaaagattagaaccaacttacctcgagttgtctcccacggcattagtttaattaagcaagtagctcagtataaaatataaagaattaaaactggacaagaaagaggctttcaagtattgggcatctcttttgttagacctcattatcgtaatttcagcctttcagtccctttagagtcccttaactcacttgccctataggagtaggatgtagcagcaatagatctcaaaattaatactactacctccattttttaaatagatgacgctgttaactttttctcacatgtttgactattcgtcttattcaaaaattttgtgcaaatgtgtaagatataaatcacacttaaagtactat

SEQ ID NO: 98006 - DNA, 582 bp, Oryza sativa
aatgaagtcaaaacgcagataaccatatctatgctgaaatgaaaagcaaacctgtaatgggcagaagaccctggcttgacatgcataggatgatgaagaccagcagctgatagtgccggtacaggaccgaggtaactgggaggtcaagaaacagcaagctttagaacaaaaattcctttgggggcaagagtgggacacattaatcagccaagaaaactcacccaaatggtggaaaactccccagccaacttccaacaggtatcggcataggtggtgtaacagcaggcattgctgcgagagaggatgaattccgtatgataaaactcccacatttcgaaaaccaagagaaccaaatttgcaaacgaatatagcaaaattcttaccagatttttcatgctttatctcattcttaggtttctgttgctgcaatgccggctgtggccgtcgttctgatggggacttttcgtcaccaaggctgggcttctccaaatccaattgcagcgtgagtttctttggagcaacctcatccgctggcatcctctgcaccatcttatcatcctccaaattgatctccagccctct

SEQ ID NO: 98007 - DNA, 553 bp, Oryza sativa
ccaaacattatgccaaaagtcaatatcgtcatttattacaaaatggaggtagtacttcctgtgtgctctgttataacaaaggattgccatggaagagataaggtttactatacaattgaatgggcatcaccaatgttaaaaattcactattgccatttaatctgttagcctaccaataaatcattcttgtcactgtattattaaaaaaattacccgagcaactgttacccaatctattccacaaaaagattacctgatctagctgtttagtgtaactgcagtaggagccaccacatacttgaaggatcacctgctaaaaatcatctctctcactacggtgtgaagctagtggaggaaataggaatactgacaatcttttaccattgatttttatttgtgtgcatgcatatgtggtgggtttttttgggtgcggggtgggaggggtaaaaaccagccacttaccactggactactttaattatgcatctgtttcgccttaagtggaaagtatgtggtcatgtgatcgagatttttgatcggttagatctttggg

SEQ ID NO: 98008 - DNA, 658 bp, Oryza sativa
ttcattttcttgccgaaacacttccaattttcagcgacctattagatgaccaattttggaacacattgccaatgcaattttttaccaccaaccctccccctggtcacccagatttcagaagcaaattaactaaaaagcttgctgtgaagtaaatattgccaatgtttttccagcaaactaattatatgccaaaactgacaaaccaaattttggtagttctgtttggtaactgcagctggcattatttcagaaattctatagttcacaagcgtttgttctatggtagcatttccaaattatctttgttgcttgactcttgaaggctatgtctgcatatggccctcttccacatataattggttctgaagagtacattcatgataacagctgtgatgtcggacaaaaccggggataaaactgccgagggacctagtttgtatggttttgtaagttggaggatgcgttgtatccggtttcgtggttggaggacgattttgtaattcgatgacaagttgagggatcttcggtgtactttttcctaaaatacggtgagaaaaacttgcatgcggcctataatagttgggcctcaacgggaatgcgggctacgtgcggcccatattagttggaccgagagctagaatgcggcccatattaagtg

SEQ ID NO: 98009 - DNA, 770 bp, Oryza sativa
aaacattcactcgaggaattacaatactttccctccagtactgctggtagtggaaagccatcacgggccacgggatcggacgcacaaaaagaaacaaagaacgattattctctatatatatgcttgttaaccaagccgaattaagtggcaaattaaaggggacacacacccacacacaagcttatactagcttgccaaaggattgaaacatactgtcagatgcagcaaattaaacaacaactgacagtgtattggtagatgtgattatgatatatagtactccactacaatataaaaacgtacggattaacgtggagcatgtataactgatgttggtttgccaggtagctggagtagtagtactagtagtatttgggcacattttcactgcctcacgtatataaagaacgtacaggtacgtatttatcttaagagaaaacgatcgacactaaatattaatcaaaatctaacaaggaaaactatatatcaccatatatataccatgtggtaggagtaatatatacatatatattagcagaaatgtaaaagtttctacattatttcctccattaattcattttctgcaatctcaatcattttgtgccgttgtgcaggtgatggtccagggcatatatttaggttgcaagcaccagctagctgcagagagatcgatgcattgggggatcggagatcatcgggatccatatggcccgagccagtctcgaatgcatgcagttcagccgttgaagctactgtgctttattaccgtg

SEQ ID NO: 98010 - DNA, 1684 bp, Oryza sativa
ccagtaattatgatgtgattttggcctcattaaaagctggtcgtattttcttctttcaaaaaaaaaaagctggccatatttttctgctacgtcggttctgaaaggcacttgtgctgagagcttaatttgggggcactttgtatgcttatcatgataatgtctctgcagtaggtcccttttcctcttaggtgtttcttgtcaaacttcattagttaccaaggcactcaattagttgagataagctcatttcaagttgtaatcctaccttctagaaagagaagaacagaactgaagtcagaaatatttttgtcttttttttaaggaacaaccctgtatgcagtaatcatcctaatactgtatttgacagaattaaatgaaagatgaaaattagatcaaaatggaatgccttttccatcctcttccaccactcttagaatcaaatatttctgtttgcctgtcaaatgcaaatgcagttttgcagggagtgcatatggttgctttctacccagatacagaaataaattgatgctgacttgccagagtgtaagcagaaaaggaagagctgatgctctcagcatgtgctggattgtccaagtaatgatgttctctgaagttaggccagaaggaggttccaaactaattactttgcattaagttagaacttcacatgtgccatgtgataatttttcccccctaaaggaatatatgtcaaatattacatacatctgacatttttctttaaaagaaaaattctgaggtcaataagttactggtcaatccagagaatagatcatcaccatgggccaatgactcaattctaggggatcccaattgaaaacgagtcagattttgtgagtgcatcattcaaaacacctaatcctacaattccatgattggtgttggatgggtcctctaggaacatgagtgtggctctatgccatccatcgtcctgaatttctcaaaatatttcccttaaaaaaataaacaaaatatcatgagtcggtatatgagtttgcactagaacacaacactaatgctccaaaaaaagaatccttcattcgacgactcatatataaaaagtgcgccctctggtgaaaaaagggctaattgtttggcttatgcttatgcttataacccaaaattaaattttagaacttaattttgaatttgatttcttggtttttttcattctactttattttacaacatttgctcttgagtcgctaatgatacatttataaaagttttactcacaattttttttggtaataagtgttttggataagtatatgaatacgctaaacaatggggctttatgtaacgttttgagcaagagactccgacaaattttaaaacttccagccaaatatttatgactagaaagagtatcacgtttatttccgatcatgacgttcatggagctattttttaccattgggtttactttccacgagaaccgataaaaaatcgcgaaatttggaggtttcgacgcacgacgaaagtagatggagagaaaatttcaaacggtacaggaattcaaaatttaaatagaaaattaaatcaaaaatttgtcgagaactgtcatactactccaaggatcgggggagccaacactaaattggaaaaggcgaacccctgtgctatcacattcatcaaaattagcaatcagtagtaattaatacaa

SEQ ID NO: 98011 - DNA, 524 bp, Oryza sativa
aaaagattcacaccctcagttcatgtcgaatgcatagaaatatagcttaatattgcatcatcaggaaggaccacaaaatattgtagaacataatatatactccctatgtccacaaatacaagggattttagagtactagctgtctaatcaatcacctctcattcaaatttcttcccatcttactcccacccaccccacccaaccctcattgaacatgagcatcctagtcttttatcttcatccttgatctctccaaaaacagagggagtatgctctttcacctctccaagatagcatagccatatagaaactatgatatgtttaatccaggtagaattatatagatgcttaaatatccatatgcacctggaaacagctctcctgctgtatatagctgttcagtcccatttttgcatgggaagatagtaatgacaaaaatgttgcatgtgtatgccactaaatgttttgcagatttgctcagattcctttgaattactttaccttcagggaaaacaatttcagaa

SEQ ID NO: 98012 - DNA, 543 bp, Oryza sativa
agcatgccttgtatgacatactcttcatctaaccatttctaatattataatattggactttaggacaagaacgaatcatgccatttaaaaggataccacattatctaaaaaaaaaaacaagggtatcaatatcactgagttttttttttattttgggcaagcaatttttccagtgctcaccagttacttcatgttcctggcatctcacaaattacctccagcatttgtgaatcataatacggtagatttgcagcagataattggaaataaagatgtacagccaattactgatattaaccagtgccattttcacagggcaggcagttatgtcaaattgtcaagtgcttttaccctcattcattctagaatcataggtaaatagtatcaactaattgcatatttgcattaggtgaccattgactactgagatcctgatagcaataaaaaggaatagaggatgatgattgtgagttagtagtatccctcagcacaatcatgatacagttgcaaacattgatttaattaggataggtttttggatca

SEQ ID NO: 98013 - DNA, 533 bp, Oryza sativa
gctacagtaaatatttgttaatgacggattaattaggcttaataaattcatatcgcaatttacaggtggattttataatttgttttgttattaggctacgttaaatacttaaacgtatatccgatgtgacacggcaaaaatttttaccgctagctagctggatctaaacacagcgttaaccatataaattgcacaaaactcctaccccccccccccccccccgcgttctactaattgcagtcgcatccaaaggtttgaaacccctcgcgccaaatgcgaaaaaggcaccccgcatatccccacgtgcgctttctcctcctctccgcttgagccctagctcctccctgggctccctcccccgcgcgaattgaaaaccctagcttcgatctctctcatccacttcgacgcggaggccaacgatcgtaaacagcttggtgagcaggggctagctagctacgacgaccaaccttggatgtacgagagcgcgcgcgtggtctcagatcgtcgattgagggcctcgatcgtgatggcta

SEQ ID NO: 98014 - DNA, 571 bp, Oryza sativa
tcctatggtcctccctcttctcctgctcccgcatagcctcgtgctgcgcaccagcggtggcggtggtggtgccactgtcggtagcggccgacaccgacgcctttgcatccgatcttgatgccggaagcgtctctggcctcgaggacggctcagccaagtctggcttcgccgggctcgctggccggacatcgtcgtcgtacttgacgagccgtggccgcttcctctttggcgctgcaataagcaggcaaaagatgagatgaggctcccagaaacccaaaattggcaaagaagaaatcgttgcaagtagggaagtgaaagaggctcaaacctattgtagcaacggatgtcgaatcggatggccgtgcaaccgaggacgacggggccggcgaggagttcccggactggcctccggggcgtccctgacctccagcttgtggttgctctccactggcttggaaggacacgggaactgcctcgtgagtccggaataacttcggcgacctcgatctcctcctgaatgaaagacggcgacttcgaaatcttcggccggggaggctgcggtggcgctgtc

SEQ ID NO: 98015 - DNA, 692 bp, Oryza sativa
ctttagccagcaaatacatttcgtgggggtggcagccaccaaaccgcctagatatgtccacaaaattaataataaaattattgtaaatccatctcttactactagatatttataccaagtgagttcacatattacacaaaatcatccatctctacattcaattttttatgtatacatcgttaaatatacttttatgtatacatataattttatatatttcatagcaaatacgcaactactccccacacagaccgccctacccataccgaatacatatcatacgtataccctcgagggtgtcagagagagggccccacaatgtgggtggctccatctccttccccaatcctgcgcgttcgacgtctccctccccactgcagaacactccccgccgcagctgtacgcaccctctttcccatggcgccgccgacatgtccttctgaatcttctccggcagccgtcacccaatgtacatccagggtttcacagtagggatcttcggctactggcgctgtgctcttgccacgagcagagtgtggggagacaggcagaaggggctagatgggctcgagggagagggatacctaccatggccaatctggttgggaaagaaagggagctagttgtccgtatgctgttatggtgagtatggtgaaagtttgtcgggccagctcggcgtgagcggcgaaaag

SEQ ID NO: 98016 - DNA, 578 bp, Oryza sativa
gaaacaaactgacagaaagatgacagtgatgaatgttgccaagaatgctcgtgtttggcaaaagaaggaagaagagaaaataagtccagtgaaactgtctcgttctataaacttgtcatccaagtcccttttgagcataaagatgagagcagtcaagaaagaaaaacctgctccctagtgaagagcaacaagaaggtgtatggagcagaaaatgctgttgctgacgttaaggagaaaaacctgaagtcagcttcaccaaaagtgagaaaagtagaagttagcaagaaagaaagccgttctcagaaaggtactacattttgtttgcccccctgtcaacaccatgttcaaagatttgcttaatttacattcaacattactacagatttcacatgataatctgtctgtttatgtcatgattgacaataaggtttaccttcttttctccccatcctaattcagtaatcttgcatccaacattactacagacaatttatgcagaaaacacttgtttctcaagcaaacattgacatgtgctcattcaaatttagcagaaaattcttgcactccaagaactgaaa

SEQ ID NO: 98017 - DNA, 544 bp, Oryza sativa
  unsure (1)..(544): unsure at all n locations
ttagtttcagtagtttgcagtttagtatcttcatgttatcctgtagttgaaagttcagttctcagcagagcatttggtactgaattgcaacttgaatggaggttgtctgaattgaaaagccaagatttgagctatttctatggtgaaacatgatcttgttgtcaaatgcttatctttgatctgctcctgctctttactagcttgtcaaaactatttctcttttcattctttgcttggcctttgcctgtcttatctcaagatattcaccagtttcagttctgaactgtggacagcagcttacaactcaaataattaggcccttgttttgtttctcaggttgtgttgcagttcagctttactttcagtaattgcagtctggtaccttcatgtaatcatgtagttgcagttcagttttcagtagaacatcaagtgattgcaactttactgaattacaacctgaactgtgagcatctgaactgaaactcaagattntagcccatgctttggttgatctgctactagtctccttatacttgatattttc

SEQ ID NO: 98018 - DNA, 533 bp, Oryza sativa
ttcaccgttctaatttggttctaccacagtctaatggcttggaatttattcttcgattaatgtgataatttatatcttttagaataaatatggcacattcttttcgagttgtcttaataataaagatttctacgttttttttatgtctctgatgatttttctaaagctatcttaataatatatatatagataaatgtacatatttggcaaagaatatttacatatttattattggtattatatttttattccaaattttatttttaagtttattttggaacctatattttcaaaggaaaactttttaattgtatcgcttaaggtgtgcacctggctagctgctgtgcacatgccatcgttccttctgtttgttgacgtgcatcgtccaattcttgctcatcgtgcagccgcgcggctcgacctgctgctgtggatttccgttgctactatacattatagcctaactattctagaacctaacttaagtttagaaaatcggacaaaactattttgagtccgtttgcatgtaaaga

SEQ ID NO: 98019 - DNA, 644 bp, Oryza sativa
cgatgcgtgcagagctgcagtccaacaaccatacacctcatgtgccgtgacccgagcgagtggctcgttcataccaccacaaaatatcatctcctacatagccttgccgaatcgagcctaggttagtcgtagcagcagcatgccagtattgtagaagtatttctcatcgaagcgctgacgcggcgatgagaagaaacgaacgatcatttcgcgtttcgccgatgggaacggcacttcaggcgtgctacgcagatcttgggcagcgtccacgtcctcccccaattcatttccgccccccaagaaacccgcaccgcgcgtcacgtctctcctctccccgccgcggcatgtgcgtctccccagatccgcgcatgcgcattccatccgcgacaagtgcccatgcctccgccgcgacaccgggacaccgggcccccgccgcccgcgaccgtgagggagcgctcgtcggtagccggcaacctgccggtgcgcgtggcttgcgtgcgggtcgtcaaaaccgcgcgtgggggatatgcatgggccgcggcccggtgcggtgccgccgcgccgtctcggtcgcggatgcatggggcatgcagttcttcgatcggacaccgtgggagggtgggagcaactcggatctggggagg

SEQ ID NO: 98020 - DNA, 631 bp, Oryza sativa
tggtttgtaaaacttcattactacatgatcttaatttataagatgtacatgatctaatcttttcataagttgctacatctggccccgttcgatctccagttttggagatagatttttatggcacgcaaaacgagaaacctcattagcacatgattaattaagtattaactattataaatctgaaaaaaggatttatttgcttttttaaacaacttctttatagaaaattttttaaaataacataccatttaacaatttgaaaaacgtgctaacagaaaacgagaaagttgaagaatagaacagggccttttatctccatttgttttctttttttcttatttgtggattacaaatggtactatactctctattagattaaatggtcaatattgcataaccctgatttttcatcatgcatgttttgtgatgttgatattattccttctccagaagttagaccccatggcatgttacgtgtcttactaaaatcctcttcttttctaatactccaatatttatgattgccttacagataaccatggttggctacaatgacaaaatgagaactcttttggagactgttattgggaaaattgctgagtttgaagttaaggctgtccgtttttctgtg

SEQ ID NO: 98021 - DNA, 626 bp, Oryza sativa
aatatagctcattttgaagttattccagttgctgtagattcttgaagttatgaactttattccaggaatataaaacttgacactcactgtacaaataatgtctctaaaatttatctaagataggttatacataaaacatgtacaaacttataaaatacatagaaaattcatttcaactcattttgaaacaaaatcaaattctacagattcatcatcatacagtctctgattaagtgaaataaaagtaattacttactttgcatcaaatgcctctaaaactattatctctataatgattagttttagataagctaaactttagaaattcatgtagaacccaatttagcttcaatttgaataaacttaagttatgtaggatcactaaaacatgtatttccatgttatgaaataagattatatacttgctgtgtagtaaaagtctctaaatattcatataaggatttactaacatagagcagccattaatttgtaaaacttgtagaaaatttatttttagtccaaatgaaatgaacaaagtttctatagaaccagcaaatagttatcttcaacatagtaaaataaaaattgtcaccttttgtagagaacattgatcaaaaccttaactt

SEQ ID NO: 98022 - DNA, 507 bp, Oryza sativa
gatcaatgtaaaactagagatattttaccgtctttaagggagtattatatatagtttttaacatttaccccaaggtatgtactcccttcgtttaaaaaaaaagacaacctagtattagaatgtgacatattctaatacaacgaatctagacatagagtatgtccagattcattgtactaggatgtgtcacgtcgtaggacgaggttgagtcttttgggacggatggagtatacatgtactcctacaagacatgattcatgcacgcgtctaatttaagcagcattatatctaaagtaagtttcttttatctagtactttatatacaaatcttgagtactactgcaatatctttaagtaaattcaactccatcgatctgttcctagctaaaagaaagtcattttaggttattttgcatagattaatgtttgagaagagaatagacttagcgctccttttttttttttgaaaacatagtgcttcttattaaatgatgttttatggggagt

SEQ ID NO: 98023 - DNA, 614 bp, Oryza sativa
  unsure (1)..(614): unsure at all n locations
ttctagtcctacgcatcctgcgtttagatagagaattacctgatggtgtgaagctaggaagccagtacatccgcagaaagaagaagcnccgccgcgccaacaagcggtttggccgcgcgctctgctcccgcatacgcagctcgggcgaagagagcaaatgacgccgtcgcctcctgcttcagccggccgcagcacgcagtcgtcgtcctctggggagcgcgatgattggcgcccgccgcgcgatccggacccggtggccgtgagcccagagaaagccggtgcatgaagctgctgcttcttcctcccccgtcggctgtcgcaccggggacaaggctaatcttggaggacagtgttgagcctgacgtggttcagatagcagccacgtaatgtccaaaaggattagacgggtcaggcttagtaagatcagaccataatgtatggttaagtcgtatttttgaacgaatcagcacgtattttttgaacaaattggcactagacggtgcccatttctttgaatatagtgtaaaaagtttaatgtattgtttagacattttatagcgtggcagatccagtgatgttggcctgtgcaccactgaagcttgcatgcctgcagg

SEQ ID NO: 98024 - DNA, 828 bp, Oryza sativa
ggccgtaacaacaagcggctgggagaaggacacatcgctagtccgaggctagtacttcctccgtattattttaatatatgacgccgttgacttttcgaccaacatttgaccattcgtttaattcaaattttttatgcaaatatgaaaatatttatatcatgcttaaagaacatttgatgatgaatcaaatcataataaaataaataataattacataatttttttattaagacgaatggtcaaacgttataaaaaagttaacgacgttgtacattaaaattaaaatatggaggtagtattaagctccgagctagctgctgaatgcagtgcgtgcagagagtctctgcactccgatccactgaactcatcacatgaaactgtttcacgtgtgtggctcggtttggaattattgaaccgattattaccgtatactatgcccctccatactataaaaaaaaccagcttagaattagatggggtttactccctctctattcatgctgagtaattttacagttgttgagaaggtaccatggggtactaaaaatttcgtgtaaaattcggtaccttatacgagataccaaattcataatagaaaaggtgatatctcatattagcttttaaaggacggtaaaattggtcattcatatgcatgccataaagcccggaaaaggaacggtgtcttttcttctcctctttggtcttgctgccatgcacaaatgcattgatcaaacgcatgaaaggagaaagtaacataggccttatttagttgggaaaaatttttaggtttggttatcacatcggatatacggacacacatttgaagaa

SEQ ID NO: 98025 - DNA, 711 bp, Oryza sativa
gttttatattagaaatgtttgattcgaaaaaataagccagatcatcatataatatgaaatggaggaatttgaaaacttcaactcatcggtgccttcctcggtcaattatggtgcagtggttagctggtactagtacgtatcatgatgttgatcgtgtacctcgtattatccttgaccaagtgaatattgatgtgccatccaatgtacctgtccaagaatatggatccattcaaaaggacataaaagaatatagagtgttgccgttccccggcattttcatcggaaggaggactgtaattacccaccgtacccttcaatcgcgaaaacaaccttacacataaatttcttcttaaagatatttagatggtatacatgaaaatcacgtgtgtagatttatctcagaaagtacttttacaaattgtgattttattaggtttctaaaaaaaatgcaatacgaagtattatcgggaacagtattttttagactatgtcagaattgctttttgtttgatgggagggagtcaccgctagaaaatcgatttttcatggcggttatctattttttttctctgacggctataagcgaaaaccggcagcgaaaatttaacgagggatgaggtgctaagaactgccagcgaaaaaattcattttcgttagcggtcgggataagagaaccgcttgtaaaaatagaggtctttttaaagcgggcct

SEQ ID NO: 98026 - DNA, 508 bp, Oryza sativa
gaacaaacaaaataagttgaaatgttgaatcatacgtacgcaacaatgttattgaccaaaatgcacttaattgccaagttcatgtaccggtctgcatatttttcaatttgttacactaaatcacatccacctgccaagttcctacactacgtattaatttactctttttgaaaacatgaaacaaataatctattccattaatccgataaataaataagttgaaaagaacatcgccgttactagggatgaaaacggacggaaattcccgatcgaccgggcgccgtttccgtttaaggggtacagtttccgactgtaccgtttttggctatttttaaattttgttttttctaatttctttctacatcgtattaatgtcgatactgagtagtttaaatgatagatatggtcaattaccggctgatcgagcatcgtttccgaagagattctaccgatttcgaccctttttacccgtagacgctaccatatcttcccctcttgagccaaccat

SEQ ID NO: 98027 - DNA, 630 bp, Oryza sativa
gctcacggctgtggaatttactggctgaggtatccacttcagtactaccccatctgaaaagttttccatacattgattgaatggacagaaatgcaagaggtaggggcctgggagaatcaccaataaagcctgtcaatccaacgtttacaaggacagtttggctgttttcgccgaatcatgaggcagggtactccagcatcctatggtgaacagtgagtaacccataagaagaggattgggatcaggtgcagtcactaactttggcagtagcaactaatccaaccatccaactagtaaggaacgttcagacttaattgcctccttcctcatttagcatttgaacatgaaatactagcacaattatttttcatttgacaagaaatttagtactacttatttagatgtttaaaagaagcttggcatttattttaagggcttgaagtagagctcatattttgatgtaactcctttaaccttttttttatgtgactcatgctctgttcaactaagaagcattaatcctattggtttttcttacagtttctttttttcctgaatggaacattttttttaaaagttatcaatagaagcttcacactgatttacggaagattttggagtagtagttta

SEQ ID NO: 98028 - DNA, 530 bp, Oryza sativa
aagaaagcagctgccatgccaatgtttctattaagctttaccatactaaaacttgcagaatagtgacgaataaaaaaagggcatgtgcacttttttaggcataaaattgttcacctgctgttgacacattcaatttctgctcctcccttgtatgagaaatcacatttgaagctgtcaccgcccaagagatcagtttagtcaatgggcaaaaaataaagtaaaaaaactggaagtcatttgtttgccaagagaacaatgacaaccttttccagcattattcttgagtttaactggtggttccttgatgtctgaaacttccttgattttaggttctccaagcttttgaggagaccttcctaactggttttttgtatacacatcatctcttgattttctttctttgtacttggatagacaaaacatcaccattagcacgagaaccaccgcggataccaccccaacaagaatgtatccaacaaatttcattgcagaaacattgttttttcttgatggggcattccctgctggtg

SEQ ID NO: 98029 - DNA, 655 bp, Oryza sativa
gctcggtacccaacgtggaaaactctcctaaaacaggagagaaaaaaaccacggttgccagtcagtaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccgcggacgcttagctaggatgttgattcgctgagttccggtcacgcggcctgcctttccgcacgaagcacgcaacaggtcagcaggtattgtcttcgatggaatcagataactttgtacagtctgcagttgtgccactg

SEQ ID NO: 98030 - DNA, 607 bp, Oryza sativa
tataaaatttgctttaaatccaacgtgaatttaagatctagagttgtgctaaacaaaatgtatcgccataacgcaaacccatcgcaactaataaatggtacattttcttcttcttcttcttttttagaatggaagtggtgactcattttagtcttcttttcttttacattcatcacacaaaagatatatattgttctttgacagatgacgtcatttaaccttttaacatgtgtatcattcaaaaattcgtgcatatatatataaaagtaagtgatgtttatagtaactttatcgataaaccaagtcgcaacaaaataaataataattatgtgatttttcaaataagaacaatgatcaccagaatcaatgccgtcatctattaaaatcagaggtagtttatctgagataggtaaatagaagaataaattaatttctttgttagaaaactcaattagttttttttttttttgcgtttttctgccattggtggggcaccttcttctcaaattggccttccattatgtacccaactcgatcttattctgttcgacgacaccatcgagccgtagcgacaggtcgacgtagcatcaaccaaaccttatcgatc

SEQ ID NO: 98031 - DNA, 629 bp, Oryza sativa
tgtgatctaagtcttccttctcttcttattagctcacttgatatatcaagttttttcactccctccgtttcataatgtaatactttaaagcattgctcatatacatatagactatgtgtttaaattcattaacatctatatgtatatgagcaatgctaaaatgtcttacattgtgaaacggaggaagtacatgacatagcgttaaaattatgggttgtatttttggtttaaatgtactatctatcttaaaatatatcaatttttatacacaaatcctaacaatggttcttatttttgctagaccggctaaagaccaagctagccaaatttcattaagattaggattatttacaaagagataggtccttatcatggtgcaggtgaaaaaaatggttcttatttttgctagaccggctaaagaccaagctagccaaatttcatgattttacaaagagataggtccttatcacggtgtaggtggaggtggggaaaaaaacaagattaggataaagagacatccctccaaactttttttttaagaaaacattgtgaacatatatattggaaattgatcacgagacaccagagttgaaaccgtacactttttaccattatcctatcaaatgcat

SEQ ID NO: 98032 - DNA, 628 bp, Oryza sativa
tggcattgccacactatatttttataatcacctcaagtatacaaataagatgtccaaagcactctggtgctgaaatgaactttctaataatatacgtcatccatttcagtacagaggcaatataatgaacccacattagcatttataatgtattacagtattagtataacagttttcagtcacaaatggcattgctggtacctttgatcctttaatggcatgtgaatttcacataagtcattttaaggcccaactgttttttttctcttaatgccctttcacatatggactttgacatctttgcagatttatcaagtaaatggttagttccaaacgttattatgcaactcataaacttttcaaggaatgggccgcttattagctagatattgtgacagcacctatcaggagatagtagtgttgaattgatgttgtacatgtgattcagccattcgtgtgttttcctggccatgctatatttggtttaatcttctcatccagagatactcagtatgatttggaaaatttattttgagatgtgttgcatgtatttttacagctattgatggtacccaaaaatgaaaaagaagcatgctgctgtctgggacttagaagtattttttacttg

SEQ ID NO: 98033 - DNA, 542 bp, Oryza sativa
gtattttacaaaaccattcacaaacttttgagtaggagatgaatttagtacttacaacttttgaatcatgttttttttctcgagtaaataagaaactattggtagttaattatcatacagtccatctatatacataccgtgtagtatggctgcaaataaaaaaatgcgagtgcaagatacttaaaattcttttgattaaatcatctcatgaaggcgcatgatataataataaagggagggaagcatatgcatgggaaaaaaagaagaaagagaaaaatgaaaaaagggaggggaggcgtacgaacccgcgcacgtaggtgcgcaactatgctgaggtgggaccctgtaatatttagtttgttctaagatcaatttaatataacggtttataatattggacctaccgatttacgtggcagcttgagagcattttaaggaattttaaatgactaattagaatattaactgcgcaatatatatgtattggacatatggtaatatttgttccagcttcatccatgtttatatatggagatgattaa

SEQ ID NO: 98034 - DNA, 1090 bp, Oryza sativa
tttgacccccaagacgccggcggccgcttggagcagcaatccagcaggtgatcgccccttcgtttcgcgaagggggagcggatctgggcctggccgacggcgccggcgccggaacaggagcggagctgagcgtcgaggctcctaggccgcttcgcccgcctaggggcgtccgctgtctgcgctcgggtggccgtttttcgcttccccatcaaactgacccgccgccggcggcagaggggatcggccggagcccggaaagggaatgggttaatttggtgtgttgtttcgggcgacagcgacgcaacacggcgcagcgtgacgaatcagtacccgtacgcaaccaatttatgcccacaccttttagcctagtactccgattcgtcgtatagtactccgattcgggccttgatccagcgggctggctatctcggggagaggaagtcggacttagcgcctagcggggctatgaccaggccagcacgggccggtccgatgtaagccgtaccatcctgacacttgggccaaaatcaagattcgtttggttgggccggtatttcgacccatttcgctcagcccctgcgacgccgcgcgccccgtcctactgcaaaacgcgtccgctcctagctgcgatgcaagccaaccagcgagcgtagtacgcccgtatgcgaggagaggacggcgaaggttgcggcgaccaacaaggtccagtttagttcttaattttttcttcaaacttttaactttgtcatcacatcaaaacttttttacacacataaatttctaacatttttctttaaacttttaattttagttaaactttcaattttaacgtggaactaaacacagcccaactccccaaacctaaaaacccaaacccaacccaagtacccaaccaccccgaggttgacaaacaaaccattgcacgcgaccccgcccggaccgatggaaaaccacccgccacccgatcgaaccacggcatatcctcgcgcccgcggctcacgcacgcacgcacccacacacgtgtggccgatggtcaaccaaaccatccctggctgctctcgcacgcgaaccacacgagtcatccatccaa

SEQ ID NO: 98035 - DNA, 1027 bp, Oryza sativa
aatgttcgttgctgttgctggcttgctgcatagtgccttgcttgttggttgctcgctaagttgctatttgccggttgaatgaaaatatgaaattggatgagccggctagcggcctggtgctcggagaagatgagacgtccagactcgagacgaattgagcaagtcaaagatacgaaaagatgagacgtccagactcggggctcggagtcgagaatatgaagcaccacgcacccgaagtcaccgcgcggagacacgcgctgactcaaacgggcttctgacactctagccccacgcgaatacacgagccttctttggttgggatgatttttttaggccctgaaaatttggaggtcctgcacggtcgcacgggccgcacgccgttgtgcacggctctgcatggtagtagtaactagtaagggcttgtttagataaaaaaaattagctaaaaacgttacatcaaatgtttggacacatgcatagagcattaaatatgggaaaagaaaaaaaaacaattacacagtttgcatgtaaattacgagacgaatcttttaagcctaattacgtcataatttgacaatgtgatgctacagtaaacatttactaatgatggattaattaggattaataaattcttatcgcggtttacaggtggaatctataatttgttttgttattagtctatatttaatactttaaatatgcacttaaaaataattttggccaaagaactaagcacggcctatgtcgtaaaataaatcaacgtaggtactattctgattcgctgtattgccagctagcattgttaccaccgttatggacttattatggtaaatttggttaggggcatttgcaaatttgccaccggttttttgaatattgcaaggataccactcgaatgacagttctagtggcatttttgcaattttctagtggcagttttgcaataataattcaaagtagtggtaaatttgcaattgcccctgttcggaagcatcacagccgcatgtcctaagattgattaggcatg

SEQ ID NO: 98036 - DNA, 580 bp, Oryza sativa
ccattcggctcgcgtggacaattggtcatgctcaaacacacgccctgttaaatctcagcatttgggatgtgacctgatgcagcaccagaccatgtaggcacaaagttcttttctcaccagtgctacataccgttcaccgacgaaattgatgttcacgtttcagccaagactctgtaagtactctgaaaacagctaaaatgtcgcccgtgcgatcgtatacgaacggtcggatcggggcagattttcctacatcgcgtgccgacggaaatggcttgataatagttccacaacctcccctttgccagtacaattctcaatatataaaagaaagccatcggcgaatacgttcgtggctcgcattgttgacacggtggtagcccatggcgatcgatcgaccagaaagcttaaataacacctagcagagacagtgttctccctctcgtctctcgtcgatggcaagagacttttttcttttttgcgatcgatccagcagcatttacattggcctctctcttcccgttgtttattcatggcaagatatggatggacagtgacgcggtaccaagaatgttaaagcctg

SEQ ID NO: 98037 - DNA, 648 bp, Oryza sativa
caaatccaattgcagcgtgagtttctttggagcaacctcatccgctggcatcctctgcaccatcttatcatcctccaaattgatctccagccctctccgtggcctctctgcgtctttcttttcggaatttcctctcgcagcctaaaatcaaaccaaaacacaaataaaatggtcaatcagtgtccaaaaatccaatgctctagcaggtgaactaaaaaaaattggtgaaactgaagttcacaccatgtccatctcagaatccaatcccttcttatccacatcagggtcggaagcaccatctctatcaggagacttcccaggaggaggagcctggaaccaaaaaaaattaaaaacaaaagaagtcagaaaaggagcaaaaaaagataagaaaaggggagaaaaaaccaagcaacaattgcggcaaaaattgtcgctttcaatcattgcccaacaaattccgcaagaccaattcaaccacacacacaaggaagcatatacccaccatgagatcaatgcaaaacttttcttgccgagctccatcagatgccagctcactgaaaaaaaaatatcgttcacacaaattgtgaatatactaatcacttaatcagatcggcacaatccaaaaacaataatggttatcgcaacacc

SEQ ID NO: 98038 - DNA, 1018 bp, Oryza sativa
atgtatgtataaaattatatttaacaataaatcaaatgatagaaaaagaattaataattacttaaatcttttgaataagacgaacggtcaaacatttttaaaaaagtcagtggtgtcaaacattttgggatggagggagtatatatgtagtcccttaatcaattataatgttgatctgggtagggggccaatggagtcctggttgatctgcttatttcttcccgtgtgcattttgcaaaccttaatgtacccacctgcaactgcttaatactagtaacatatctgcaaatgcagatgttgtagttgcttctttttccaagaacatgcatgggcaatcgcattacaacgagagggagaatttactatttgccattctcccaaaatgtgcacccgatcccatatctcatttgtccgaatggaggatgaggctgacatgtgagttcagtggcaaatgtgcatgaaaatttgagagagcggtatttgtgcatatgcattttgggaggatgataaatagtaaattctcctacaagaagccgaaacaaccgattctacaatgcagtttcatttggaagttcatcttttggacaatttgtcctgtgaatactgtgccatactgccattgaatgtgtctacacttgtagaaaatgccattttgccatggtcattgacaaaactgttgagatcttgtagtttacagacttttttttttaaaaaaaactctgcatatgtggtctctttcctatcttaaagcagagagctctcttttttcacacggcagttttcttagttcagattcatgacgtttccctctaaatatcttcccaatttttcttacaggatgtgttgaacaaaggcctccatccaagcgtaggcaaggtgtacacttaggtggtgtttgaatcttctgaagatgaagatgaaaattaagtgtttcacgcaaaacgagatggtaataacgtgtgattaattgagttttaattattacaaacttgaaaaatggattaatctgatattttag

SEQ ID NO: 98039 - DNA, 654 bp, Oryza sativa
gagtggcgcacagacccgcgtgtacttttccctgttcgccagccagtgaaacgtgggcccaacgtacggcggggcccggtcgccgattaattttcattgatttattatattaattatatgtttttccacggggaagacggggggtgggggtgtctggttcgttcggtagtggaaaaagcgtgtggtggaatggtaggggggggaccacatgcaactcacgtgagccccggatgttgacaagtaggcacgtggttgtaggcctcgcgacccctctcacatgggattgtctgcgctcagccgggggtaaaaaactgcacccatctttgattatttaccgtttatggtttttttaacaagcgtgtaaattatggcattttaagatttttattaaaatgttttaaattagtactatatggtagtacagtgaccactccgcatgtggtggggaatgagtgagcaggaaaaatggaatggccactgccaaattatggccattggattcatcacagttgactgctagaatggcaaatactgcctactactcctacatcaaggcatggatgaacatacattgaattttacaagtgtttgattgatgccaatcttgcaaccgtatcagcactgcatcctcttttttattccgaattatcaaca

SEQ ID NO: 98040 - DNA, 1016 bp, Oryza sativa
ttactgttgttattatttgtatttgcaaatttcaggagatcaaaaatctggaagtatcatgtgaggctagtatgacaaacttgataatgatctctctctggtatgactgaatgggcaagtagtatataattgtattcttttgttttgaaatgttggtattcagggggtaacatggtgagcatatttaataccgcatagttgtgggcagcatatataatatatacaccaggtcatctttggaagtacgtttgtataattaatttaatggcgttgttaggcagctaaacccaaacgagtagtgacaagccattctagagctagtagcgcacccttccctccttcctgccacgctactcctattaatttatactctatatttatatgaataatatcatgtccttttcaaaccattatatccacgataatacgcctacgatagtcattaacacgtacttacttgtaaagtaatcgccatgatactgatataataacaaaatgccaacaagaacaattgtttaattctgaggatatatcttggcatataaaattgtgccacagattataaaattgtttggctgtggggctacacaatagcccatattagtacaatatatacaaatggttcagatgtgtgttcatggctataattgcactagtcaaacaaagcttcacaagccatgcacttgccctagataaataattggcctcaccaccaatattgtatctagtggtaaacataataataatatcatgcatcatgcaaagttaaaatattgcaatagtaaaataaaaaaattatgcgtcaccaagcttgtgtgatcaatctctcgagtggatggcggcattggcctggttgcttgtccatgtcccatgttttttttaataggcttaagaaatttaaacctagaaacatgatcccagatataatattatcttggggccaataaagtaaacacaaagaacacaaaaagattagaaccaacttacctcgagttgtctcccacggcattagttta

SEQ ID NO: 98041 - DNA, 733 bp, Oryza sativa
agctcggtaccctaaaaacataaaccaaaggttggttaaaaattcacatggtttaggttaggttcacacccagctcattaccattggtactaacccattgcaatatatggacattttctcttttattataaagttagagcctactaaatcgaaaaacttaacatacaaagatatcacatcatcatccaataacaattattacatttaaacatgtaagcatgttatattatctataattttataatttattaatttttatagcttttcaaatgtaagcatgttaaattatcatctcacataattcacataatatttcaatatgtatcattattttttataatattttatatacttatataaggtcatcctaactcctaactaagttaatgggctctctctctctctcttctctcattaatccatatcacatcaattatttttgtccttagatgattattcatggttcaaattatctcccttaatttcttctcttattaagtcatatcacctcaattgttttagcccttagatgattaatctatgatccaaacttttacataaaaccacaacaacttttacatttgaatcattattatttaaatttaaaatatcataaaccacatctacttacataagtttatattgtctatcccagacttttcccataaggttaagggttgatttcctataaaaacttggttatggtggccctcaccgaagttagtatacatgg

SEQ ID NO: 98042 - DNA, 604 bp, Oryza sativa
tgaaatggaatattttttccttttttttttttttacaattgggaacgttgacactttatcaaccggccgacatatctgggtcgggcaatatacaggatagcatctataactttcaagccatgcattgaaactactccctccgtcatatttatttttcactcatcttgcacgtacatatacacaaaaaaaaactagaatacccctaatttatcatattccaataaaattatttctctttttatccactcctaatacatttaccacgtattccatctgtcctaaaataagtaatgttttgcactatttacgtccaatgtttgaccgtttatcttatttaaattttttatgattagtattttttttgttattagaatataaaacataaatagtattttatatgtgactaattttttaaaaaaaatcataaaattttcaaataagacggacggtcaaacgttggacacggatatccatgggttgcacttattttgggacgaatgtagcactttataaacattgatataataattgctaaaaaagatatttaggccccctttgattctaggataggaaaaacataggaatagaaaaaaaatagaagaat

SEQ ID NO: 98043 - DNA, 592 bp, Oryza sativa
ccacccgcagccgctgcggctgaagcagtgacaacgacggcggcgactgtgacgacgacgatgacgaactcttccgggccggcgtccgagcgacgagcacggcgctccgagacgtaaccgacggcggcgcggcgagcagcaaagaggtgtcggtgtacataagaagacgacgagcggtgttagcagcttcgccgtggtagggaacagagcgagagagtcgttttcatttcagtttctttcgcattttcgccaacgttttgagccacggaaatggcgtgcataagccgatgagctcctcctctctctcgcttagctcggatgtgtctcaccgacactgcgagctaggaagcgagtttttttttttttcctttggttgtcactctcctttacttttcgaaaaaggaacggcacatgtaacgctcggttggtgatcgccggggtcaatgggccacgcgtgccagtggctttgtacatacaaaaagcaagaacatatcaagaaaaaaaggaaaagaaaagaagacgacgagaaaaagtcaagttgggcatattgtagaagcagtatcaatgtatcatcagtgttggggtagtaagc

SEQ ID NO: 98044 - DNA, 586 bp, Oryza sativa
ttcgatcgtgtgttgttacacggtcgctctggtgcctgtatataagtgaaagaaagaatcactgcaagatagcattagtttcatgaacttcagcctttctgtgttcagaatggttgcaatatgcagtttccttttttttcgtaaagaatctaaacgatatggagctgccatttttcagttccacaggatgaaaatatcagcttacagattaatgaattcttgttatgtgaagtgtgaatgttatgtcggagatgtattctcccctcttaattgcggtggacatctgtacactgtttcagaccttgtatgttcatctgaatcgtggattctttgctttggcctgaaaaataaggaaatggaatactactgttctgaacctccttattcttggtctttcttaaggaaagcaggagctctgcagtgcattaaatatagtactctagaaaataagtagggttacaacatttgcgtaatggaaaaaaactggaagaaacagaaaataaaatgaatagaattatggattcttttcataataaaaatatgctttcgttgagagtcgaactcaagacctcccgcttactaaacg

SEQ ID NO: 98045 - DNA, 716 bp, Oryza sativa
attcctgcagccctgtttggtacagctccaactcctaatttagctccaggagttgagtctagagcggagttgtggagctgtctaaacccagttccacaactctagtttattttgtgagagagctccacccagctccattcccattattggtagagctgaaactgtttagctgagctccagctcctggagaggtggagctggagctggagctatgccaaacaggcccgaagcagcgggtaccagctagcctgagttatttgtgctacactcaaaacgagatagtacgtcattagtgacttagcgagtgattagttgaatataatcgattacaaacttataaatagatttatttgatttttttaaaaaaaaattataccgactacgtccaaaaatgtaaaaatttgcaaggttagatacgagtatcaagaaaacaatgtggaattaaatgagacaatattgtgattgatagagaataataagtagaggaagacattcagccccatcgtttcgcttatatatacttatacttataagcaaaatttaaatactaaaacttaattaattttgtggtttcttttatcttagtttatattataacatttaattttgattgctaagggaaagtatatgaaaattgtaagcacaaattattatttgttttgctaataagccatatgtacaagtataatcataaacgaaacgatatggatgtttga

SEQ ID NO: 98046 - DNA, 664 bp, Oryza sativa
cactgtagcgacttcccatccacgaggcttgcgccgaccgcttcgcccgggacacgatccacggcttcttcgcgcacccgcggcacccgctaaccgcggttgtggcctcggcgaaccccgggtggtgcgacctgtgccaggggcggatccagcccggccgcctcgtgtaccgctgcgcggagtgcgcgttcgacgtgcacccgctgtgcacgctgctgccgatgaccatccacccggccgccgggtgccacgggcacgtcctcaacttggtcccggcgcgcggggagtgcgcggcgtgccaccgggactgctccatctggcattaccggtgcggcctatgtctgttcatgctccacatcggctgcgtttcgccggccggcgccggcggtgctccagctggtgcgaggggttggcctgccaccggtggcggcggcggctgggccggcggtagcagtcccatcgtgaggtttctgatcatgttcgcccggcaactggcggtgaatttaattgtcaatgatattacggacatcctaaatgcgctatagtaagatgtgtgtgtgtgtttatataggtgattattgtgagcaactgatagcaccgggatggttgcataagttgcaagtaagtgggagtggattgaggggacatctttttcttctaaatt

SEQ ID NO: 98047 - DNA, 507 bp, Oryza sativa
atggcacgacacggcagggaccggagcatctcgcaggtcgccgggtcgcttcatacaggagacgagaaggacagagaggcgcacaggggcgcgcgcccatgatacaaaatacaaatcgcgcatactaccactgtacaccatcagtacatacatacatacggtttgtcacgtagcccgggcaggcacggcacagcctagcattgcagcggcacaccgcacacacaaccccccacacctgaatgcggatggcgacggggccagccagccaatcatgcccgccacatcaccaccgtccatccatccccctgcccaaccccgtacggaccacgtggacgcctccccccgtcggcccggaggaggagccctggcttacaggtgggccctgcccttcattatgagacagctaggcattagcctatggcgtccgaccgaccgaaccaccaccggtgggctcgcccgcccgcacgcctgccgcgctcgcgcgacggagcaccagcgctgctcccg

SEQ ID NO: 98048 - DNA, 718 bp, Oryza sativa
tcctgcaccccgaactatgtttggtgatgattgatagaggatagaaaaactatatttgggtacagaatcgaaaatacggccaagacccaacttgtataaaagtcaatgtatggcgtgcatgagggaatgatggcaagcctgggattctcattcatttgacctttcattcaattttgtaaaatcacatatataatatattatcccgatgtacatgcataataaaataatagttaatataagcattattctctagagttgttcttaatttgtgccaaactgaaattcagcatccacttcttcctttcatgtttataaattattttaggattatcctaagtcaaacttcttcaagtttgattgaatataatttttatatatttgttttgtgttaaaaatgttgctatattattctataaacttgatcgtttgacttagtataaatccaaaatgacttatatgaaactggggaatagtatctagtactccatatatgggagacagacaaagtacaactgcaagtaggcagactttctatatccatgaatagattagctattgattagctaatgcagtttacattaatagattaatgcttctctgtatccatgactcaggtcaaatataatggccaatcaataaatgaattggacattattggctcacctgatcgttcgctagttcttcctggttttgtctgtgtatatatgcatagtgtctg

SEQ ID NO: 98049 - DNA, 929 bp, Oryza sativa
ttttctgttacttcactagtagtaaattattacggtggattatttgcttctctctgaaatatgtctccttttcctaaaaaaataaattcttctactacattatttgaaccacatgttctaagttatctattaagtttatttctaaaaatatttttttaggatttacaaaaatatttaatttattcctacagttaagtagatatctgctataataatttattgaataatttgtttcaaagtttaaagtacaagacctggtttgatgcccatcactttttagataaagggaacttttattgatattagaggattactgaacactctgatggacatcactactgcttcagagtttcaacctgaagaaaagtcaccgagaataaattcgctaagcacgattcccctgcattattgtgcagtaataatgttgcattccattccaattcccttgcataattgcagcactttttctctggagaatatatggctctacacaaacacaacaggattcctacaatccggtgagacggcttcagggccgtacacaaacctttcacagtagtttctctgaaggaggcatcagatgtgaatcttttgtgaacaaatccttctccttgaatgctctagaaaaaaaaacatatttttctttctttgcatttatgttctgcttgaattactaatttggactgattcaattcaggagacattcagacgtgccaggttaacatggatggcgagtggcgacatgcaaatataggacactgttcatgtttttatcatttaggaaaaataagctaatcacatgaaaaacaatgaattatactccctccgctatctagatttattaacatcaatataaatatgagaaatgctaaaataacttacattgtgaaatggaggaagtagttgcaagaaacattttttttacctca

SEQ ID NO: 98050 - DNA, 576 bp, Oryza sativa
attcgtattaggatacgtctcatccacctaaaatcccttatattttaggacgtagtgagaagaatatacgtactatcatacatgccgcatatggaaaggaaaagaaattaacacagaatggagctgaacgataaacatcagactaaccgaaatggtgagatagcaattaagcgatcgagcaaacaagttcagatttcagaatgatatctaggaagcatgcacgcatgcatgtaaaacaaagctctgttatgcattgctccaacagaaccccatgcatgcatatatgcattcttacagaaatcaagagtctatctaatttaagggaccatgaccaaccggtaatatattggttgacgacctaggtaagctaagtagagctagacagcttgtgggtagagccaatattcgagcatacttaatgaaaataactacctaagcaagccactgtctcactagctagcttataagattcttgcgcaccagactccttaccgtggacattgcacaccgagtagcacgaggggtcagtctcctggacgaaaacacagtagggctaagaggcagctgatgagcgcc

SEQ ID NO: 98051 - DNA, 631 bp, Oryza sativa
atagattcacgggttgacctattttcatcctaagctgcatcgatccctccaatgccccaccatcacgcttataccagttgggtaaaaaaaaaacacaacaggctgaacagcttacgtgttgggcctagtttagggtcaatatacagaatccattatatgccattgagtttgtctcatttctatgattagctattgactttgtcacgttctacaatataccatcgacttttgcttaacttctacgatttaccatcaccatccggtcagtctccgttagtaatatactacattttgtttcaaataaccaaaataactttaggacacaaatatccaaaattagaataaaaactgtaaaatcgttatttttgcatacctttttagaggcatacgggtgatcgacccaattgcatggaaaaaatgaccacatgcaaaaatccttttttatagtgccacctaggctcgcacaataaaatttaaatagtttttatgactcgtgaacaaaatttttatagcaaacgtgtcacaaaataaagattggttgggcctttttttaagaataaggaaaacttcagacttcaaggggtccgttgggaccaatgaattaatttagatgaaaatttaaagataggat

SEQ ID NO: 98052 - DNA, 628 bp, Oryza sativa
  unsure (1)..(628): unsure at all n locations
aattctcaagcacagaagctaattgaggctattccgtttccatttcttcatgctagtgcagagataatgaaccaccgaaaagaatacaaattgtctcgtagaagtaaaaagtacgagctgctacattttgagagaaaaacaaggtacaactgaaaatttggaggatttttatttgcaaattcacaaaaagcaagctaactaagcagaactgagaagagggatttgtgggagtagttgaggtcaggaataaagccctgttccggcccatcccctgcttcgccggtccaggtcggctcaatctcctaaggtggcccaccactctcgcgtaagatgggcccacactgacagaccaactagacccgaataaatcgccttctctcccacgccacgccgncaaggcgccaacgccttccaccagccacgattcccagtttcctaccaaaaacttgtttctcctccacgtcggtcgagtccgagtccaccgctccggccgccgtcttcatgggccgcttctcctccaccgncgnagcgtcatccatgtccggcgccaacggaggangaggaggagggagcgtgtttccaagcccttccccgccgacgccgtngaaccaccaacacgcgcttccgt

SEQ ID NO: 98053 - DNA, 550 bp, Oryza sativa
ttcctccctcaccatctcccctctctctcctctcctctctccagcggcctgcaggggccgggggttatggccgcatggtgaggttactatggggcgcgggacgacgcgaaattggacttggacggcgcgccctagcccacgtttaacggtggagccgccagcttaagtgaccttgcctgcaccgtagggattgcttcagtggcgacctgcatctgcagaacccgttcaggtctgcggcggctgctgtaggaacggcgaaaggagaggaaagggggaggagactcgctaaccttgtaggtgctatcaggtcaagcggttatgctcggtgcacggtgcgcgacgggcgcccttgatcgacgccgatcagaacaaggcgagtgacccgaggatggaaatgtaactgtatatgcgactggaggaatgggtgtggccgggtggctccgatctatgcctgggccaagttaagtgggcttggtcagcccgcgtggacgacctgagtggatgtttgcgtataagctcaatttggggccccttaattgtcgcactgtcc

SEQ ID NO: 98054 - DNA, 686 bp, Oryza sativa
gttcattcctgttttggtataatattacatacaaatctggaagtgtgaagtttaggtagctgattgatcgtgatcttatttccgctagtttgaattgcacagttataatttagttatctctaccattcccagtgcgctgtgttggctttcttttcctattattgctcccttctatgctatgctaaccacttggtaggtttttaataactgagttgtgaagtgaagtgaaggagtagaccatattctttcatgattaccaccttggcatcaatgagttgataaaattttttgttatcattcgtaagacaatattaaactgttatgggtaaattccaaatagactcccatatataatggagaaattttaatgaccccaaggattattatcaattcctttctgtggacatcaatctaatttctggcagaggtattttatggtgcatggatatctatgtaccatgtgctagggatccaaaacaattgcaaatttttggaatcacattatgtggtttttatcattatattaatgctcaatggcatgataaatcaatcaagtagtccgaacagcccttaagctagtacatctaatactaataaaatacacagtgaacatgaattttgagcatagcaattttgctatgtcctcaatttattggtaaaaaatagttatatttcttgctggaatt

SEQ ID NO: 98055 - DNA, 662 bp, Oryza sativa
caaaattatatctgtataacatcatagtaatgccgaccatgtacgcatccacatggccatacagcaacatcagaaacagaatttaattaattatttgactaaacccagaatcatttgctgctgcatcgaatcgttcctctcgtcatcgccgacgcaaacatgcgctagctgatcagagcgaatggcaccacgtccatgccgcctgtttgttagctacactgcaacatacactaatacgctaagatatatagattgattctgttcatggtcaactctatgctaagtgtactagtttaattggtacagtactaagtaaacactgaatccactactctactattataaaattgaagatgttttgccggtattttagtacgttatccgtgtatgagtctgtttttaagttcgtttgcttttggaaatatatatctgtatttgagtcggcttttaagatcgttcagttttggtaatacagaatgaatcatataagaaatctgtttaaaaaaactcgcatgctaacttgagacgatcggactcctaactgtagcccatgattttctaaaaatatatatatctaatcgaactcccatagtgaatttcatcataactaaaccatataacaatagtaagattaaaatagacttcacccattgcaacgcacg

SEQ ID NO: 98056 - DNA, 655 bp, Oryza sativa
  unsure (1)..(655): unsure at all n locations
aaaattttcgttctttgtgtgagagtctaagtcgtgccaagatctcatctcaaatgacattgttccctctcatcgaaatcaaaatcctccacctcaaattcctcttccgattcaagtctccaaatcaaattccgaaattcagtcgcatcctttgaatcctcgctaaacactcgctcccaattgcgaaaaataccaaaccctatcttgagctttccttgattcctccctgaaccctcgagttcgaatatcgaatctgaatccaaatccaaactccaattctctccaaatcagccttctctgtgaaagtctattttacctccctctggctcagtgggccgactcttcttccccagcccatctcctctcagcccgcttcacctnctgcccgcacgtgcgctgcatgcgccgagagagagagagaggcatcgcctctcttcttactctctctttcctcgctctctctctctgcttcctttctccctctcctcagcgccgatttcccgccgacgccgttcgaaatccggctgcacccccgcgtagcgcgcgctcgctcgagaggtggccgaccggccgaacgccgncgccatcagcccttgcgccgncgacgccacgagctgccgtcttgccccgcttcatgacaaacgaccgccgccgt

SEQ ID NO: 98057 - DNA, 578 bp, Oryza sativa
cttttctggccgtttcacctgctgtcagaagatgtctttcatttgttctttttcttcaggggttaggttaagtgggaagagatcgatacagtatatggttatatatatggctaatgggatggccatgcttgcgtacgttacgtgcctgcgtgcacagatgcgctgtaaggttcctgaccaaactgtacattggggaagaaaaggattaaagcgaaagagatgaacagatatggtttacagagaaacggacggcttcatgcgtccagctgcagatcgagtagtggtggcctcgtggggatacctactgcctacccatgagtccatgacagaaaactctgctcgatctgttcttttctccgggtattttttttccctacttacacacgggaaacagatcgaaaaggcactttcagttgatcatttcgatgtaaagcctgaaaatcatctacctgaaagttgagtgacaaaaagaagcaccacctgtcaacagttgaggagggggactacagctccactacgagccgtccatgcagctgaggcatgcaagcctgctgcttcttagtttcctgcatttttct

SEQ ID NO: 98058 - DNA, 604 bp, Oryza sativa
cctccggtctcccccgccctcttcgctttgggctgaggccgccgtgctcgcccagtccttttcactctgcccaaggtggcggaaacccaaattgatggagcgatgaagatgcagatggagttgttggtggggatgtggaacttgtcggcgacccacgacatctccggcgcgcgctgccgcgtccttggccacgcaccggaggcggttgtggaggtggacggtgtcggcctggaggtggacgtagtggagcacgtcggtgacgtcggcggcaaccttgaggcgagactgccacgacgcgagcagggtgaaggacgggttgttcgggttgcggtggagcgcgaagagcggcgacgcgtcgaggaggagctcgtaggcgaggaagagcgagccgttgggcgacgcggagacgccgaggaggcgcgcgatggcggcgtggtggcagtggccgaggacggcgaggcgggcggtgacgtgcgcctggtcgcgcgcggagcgggcggcggtgtaggatcgaatcacaagaactaagccaaccagagggggggtgaatggttggtatacccaaaaaccgaaaacttttagcggaaataaaagttaccctcaa

SEQ ID NO: 98059 - DNA, 612 bp, Oryza sativa
tcatgtaggcggcatgaccaaaaactacgccaacaatggtaaccactaagtagccatggggataaggccttttgattgcccatgcgcctgtgcggcacggaatgatagttattgaaatataatgcttatcaattaaaaacactagtaatatgcccgtgctaacgctacggggtgacaattgataactcaaattgaaaaagatataacgtcatagtgacatttgatattttaaaggcattacatttccccatagaaggggtgggattaaggttcaagcaaaaaattacataaagagttaagccagtgataatcacgtggtaccgcacgtgtttcttctggtatgctatacaaaatcaaatgacagtagtcagtaggattcgaatttgtaatttcttcttctaaacaatgaatgttaaaaatcatagtatttatgtaagatgacaatgttatacatgcccattcggagatgaacaagcaacataaattcttacagagtactaaatgattttatttacacactatcgctcacgccatgtaaaaagccaacaggatggtaagatcacccaaatccacatatcacatacactttaatcaatgatggggctgcaggaa

SEQ ID NO: 98060 - DNA, 648 bp, Oryza sativa
aaaatttggcaacaaactaaatgtagtcactttttttttaactttgccaaaaagttaagtttaaaaatggtagcaaagtgaccaagccttaatattaataccatctcgccaatttgaaagagagggagcagcttaaatactttctccgttccaaaatataagtacttttagacttcgacccggttttcgagatgctactttgaccaacaatatttacaaaattttaaaatgtttaaataaaaaattgcatattatgatagtttgtttaatgataaatctagtaacatcaaatttacattattaatcttttttatttctttgctattaatactcagaatttaaaaagtttgatttggtactattctaaaaatgtttatattttgggacgcagggagtaggagactggcttgcccgaaaggccggaaccttcaacacagggtaagaattctttttgcatgaagcgttgacaaaaaagtagtgtatcgtagtatatgtgtggttcgactgaatgagttgggcctaataccattttcaggtcttgggtgtcacgcttgtcctaagaatttaattttttgaatgccaaaatgcgcttcacgtaacaattttttggatgtagaaaagaatattttttaatggtgacgatggaga

SEQ ID NO: 98061 - DNA, 568 bp, Oryza sativa
aattttttgcggtggcggagtggcgaggccaagaaacggggagaaatcgcacaaaaccacggcgttttccgcatggcccgccacgcggcgcgaaccacatccactgccgcgccacgcctctcggccgccacacgaccgtgcccccatcgcgccgggcttcccgtggaccgcgcccacccgcgccggcctcacgcgcggctgaggctcacgtagcacgggtccacaccaccgaacaacaacccacccctcctgcgctctccatcccatccgcatccctaatttcgcctcggcctcgccacgccgccgcaccatggccgcagccgccgcgtcgtccacgcccctcttctcgccctgctgcgccgccgcgaccgccaagctcggggcggcgtgcccgtcgtcgtacggatcccggcggaggccgtgcacgcgccgtggacgcctctcggtggtggccgtgcagacgggcccgcagaagccatcgccgtcgtcgtcgtcccagcggggacggaatcggagacgctgcagaacctgctgaagagggagtacaagtatgggttcgtgtctgatt

SEQ ID NO: 98062 - DNA, 577 bp, Oryza sativa
tagagttctggtgacatgtgagtaattgttcacccagtagagctgcagcagcttgcaatagcaccttcatttcgcgccaggaggtagccctgaagctcttcacagctttgcttagagattccactgtttcatccgtttaaatagttgtgacaactaagacaaaaagcaacaatgttgagatgaactgtgtttggttctataatatgtttagcacattctttgaacagtatacacagtgatcttgtgttttctaattgaacagactcaatgcattttcattttacatcttggggcagttctgcagaaaaatagcattgaatctgttcatgtaatactgcaaaagagtaaaatatttacatggaagttattgaggtaattctgcaagccaaaaaaaaaaacaattaactggcttatgtgtgagcttttggaagatatgtaggatagatgtactgaaaacccaaaaacacagagttgtctcccttccctgccaagagcacctaagcaccacccaaacccttccgagtttggtttcatatgccaatctactatccatgccagtcatagatgcagaaaaata

SEQ ID NO: 98063 - DNA, 637 bp, Oryza sativa
tatgcaagtttttaaaagagatttcttatatgtctccttctccttctccttgtgtatttataaaagcgaatgaactcaaaaaccgattcaaacacggatttgtatttccaaatgcaaattatgaacttaaaaactaactcaaatatggatgacgtaccaaagtaacagcaaaaacatattcaatttttataatagcagagatatgccctcgttttccatagtacgattcctaaattggtaaaatgtatgtttttttaccaaaattttctataagaaattatattaaaaattcatatcaatccatttaaaaaaattttaggtaacgtttaattaattatgtgtttaataacttgaagttagcatagctcaactgattagattacatttggttaaaccagaacacccggttcaaatactagatttgaaacgagtgttcggttttacggttaattattcttttaaaggtatgttatgcctgtgtgtaccatagtggtacagaaaatgcactgtggctaacccacttatgggtaagctaaacacacctggtgaaccatggagcaatcgtgggcggcacgcacggttgatactctgcacaagacaaaaccaccgaaaaaaaatctctccgatcccgatacta

SEQ ID NO: 98064 - DNA, 595 bp, Oryza sativa
accaacaaataaatgattctacaaattgtcttagacgaatgcaagttctacaaaatattaccatacaagtgttgttatccccttttggcactacctttaggttttcatccatagatctacgttatgtctccccaaaagatctttttgcccttttaaaggcctccattaagataattatgtagaatctccatatgaaaatatgcacatatttttgctattcaattatttatgatattcttaagggtaatttgggaatttattattatggaatttaccaaattctaggggtaaaacgatcctcttagacgacctaacaaagatctatggatggtagttgcaaaaagaaaagaatgcttgtacaatggtattttattgaacttgtgttcattgatggcagttttaagaactggtcgcttatcaatgtcaaaatttagaatttgcctgaaatgttccattagaaaagaagcactaggaaactactcttaaatacttataatggctttgtggaagtctccacggttaatttgatgtccactccctccgtcctcaaatgtaagtattttttaaaagtattttaacaataaagaaaataatt

SEQ ID NO: 98065 - DNA, 667 bp, Oryza sativa
tctccccttcttctcttcctactacagtataccacacaatttttttttaaaaaaacaaagagttacaaaaatttatgtatagaaatactatatacaaaaaatttgaatcgggtatgtaaacttttgacttataaactttgggtctataaattttagatgtataaactttagatgtatataaatactatatatagaaaatatttgaatttaaattcaaatttgaatcggatataattcaaatttaaatttgaatcgggtatgtaaacttttgacttataaactttaggtctataaactttaggtgtataaactttagatgcataaaaatactatatatagaaaatatttgaattcaaattcaaatttgaatcagatataattcaaattcaaatttgaatcgggtatgtaaacttttaacttataaactttggatctataaactttaggtctataaactttagatgtacagaaatactatatataaaaaatattgaattcaaattcaaatttgaatcggatatataaacttttggtctctaaccttatatgtgcaaactttgggtctctaaactttagatgtgtaaacttgaggtgtataaactttaggtacataaatttactaaaataggaaagtaatgcggtgccaaaaaaggaaaccagtagaggg

SEQ ID NO: 98066 - DNA, 601 bp, Oryza sativa
tcattattatgtttgtaaatatagataactcaagttggtgaaaccaatgaatctatctcaaaggaaataaaactcatctcttcctaatgtcgggcgtacctgtgcacgtctcctgtaagcaagatcaggatacatatatctaatctatctttactgatccatatgtaaatatatgtataacaaattacattaatatgaaccaattaaaaggagggctagcttgatggtccattattaaaaataatattttttaagatttgttaaaaaaatcccaaaacattcaatctaaaaagaaaaaagcaccttatttttaatttgaactattagacatgttttctaaacaaactaagtctacctcatttttaaatgatgaagaagaaaataataattacttatagagatgaattaaatattacgtagtatgaagataacaaatacctaatgaaaaatatttgagcaaagccagcaaataaatttatgaagaaaatgtacttctgatccttataagtttttcaaatacgggcttatgatatacttgcccgcgtgaatacgtgagctaccatccttgttgattttaaaagttcaaaccatctttttgtga

SEQ ID NO: 98067 - DNA, 584 bp, Oryza sativa
gatccccatatgaggcaacatctacataatggttgtgcgacggttctatattgtggttgtacaaccatagcagctgcagctgccatcaatatagatcttctttatatttttactgtatcagtgggctgcaaattagcgatattgaacatatccataaactacaaggaagaaagaaaaggtggtagtggatatgttgagaagaaatgtataaaataataattgtgattgtgaacgtttagctgataatatatgttgtggagaaaataaaagaaagtcgtcaccctattaattgaactatctctaaaccacacaaaatggaaagtgactatagtactagaaattttacagtgcccgccctagtaagctgggaaattttgttttaccggtgaagtgagactgggccggtcaagagtgagcactaggacattttacatatgcacagtggatgcattcatgtgtcttgcatgctttggactagtatgcatcacactcttgctagctggatggaacttttgcatgaaagcacccttcacctacttttcgttgcatgcacgtgttgcatttcatgacctgagaaattaagg

SEQ ID NO: 98068 - DNA, 586 bp, Oryza sativa
acaaataaatataggctattacaagaccacgaagggtccaaatgacatagagaacaacaaaacgaaaaaggaacacacaatatagagtaatagcccatacccataccaaatatagcccaatcctccttagcctattaaatatgaggtgactaacctcactactactagtcccaacccacaaaacataaaacacactattctcccccttttggcatcaagcaccaaaaaggtcttcactcttgtggaggagaaggaggacgcgccgaagtggaaggatgagaagcatcacggtggcgatgatagacaaaagcttgggtactctccaaggtttggactcgagaatccaatacacccaccctagtatgcaatcttcccaccgaagtattcaagttgcaaacatcggtgcgcaagccacgaacatcctcatgcaatgcttcatgcccggtggataagcgttgaatgctttcacttaaggtattaatagccccaaggacctggttgaagaagtcattgggttgcatttcaaagtaggcatattgtggatggaaaaaaaaacacttggatcatacccttgaagaggaggggg

SEQ ID NO: 98069 - DNA, 584 bp, Oryza sativa
ctttcaaaccgggactaaagatgtttttagtcccttccttaatagtggaggatgtcctcatcattcccaccccctcccttccttaatagtggaggatgtcctcatcattcccacccccttcctccttttaagctaagcaagacgcttcccacctccctctcttccgcccgactttagctttcaaagcgggactaaagatgtttttagtcccttccttaatagtcccctcccttccgcccgactttagctttcaaagcggaactaaaattgtttttagtcccttctttaatagtccttccttaatagtggaggatgtcctcatcattctcaccccccttcctccccctcccttccgcccgactttagctttcaaagcgcttaatagtccttccttaatagtggaggatgtcctcatcattcccacccccccttcctccccctcccttccggccaactttagctttcaaagcgggactaaagatgttttttagtcccttccttaatagcccttccttaatagtgtaggatgtcctcatcattccaccccccttcctccttccaagctaagcaagacgcttcccacc

SEQ ID NO: 98070 - DNA, 678 bp, Oryza sativa
gcatatcgaaaggtgttttagttttatcagaagttaaactttttaaaagatagttaacatataatatcaaataaatacactatcaagacatctttaatagtatatttaaaactaatcagataatgtatatgttgcttttttatataaatatggtcaaagataaaaaaataattctgaaaagataacatattacactggcctctatctaatggtgggagtccgatgtatgagaagactttggtctctgatatttaatagaaaaaaatgttaaaattagcttgtgcgagtttaaatatttaattcatttgttggtgtcctcgatatggttcgtcaattcgcagtgtcatctactaatatattaggacacataaaatgaggttagtagtcgcacatgccgtatattaggacattacggatatggtttcgtaataagggtggttttatgaaataagtattttttgagttttaattaggattgtaagccttgatataaatcatattcgtcatcgagagagaaataactctatgggtaataaatagatgttctagcttttctccgtcatactggtaaaactctgatcgctcataacttaaagcttcctgcaaaaaatgtggcatacattcatccggcatacatagatatatcttgacaaacaaggtgcattcattacgccatat

SEQ ID NO: 98071 - DNA, 1831 bp, Oryza sativa
atacttgtttttttttatggacgaaaggagttgagaacacccatatatatgtataggactgtagggtcagaatgtgatgcctaggctccagggcatttggtccttgtatgtggtggcatgagtacagcgtgtaattaattatttccatcatggtactacggaacatttcaaaaataacttaggccatgtttaggccatgtttagatcccctggtaaaattttacaccctgtcacatcaaatgtttggacacatgtatggagtagtattaaatatagacgaaaaaataactaattacacagattgcgtacgtgtaaattacgagacgaatcttttaagcctaattgcgctatgatttgacaatgtggtgctacagtaaacatttgcttgatggattaattaggcttaataaattcgtctcacggtttacaggcgaattatgtaatttattttgttattagactacgtttaatacttcaaatgtgtgtttatatatccgatgtgacataccaaaactttacacccctaaatctaaacacaaccttagctgctgtccatttgttctgtatttagaaaagttaaatcgttttatttagctatgtaaacgggaataatagttttagaaaaacttataaatgttctagttacatttagaaaagagttgaaaaatctaaaatcaaatagtacgtagatgggtataattaatgatatcttgaaacaacgaaaatattaaacggttttcctcagctttaagaacagcgaaaatattccatcagctgtatctattccgacacggcgataaactcagatcaatttatgcactagatcacgtttttccctcttatttcaaccagctagcaagtgatgtgagattaaataattgacagcttgcagttagctttccagtgcagctaataacgaatagcgcggcgacggtggcttgtacgtctctgtgcatacgcacagttcgttgtacattcagatccagtagcgcacaagcgaatgcccaatcaccatagattttaaaatcgaaacacaatcatcatgtgatgaagaatccaacgatgccctgtccctggaacacagttcttctccgtaccaaaaaaaggggaatataattagtccacgcgcatgttgtgattataatgcttctaagcatgaatcaaccgcgacatagcaatcagcatactactgtctgcattaattccaaacagaaataggcagctagctagcctcaacacacattcatgaatcatgcacacatctactgttcctttctaccgttgcatgcttctactgtagatagatcgatcggcacagtgcatgaatgatcaaccacaagaaataatatcaatgttcttccaatatagcagtagttaaagcatctgtcttccccccccccccccggccataatgtgttggactctggtcagctagctagcagttggtgcaacacagagatactatatagcaatatatatatatatacatatatatatatatacatatatacatatatgtatatatatatatatatatacatatgtgtgtgtatgtatgtatgtatgtatgtatgtatgtatgtatatatgtgtgtgtatatatgtgtgtgtatgtatgtatgtatgtatatgaaaaatgcttctatacacccaggtgtacatactcctggtttcatccaccgtccgttcgcaactagcagagatcgagtctgctagcggatccacataccacgacccgttttgatttttgcgaggaaaaaaatcatcgtaatatttgtatcccgcacatatcgcgagcatactgaatgctcacataaatatctcgttctca

SEQ ID NO: 98072 - DNA, 646 bp, Oryza sativa
acacgattggtgggcttggtacagaaaatgggccgtgcttcttcagtagaatacttgggttcctattgctcccaactgagctgacgtcggagggatcaaacggatgagatcgtatataacgaatagatcgaacggctcagtaattcaggtgacgtggcctcacagttttgcagctttatagcaatgaatgagttttagtgggtaccaattatataggaagaagggataggataagatgcgcccctaaggtgtctttgttaagaaaaataaatttgtttttctatctgaatgaatttgagattagacttgagatttgataattacatagttcatgcatatacctgtctcgataaactttttgttgactttaggtacattttaggtccaattttaccgcttttcacttatttgttagttctcactaatatttccccttgcgaaaacctcaaaatcaacttaaaattaaatttacgttttaaaatttaaattttggttgcagccaataatagcataattttttttatcaacgtaatagtttctttacgttttaaaatttattgttttactagctatgaattaacccttttgggactaaaaatgtgaagattttcaagtcggtcggtattcaacccacatatatcccgcg

SEQ ID NO: 98073 - DNA, 1142 bp, Oryza sativa
attggctggatatgattgttgtttgtctattgagagaaatgtttccagcttccaagcgtatttcttctggtttacccactaataatatttctctccaattcctaacgatatgttttgttgctgatacttccgtagcaatgtaccatcatttgcattttaacttatcagttgtggccaaaatttacattttaaaacttagttttagttttggaattgattttggagtttgtttatcatagtttatttttcaggtttatttcttaaattgctaaaggattttttcaggtttataggaaaatcaaaggaatttttccttttccaccaagttgtagagagaatgcgggaaaatttcgttccactcatacctcttaaaaaattcatatggattgatttgtgcatacctttatatttctccactttttctattcctatggataaaaattcctccaaaccgaacacatccttaataatttatgaatggaatatttatatatgtattattgtccgtttaaaagctaatactagaaaatagagcatgtttctaaaaagaaaacctaaaattaactttaaaattaagtttctgtattcaatcattagctatttttaataagctagcaagcaataagagacgaatattctacatttcttcaacaagtgctgcactatgcagccatagtacccttagacatctttatgctgatgctcatagccatgaatctagcggagatcaccaatgcatatggtgaaagtgttccatatggatgggacctatatacatggactttaacaataacgattcttaccacgcatataaataaggtagtattagaagaagtagagatagataatattatttattttatatgggtagtcctcgtgcatatggatttctttcgttatttttttatatagactagtttacaatgatataggtggcaaaatgaaatattatattactatgtactacttttgcaccataatgtggatgccctaactttgtgagatggtgatgtctcgagcataagttctgattgttcatccaaaattccaaatacttcccccgtttcacaatgtaagtcattctagcattttccacattcatattgatgcgcaatgtactccctccgtttcacaatgtaagt

SEQ ID NO: 98074 - DNA, 1916 bp, Oryza sativa
tggtatgtccatcccgttttctctcgttttgtatttcttgcagattgatcaaggatctctctttctttttcttacagatcgatcgaggtataagccagcatgaaggtcgccagctgcctcgtgatccatcggcgactcgatcgtcatcaatggcggcgattcgatcgtgatcgatggccacggccatgttgcgtcgacaatgcaggcgcgcagcccatcggcaaagccggaggcgacgaccaatctattggctcactgaaatcatacgggaacggaaaaaagcggcgctggagacatcagacagcacagcaccaagccaccaaccgaagatcatggcatccaacgaatgtatacatcagattatagtaatcacagtatatatgtgcacatcagctcatgtatcgatctggttgcctgcatatacatctctcttcttaattatactccattgaatctcttcctgattatatactactacaagatcaactaatttcatattatttgtcactattacatactactgtgaaaagcgcatatatatgcaacagttaggaattaataaacccaacgagtatagtcgagtatggctagttttggaaatacatgccgcttttctgaatctttgaaaaaagcatgtattttatactactgatacttttgcatcatcaaatcatgaatgcagccagtagcccagtagtctgtactgctacagtgtaaaatcaaaatagataacaaagtatataccgctagtaacttaaaaaatatgttaaaaaaggcatataccgatactaactataaaaaacagtatataccgatactaacttaaaaaaaaaaagataccgacactagtttaaaaagtagcatatactactactaactgaaaatgtagtatatacatgatcagtatatactactatactactaacaaaaaaaaacagtacatactactactaacaaaaaaaaggtatattctccttcaatgagtatacttaaaaaatgagatatatacatctctgatgattattgtagtatatatagtacttattaactaaaaaatagcagataatacttatattaactaaaaaaggtatatacttccaaacaaaaaaaatagtatatatcaaacaaaaaaagtatatactgaccaaattaaaaaatagtatgtgcagtatatatcaaaaacttagtatgtctactgaccaaacaaaaaaacagtatatactcattcagtacggacgtaatatatgctggaaagaaaattaaaaatttgaaagcaaatgcataccaacgttctcgtttgagtgagcacaaaatccggtgtcagctgtgcacatgcatacggtggtttcaaattaataatttcactttaatttggatgctaatggatcatccattaacaaggggaagtacatacacctgagtatacagaagagtcgtcctatatatatatatatatatatcctatatatatatatatatatgtagggtgggggccgcaaataatggcccatatgcacgataatatttatagtgcgacaagacctgacagtatagtgagatttgaaagcaagcaagcatgcacacggggctcctgtgatcgatcgttcgattcaagaggcaaacgaaggaggaggtcgatcgctggcctgccgcaattgcaccgtgggtccaacaaaggcattgcaaagcaaccgggcactaaaaaaacaggcaagaaaaagaaagggcttggggtgttgatggcgcagcggcaggcaaggcatgcaggcgcaagcaggcgccccggcatgcatatgaacagcaacgctacagtgttctacagtagcgccgcgcgcgcgtgagaggaggagaagctagctagctaggggaagggggggagagggcccggcctgcaagggaagcgattcattggcttt

SEQ ID NO: 98075 - DNA, 1635 bp, Oryza sativa
atatgcggtatgacagcatgtacggattgcttttaaatctagagaacaagctagacgaatatatatcatcgacgtacgttggcagacaaatggttcatagagaagttcaatataacgttataaaatgacgtttgttagcatttacttcctccagccaaagtctaagtccagtaagtaattaacacatccaccatgtgacaaaccaataaaatatacacacatgcatgcaaccaataagtcctaagatgacttgttgagttgcagtcaacaatttaatttagcacatatacattacaaataggctttagattttttttaaaaaaaccaaaaaataaaataggtcttaaacttttggatggagaaatatataatataatatatctataaataagaacataaaagaagcacacgaactaccttcttgtgttgtttaacgtactatatattacattatactatatgttcgcattcggtttatcatgaggaaaagaactttgcattcatatgtatgtatatactcccatgttccaaaataaaaagtttctagattctttagcgaaaactaaggtagagggaaaagattcccttttaggctctgttcgtatgtcaatgttcccaactcccctactcgttttccgtgcgcacgtttttcaaactactaaacggtgcattttttgtaaaaagtttatatatgaaagtggcttaaaaaatcatattgattcatttttgaaaaaaaagagcatataattaattaatcatgtactaatagaatgctctgttttctgtgccggagggatggagggatgggttcccaacccagtcaaacaaatagagccttagtcatttcagtggtcaaaatttgaattttgaatttcttaaattttctttctaagcatcttattggcttaaaattatagatttccatgcatgagaatgctaaaaatgtttatattgtgatataaaatgtttatattttgtaacggtgagtacaccagtgcggcttatcataatatgtctgactctaccacttgtactaatttaattaagtagttatcgcgcacactgaaaagttagattaaagcataactgattgtctaatttgtttctaatttgatgagacaaatgtttaaagcaggtatataatagaagtagttattttgtatggatgcagagtaacatttttcttaatcaatgagcacttaaatgagtatttgtagatgtttgtttttgaaagcacttctagtaatatactcactccgtttgaaaatataaggcattcttgtttcccacgaagtcagcgcttggaacttttaactaataactaaactaaatatatagcagtatgtgtttagtttcatgagtgtagtatcactagatatgtatttgagaatatttttctacgatgttaattttgtagttattgataatatattatgagagaactaatggtaaaaaaaaatacaatatggagaacggtgtataaacctaacacgtcttacatttttaaatggaacaagtatttgagtggatgatcaaacgctcaagaaatcgctttaaggcaagttcataaccatttatttccgcttcctcttttatttctcccgtttttattttgtttggttgggctgcaggaat

SEQ ID NO: 98076 - DNA, 693 bp, Oryza sativa
tcctgcagcccacttattagaaatgcttacgtaaaagctgtgctactttatagaggaaataaccaatgttttgaattttgtggaatacatgatagagttgcttcctttgtgagaaaagaaacttgtctgaaaatcttatgatttttgcgggtatcaacactcacatgttggattgctgttgttttatgattttttttccttatgcaaaaccctaaatctgtctttgtgcagcacagtagcagtgatcttgctcttgcttttcacattttggaaagaaacctagaggatgattttgcataggttgaaatgatatttgatagcactgattaacatagtggataatgaatattatgcttttgtgaaatacttgttggagacagcctttcttggttttgtgaaatacttgctggagacagcctttcttggttttgtgaaatacttgctggagacagcattttgtgaaatatttgatagcactgattttgtgaaatacttgttggagacaagcctttttttggtttcatgtcaattagtatattatgccttttcctgtgatgtctgttaacagtttaacttgttgatctataattggcgtatcagtttagctttctgtgtatttgttctaaatttgtgggtgtgtacacagttgcaaacagagttaaagaatcttggaagcccccctggtttcactgt

SEQ ID NO: 98077 - DNA, 699 bp, Oryza sativa
ctataaacatattttaatgagataaaagatgaaagagaaaagaagcgggctacagatctgtagccagctgcagcacggactccaagacgtagtatgtataggataggtgggaccatatataataatatagtaagcaactattgtatgagttggctattagattggctatagatgaattggagctagtagtgggatatactattaaacttgctcttagcccctatacaaaaccaggtattagagacagtttatggccattgtgttgtgctctagaaccaagtcaattacatgactattcaatataattccatccaaatgtagaaatgtataattattacacatattttgggagggaactgaatttatttgcaatttgtcttacacatatcttaactgtgattcagacctcaagagctccatgttttctttctttagtcacatgtctccacatatatatactttgtgagagatgtgactaaagaaagaaagcacagagttctttgggtgaatctctttctgcccaagatggattgacacaatagttatatcctgctgccgcattgcgcaagtttgtgacctgttcagtgttgagaaataagagacgtcttcttaaacttcagttcctatatattgcaaaaataaaaagcaaaccaaaagatatttgagctgatctccaaatttgaaacttcacaatttgtg

SEQ ID NO: 98078 - DNA, 1016 bp, Oryza sativa
ttcatgggctcacccgacttccggctatgtagtgcgccagacattagggtgcacaatagcgtaatgaagagactaacttcacccatgtcgatgattggaacttggaagcaatatacaacacaatgttggattggtgcaatggaaaagacccttttatagagcaaaagttgacatatgtttccagcgtctacattaaattctcagtcaaaagattctgttttaggagaaattaatgttcatccagcaataatttcaatgtacaaatgatttttgatatctgcattaattccagccataattttattagaaaaaaatgtttgcattagttctcacagtggctaacattaatgtctgaatcacatggaactcacaacagacagggtaaccattcgatctggatagaaggccgagataatcatgtgactgtaagataaaaggtgtttttgattattattctgtgatgaacaatttgcacggagattattggttttgttatttagaatttatttacgaagtggttttggagatgattggatttcacaggtgatctacaggtgccgctgtttgtttgaaccggtcagaccgggctgtgtatgccggtcagaccggccagcccgcggtctgaccagccgactctgtgtcggtttcggtttcgggttgtttgtttcgatatccatgattgtttcatgattatggcttctagatggattctatacgtatgtaatactgttgtttgctaacaatgagtcaagttggagatagcttggtctcagaatatggtttctttgtttatttcatgtgtaggtgactcgatgcctcgggagagtatttgcggtgatggaccgggagtcggcttagggctaagacgacgtccgttgtcggtgacatggggccgggggtatcgtgactagaggcttgggtagccgcggtcacccacgtggcctgaccccctcgggggggggggggggcgggcccgagggtgacgtggccactcctccctctgtctccccgagggg

SEQ ID NO: 98079 - DNA, 533 bp, Oryza sativa
tatacgctgaaaaggactcttatcctcattcaactgcatataaagaggaatacagttaaaaagagagataagcaattgggcctttattttgcaaatctcaattaaaccattatagcaggaagctcaaccaataaaaaagaacaagttcaaacataactatgtaagcattctctaagttctctgctaggatgatgccatgctcacaaagttctgtagtacacaactataacgatgacggtcaacatttagtctccctctcatgattttctttcatattgtcccaagatttcagcggcatctatgggataaagtgaacagagtacgcaaccccgtttttgcaatcaaactaagagttcataagctttttctaaacatacaggtactggtgtactttaagacccaactcacaaaaatacggtgtctattccattaactgattcatcaaataaatcttgctgaatagcaaggcatgtaactgtccacgaatgataccccatagcaaataatatgtacggcatagggctgcaggaatt

SEQ ID NO: 98080 - DNA, 544 bp, Oryza sativa
cctccgattgcccattaattatgtagtagcaattaatctctccatcctcttgcaaacgagtacacctcaactagcactgctacaaaacacatccttaattccttacagttagccaaaatagcttttcacatgcggatggagcgcctgcctagaacaaaaggtatgtgaaaatcaattttcccatacaggtacgtgaagacgactaactgcgaaaatgatttttggtgaaaaaaatgcaaagagaaaagttttttcaaccccagctccgtagaaaaactttccacagaattcacatcaaggggccctaattccccagcaatttttttcccaagaattcacaacatccaacaacacaaaagttcatcacggcagtgatggggttgccactagtagaaaaaactttttttccagctgggccaaaagtagttttttatgcagaactccaacaggtatgcccgaaaaggtatgcaaaaattgctctttttccatgcgggcgacgcacccgcacgcgaaatgggtgcttatgtcaccctcatgcaaaaat

SEQ ID NO: 98081 - DNA, 599 bp, Oryza sativa
  unsure (1)..(599): unsure at all n locations
cgcccgatccgccgccccccgctgggctgttgcctcccccggctatccctctananccggcnnactcccccctcttccgcctccccctcccccctcccacccccaccccaccccaggaccctaattcgtcagccctctaccgggtttgggttcgccggcgccggagaagaagaggtggtcgccggagtttgagaagaagagtacgaatcgcgaagcacatcaagtgatccaaaatttgcaagatttgaggttggatttttctgtcaacagagctttagcaattccgttttagtttactttgacaaggaggttgatagaggaaacatgaaacatttctttattgagatttgaaataaatcaactagaaaaagaaattgtgtggcatctgacccatatgtgtacaacttacatcccactagtgcatgtacactggtggagaaaccatctttcgtcggtcggccgatttccacaatagtcccggatgcaataaaaactggggctaaagatgatctttagtcccggtgggactaaagatcatctttagtcccggttcgaatgctgtcaggacctgtcaggcccccccgggatctttagtcccg

SEQ ID NO: 98082 - DNA, 709 bp, Oryza sativa
tgatgattaatggccggtggtggtggtggtttacttggagtaggagggtggtgcgacgaaatcagccgccgccgtcgccgtcgccgccaccagcggacgaagacgtattaccgttcgaagagtacccgccgccatcgtccgacgaagaggaggaggaggagatcaaccaccccacgccacagacctccaacgaggcggctgacaggcgccctggattactcccggcctcgcgcaaggccatacagggcctgcgtgaggtgacggcggccggcgcgggagaagacgagtgcgccgtgtgcctgcaggatttcgaggcgggcgacaagctcaggatgatgccctgctgccacaccttccaccagcgctgcatcttcgactggctccgcctcagctgcatctgtcctctctgccgccacactctgcccacgcagaatgtggaggacgacaggcttgggcgcgctgcccacacagtggcaggatcaaccggctgatgaaccagccgaaaaggcttctaattttgttccagttcacctgctagaaatcattagcagtaagcagataggtgatttctctgttccaacatttatcttcccatgaatgtaaatctacgaagcatgttgctgtgacggtctactccagatgagcagtactctgaggcatgttatttatcttctctactgaatgtcaaaactataagtgcaatgccatg

SEQ ID NO: 98083 - DNA, 558 bp, Oryza sativa
atatgttaatgaatctagacatatacgtgtgactagattcattaacatctatataaatgttggtaatgctagaaaatcttataacctaaaatagagagaggaagtatcatttaatttgtgaaaggatcgccatgtttgtcttttgcttttgaatttgtcttaacatctagtacctgatagtttccttaaaaaaatctattaacagtgatgtttactcttacatcctccattgtgtcaatatctatagctacatcatgtttgtgcacatgtttgtggtgtttaaattcacatgattccactcaataggggtttaaatcctggtgtggtgtatgccaatattacatatatgagtgtgcataagaatatcttaagaagaacatgtaactgtttttctatttcataacaaattaatagagtgcacaacataacccttaataatcaaagaattttagtgacagtgtaaaaattacattagttgatggtttgaatattataacaacgaggctgtgttcgggaggcgaggttgggaaccttgcctcctgacacggaaaacgaagc

SEQ ID NO: 98084 - DNA, 1231 bp, Oryza sativa
tttttaaaaatagtattttctatagtagaaaaacaaaatttattactctacaaatatggtaaacaaacatacaataaaaacatatgatttaaaaatatatgttttcagctgctcaggcattcttcttattagtgaggctttaaaaagtcgatctaacaataataatatatagtcactttctattttatttatgcatgcccagtgaggtagtacaagatgaaataatatataaaataatatatagtcactttatttttataactttttatacatgtttgaatgacattcaaggaatagtaaatagaatttagaagaatatacatttcacaagtgaaatagacaacatatgtcaaattctaattgtggtttttatcataaataacataatggtccaaatagataaaaaataaacgtatgatttaaaagtttaaaattatgatgatataaaatatatcgttacaaataaatatataatttagaaggatgtagtaatttaaaaattattgttgcaaatattttcataaagagaaaaagggagaaaaagtaatcaagaggataaacttcctacaaacccttttaatttaccacaagtaccatataaacgctcatataccatcatgtgacgctctaataaatcatagaaattataagaaaaaagaaaaatattcgaccatcgattttcatttaatctggtggacctattattttcaaccattaaatctatcttaaaaattactaattaaatttatcaataaaaaggcccacgtcataatgccactatcgtccaatatacatgcacataggtacgtagatattcctccttaaaaaaagtatgtacctacatacagtacatacacatgtatttctccgtaagaaaaaaaaatatgtacttatgtacggtatgtacacacgtcgggtcccacatccttattttttcttttttttctcatttagacttgatggaaaaccaaactaataattaaacccatattaactatgctttaagttgtaaaacaatatatgctatttcgagttgtattccaattaggcgcatgtcatcgaaacataaaaaaacataaataaattaaaagtatagattatatggttgttaaattagacttacattttccaaaataaaaacaacttcaactgtgggtagaatttcaaaaattattcactccctattgtaaaaaatacttatatggaaaaaggattttactaaatttatcac

SEQ ID NO: 98085 - DNA, 614 bp, Oryza sativa
tgtgatatcaacacacgctccttcccccggtcttttagttgcaatttcccttttagtagcaatttccctttcatttacagatgaaagtttgagacattgaattgattatttttttataattcagataaaagtttgaggctacatttgataatgattttttagttaactgttgtatgattgagtatagagtttttgattttttttaatgaaagttttagattttgaattgagattattttaattcatgatgaaagtttgaggtcaaaattgaaagtttgtagagtttaaagttgtatgattggagttgaaagttttgcatgaaaacactactaaaagagggaaaaaaaggggaaggagtatgggcggcaaagacacctacgctaggttttcaacaatccgcttggtttaattaggtatcacacttacttgaaaaaaaaagggtttcactcctatttcacgcaagtgtcataactttaattcatgtgtatcacctatggtatcgtgaactatcatggtgtttccccatgaaatttcatggttttacctggtaatatcattgttttatgcatatattatctgtatcatcaatgttttaaagaagagtcattagtatt

SEQ ID NO: 98086 - DNA, 735 bp, Oryza sativa
ggttacgtggatgagtaggacacgcactccactcgcctcgtattgagcatctgagagagatagagacagtgtgaagagatgacacgtgggcccattaattatttttattatttttttctgatcggattgccacgtggacgccacatagatgtaaaaccactccagtttgtattaggggggtaatttatccggtttagaaagtttagggtgtaaaatgtccggttttgtggttcggggggataattcgtactgtcacgatagttcaggggggtaattcgtactttttcccacttagatttgaaaagtattcttgataagatcacaaagtccagcaccctgcaccattactcgaaatctcaagacaaattccagatcccattcacagtatagaacaggtttgggcttgtatcatcttggccacaaaagaaagattgagattaatgatctaatttgcttttttccaaaggagaaattttaattgtcttcaatggcaagggcctttttggctgggttccaaactgtattttctccaaaccagaaactgatgcaaatgggtggtattagaagtagatattttcttatgcgatgacttgcagagattttttgattgatttggtaaattgtgctggtagaaaaaaaaatggccatgatccctttatcaaataaaagaagaattattgggtctgtgagcacagatcaaaccactcaacatgaatgggtcttttgcagatgtgt

SEQ ID NO: 98087 - DNA, 714 bp, Oryza sativa
tctacttcgtactaaaatgatccaaatggatttggggaagactgcaaattgtgcgttcgatttctgaaaatttaggcgttgtttcaccacttctatgtaaattattttattacttttaaatgtatcaactaattacacattaaaaaaatatcgcccttaaatcaataaccactacattaaacattaaacccaattaccaaaatatcgaaaatattgaatgtgcaacgagtcgtataaatattggcttctcacacacggatcattaaatttgaacggttgattttttttctttaacatataatcctatggcctctttcaaattaatcaaaatgaatacaaccgtataattgtataattgagcaaatactttagggaaaaattagaacatactaatagggtacttggatggatcaaaagcatgggtgtcagcttctagccttccacagaccacagctaacacgctggatccggcaggtggcaattatggtggaaagaccgcttctcaatcactccacaaattttctctaaaattactctgaattgggccatctatctatctattatatactaaaaatccattaaactttatataaacgcttctaaaccaccatatggtatcctataaaagctcctaagctaccacatggcactctcataaatcggtggacccactatttttaactattaaatttctttttagaaaaaaaataaaac

SEQ ID NO: 98088 - DNA, 512 bp, Oryza sativa
tattacaatgcatattcaaaacaagtaaaatcacaaacaataattagttggtcttttgtcaagttcttgaatttttttttcttcttctatcttgtcgttgataatgactaaggatgaaatataactggtttctttcatcgaactgttaataatgactacgggttagatatagaagttccttgctgtagaggccactaaaggaatagtttacatcatcaatgttgtttgattatttgaatgctagaaataaaataaattaattatatgtcctaggttcagctcaaagcatatgttattggatttgtttccattatacgaaaacggtcaaagcgtgcctcttaggctgtaattttgctgtatatttgtgttgagttgcatcaactgcctttggtcattgaaaaacataagctgaatgaggaagagagaataatacttttatacttcaacactccccaatgctatacgtacaagcaactcatagaagtgggctgtgtttttttatttaactatga

SEQ ID NO: 98089 - DNA, 673 bp, Oryza sativa
tgtggtacacttcgctgtctaaccgtaaactagtgcccctttggcttttgagattggagtgggttttgatggtttgaagttcgataatttgacttccactcattttacctaccattcacccaccctctagtacaatttgttctcgcgtttcaatcgtacaagtggtacgagaggcacgtttttgctctctttcgattagccatgggcaattggttttgaaccaagcctcatgtttttttatggagttgatttcagttttggaaacaaaagatgcaatcttatattatgtgtcaggtcttgatgtttagcaaaacattcttagaggttatattatcctggatgcctctgatagtacaagtaaagttgattttgaagataactgcaaagctctcaacttgatattgagtggtgtctcatgctctgatattgatcaaatttctcaccatcaaactgtgcatgtgatgtgaaaggcctatgtgactttcattaaaagtttcctccacaatcaaggagatacctaataacttaaagatgtttttataaacgatcacatgaaattttagaaaaaaccttgttaacggtaaaatttggcatgttccattggtaaggagaacgaagcaaagtcgatggcatgattttgggatctaaggtcaaaaggttaaattggctaaga

SEQ ID NO: 98090 - DNA, 630 bp, Oryza sativa
ccccttgtgttattattgtagcaccttatctcctcacaaagaacattgcaaatagatcacatgcaacaatatgtatagttgaaaatgatatttttgattcaaaacataatctctcaatcatttcttgtagtattcctgtgtttattatgtgacattccccatcatgtgcatttatctatatgatcgacttaagtttaactaaagattgaccatctaacagcttataaaagcagcaagacaatgtttatgcatgtgagtaacttggtgaatggtgatgttgttactttacctgtagactaaagcacggtaaccttttaatgtaacattacgatgataatgctagtcgtggtgtcttcggtgtatggtagatcattgttgtggcatctaacccattcattcacacttccctgaaatattagcatatagaaatatatttcaaatgaatgctcatacatttgatgtaaaattgcaaacaagaagtcatctatcgaaatgaaaaaggttcctcaaatttaccttcttgattccgagagtttcttgggtgttattattggttgcccaaaagtatgataagtagttggcataggtctgcaatgggaataattcaacctaattctggccagattgatg

SEQ ID NO: 98091 - DNA, 606 bp, Oryza sativa
gtgtctcctccgtccgccggcctcaacaggcgacgtcatcatcatcgtggcatcaacaccgtcagtgtcgtcatcgcgtcaacgagaaggggagccagcggccggatgcgagccgtcatcatcacccgtcgtgatcggtggcggagccgcgagaaggcaagccagcggtgaagaaggcgagccgtcgtcgtcgttcgtcgtggccggcagcggagggggcgaggagcggaatcggccggcgcaggcggcgaggagggaagccggcagcggagcaggagagccgttgtcgtcgctcctagtggccggcagcggagggggcgaggagggaagcggccagcggaggtggtgaggagacgagcctacgccgccgctcgtcgcgcacacaccgctccttctcggagccgccaccgctcgttggtgtcgacggcgacgccaacgccgacgccgacgctgctgctgacgccctgccgcggccttgctgagttgagttgaagataatatgcgagatggagaggagagggtgagtggtggggcggggttgagttgaagataagattgagtacttgagtctgtgacttagatatttttcggtggaggtatgatttt

SEQ ID NO: 98092 - DNA, 2234 bp, Oryza sativa
aaccacattttaattatagatggaatgagcatttgcatatttctaagcatggctaagcaagtaattgcacatagagcatatataaatccatttgagcacaaagagtgtactctaaccatttctaggggttcaaacagcaagaggatcaattattcaaggtggaatatgcagcaaataggtcataactaccttaacccaatttcaaataccgatatagtctgagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgatatgcaattaaacaccgaaagagctgaaaatccaaaatgctctaaaatgcatgatttatgcacagtgggttggtactgatctaaaatgaatttaggtgaaagaatttttattttatcttattccattagggagttatgaatttttagaagttttatcggtttatagtagtatagtcttaggtagtgttatgaaatacttttgtaaagtgatttttattagattagacttcacaggggtgtgaagatgtgttttctaagactaacacatttggtttcacaatttttggagttataatgattttcttatagattttacaagttacaacgtgttttaggcatatagtgttttatatgtgcatgacttttgagtgataggttcagaacatgctacttcctgtttaagttgaataaaaggaataatttggttaactaaaacatttttagttcacatgtttatgatctttactagtatggttcatattttataaactagagatgctctaatctaaactagcaatatattatattaacctagaaattgttatatgagctaagttcttctaattttagtggatgaggatggaactatggattcactggtcaattaagtttttatttaggtttaattagacctaaagtgtatatatatacttatacatgtttatgtattacttaaacaacactatgtgtttaaattcttatttcactaagttaaggttttaatcaatgttctctacaaaaggtgccaaattttattttactatattgaagataactatttgctggttctatagaaactttgttcatttcatttggactaaaaataaattttctacaagttttacaaattaaaggctgctctatgttagtaaatccttatatgaatatttagagactttttctacacagtaagtatataatcttatttcataacttggaaatacatattttagcgatcctacagaacttaagtttattcaaattgaagctaaattgggttctacatgaatttctaaagtttagcttatctaaaactaatcattatagagataatagttttagaggcatttgatgcaaagtaagtcattacttttatttaacctaatcagagagtgtctgatgatgaatctgcagtttttgagtttgtttcaaaatgagttgaaatgaattttctatgtattttataagtttgtacatgttttatgcatgacttatcttagataaatcttagagacattatttgtacagtgagtgtcaagttttatattcctggaataaagttcataacttcaagaatctacagcaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgagttttctaggaatcaacccgcagtcctaggcccatatgtcagttactaacattttacgcaaaaacccctggtttctcgggaaatagatcccgcagtcccctagttttaggtttgtatgcaaaacgatgcttgagttttagtttatttacagattattactggtcctacttgtaagtgactgttccagttgttaatacatccctgggagtctttaaatttcaaaagccatgcccttgctctggacagagcagagcagcagcacagccgcgagcttcacagcatcaccagtggcgaacaacggcgattcagcttaagctcccaaaacaaaaagtgtagagaacaacccgcgaacctattggctcaccaagaatcaagaaccgt

SEQ ID NO: 98093 - DNA, 664 bp, Oryza sativa
tgtttacttttagccgtaacaattagtctggttttctgtactaatttaaattgctttgctatccatgaacaaatatgaataaaaggagtttagtatctatttgaaaagattctgcacagatacaatttatttaaactcatattctatcatagtaatgaaatataattgctttgcttatgacttgtacttcattatggaatttctatccccaacggagtactctagatgatcaatggtgaaatgataaatgaaatgataaagagaataatcgactcttctccaacaaatgaactatcaacctcccaaaaaaattaattaatatattagattagctatctatttttccataacaaaataactatatattaactgaataaaatattgcaatgaaaaaattatttagtaattatagaattctttagtagttaggggatctttttcttctattggtgtctattagtttgtgtttgcttagcttcgtttctgctattgtgaacttttctgtgtgacttatgtaataaatgtgtgtaactctttgagtaaacgctaggatgtttcattgaaaaaagtaattataacccgcaaaaaaagaaaaaagcaattatagaattcttgtatttctgcttcgactttgataccaaattaaataaagaaaaaaatgaag

SEQ ID NO: 98094 - DNA, 554 bp, Oryza sativa
caagcttgtatagtttttcgcgttgagcttggttatcatgcttccatgtatggcttggccgggcagtttaggatagttggttgtgagtccttgtagctatgattttcagtcggttttccttaattaatatctcatcacattgctgcgggaaattaagttgcataatatgtataaatcaaatacaatatgattattaaaactaaaacaaattgatacttatgaattttaagtccaaaaataattgatattgcatgttttatgagagaagaaaaaagagatgatttgaaccaaagatctatcacccaaaaactataaataattggggtgatgtggcttagtgagaaaagagagaaataacattaactaattcttagtggggatgaacatataggattctgcatcatttctccttgaagcacaatattatatattatataaaaaaataagcttgcaatgggtcggctgtcattaaaaaaaatcagatcagaactatttttttaaagtatttatcattaactggaacatgtttatgtttgataatagattgttagaaa

SEQ ID NO: 98095 - DNA, 554 bp, Oryza sativa
tcaggaccttagatactactcagatcactgcaaccactagattacatgccctttcacggcagcataactacttaatatctccggggattaagaaaatcgatgtgcatgcagccctgcccagatatatgtggcgttgagcgctgctacgtcctgccattgccaacatcagcgaatacgttgggttcggcctacctgtgttgacgaacggtgtcgcctaatgcctcgtgctggctcactgtgcaattaagactttctcgcagtcaattatccaatccataatgcgattgtgacgatcgatctcgcagtgtacttttgtggtattaagttacatgcatcaattaattcaacacagaaactttagttgatgtgaaacaaatttgctatatatttggctataaaaactcctccaaaaatttgacaaatgtaattatagtataatcacagtgtaattacactgtaacttctatgtaactttcaaaaatctctccgtaacatgttatttcggaaaaatggaggtcgtgggaacaaatcctttcacatatatgcgtgctatg

SEQ ID NO: 98096 - DNA, 630 bp, Oryza sativa
  unsure (1)..(630): unsure at all n locations
tttagctagtggaaagtagaaagattgaactagggatggtctaacatgaaactaagtgcaattcactcttaaaaaaaggcaaaatctacagtgagaagatttgttgagcggtttggtgcaacattttgatgcagttgtttgtttaggtgtcacatgtatgtcgtcgtatatagttttttaagccacaaattctactggctattctcatgctatttctgttttaaattaactttattttttaatctatgttacaattaccaatataagatttagaagattaaaatatcttttactttattaattttcagtacttttgtctttaactttatcaagtccaagcccaccacgtttatcgccaactttaacaagtcctaatattttgattatttaaaaataaagtctttatgagttaaattggtgaaggaagagatgaagttattttgagataaaaaagtacctcgtattatttagtctcgtcatgtctaagatatggcccgggtatggcatatttcaacgttgaaccaaacctcccattataagtgcaagccaacgattgatcaccgtncaaatgcacatggcatatgaatgctcgtaatggcccgtcgtatatgacggataagttcatgcttt

SEQ ID NO: 98097 - DNA, 522 bp, Oryza sativa
tacgtgttaattactagacgaatcttttaagtttaattgctccatgaattgacaatggggggttacaataaatatttactaatgatggattaattaggtttaataaattcatctacctgtttacaatctgaatatgcaatttttttggctattacactactgttaatactataaatatgtgtctgtagtccgatgttacacgctaaaacttttttttttaacattcagactgtcgccgatgatttatattaaaagaatatattctgtttaaagaagaacatacctaaacttttcaaccctgtgacaaaaccgggccaaagaagatagcttctgaaaagatgagcatctgtcatgtgcacacactgcaaacgcacgcctagtttggtagtggtagctcaacgaataaatgacggacatgtattttcatcgtcgattggacgtcaccacttttttatatatcatctaaataaaaatttttttaaataataaattttatatactttatccgcctcatattaaaaa

SEQ ID NO: 98098 - DNA, 1379 bp, Oryza sativa
ccgattaaaataagggtatctgttctagtgttaataaatattcactcaactccttgattgctttgaagctttatagcatagggtacaaataagccttacatgtgtgttgagattaggtgctcgttatatagtcctttttaggcttccaagtttcccaattttttcatttacagcagaaaaggcctgctttgcctatttgtcaaaacaaaggatctgatcaatattttctcagatggagtagccaccagtttgggtagaaccatggatgcgttttgaaatcacgaactgcctaatagaataggtatcctcccaattaaagaattgatggtattcatatttaatgtacaagttgccatgtgccaaattgtggtaggctttccggccttccattatatttgagagatgaagtgaataattcaagtcatcaaacaagcataatgaaacatccgacacctcgagagaggaatattggagacattgctgggcccttagcctgccattcaacttcagcctgagatgtgcccgtcaaaccactctaaggcggcgaccagatgtgttacacattcaggagacttgacaaaaatggctaaagatctacaacctctcaaatattcctaactcatactcatgtgaatctagttcccaggatgtgcactagattcacactttcatcttaagcatgattatacatagcaaacacaactaagatgaaagaaacttaagacttacaataacttaataattacataggccaaccggccaaatagacttattagagaacagcggaagcttgactacccaatcacaagcacaccgactaggggtttaccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctaccatactacatgtaaggcatatattcaaaggaaggcaatatgtagatcattttcagcataaagcaagttttgtttcgcaattcttttgtaaaagagttgatgcttcaattaacaaaacaagttttaagttttaacattaagttcatcataattccatcataatcaatctcttgttgtcatccttgacaacaagtcataatatatcatcacactcacacaactcaacacattttatcaatttcaaatcaagtcacatgttcacattttaaatcataaagtctatactcatgacacatcaccaaagcgctcatgaccgggagcacggcttaatcgattagtctaaagaactctgcatagtttgtacagctttacccacatgatatgaactctctagtttgttttgag

SEQ ID NO: 98099 - DNA, 698 bp, Oryza sativa
agaatactgtagagtaccattatcttcttaatccactcatcatttcgtatctctactcaattggctaggttgcctccaaggtgttatttattgtgccactcttacttttaggatgtatagacatgtgtcccaaaaagacttcgtttgtccagattcatagctagaaatgaagtctttttgggatgggggactagtagtagataatcttgcgtatattctgttgaaattggctattgactctcaacatgagcagggtggttcattcagagcatgctactggaggacacaaatagacctgcttcttattaatgttgcaagagagtctttctgtactatggggatgtatgaactaagaccactattggcaggagatccaactttttcagacttccagttagccttgttaaaatctctattggcatcctttctttcttctcctgacaattgtccttatttagaacgaggtcttgagctcttcaacaaaggtaataccttcttccaggttctgagccaatctgggtttgctgtatttatcatctatttccacatgcattccagttttgctaattcattggtaaaacgtagagttaacgatatacagaagaaacccactaggacacatacgcatgaaatttgttaagctagctaaataaatcatgcatttcatatagcagttcatttacttaattacatccatg

SEQ ID NO: 98100 - DNA, 1250 bp, Oryza sativa
aatttaccaacatcactacaggaagaaccaattgatgaggacatattctatgtgtgttagccggttaggtgttggtaatgtaggaaactctttaccttgctcgatagtaacatctatcccctaaataattagataggttattagcctagagatgagctattattaggtactcccactgtcccattttaaacgtcagccaatgattttccatgtccaactttaatagttcgttttatataaaaaaattatgattaatatttttattgttattagatgataaaaaatgactagcactttaagcgtggcttatgtttttttaatttttttaaaaaaatttaaataagacggacaattaaatttggatatggaaactcatggttacatttaaaataggacggaggggtatcatttgtaaagtatcggtttaggagacatggtttattacaaagcccaggtcgcccgttctgagatgattttttgctctctttcttgacaataacaatacgggctcctttggaacaaaagcttttcttttttaaaagaattttgtaggatgtggagattttccgatatgctccttcggaacaaatgaatgctatatagacgaagagctactatatctagtaggttgatgggctttttaggcaaaaaagagtttttaattttaattattatggggataaaaaaaggaaaaaaggaaacggaggtcggatggatagcacgtacgttgcgcgcggagggatcctaattacttacggagggagattatattcttgtgagataaatttaatgattaaaattaatgggtccaccaatttaagtgaaaatcaatgctcgtatttatctattttattagtcatgtgacgactcgaaagcgtttttagaaatatatgtgaatatcgatggtcagatttatctattttattagagtgacatgttgtgactcgaaagcgtttatacgataccacatggtagcttaggagcatttttagaaagtttaatggaattttagtatataatttttttagatttcctctaatttaaaagtgttatatagatgtttagaattttttttagatttcctcttatttaagagtgttatatagatgtttagaaatatttacatcatgtttaatagagtgtttattaggagaggatagaggaagagctagcaatatatctagtaggttgatgggctttttaggcccaaaaaatgtttttaattttaattattatggggcatatgatga

SEQ ID NO: 98101 - DNA, 564 bp, Oryza sativa
cgctttgcaaccactcgcacccgagctctctgccctagcgccgtgcaccacccgccgccaccgctctaagcgcctccggccaccgctcgccgccgttagagccgtcgccgagcctcgccgttgcctccgtcgggttcgcgagcccgagggccacgccgtccacccctccgccgtccgatcccgtcgccggaatccgcctttcaccgcacgcaggtgagctcgccattgcagccgccttcggccggcgtctccgtccgttgctctctctctctctaatcgctcccatttcgttccccaggtcgctccggagcccgtcccgccgtcgcccgccgttttccgccgctcgccgtcgctcgtcgtcttcggtgagtccctctttttccccctctctctcttcctagccgccgcctagccgctagtgccgccccgctgtcgctcgccgccatcggccgtttgccgtcgtcgggccagcttgcgccgccgccgcttgccgccgcgccaccgcatgccatgccgccgcacgccaggccgccgggccggcttaagccacccgcgcgtgcgccg

SEQ ID NO: 98102 - DNA, 701 bp, Oryza sativa
attattgggcattaattttatatgagaatattattcgcagcccaattttactgaatacatgtgaggcgtgtctctatgatgtatgggtccagaaaaattcaaatatcacgctacatccaaatataatcaatattggactcgttttgttctatattttgagtagagaccataagtacaaacggattttgaataggatatatcatatgaaaagtatgagctatcaaagattatatgggggagaaaattgactagtgctagccatatggttggttggttgcttttgataatcacgtcagattaatgacgattatatttagattatcggcaagcacacccaaggcgtgcaaatgatgtccagggccactgtcatcagcgtattatttgcttgctaattaagtaccatgtttgttaagcatgtccattatccggaggagatcaaatatttaagcgtgattagcccaagatttgcggacgcggttgagagtctcagcctgatccatccatcgttagctctgcctataaaaggcaccgactccgtccctcgtgaaggagaaggagagaaacacagggcgcaagcgctgcgccattaagtagcaatatgccctataggtacacacccgcacccacatatattcacagagagatcagaaagaagatgcatgcgcatgacacagggtgcgtgatcgcagatcagcaacaag

SEQ ID NO: 98103 - DNA, 508 bp, Oryza sativa
ggccattaaattactactgtctatatattaactgttttatcactaacccatctggcctaacatattgatagttgatttttcttataattgtattatgacacctttgtatcatcattaaacttgaaacgtcaaccttctagtgaccccattttataagaattggtcacttttcattcgtacaaaccatcgtaataagcaattttcagttcatcacttagaatccccgccgcaacgcgcggggtatcacctagttgtacatatacatgtagccaaggccagctctgggcctagctaggccggttgtgcgaccatcatcaccacccccacccccacctacaggcctaagcccatagcctcagtaaaggcggaactgcgcgcgggcggccttggagagcgatgcggcgatccagtctctagggcacgccgcgccagttcgtcttcaatctgcggcggtgcggccggaggccccccccggctagcgctttttttccgaagctccttgaccacg

SEQ ID NO: 98104 - DNA, 573 bp, Oryza sativa
gagtttaaattcctaaaaatataccgtatacacaaatttaaaatttagatatactttaattccaaggtataaaaaaaatacttgtgttaattaagatatacgtgtacacaaattttaaatttaattgtaggtaccgtgtacataaaatttaattttagatatacttagattatatcaatctaagtatatgcactgtacgatcatatctttacataccttattaaggtgtacctattaccttccatgcatatcttaacactcatgcaaaaataaattccatgtatagccattacaatacataaataagtaaacattttatgtatttgaaaagtgaaacgcactaatttggcttggtttacataataagcataccttatacttatattccaactacaacgtacatggtaaatttagtacctcgtttaatttccatacatacttaatttcgaaaaaaccgcatgctaatatttccatatatactacagcataaaagctggccgagcaatgggagaagatgggcaaacaaaaggagaagatgcttgaacagccaatgatacagcagctaggactgcg

SEQ ID NO: 98105 - DNA, 1236 bp, Oryza sativa
aattacatagaatatccgaattagtagatacaattgccttctcaggactctatccttgcatggcaattaccatgaagcacattaactcaacttgatgatgtacaccgagtcgtattgttggaatcggctgtatcggctaaccccgtccgactcaaactctgccgatcttatcgtagccgatttggatggcagccgattcttgctctgttttcgcaacagtctccgtcttggattcctcttcgatctgaccttcatccccgatactgaggttaccaaatttggtcgttaacacatgccccccaagtccggaatattttggtaatgtttcggatttgccatatccatttccgagagaaactcgcacttgccgtcttcccgaccgttatcgctccgctttaaatactaaccgttgcccccgagaatcttcacaccgtgactcccgttttcaccgcttaagcaaattccgtcttctctctctctccggcgatttccctcggccagatctccatccgcggcgatgtcgacctccgccggtccgtctgctgcgccaccaaccaacccatctgctacaccatcagccgagtacgcagaggtctgtatccactggctacatccctttctcttatcggcaaatcgattttctcttgtcttatattgctttcttcttctcggtcgctttggatttgtagcacctctccaatctagtggcggttcccagtttgctgcacgactaacaatatttccttggtccaatcggtaatcttgaccccactgaattcatcatatccgaaaccaatagaacccccttcaggtcgaccaacccaaacatgaatcattggaaaaacacctttaaatcctggccttctcttgagaaaagctagcctgcatggtacaaacggatgtcggctagcaaacaagctcattgggacgagattggaatcagccaagccttagccctcaccatagcaaatttggccaaggacgaacccctgatagctgctgccacctatttctggtccaacacccttaatgcctttctcttcaaccaagggccaatgaccccaactctgctggatatcatcatgctcaccggtttagatgtgacctcgtcggccaaccccatgaacttgaacaccaagagtactttcgagttcaagactaagagcattggaggctggtcaggatacattgcagcatacatgggcaaaggaccagttaccccaagagagcatgtag

SEQ ID NO: 98106 - DNA, 2131 bp, Oryza sativa
catgtacgaaaaaattagcgaggcaaatggcatccaccggacgtgtgtcctccccagtccactacctaggcgtacacgccactcagatacgcgtatacacgacctcgtaggtataagctacatacgtagtggccgcgtaattgagacatatacctgtacttattgtcacacttgatcacgagcctagttaatttgtttatatgtaaaagaccaggcatacatgcgtactgtgtaaatgtgataattaacctattcgaaagggatatcggctgcgaaattaacttgtacgcaaagaatagtgaggcgaccggccttgaccggatgaccggacgtgtgttcgcatcagtccactacctgtacgtacatgcctgtcaggtggcctatccaattaattttttgatagaataactgaagtacattctggcagagaatacctgccattaaaaagaagaccgattcacataggcagcattgcagaattgaagataattaaacttgtccatcaggtatagggacaataatataaatttatatatgtatcaaagaattaatactcatgtaatccaaagtaaaaagtaacaaccccaatagttcttgcatcatatgacagatgttatttcacacaaataaaggattttaaaaaaaatatcttgcgcttcattgcgagacagcactgttgtattgcttcataagttgtctgacgacatccgggagtgtggctgtattatccttcattgccatgatatccatcacaatgtctgctctgatattgttaatggatacctgtgattcataaaacaattcattgttaacaagatgagtataatgtacttgaaaaccataagtgaaaagtgcacaacatataataagtacttaggaataattaccagattgagacctccgacacatttgaagccatccagttcttcatgtacaccagagagttgattccactatcaacactgcatgagagttgtttatatatccattaggcattaatcaaatataggtatattctatattaaaattcaagtatgtttttttatacccgaaatacatcggaggatcattgggttcagtctgttctcacttggtgacctcgtcggtccagtctaggaagaacatagacaaacactcctgcattgctttcgctagtatggggccattccattgatgattattttcagcatggctatcattgccacaaaataactttttgggatcaaggatctgaaccaccctttcccgcagtttaaatgcatagcttttccaatggttcatttcacacattggaacaaaaatctgtggtttaattttgtcagcttatgtatttttatataaaaaggtagaaatgttcttactgacagaatatttacaatagaatgttagtagataaaaagaagaaaaatggcaaatcatctatacataacagggactgcatgtgaatgtaaactgtgtgagtgataaaaactaagatacatacctttcacgtattgtagctcgctggtgaatattgcctgttccgaagctcagaaacaaccagcgacggtagcgaaaaggcacatggacgtccggcgctgtaatgtggcttgacaaaaatggttgaggaggtctagtttccagcaagaggctcgcggacgaacgtcgtcggtgacaaaaaccacggacgtcggccctcttcacggcgtggcgagcaatcccggcgaggtaactcagtgaagaagaggtggatagctagctcttcgaccgtgaaacagtgtagccaagaaaaataaaaaaaaggaatattgtagccggtatatgtgtatcttgaaaattgaatgtaaccttgaaaatatatggcaataatcgcaattagtggaatggcgtcatttttcaaaaacagaatcttgtttcaataggtaagtacctgcatgcaaacattgtatatatggaaatgtgatatagaaaatggaaagtgctaatcataatgtgtaggcatgattagagggcacaaatttggaaatacatgcacggtatacatcaaaaatggaaatacctgcatgcatgttctaaggaaagtatatcgatgcaaaactcttatcgggttagatccgctaatatgtgatagtatcctctagtgggggcgcag

SEQ ID NO: 98107 - DNA, 779 bp, Oryza sativa
attcctgcagccctgtttttggagatatatgtaatgtgttatgtcatttcctgttaaaacattcatatggtgggatgagcctgtatatgcatgtattgtactatttgaggcattttaataaagtgcctaaaaagaaaagtaaaggcattgtcaaaaatgccttgaaaataaattaggggcatatgttaaaatacctcggaagaaattattggcacaagtccaaatgcctcaaatgtgcctcaaatgtgtttaaatgcaatctaaaaagtgccttcatctatacttatgaaggcattttgaaaaagtgccttaaaatccctttccctacaatagtatatccaacacttttttaagtgccttctttaaggattggaggtatttttttaagtagttgaggcattcttaaatgcctccgaatccttgcgattcggaggcgccggcgtcttccattactggtgcctccggtatggctgtccccaggtgattggctgggcgaagcgctggtaaccaaacaaaggcgccgttattcttggggcattggcaagcttgtgtggccgtgcggcgacggcatcgatccaggcccgtgcaacgatcaagatgacgatgagcgccgtacgtccagaactgcaacatcgacgatgctggcaagttcttctttcttccgattttcttaatttgctttttcttgcagatcgataatgcatgcatgtatactctttccttttcctaatagatctatctctgttaatagcagaagaggatgcagacacgtatatata

SEQ ID NO: 98108 - DNA, 990 bp, Oryza sativa
acccagcataacaagcacgaagaaacattgttccctatccaggttgtacaatatgtggccatccggtggaggacggctttcatgcaactgtggcatgttccaaagcaagggcgttgagatctgaacttcgtcaggtttggagtttgccgggagaggagcttttcgttgatttggggccggattggttattattgcttctagatcgggtggattcatacaatagaggcacaattctgcttatgctttggcgggcatggtacttgaggaataacgtggttcacgataagggcaatctaactattactggttctgtcagcttccttcagagctatgctgaatccctgttgcttgtccgacaaaaggtttgcgatcccaaaggtaaacaggttgatcagcagcataatcaagcccctccgagatcagtgacgaaccaagtaaaggagaataatatgaggtggagagctcctccagtagggtgggcgaagattaatgtggatggagcttttaatcctgaagatggtttgggtggtcttgggatcattatcagagactcatctgggaaggttcttctatcatcttggcgttttattcggcgatgttcctcggcattagagtctgagctgctggcatgcttggaaggattgaaactcgctgttgaatggattaaaatgccggtaatattggagtctgactgtgcaattgcagtggagagaatgtcaagcaaggaacatgacagatctcaatggtcttttctgctccgagagatgaagaggaagatggctttgctttcggaggtgggttttagtcaatgtcgacgaaattgtaatagggtagtccatgaacttgctcaattggctaaaaggacggcacattgcgcggtttggcgtgatcatgctccatctgaattctgaattacagcccatattgcagcaagtatgtatccctgttatttaaatcaataaagcccaccgttccctcaaaatatatata

SEQ ID NO: 98109 - DNA, 760 bp, Oryza sativa
ctactcaggtacccatatacacgatctcgtaggtataagttaatttatcctctaaacttaacagtatatttaaatctgacagcgcaccctaaaaatggtgagcagccgaaattaatttcggataaaacactaatttttgttttggaaaaaacgctacatatagagttgacgcgtacgtggcacatatacctgtacttattgtcccacatgatcccgagcatagtacccaatttttttaaaatataaaaaaccaggcatacacgtgtatcgtgtacatgtgagaattaacttgatcgaaaggtatatcagtcatgaaattaacctgtatttaaaaattagcgaggcggacggcctccaccggacgtgtgtcctcccagtccacacctgtacgtatacgccactcaggtacaagtatacacgacctcgtaggtacaagttaatttatcctctaaacttaacaattatatttaaatctgaccgtgcaccctaaaaatggtgagcagcctaaattaattttggataaaacgcttccttttttttttgaaaaaatgcaacatacgtagtggccacgtacatgacacatatacctatacttattgtcccacgtgatcccgagcatagcacctaatttttttaaaatataaaaaaccattcgtacatggtacacgtgagaattaatttgatcgaaaggtatatcagtcacgaaattaaccagtatttaaaaattaacgaggcgaacggcgtccggtgtcctcctcag

SEQ ID NO: 98110 - DNA, 574 bp, Oryza sativa
cggactcacactctcgtatatcctccctcctctcctctttcccagtggaatccatggctcctctcgtcgctttcgtccctgcccatctacacgcacgcacgcacatcacgcactgcgtctgcatgcatgcgtctggccggctccctccccctttcggcccggagaaaggcggagtacgtcagtcccatcaaaagaagccccgagtgcgcgctggatcgagagccgcgtgacacgatcgtcgtcgttgatccattccattctcgttggatgatcttggaaagtcatgatatgatgaacgtaacgtcccgttcttttctgattaagatgtaaattttattttcgtttttatttgtttgatttccaaactgctagaacagtgtatattttttcatcttaagtagaaacgaacatcacctaaaggtcctgctcgtcatggtcctagttaatttttacttccaaattttatactagtaagtggtaaacaaaattatgaagtgggtttttatgcggcagcgttggtaacgaagattcgtgaacggaagccggccgccattgatggaagtggaggatggca

SEQ ID NO: 98111 - DNA, 710 bp, Oryza sativa
acggtgggtacccgacgtcgctgccacggacgccactgtccggccggagcgagagatacctgcaagagcagttcagttccgcgctgcatacgcaaaaacttcagctatatcttcaaataagttcagaaaagtccaactcacacaggggaatcaggtgacacattagcttgcttcttctggccatctagcaatctgcaagaagcagcaatcgatttgaaaggcagatacatgaataatgaattaacgtttgaatttttgattgattatacgaagaagaaagctgccgcgtcgtcggcgtcatcgtcatcggtctcgtcgaaccgcaggtccggcgtgttcccgtccgtcgagaatggcacggcaagcacgcccagctccatgaggtctgtcaagagcggcttgctccggtggaacgactcggtcacgaactccgggagatttgatttcagggtcatcttttgggcacacctctgcctcgccggccctgcaaccgccgccgccgccgatgacatctacgatgaggaggaaagcgagaaagaggaggaactataattttttttatttttagcaaaacactcactgacatgtgcatcttagggttggtttggtttgtggcctaaataggccttaccaaattttgtcaatgccaaattttggcaagttttggcatgactaattttggtaagacaaagttgtgtttggattgaagc

SEQ ID NO: 98112 - DNA, 640 bp, Oryza sativa
aagtaaattcctacagtgaatttcatcctagctaaaccgtataacaatgataagattaaaatagcactcatccattgtaacgtacgagtattttttcaagtctattgaaaaggaagtaggagaactgacttgctcagttagttacgctaaattattttttcatcatcgtgcggattattggagattaattgaagacgcgcggcattaattcgtagagtagtattcatagggtacgtacaacgccattgaataatctgacagtagcagagacaagttcagtctgtacagtgaagtgcaaagcttctcttagaccctgaattccaacctttttctttaaatttttaactttttcattacatcgaacttttttacgtacacaaacttctaatttttctattacatcgtttcaatctcttcaaacatttaattttagtgtggaactaaacacatccccttatagtagtagccgtatgttgattagagagacagcccaggccggctcctcatgattgaggaataagtctactttgtctctctcaaatttacgccatccaatctaatttgtatctctcaatcataataccatatatcttaagcactcaattattaaaaccgatgcaaaataactccctcgataatt

SEQ ID NO: 98113 - DNA, 633 bp, Oryza sativa
  unsure (1)..(633): unsure at all n locations
ccgggccctttgatggttctgcatctaattaagaactgtggcccgatatgcctcatctgcagacccgaccgcgctaaattggtatgctggctgttgcttatccttgctaaggttatactgatgaacctcagacatagggatcatagatgctttcttactctatgcggaagatgaaggcttcctcagcggacgggacacaccagacaagattgtatccgggccatgccctggtccaacaaactgccgcttatggatgaaaagtctcgactgcctgtcgaccctctgactaatacttgcagcagacggtgaagcagcggggagatctaaagaactgccaaacacggcggcttaaaagctggaagcaaaggactctgttgtgataccagctagtgcgccaaccgattgcggatgtgtatatcccctcatggaaaaatggctcgttcttaaattgaaaaaaggaaaaattcgcccagagcaccaccgttaaaatacctttccctttcctagttccccttgggaaaggaatcggcgggaattggagaaaaccaacccccgttttttttgggggggtttaaccccaaaatttttcgttantgattggatatcctgattntagatcgaaacgagggcggg

SEQ ID NO: 98114 - DNA, 610 bp, Oryza sativa
aaaccatctagatctggtgaaaagcacatgtcttttgctagtttttagtgtgcccgttaatttttattggaaggtgtaatcacttgttaaaaacaatgataggattatacgcgtgcggtacaactattttactgctgcctcacatgaaacctactctagttctgtttcgttttgctaagttatattcctttccaaatagagtctggtgtcctgatgctactactatacgccatactcaatctgagttgtatcatactaacatgtccgcttctatagtgcttatgtggaacaacagtatatttccaaaattttacgcattaaatcttaacccttgagatctagatttactatgatttagtggtctatatttttctctttttctccgattaatgtgggagtttctagaccccacagcgaacgtagtgccttctttcaaaactgttttaataatataataaatagatagattatttagtgatatactagaattaaataatttaaccaggatcccgaccctagttaatagtactacgtatgaacgctcctgtgtataaatgatgagattgtatacaaaatactctcaatggttttaatatgtatgatgccgtta

SEQ ID NO: 98115 - DNA, 4514 bp, Oryza sativa
ccaccatcaaggatagggttgctccaagaacagcaactggggcattgtcctgcattgcctctgtagttgtcattcagctgtctgcttactcctgaaagcatcccaatttgcagctaactgttcacaaacaatgcaactaggcatgtcaataaaggctatgatctagtgagtaccacaacttggcaatgcattggactatgatacagtctaacagttctctgttacgtgtgttacacctgcagttttatcactccttctgcatgatgacggtttgtggcatcaattgctcagtgtggggatgatggctgtgtcataatcttcagagattacctgtgttagccttggaccatgctcatccatacattacaaggtacagcacatctctgtgccaatcatcatccgatatacccttaggattctttcggcttctcttatgagcttatccccataacaatgaattataatttgataacaatataccgcacgcattctgaagtacactcttcatattatttatttatcagattgttgaaacgaattatttgctccatgctttaaaaaatacattttctaaaaaaaattttagtgtattgcttggaccacttgttttaagttatttgttaaatttatttatcaaaatattcaatttatttctacaatcaagtatataatctgccgtaacaatccgctcgtttcaaactgagtcgctttgagccaaatctgaagtactctttggtatatatgccatcttcttggaggcctctgatctggaaaagaatgtagggttgttttggtttgaagccctaccaaaattttggtagtgccaaatcttgggttatgttgtttctaactctattgaattagtaagatttggcctcaatctaaatagttaacaaaactatcaaataattggtagggcaagaattggtttcaatccaaacatacccgtttatgccatcttcttcatccccaatgatagaggtaaaatcagttgggaaaggtggctttctatctcatcatttttcccaaccttgactagtcaggaagccatacatagggtggcagtctttgagcactgcaacaaaacgccattaccgtttgatatgctcatatcgtgctccgtataaaacaaaaggcggcactgtggccgtagggtccccattgttacgtgtacacttgcatgcttctctacagggcttctcataatctctttacatggaccgtattttttttctctgtatttttccacatgagttactgttgtccacagccaaaaggaagttagtgatgtacagtgaactatcaagagttaggccatgttataacgtctgcggtttttcacaggaatttcaccaaaacaatttaaatattatatgaggagtgagtagggatatgaaagtaaaagaaagaaagaaagaaagaaagaaagaaagaaagaaagaaagagaatttcatacgtgaacatgaaaattttccacaagtttggtttttcatggcgaacgaaatagtttgccgcactgggtgggaaaaaaaattagctaacaaatgcccaagatctgtctgatccatctcaagactttctactcatccatgcaaatctttttaccgtgtattttttttctagtgaattttcaggcgatttggggggccggcatttcacatgcacatagaagacggcaagacgctcatgtctaaatgcaacagtatgcttcagatttgtatccattcatccatcacctttcttcaagccgattcaatgcaaaggtgagaaccgagaaggcaggcaataatgcaaggcagtcatcgtcgtcgacgacgacgacgttgagccgtagaaaaaagggggcaaaaacaacagtggacaattaaaatccaaaggagaatctagtgacatccactgttgagtgcagctgcagctgcagcagcagcagcagcaaaaggaaaggaaaggaacaggagccaacgcgaaagcatggaaagctgtggtgcactttcagcttgcaagaatttgcaatggtcagggggtgccaggaggccagtattgcatggttcagttaaatggggaaagtgcatcgcctggcaatgcacaggctgtgtggcattgaactttctttcaggtcctcacagccttttttcagaatttttctttctgggagaagtttcagccttttgcagtgaccggaaatgcttgttgagtttgctgtttctgcaggtaaaagttgtagtagtagtaataatctttatgtgaaatgtgctgatagagataggcatcacattcttgtgtgaagttaccttcctcaaatgatgtctgatgaccttctagaaaacagtggtacttcagtccatgtccctcagaagtgtagctcatctcagtagtccatcaaaaaagcaagttaagcaactagacaaaatattgttcagactatcttactcttaacatatatttttgcattgttaagttgatgaccttttgtggattagcttgaggtatagaaatttgtagtctgtgcagctagaagggaggctttgcatgaatgtcttcttggataagagcacttctgagggatctttggctcggttcccttgggagcatctactacttgtgaaagaaactgcattttttcttcttctgaattttctctgtgcaagtgcaaccttgcattccatttctttgtcaatttcttcttttccctgtacttctccttttcgggtagatagagtgagagagaatcagaataaatctgcaatgtgttacggaggatccagaattctttggactgtcccaggctcataaagacaatgcgttcaagcatctcatgtcatcaacaggtgacctacctatacaatgctaccaatcatgcacgcatgggctagttctgggagatgtctatgatctagagctcaccaaaatctctttccttgcttagggcctatttgggaagtttaacattctgagaagcagttggttggtagccagcttctgagaatctggaaaagctgggtttcccgacttctggattctagttcattttctggattctagaactacagcttctcagaatctggatcaaaagctggtttgtttggaggagcttctaattctgagagaagctgcagcaactagaagctcccccaaacagggccttaggttcatctaatcgcttaagggatgttccttggtgtacttttttttaaaaaataattcaatattaatggttgcgtgaaattttttttaataaaaaggcaatgtagaattacatctaccacttcaccaaaaatcatattcaaattcgatctacacattgagaaacgaaaaagacaaattaagatgtgaatagtaccgatactatttgggattgcttatttgacccgttttgaacgttaactacctatttgaccttccttttttgagtttgcttatttaaccctgcttttcgaaaatgaacgatccgtctgaccctgttatgttaaggtgagttaacggtgttaagttagggataaatagtctattttgcccttgcttagttatatattgcttgtttgaccctattatgtcataccatatatatgttcgaatattttgacatatttttactaatttttacatttctttcacattaaagaaaagtttgacggatttgccataaatttgacaaatttgaatcattttgacaaaatgactttaatttgactgaattttaacaaagtggtagtagagtacaggtatcaatagcagcggcggcgaaaccgtggctatctaaaaaaaaatctaaatctagaacacgacggcggcggcggccaacgcaccggtgacggcgatgaagctgacggaggcggagacggcgcctgcggtgctcttcctgaccgcagcgggcgtgagcacgctgctggacagggccatcgcagcgcctgcgtcggcggggctcggcgccgcagctgacgactcagagggtgacgagggcggggacatcggtggggccggcggcgaggccatcgtcatcagtgacgatgtgggccttggtcgccgggagagggggcaagggtgccatcttcaacgcggatccctctgtccgcttcccgccgctgccgctccttcccttcacgagcgggcaccgacacatgtcccctccgcatgcatcctgctgccgccaccgccccctacctccacaagctggcgccggcgcggatccactctgcgagcttccctccgcccccgcccccgccccctacctccacgagccggcgctaccgcgggttccctgccgacaccgagcaccgccgccgccccctacctccacgagctggcgccgacgcgggttccctgccgacaccgagtgccgccgccacaactcgccggcacgcgagacatagaaccgggcgtggatagggttagggatggaatggtttcctcgagggtattttggacattacgattttaattatatttgtttcttttaactcaaaccttagcgttgtaatgaaaacagggtcagacggatcgtttgttttcgaaa

SEQ ID NO: 98116 - DNA, 622 bp, Oryza sativa
tagaaatgttaaacaaacgaggggatgtcccttcctgagtttagaaaactttcccgcttctgtccacggcagatttgtctcttttctccaccaaacagacagtgtttacatcagtagaaagctcaagctaactagaccactgctgctggtgtactaatgacacacacacactcttggctgctgtttgcaacagggttaccgcgctaatcccggtgtttttctgctgagacagatgccgttgctgtggctgagtgaacgtctggttgccactggggaagaagagagaagctttgatgtgatagagcacagtgcccaatcctccatggtgttattggcgttgtctcgtgaattcgtcatctgttggagtagtttttttgcaccacatttttgggtgtttagatgggactaaaactttttagcccatgtcatatcggatgtttggacgctaatttagagtattaaacatagactaataaaaaaactaatttcataaatgagagctaatccgcgagacaatttttttaagcctaattaatccataattatcaaaagtttactgtagcatcacattgtcaaaatcatggcgtaattagactcaaaagattcgtctcgcgaattagtc

SEQ ID NO: 98117 - DNA, 664 bp, Oryza sativa
ttttccattctgttcaaaatcacacagacaatattaggtcaaagtttaaaggctagtagagagaggcgatccttcgcttaacttcatgtgtagttagtgtcactaacatagcacatcatactatgcatgtctctagtagggcagtcgcagtctcgcagataattatggccccgttaatatggggaataggtcgagcttattaaccgcacgtaaaattgatctaaaaaataatttgtaaataaaacttttataaacgtgttcttagcgatttaaaagtaaagattaaaaaataaaattcgagtaaaataaaccttaaaatcaatttaaattaaatttaaggttaaaaatttaaattttactagctgataagtaagcggaaagatgaggctcttattcctttttttctcgtcggagtgcccgtagcatttccccttccctcctttttgagcgcacgccgcacccactcccccgtgttctctgcgctgccgttccccgttattagccaacgctttcctccacccgcccccttcccaagctgagctgtgctggcccttgtttcgcccttactaatcatcatcggcttctccttctccttcttctcttccccaccacctttcttcccacacacacacaaacttgcgcgcgcgcggtgagaacgagaagc

SEQ ID NO: 98118 - DNA, 656 bp, Oryza sativa
tctgcacacacatcttcgccacttccaatgtccaggcgtgggccgggcccagaattttcaatttgggtattcgaaattgaaagagatatttttttccacacaaaggtctaatagttgtataatatataatggtataagcatgatgcgtgtctttcatagaaagggagctgactcccgctcccttccgtccatcagggatttattcaaaaacctgaaatcgagttgagttgaatggggttcaagtcaactagatgaaatgtttcttcgtagtgagcgaacgagttgtaaagtcatagattcatagaattgaccataaattaaatatgttaagcatattttaaagtacagtactaaagtattaattgacaaaacatgtcaaatttataaagcatagaaaatggaaaaatgataagaaatcttacaatttagagagacttttcgtttcttgatattttgaaaataagtgacgatgtctttatccttcactttcctcttcatgtttcaaacctacaaaccaacactacggtcttctaatttaagtattaaccatgctaactctgctaaatatgtgcactaactctgctacaaagcctcccaaatcagtgaatcacaagtttcaaagttcaattgttcaaccataacccatgaaccatccc

SEQ ID NO: 98119 - DNA, 620 bp, Oryza sativa
agatgcggcggagctgccccaatggtggagcctctatagtctctcccctccaccacccgccgcgatgtcttccgctgctccgccgctgccgcgctcaccggcggcgacgcccgactcgacggcgtcaactgcccggacgcgcgtggtccgtgcgccctcacgaccgccgcgggcgccacgccgccggagtgggcggagcgccgccccgccgtgtccgtggactacgaccggggccagcgcgaggcccgcgccgaggtggagggcgtgggcgccgtggcgttccccgcgcgccaccgcctgcgcgtggaggggagccggtggcagcgggactggaaggtgttggaggccgccgcgcgcgtgctcgcgatcccgcgcgccgaggccggcgctgtcgacgccgtgctcaactgctgggccggccgcttcgcccgcggcaacttccctctcctcatccgcgtaagggcatcatcccacgctctgaagtatttcatgaattgaattgctgtgatatacatcgatgtggttgccatggttgcgttcttatgatttgccatcacgcaagttatcgattgcttgaaattacgaaaagcgtcaacaattctatcaatctagctgtgttg

SEQ ID NO: 98120 - DNA, 670 bp, Oryza sativa
cgcaacgtagtgccttctttcaaaactgttttaataatataataaatagatagattatttagtgatatactagaattaaataatttaaccaggatcccgaccctagttaatagtactacgtatgaacgctcctgtgtataaatgatgagattgtatacaaaatactctcaatggttttaatatgtatgatgccgttaatttttagacatgacgtatggtcattcatctggttcgtaaatttaatgaaaaaaaatatctcatacttaagcacttttaataataaaataaataatccccgcaaaaaaataatcaaatatataatatttattgttatttcaataaaaatgatgggtatatgctatagcctaaaaaagacaataactacatatagatttgctgaaattacacacagccacaggcatatggcaattttggatctttccataaacattttcccccatcgacgcacaattactccatctactcgagataccagatgtgactgatcgagctcaagctagctcgtggaatataagaaaaataacttgcagcttcaaatggccggcggagatgtgagagctgaattaagttgatcagttgagaattgaatgccaagaattcagtcgggaacagcataaggtccacgtactggtcaagggacatgaaaatt

SEQ ID NO: 98121 - DNA, 550 bp, Oryza sativa
tatagcctgtagttctgtaattattttttcccgttatatcgatatgaaacaccgaatcatattttttgtttgttttaaaaatatgtatagcagttgttgttactttctactctctctgttcgatatcataaactgttttagttttgtttaagtcaaatttctctaactcgtacgagcatcgatctctcgtgtaagatgttttcttagcagagtaatactgattaattaataaatgtgtccactaaacatgaacaattcccttgtacgagcatctcgtataaacagtatacttaaatttctcatttaagttaagactttgaaaccatcccagattagtactgtacggtctgaccagagcttacagccacaagcgttaccgtaggatttcaaaagttcttgaacaaatgtcaatgtttcactcttgaaactttaacccacaaccgatcgttccaagtcaagtatatgtggtttgttgagattgatacaaaaactcttgtggatgaccgtgttaattttagactggcgttgacaattaattggtttgaaaatt

SEQ ID NO: 98122 - DNA, 591 bp, Oryza sativa
cccagaattgtgtttgaagttgcatacataagtttgttactgagatgttcacctttccaggccaacaggtcacggattggagtgaggtcattgagttagaaggtagtttcgaagagttgaatggaaatgtgagcaatgctgattctgagaggtctctctttgaagaacaatatgaaaaagacgatcatgataaggttcatctctatttcccccaaatgctgcatcatatctcaaagaacactttgtacatgcaaataatgattatgaataaccacatctggcatttgaaaacatggagctaaaaatacttactactttctggggtatgcatctgctgataaatcgctataacatgggtttttagaacatttggactctcatcatctgcttgttggcttatcaaccgcagccaaaatttgaagtttgaaacttaattttagagttgatattggggttttttcattgtagtttatttttcagccttggcttattgagatggagggttttagtagttctttatctcgcactaatcaagaagctagtgcttaaggagttatgttttttgcattggtaaaaaaactgagtattttt

SEQ ID NO: 98123 - DNA, 606 bp, Oryza sativa
attacaccaacaccattcatcagaagtagttaaccaccagattttttggggcctatggcaaatacagttccaaatacttcaacaagagccagcaaaaaaaaaaagaaataaaaaagaaagaaataaaagaagagaagcgaagactttgacttttcagaactgcgtggtgtttgacccggacgccccggcgccgtagctgctccggcgcggcggcggccgccggatcgacacgagcccctccgacacgacgctcccgtcgtcccactgccggccgagcagccccgtggccgtgaccgccgcctcgtcgtcctccccgcgcatcgcccggagcgtccgccgcgccatgtcccggcccacgccgccggcgccctcggccaccggcgtgagcgcggcctcgacgccggcggcgcgcgcgagccctcggaacctcaggctcccccggctcatcccgtacagcgacgagatgcagtactcctcctccgcgctccccggcgcggcggagccgctgctcatcagcctcaccacggcgggcaccgcgccgccgtccatcagcgcggtcctcccgtccgggcagccggcgaggttcgcgaggatcatcacggcgat

SEQ ID NO: 98124 - DNA, 685 bp, Oryza sativa
tctcaaatgtacaatacgtactactgttcactggattgagaaaaaaattcgcccgagtttgtacaaactacgcgctgtccttcactccttgaatctttatacataaaatcaatattcacccatcctctaataaacttatctaaataataaatagatgtatatgggaaaatattatgattacatttggtattaagtatattttaatttaaaaattatcacattgaagcatatttagagctttgtccattaaatatcatgtaaacgctattaagccaccacttagtacatctacaaatgctcctacaccatcacgtggcattttaataaattagaaaaatcacaaaaattacgagaataaacaaaacatccagttgtcgattttcattaatatacggtggacctattgtgtgtacgtacctctccacctattttctttatctcctattttccagtttctgttagatggaaaaaatattttaggataaaaaaattttagacaattatattatctaaatcatatagctaactttttattagtgcacaccattagattatttactataaaacataaaattgaagatccaagttaactatattattaaaaaaatcattactctgggtcatatatattataataattattggtttcactgatccatacatttttaagaaaaaatatatagat

SEQ ID NO: 98125 - DNA, 785 bp, Oryza sativa
gcagcccataaatctaagtttgagttgtatctctcacaatttaaagcaagtttaggtgacaggattattagattgtgcttaaagcctaactcaacaaatgattactcaaattttaggccattacaaaaaaaatgggtggaatggctagagttgtgcttggatcggcttgcagataattaaagaaaatgaaatttagtttatttggttagactggaatggaccaaagatcactcatgtgctgtctcttgcatgcccatccctaggaatggctagactggatgaacacggtcggtcattactggaattactctcttatattatgggtcgaactagacgttgcttgatggaatagtacatactccctccgtctaaaaaaaactaacatcgtactaggacgagacacatcctaatacaacgaatctggacactaagatgagacacatctatcttatcctagtacgaggttaggttttttttttttgacggagggagtaccatcttcgttttttaataaataatgccgttaacttttggattaaagtttgaccaattgttaatttaaaaataaaatatgtcacaaaaaataaataacaattatttaaattctttaaataagttgaatgatcaaatatcataccaaaagccaatgacgtcgtatgtttaaaaacggaagagtctatttaaaatggtgtcactccgtttggaaccagaacagaattgtaagcttggtctaaaccacaagaaattaaaaaaaagaacgaggacaatagctatagattaacgtt

SEQ ID NO: 98126 - DNA, 531 bp, Oryza sativa
aactattgttcttttgataatgtaattatcaatttagccttgcttttcaaatatgaagcggacatctgaacctggaatagttaaaattgttaaagttagcaccaaaatatcgtttatgcccatgcttatttcaccatgctttctaaaaggtttgttttttttttcagttttgtgatgtatacataactttgtgattgaaattttgaaatatctgtggaaaatttaacttagatttgaaaaattgtaattgaactttaacacatttgtcacaatatgtcaaattaagtcaaatatgtcacagatctgtcaaaattttcatcacacatttttataagtgcacaaaattaggccaaataaacaagacatttttgaaattagggcataaaggatattttggccctaagtttgaagtcagacaataactttatttatttatagcagggtcgaataaaccaagtttaagaaaagtccaaaagcttaattatccgtaaaaatacatattgaaaaaatatatattgttttgttaatgca

SEQ ID NO: 98127 - DNA, 739 bp, Oryza sativa
atatggtcccacatatcatacacacattgtgtcttaaagaccgtgctacagccggctacagatctgtagcccgctgttcttctctcttatcttttatcttattaaaatatgtttatagctggctaatagtctgctattgtacctgctcttagacgcccgtgccatgcatgtaaactttgtgaaagcattttagaaacagtgtcttttcttgcatgtggtcgttagttgtgctaatgcaacatggcaatcagcaattggttagcactgtaggataaatacacagttgctttgcatttttcaaaaccactatggagatatatttgtttagttgtggatgggttatggggattggaggaaaacaaatttcaaacttactttgggcagggtatcagttaaatttggacagggaatgagtttgatcagagtaggtacaaatttttctactaacggtactaatatccttgcttatatggtcaatatatagtttcagtgtgtcacgatttgatctaaatatataggtgtaagtggcaagttaacttgcaaaattatgcaaccgcatcattaaggtggtattagtcatcagttttttctctttatattataagcatgtgtagtggtgaaacattcccctggtgtaaattaatttgtattgcatcctgagaaatcatttcgccttcaatgtgtgtaggataatatatggcatttctctattgtgggtagaaatccatgacgaacgcgt

SEQ ID NO: 98128 - DNA, 1420 bp, Oryza sativa
ttggtggcatcggaggaggaggcgtagccccgtgagccaatcaggcggaggaggcgaagaaccgccttgtcgtcgtcggtcgcgtcgtggccacggcgccggagatgggagaggagagtgcggcgaggctggagaagaatcggccgccacattttgtctctgcggacgctagctttagggttacgtacgttggttcagctgcacctgcacgacaccattggatggatccatccttgttttgtatatgggccatcgataccatctcgatccgttcttcctgggaaaaagtacaccgaaggtctctcaacttatcatcgagttacaaaatcgtcccccaaccgcaaaaccggatacaacgcatccccaaatttacaaaaccggtgcaaactagatgcctcggcggttttgacccggatttgcctgacgtggcggctgagtcagcgtgggacccacgtgggccccatatgtcaggatacacgtcggcagccaacctcttacttcctctcctgaccgggcgcatggtcggaccggcacagtgggtcccatatataagtgaatcaaaggtaaatgggtggatttaacagagaaactaggcatggtggggcccgcatgtttgtgagacattagagtgagattagggaaggattactgtgcggggtcggcatcctggcggcggcgctcgccccggcgcgccagcggcggagagcgggggaggagcggcggcctgggaagggtgtcgccgcggggccggcgatggacggcgcggtgcaggacggcaaccagcgtcgcaacggcggagggcgacggagcagagggggcgcgggaaggagtcgacgcggagtcggcagtccgcgtccgcgaggaggagcgcgtggaggccgccgtcgcgtcgcccggcccggcgccgccgcgtcgctacgccaccccgccgcccgtccccggcctccctttcctgcctcgccccaccggccggcccgcacgaggggggcggggaggccagtgagctcgcgccgccacctcgcgccgtgggcgccctagcgtcggcatccccatgccccgtgcgagagaagagagcaaatgagcactgcgacttgactgcgatagatatgcattaatcgatctatgcatgcatatgcgacttgacttcgagagaggcattcagaattaatctgtttagcactcatatatagatatgtgaagtaaaccaaacacacaacacaccaattacttgatgatgtttgattaagctattgctgatatactacacacaactgctagagaaagagaaatatatatggccctggcacttgaacctctaaaatttacctgtataaacgtagttatagcttggatcgatcttgcattatattggctcaccttttgttaataattaattagctcaagctggctggggtgcagg

SEQ ID NO: 98129 - DNA, 709 bp, Oryza sativa
ctgctggtcatacgatcccatcggctgaggaattaggcaagaagagatattgcaaatggcataattctggctcttattcgactaacgattgtaagatctttagacagcaaatccaggttgccattgaagggggaaagattaggtttgatgattccaagaagccgatgaaagtcgatgggaatcattttcctgttaatatggtgcatacagctggtcaagcagccgatagggcccgtgcaaagggtcttcaagtaaattcggctaagattatcaacaagtatcaaaggaagtatgataagcagcaggagaggcattatgaagaatacgacgatgtttttgatcctcattggggttgcgagtttttcagattctgctggaatgaagggatgaggttgccatctattaaaaactgccctagatgcagtgatatcatcgagagctcaagccgatcacataatagggataatcggctaagacaggcaagactccctgttcatcaaagattgggcccgatgagtcaagatcgtggccaagaggatgaggtgatcagggagaatcaatggtatccttctggtattttcatgaagaatcagaaaaggagggtccatagattgaggagcagggagcgttttcaggaggttgaagaggaaatcaaccatcggctgaggaaaccaaagccaagacaggagtggcgtgtcaagaatcagtt

SEQ ID NO: 98130 - DNA, 3300 bp, Oryza sativa
ccctcccagagggcggtaggcgactatttccgtcaattttcaaaatggaaaattatttttgtaaaacttttaataagaaaaattataaataaaaaaaattctgattgtattgtggataaaataggtgccaatttcatagaataaaagtcagtatgtggctttttggtgtgtctggaactaatctctatgtgtcgttgatattgatgtttcatcattggtcttggtgaaagtaccttcatgtttaaacaagaggtataactcttagtatccttgttactactatatcgaaagaactaatacgttatataaccatcattctcatcaatcacccactctaaatattattggttttgtgcggtgtttaacaccatattgtaagccatggttaaaaaaataacacgattccaccatataattattagcaggaatagtacattgcatcagcaataatagccgcttattgtaatgtctattttagaacgtatttacatgatagttgttctcaagactaagtatacataagattgatataaccacattaatttgtgagattattaatatcaccatgatatcaaccatacacaacaattaatatatagttgcacatagctcatactatcagttactcctacttaatgcgtattactttgcaaaaaatatccataagtccatatatatactacatgttgcctggagctacggtgacaaggatgatgaatagatgaaacgaaagccataagtccattgcttgttaccgttaataatgaaaaatatatataatgaaatattagatgtcgttttatcaatcaagagtaagaaaagtattgacctactagtatttttttagactagtccatctacaaagaaaattcaactatactcagatgtcacttgtacaaatagagaaaaccgatattatgtaatacaactacgggtaaaccttaaatgcaacttttttactatgattcctctagaacgtaagattcttaaagtataggaatagagaaaacatagaattaaaaatatcatgccatgtaaaatcctacaagaaagaaagctacagaatttattcaaaacatgtatttggtgtaccatagaaaaaaacaaaagaattttaagattatatgttgatttgctagagagataatggagagagaaaatgccttaaaatatcaaaggaatttgaaataatgaggttgaacctaatgctaaaattcatcaacattgtggaggaatttttcctatcctttaaattgccttaatttgaagcaatcctgcaatcataaggactcattcctttggattggatcctgtcttttccttaaaaaatccttcaatcccaataagccctatatgtttacccattaaaaattactcctacctactttctccgtcccataataaatttattttgcttgtccgaaaataattttatttttagagtaactattacatcgaagtttgtgaaataagaaataattatattatgagtagataaagtgaggaatagttgtattgaaattcgataaagtaggggaattctagtttttttattagtatgtgtggaataggtgaaaataatgaatttattttagaacggagataggacataacttctgcatgtatgttaatatagtgtctaaaagattaatgtttcttttttctggtccagcagctaccaatctacttctactataccatcacatgcctgcctatctctgacaataccttaccaaaatatcagaggcaccattttacagaaacacatggataaggaaagagcaacttggagaaaggggaacaaggggctgtggctcaaacggagcaacctcaagccgcggcttttgtgtgtcgtttgtgtgctcaattgttgagagatcggcttcttcttcttcgtcacctacaaactgctgagagggagagcacgtaagtacgcaatcaaggctgacacgctaacggccgacatcgcctacctgccatcaattaagctttagctatatatactaccactgtatagctaggtcccatgttgcgttggtgacactagctgctgctgtcatcacgcattccgaggaaacacatgtttttaattattttgttaattacaacagctttgatacaatttcgatcattttattcgttttaagtcactgagcgtttcaagagttgtccttccggctaggacaaattaaaatggtagtataagatattgttttttaataaaaatgaaacaatctattatttatttattaattgtctttttgttagatttctctggagatcagtacaaacttcttttggtctatatcctcgtataatatactccaactcatatttttggaaactggcttgtgggtattgataaaaggaccaataaattcattcttgtaggacaaatcactgtttaaatcttatatgtaggtactttttggaggcaacgcactagattcggttttggacgtaactacaatggagtgatgaggacatcaaacttattcacactgcatgctgcaacctaggggcaatggtttgcagatttttttcaacttcggatggagattcacaaatagggtgcaataattgtgaagtcttttgtctagtgttggtggttattagtgggtgcatcacttcatgttttcttttggaggtgccattatgaaattgtttgttgtgtgtgcttatcaatgaactgattttttaataataagctgtagctcttagagcaaagaccgaaattatattccattatttagaaaataatttatggtcagagatagatgtttgacataggataaatctaaaacgacaaataacaagcagtaattcaaaacgatgagaatgttcattcgatgcgtttgtaatgccatttggacttctaatacctatgtggtggtttgtttgcacattccaacaaattttaatgccatgaaagcattctttacatggatgtcgttgaaggtgtatttttaatacatccaatgtgaattaagatattgatactcaaaatttcaatacataatattgacattgctgttgttttgtttgtctcaacggttttcaatgcatatactagcttctcgaatactactacattttggtggtcccacggtgaaagaccagcagatgcctgcattggagatttggagctgaatctgtatttctagagacagaatatgctctttagtagatttatgggctacgccgtttgcttacatccataagattaattggtgagtgtataattagtgatatgtgtttttcaagctctttaagtagcttatggattataggcacacttct

SEQ ID NO: 98131 - DNA, 609 bp, Oryza sativa
atttactaaagtagaaaagtaataaggtgccaaaaaagaaaaccaggtggaggggtggtgggagggaggggggaggggatcgatcactaccccgtctccaggcgatcgatcggccattaggatcccccggattcagcctaataaaacatggcccaagtcccgtgtgcaccatgcaaccataatgtggatccggccccataaacataatactaagatgacttgtgacttgtgagtgagctagctcaaatattgtagattaatttaaaactgtttcaatatatatgttgtctcccagctcactctcattagttggtcttgatgtagttattttgagcgtttcttatttactagtggattcataaacattgtgaaaaaaattaattggccacgtgtaggacccatcttgagaccaccatcgtttggcctaatataatatcagcaacgaaaaaaattaacatgcgggtaaaatttatatatatgtatgtccttatgatctaaaagacaatacttaaaaataaaaatcctaaaagtcaaccctaaattaataatcaaattctagcaacaacttataatctaaaaggtaaacgatggaaagctatgtataacaat

SEQ ID NO: 98132 - DNA, 593 bp, Oryza sativa
gtgccttgctaagatactagtaaatggttatgaactagaaaaatattatcagtacattagcttcatcacaatgtaatgcaacaacagggagaaggtgcactcacagagctgtagacgagagagagacgaacatcgcgggcttccgtaaaatactgcaggagtggcagagagtgtgaaacgtatccatacaccatgacaaagacagcaagtgtatggacgtttggcattgctctgaatcggactgaactcgaacggaaaaaatcaacccaacgaagtgtccccagcgctggagcaaagatgtcaaccattggcatcccccacaataagcaagcgtacaaatctagttctgtaagcgcaggagcagaaatggtgagctgacgaatcccttccagtcgagacagctgaacaaggcggagagactccgagcggatggctagattggacaccacatcggcatcgcggatacggagctctcgtagcgacgggcacccctccgacgagacggcgcctccgagatcgcgctggctctggtcgtccaacctgcagtggctcagctcagcgcggtgagcctcgcgaagacgccggatggtggt

SEQ ID NO: 98133 - DNA, 585 bp, Oryza sativa
ttggaaaaatagatttgtctcaccatggtgattcaattggagataatgcagtgtaatattatttggttcttggtctgctttagtttcttggttgatgatcaacagatgattaaattcatggtggatggaaaatgcaatcactggagattaaatggctagcatttgcgtttgatcaggagatgtaaaggctggtgcatggtgaggtggataggaagaaggtggagatgcggctgagatggaaaactgatttggttgatgatggtgattcaatttttgtcattcaagtggagaaattaattagggaggagaagagattgcagagatagaatgacagggagagagatagacagagagacagaacgtgagagagattgagagattaatacggagagatagggagagagatatatatagaaccaagagttaaaagaaaatgaatgtctcatcgtgtttgattcatttttttaatattagtggaggatattgattggggattgaaaaaggtgaaactaatgggagagagagagagacagaacatcagagggagatagagacatggagatcattacagagaaaaaaaaaaga

SEQ ID NO: 98134 - DNA, 754 bp, Oryza sativa
ctattgctacccaagattgttgattcccagcatgaacatatgctgcgagatgagaggcctcagtaatcgcgagatgagaggcctcagtaatcaatggttactgcttctgataaaaagacagtataaagtggggtgtaaccttgaactgtattcatttcaccattatcaacattggaatgaactgctgcaatacagaatcaaagaaaatttgagcaatagtagcaattaatttgcttgtaaaaggtgtatgtttaaagattaatgtaaaatctatggatgtaaaggaagcctgactccatttttttttctgaattctgttcccggattgtttactattggcagttcagaaaactgctttctctaaaactaatccagaaggataaatgtttctcatggagaacaccattcgtttcaaaacaatcagttgactcgtaagtgttgactactcatgagacattcacttcttgttcaatggattatttgtaaaggccccattatttaccttatatgatcagccgttgccaaaatttaaattttaaattgattttgaagttttttggttaaaatttatttttccgcattagcttttaaattgtttaagaatgtatatacaaaagtttaactcacgtattattattattttgctactagtgcgccatacggcgtattatcctcatatgcccaacagatgggggcctaacctttttcaaataatgataataataattgctgaccccaatcccatatgttttat

SEQ ID NO: 98135 - DNA, 696 bp, Oryza sativa
  unsure (1)..(696): unsure at all n locations
gtacagnagttcatcagaacagaaatgtctttgttactgatgaatcttgggttgaaaaattggagatgttgagaggttacgcgatgccgattgcgcaccccgcgtgtaagagtttgcgcacgaatcgatcagccgctgcgtcttcaacctgctgatctgcgccgcctacaccaggctttacatattcgccaccgtcgagttctccgcgagagccgtagttctcacagcaatgtaacctgaaacgtgacaggctctcaatcccattgatcatgacatgaacaaatgtgtgctattgtgactattgagttggatgcgttaatcaggttaccagaacttaagctgatgagagaagacggacaattcaacgacacggacggttcagagttccgtacatttgggaactctgaaactaagagatgagagatttttttgattgactgattgattaccgtgcaagttcattgtgccggtccagacctaggagtgcggctgattcagcaccgggaaagactcgccagagaggctcctataggctacctcgatccgggccgtcaatcaccacgccggagacggtgacgatctcgacggacctgaccgcgacgacgtacaccacgcggacgtngagcacgctgacaacctctgccgatgtcgagatgaacgacttcaccagctgtatgcccatcaacgacgacatcc

SEQ ID NO: 98136 - DNA, 667 bp, Oryza sativa
caatttttctcaaacttctccccaattttaggagctaaacatagccctaatttattgaatactagtaacatacccctatgttataacgaatcagacatgtataaggaaggataaactataagtgtgattgtagggtaaaacttagatcaggtcattacttatatgatgcacgtgggcgcgctgcgcacggtgggagaaggggatggaaagaggatgaccctacttttaatatagtagagatatactctttgcaattttaaatttttgcacaagtaaatagctcaagtgactttgtttccatttgtttatactaaattaatggctcctttgaacagtatgattttcctagaaagcatggattacaatccctaagaaaatttcctatacatatgcccctgtggattgagttcctatgccccacttccttgggaaacttaaacgatgagctcaattgctcaaacttcattctttcactttttgaaaggtccaatgcaactcttctccatctatctactctcaaatgaatctaccaaattcctatatgtcttttctatgtatttttcatttgaagcatccaaacaaaacatctcatattcatgtgttttagggttcctttgatttagaggaaaaacaaaggaattttggagggttttaatcctatatgaaa

SEQ ID NO: 98137 - DNA, 792 bp, Oryza sativa
cccatgtgggaagatccattatgtacaaacttaattaatagtacaagcttagtactactcgattgatctcatcctctgatccaaccatcacatcgattattacgagagtaattaacaacaaggggaagaaaacatggtaagcttagctacctggagggaagctaattaaggttttgagccaataattgatagctgttggagaatgcaaagggtcgcctaagaatatacaaatgtgagctaggactctgacatctcatcacattagcctctcttttttttgctgctaactactaattgtatgtttttttaatttggatgtgacctgatgattgacatggactgcacttggctacatataggccatacaggaaatattgccggccaaggttgtgtttagttcacgttaaaattgaaagtttgattaaaattagaatgatgtgacgaaaaagttggaagtttgtttatgtaggaaagttttgatatgatagaaaagttggaagtttgaagaaaaagtttcagccctaggttcttttttacactcataacctgtatatgtatgtgcaacaaaataaaagacacgatattactatatatccccgttccaaaatataagagtgtatgcgaaaaagcatgtatcctaattgttgtagtgacctaggtagcatcttaagatcccgagttcaaatctccatagaaacaaattttagattgggttatttatggggctaagttcccaattaaaaggctgcatatatccggttggatatagaggctgggtaaaaaatatccttc

SEQ ID NO: 98138 - DNA, 1818 bp, Oryza sativa
  unsure (1)..(1818): unsure at all n locations
acatgtgggccacagggtctatggggcccacatatcagtgagcagtactgtatgtgcagtactgcagaggacccttactcgctaaacccaccctcagtatttaaactttgtgctcatgcaacatggcgaattgacatctttaacatgttaacattgcactaataactacaccattgctttgcattttttttagaattcgtatgtacgtgtatttgtttagttgtggagggattatggaggattggagggcatgaggttgatcagagcagtcacaaatcctgctgcaaatgaatgatacccagatcctgacttatgtgttgtaggaggttgatattgttgtactgtgttgcggtctctgatctatataagtggattgggtaagttttgttgcaaaattatgcaaccacatcatcaaacaattttactggtcagatttctactctgttacgagctgttggattcacagcatatgaaacctcttccatatcatgtctctagtgttgatagaatagtgcatacattaccagagcaggatggaagtgatatatggatcttcttctatcgtggtctaaatgtatattgggcaatgggcatggatacaaatagatgttctcaaggaacaagtacaatacactttgtgtgaantaattggagaataataattacatatgtttcatacactgctagtacaagatgtgaccgacttttccttgctggccgatggatggctttttgttgttgagtatgatgggtggctcgacatgtgatacttctagttgctcattactcattcttttgtcttgatttagtcctaaaatttaaatttaaaggtctaatgtggnactccctccgttcatctagttgacagntattttgaaacaaataagtgagcttgcggtccatctcgttacgtgttattggttgttagacatgacacgagatttgcttggtacgtgttaatgcttgctacatgatatcaagaaatacggcgcattgcacatgccctacatgtaaactttgtgaaagctgttcagaactgatcgagtttgtttgcatgacttatatcatgctgctgcaggatggcaacgggcaacatgttataaataaacagtttctctaagttattggttgagaatgaaaattagcatatgtttttgttttagagggtataattagcgattggagagatattggaggaaaccaaatgttaaatttaaatttggggtgtgtaatagttggttagatagtcagcaactctctttaatgtcatctattgagttgctagtagatgataaaaaaagttacgttaatttcatctattgagttgctagtagatgatagaaatagttgcattggaggtgatttgggatcatctagtctagtacaaatgttgccatgaaagatgcggtcgctaagtatgcattcaataataatgaactagtgatctatccaaatgaggtaactcaccaagatcgctatgttggagtccgaggagcaccacttctagtcgagccatgtcagactccgaggagcaccacttcgagtcgaaggccgaggcccggaaccatccgcaagaatgggtagatcgttattaggtttctacctcgaatactggtaagcacggttgttggcggatggcatgaggcccttcgaccaaatctgccgaaacccgtggcgaagactatggagcaagaacggcgtgaggcaaagagtcgtacgagtgccttgccaggccagaggcgtcttaggcgaagggtgcaagacgaagactatctgccgaaggaagacgacttcgccatggcaagttcgcccccgcaa

SEQ ID NO: 98139 - DNA, 946 bp, Oryza sativa
gagggggcgcgcgggccggtgggcctcgtcctgaggctagcccagcgaaggggtgcgggagggaaacgggccaccggcccaccaagtgaaaaaggagggggggaaagagaaaaagaaaaaggaaattgatttccagggctttaataattgcttgtgctcaattttaattgattaaaattatttctagagctctgaaaattctactaaaaatcctgttagcatattttgacatgtagaacccaagaaaaattacagatgccattttcgattattaaatgcatttattaaattagggtttctctcttgctattacacaaataatttcttaagaccatttattaattcaatttaggcttgggagaagaacttcaggatgtaacatccatgcactaataaactatgtcgttttccatgttggaaggaaaggttcccaactcgttgaaatgaacacagccttaatggtttggcattataattaatccatccaagcctgcgtctaatgtatgatagaagacttggagcgaggtgtgtgccacagtcacgttcatcctcgttgtatcttataaacttaaatttaagacctacagattcgtgaaaatgagtagtgagcaatgaaaagaatcaacggtccaaaactccaaaagcccatcatggcctagcaatgtgagttatcgtccatctatctcaatttctcccttctcattgcattcgtgatctttcctcaagaatgtcggaattttatattattctcacatggagtagtagtttaattcctgcaaactttctttttaagaaaaatcttcattccaaagtttttaccacattagacctttaagtttaaatttttgggtgcatcaaaacataagcatgagtaatgtgcacctgaaagtatcacacgcgttcgtcatggatttctacccacaatagagaaatcgggctgcaggaa

SEQ ID NO: 98140 - DNA, 742 bp, Oryza sativa
catgttgtaaattactttcatcatatatgtaaattacttttagatttgattaaattacttcctggatatttgttaaagtaaattcaataaagcctaaaagtaatttacacatattataaatgtaacatactaacataacacgaaatgaaagtaagttatcatggcactaaaagtaaatccgttgtaggggtaaaaacatgagtcttaagttacatgttcacaatataatcaatttctagaaattcaattgaatcaacacaaagtatagaacagaataaagacggctacaaaagtaacatgttcacggtattatcaatttctaagaagtaatttaatcaaatttaaaagtaaatacatttatgagaaaagtaatattgatatataataaaagatatttacaacatatatattttcttcattagaatataatcatgtaagatcttgctgtaaagatttaattaaacaaatacaacggtacaatcggattgtagatcggataagtaatttaagggaaaattttatatgaagtttaaatgtagcgggaatctttgtttcatgctcacatgtgggaaagtgatgcatattattttttggtatttattgaaatggtaattatttaagattaattggtgcacaagcactgtgcagtggtgtccgtctttgatctgtttgcgtgcaatatttatgaaaaaaggacaacaaaaccttccatttaatttggaaaagcaagctttctacaaaa

SEQ ID NO: 98141 - DNA, 679 bp, Oryza sativa
  unsure (1)..(679): unsure at all n locations
gcgtgtannnnntatagtatcctatgctnnnnnnnnnnnnnnnnnnnnnnnnnnnnnnnnnnnnnnnnnnnnnnnnnnnnnnatttagtcgataccggcagaaaccctaaaatgagaagcaaccgataaagctaaattgatatgttatcgcaaattagccttggggttatgaaatgagttttgtcggtaataaaacctaataatgccacgaacttacttaaaatatgacacaaatttagcaataatatatatttcatagcattacaaatccactaaaagcaacatttgagttcaaaagtgcaacttaaatagtttcaaagttgctttagcaaaaaccattccatacgaattttaaaggaattggtagaaaataatcatttatttcaaaggaacctatataattatttttcataagataaaattctctaaaatttctctggctttttccattgtttcaaaagagagcctaattacatggttgctggtctccgtcgacgttcatttggcggccgtagagcaagttgggggcggtcgatcggtcagactgtccaggccgggggcggggtcttctctgccgcgatcgacgtacgacgtgacgtgtgcggttgcgcgcgcgtcgtcgtgcatgcatgatattatgatatggtgggtgacgcagctacggatcatgccgggatgt

SEQ ID NO: 98142 - DNA, 543 bp, Oryza sativa
atttcatatgaggattacactaattttatgaagttttatgagctaatgtatagaattatgtttctatttcggttgcgagctagttacaaagtagtcccttttaattctctacaagttaaagctagtactctctccagtcataaacatttgatacttcagataagattccatcgaacttttggaactttgacatttagttacttttactgtttaacttttcaaactcttaggctcaaaacataaatatggcacgtgtgaaaagtactttcatgatcaacgaaaagcacattatgaaaagagcaatcaatgtataataaaagagatttttttcggtctagcaaaaatatctcgagataaaggtacctcatggtactacgtatatcgtttctgatcgttggatctagctgggtagaaaggcatacgattagaaacgatttgatcggaaacaatttggtactgtgaggtatcgtacctccagatactttttgttggaccgaagcaaatctcataataaaatttgcatgcacgcctacgtgccatttg

SEQ ID NO: 98143 - DNA, 632 bp, Oryza sativa
ctgttcattggatcctcgccgtccagcctttcagggcattgcttgacgatctaaaactgtaggcgaacgtgtttttctgcagggtgaggagtacactcctcgtgtggtctgtacaatgtccaaagctaaagggatgagtaaataagggtcccggggcctcgtcttttttgcttatgcccacatatattagccaaaatttaaatttttaaccttaaatttatagctggttttaaaatttttttattaaagtctatttttcattatgtacttttagattttataagaacacgtatatagaaattttatttataaattacttttcatttataaatatgtcgtttcgcttattctaggtataccggatcgaaatccgcttacgaccgatatcatcgaattttgtgaaatccaatcaaaaacttccttcaaacttttaactttccattacatcacatcacatccaaaaattttcctactcacataaattttcaacttttttttaaactatcaatttttctaaaatttctttccaatttcagaaactaacacaagccaaagttaactttgatcgaaaacggaatgatctggttttcaaccccggtcaggaaactggatttcgcgaattcaaatcgatt

SEQ ID NO: 98144 - DNA, 703 bp, Oryza sativa
ttcctgcagcccttgttcctgttcctgttcctgttcctattttttctttttctgaaaaaaatgaattttagaattagcatgcaatattttcattgcacgagaaaaataataggtgcttagttctttgtcatcggttcatgcatgccacatgacacctcttatcttgctgtatctatatctgcccatgatgtgctagtttgtggtactagaactaagttcaagcatacatcttttagggtatgtttggatcctaggcaagagaaatcttatcctagcttagcaaggacagcagtttgctaacgacaataaaaatcttacttctgtgggaaagcttgcctataactgcccaggaaagcttgcccagcttgaaggacataaggcacttctgtgtgacagttgatgcatgctaggctacaaagccaaatgttgtgcttagtttctttgagctatggcattgctgggccaatttgtgctggatatgtgatgcgaactgataataagatataaacctacccttagtttcgagctgtgttgtttcaattaaaagcactggttgatctgccagccggcaatccttggttgtctgcctgcgcctgtaggtgaaccatcagcaaacctttttgtgagttgaagatagtatttttcggtagcctttgctagacttaacaaagctaaaaacaggattcctcaactgatcaagaat

SEQ ID NO: 98145 - DNA, 731 bp, Oryza sativa
  unsure (1)..(731): unsure at all n locations
cacgtgattagattgcgcgtnnnnnnnnnnnnnnnnnnnnnnnnnnnnnnnnnnnnnnnnatcccaaaaagatatatcactactaatggtgcagacagcatgcatccatatatcacattcgctagtttgcacagctggtttggatatttcatcgtccatatattcgttgaatcattgaacaccttacatgttactagatgcatacctttggaccctccaaaacaagagaaacatgttggcaataggatggtccgtttggacgactgaaaatcagtgtgtggttgcagcttgtgcatcatctctagcggcctagcttcgtctgtaccctgtgtagtatagtagtaaataacgcttcagtccggttcaaacctccggcgataggccttcgcttcactccgtccgaagttgatcgttaaatgtgtacggagtacaaataaggatgtctttagttcaacgcaaagtttgaattttggttgaaattgaagatgatgtgatcgaaaaattgtgtgtgtatgacatgttgatgtgatggaaaaggactgaagtttagatacagcctaaatttgaattacaacccaacacttttaaacttgttcgccaggttgattaatttgtttggatgattttgactaactagagaggagtacggacagacacgtaatgtgacaagactagggaacgagccgggacatccataaaagtaaccgtaagtttacacatggttttcagtg

SEQ ID NO: 98146 - DNA, 674 bp, Oryza sativa
ctaaagaccaagtttttgttggcacaaataacatgtcgcaaagccttaggattatgtttctccaattttcttttgctgcccaagttgagatcatcaggatctgtttccttctccatatggtttgcatcttgcggtaacaatggcttgtctttctgtgaaaattccatgcagatgatgcaaatgccacgcggcactaggaaaaaaacaaaatggacctagcgctgtggtaggggacttatcaatgaagcagtggcgcctagctcagtgacgccaccgcagtctcgacttccaatggcgttggactctcatgctggtaccggttcctttctcttccatgccactgctgtctacgatgagcctcatcaacttcagtgccgccacgggctcgccaagcttcggagcttctaatcaagtcctataccttagcactaggcccattggcgcttatggtgagaggttagcatccacatgctgagaaagtattttctacacctaggtgctatggcacttaggtatatgcatgcaatttaaacaattatataaaaagtttatataatttaataagataggccatgataattaagacactatacaaaaatgcaagtctaaattcggtcgatgtatgaagaaacaaaaataacaaattttatctgcgtggtatgagtactattcaa

SEQ ID NO: 98147 - DNA, 511 bp, Oryza sativa
gctgccgatctgccgttgctgctgcttgtgcgttgctgctgctactgctgctattggctgctactgcttgttgctgcagaagaacaggaaggaggaagagaagggaaaaaaagttagaagaagggaaatttggggagtttggtggatatttccaaattctttgtttttcttacaaaattagtacttctaggtaatccgttttattccctagttgtttctaatttatatataagacgttccgtttctggtagcttgaatttatttttatagaacgctaggctgaaaccgtattttcaattctggtattaaaccatcgggattcaggttagttgtcctaaataaagtttgtagttatcgtcgatatctttctaacactgctagtttcgttcgattctgataaacagtttgggagaaacaacaaaaacagtactgctgaccgggtccggaaatcaggacagcaattcgttttccttaatctgggattttcataggcataatctgattttgtgcc

SEQ ID NO: 98148 - DNA, 537 bp, Oryza sativa
ccttgtggttacatgtcactcaaatggttatgaaaaaaattaaaaaaaattaagaagatatattaacatgtgatataccactccacaaacatgtaagttcaaatttaacttctaaatctcataacaaaaaaataaattttactgtgaatatatgttaactagctgtagtttaattttttttttgtgagatgtacaaattcaatttgaactggtatgtttctagagtaatatatcacatgttgatacatcttctaaattttttttatatttttttataaccatttgagcgagatacaaacccctcaagggatcaaaatccactctcaggaggacctgtttagatggatgttattttgaactatataattttagtaaattaataaatatttattttgttattaatactattggaatgtggggatgttatcagcgtactaaaatttggccattgctaaattttggaaatgttatttttgacaataatttgaacagcttgaaatgccacgtcaggcataggcaacattctgagttattcct

SEQ ID NO: 98149 - DNA, 592 bp, Oryza sativa
tgtattccaaatgaacacttttatgtcatgaaaacaacagcaaattaagcacagaacacgttatgcatcttgagcatctaggagtgtagtacagtagttgtaacttcgtcacacaaaagacttcgtaacctggataagtacagctagcttgttggttgttgccttgttcacagttcacatgcatagtagaaccataagctaaccgagagaacctagatattaactgagaaattaaagggtcatgcatgatcatgtattgtacaatatgaaagtgatttcatatccctcgagagttatcccatcgttttgtgtatgccatctaaatagtcataaaaaaatttggtaagatagattaatataaaatatatcactttataaatatgcaagttaaaattcaacttctacaagttgtaacaaaaataacaaatatagcttattttgttacaacttgtagaagttgaattttaacttctacaagttgtaacaaaaataacaaatatagcttattttgtttttttggtaacttatagaaagtggaatttggtctataaatctttttaaaaaaagtttattactatttaaatgacatgta

SEQ ID NO: 98150 - DNA, 633 bp, Oryza sativa
cccctttgattatatcctgcatcataccctctattccggtatgacttgctgagtacagtggttgtactcagtcttgctctattttccccaaaaccccagagattgagtgcgtgtcagatggtggcttctccgaggagtaggcttcgtccgtgccgtcgaggatgcctgtggagtggtgttctcgctgcagtccaagtcaaggcttagctccatttatcttttaattttccgttgcatttatgtaagacttttataatgtttgtaagacgtggatctgtatgtcaactttgtcgtttgtgtaccccggccggtcctggacgggggtttaaatgcacattctgcttggaattctattcgggaatttctgggcgtgacaagttggtatcagagccgaccttgaccgtaggacaagccaaatggaaaacctaagagccctctgaatccttttcattgcatatgttcttcgcaatttgatttgctccgggaaaattgggatttgttcctgtggttcaagggaaaaaagctttgtcgcttgtttaagtgagatttgtcaaatcaggtcagtctaggattttagtaaaattatttgaggtttatttgacagtgaagtcgggattggatgggaggaatgca

SEQ ID NO: 98151 - DNA, 530 bp, Oryza sativa
ttcagtactgtgtatgcatatattgatatatgggaaacctgatcatgaacgagacggctggtgagatttgacacgcaacttgaccatttcttggttggtttggacatctcactagctagctgaactgctagatcgttcccaagaaaaaagcagatggatcgatcgatcattttgaccaaggaatatgcatgcagggcctatcaatacaagaacgtttgtacgacgttttgcaagctagtcagccagccaaattaagccttttggattcacctgcacacacgtacatgtcagacagtccgagtcggtgttaactcagtcatggagatttcgatgggtttggatgaagctgactttccttttgatttcaaaggtagccatcgatcgacaccagcaagtaatagcagcttgcattggtcgacgccaattaatgaccggtgcaacggcgaccatcgcggattaattaactagctgttgagaccaagtgtcgttgagtctaagagtggattttaaactgttgatagaacgtttac

SEQ ID NO: 98152 - DNA, 506 bp, Oryza sativa
agatgatttgaactgaaaaggtcatcaataacaaagtggtataactcatcaatgtctataacttttatttggatcatttctttatccgacaatgtgatttgtaacattgttcacaaaatgtacatatctcttatatagtttataaactataagagagatatgtaaattttctgaataatgttactatcactttaccgatgaataaatgaccaaaataaaagttatagacattgatgagttatacaactttgttgttgataacattttcagttgaaatcatctagtatttgaaaatgctatttgaagttgtcaaaatttgaaatttaaattcaaattattgaaacaaagtcacatagcaaaatgaccaaaacaaaagttgcagatattgatgagttatacaactttgttgttgatgactctttcagttgaaatcatttagtatttaaaaatgttattaaaagttgtcataaattgaaattcaaattttatataggtaaataaaactc

SEQ ID NO: 98153 - DNA, 711 bp, Oryza sativa
tttattcatatttatagtttcatccggttctaagttactatatattgagatgaaaaaaattaccttgtactttcttctttgtttcatatcatcacaaagatatatctgaacaaatatttgtccatatacgtctgtagaagattagaagttgattttttagacgaaagtgtatgcaccaaattgcaacttggtctcatccaaaatggccatgtgtcgtctttcccaatccctctcctttcctttttcacctatcctcttcgtttctttgccaccccccttgtccatgcatttacacatcgctaaatcataccggtggtcaggttacaagtccacaacgagtcaacgaaactacccagctgagctaggcttgatttcaatccaacaaatatgaaataatgaaagtgcactgtagcaacaggcttgcaggttgtaacactgcttccccgcaaaaaaaaaaaaagttgtaacactgcttatcactgtgctggtttctctgccgcaacacatccagcaagatgatccatggatcatactacatggataaccagggtgtgctcacagctcgtgtgtacatgtgtgtgtgactgattgatgtggcttcgatggggctcacaaaagttggcgttacgtgacaattggctgaaactgtattacggagcacgaactcgattggattagtttggcttggttcgttcatagtagcaactagca

SEQ ID NO: 98154 - DNA, 654 bp, Oryza sativa
cagcaaaagatgcttatacttgcttggctgagagcgaacccattacctcgcagtatttagcacctagagttcaccaagctttcttgtctttgtgtgtgcaatggaagcttgtagataactaatatttgtaaattgaacaaagagtatttggcgatgacctcggatgacgtgtaaaatccgtgacacttcggatgacatctcggcgctaatctatatggcgctgagaaaacggcctaattttgaaattagtttttgggatgattcaatttcaaaataagttttttaaaagggtcaaattgtcaaaattacggtaaaaattatccacattcacgaacaatggatcaaaatgccgtctctcacatcaatctcatgcaccttgcagtgtttcccgccggctccgccgcccgtgcgcgtgtgcctccaacacattacctgcatacttgcatagtgccctactgtacatatgactgtatcactggtcactgcatgtggcgactcgacatggagatggggggcctctcccagcctcccctctcttgggctttttggccgcgagccaacacaggcacacagcgccgcccgctgtagcgcgacgtgcggccgatgaatgtggcacggaacgtcgcgccgggcacgacaaaagcggaagggcct

SEQ ID NO: 98155 - DNA, 1362 bp, Oryza sativa
tttcctgtgttaccaggcccaacatctttggttctttgccctttagccctaccacgaccagaggaggttctctctttcttcttgctggtattactagtactgggactatcatgatcaagttcatctgtctctagaaagcttttccctgtaatacccttgatagctttcttaatccttttgctacgaatttttgcaaatctctcattgaatgagtaaaacgcctccatgcgtagttgagtctgcatgtgtgtgacacatgaaactgtaaaatttaaataacccaattttgcagactttggattgctgacattccggttaaatcactcttagttaaatgaaatccaagcagaaaagcatgcctattctattttcaaaaggcagcgatttcctaaatgaaaataacttaaagacaatgaaacgaattgtcaaaaacttgctttttacagatgcctaaaatgcaaatgttgcagaacatggcaaaccagcaccagccgatccaaaaaaaatgtaaaatagaggtgaaatgctgacatcttaacaattgatgttctcaaaccgtaaaactaacttactagtaactcatttttttagggaacagaattcaatggtatccataaacatattatcacatcaaaccattctataataggataaataatagttacagtcttccagagactaacctcgtgcttattatactctctcaaaacaggaattagcagttcatcagccttttccttgctccacccaaacctttcccaacataacctgaaggaactcaacattagatcttctgttgttgcgccaaagaaaagaaatagagcatgtgtgttttttcataatcataatccttagttttgaaacagaactaacttgtgaagaaaaagatcagaacaaattgtcaaggtaatgataaggagctaaaaagcacattccacatcataaaaacaaattgattataacatatcaggcagctaaaagtaacagaacactctgctttctggtaaaacttgtctagggttttgcgctccacggtaccagtctgaacacctaccagaaacaagctggtgctggcatatcggatatattttaggtttttgagcggttaatgccactgccaatatgttggactacattgtccaccactttccagcaagaaaaacattgctgctcttaaaaactgattcaatacaaaaaagtgcagggaaatgaaatgaacggtatcttttattgtttgctcgcatccatgagaacataaggttattcaagaaagcttacttgcgcagtaagcctgaatctggtcttccccaggaaaatggttctgttgaatcatcaacttgtggggaaatatatgcgtttatg

SEQ ID NO: 98156 - DNA, 654 bp, Oryza sativa
gaaacctggctctgataattaatttttgacttcttaatcgtctaattttattttatttattcatcttttttgaatcgtctaaatttattttatttattcatcttttttgaattattgcttcttaatcttctacgctagctctatgcaaccacaatctcaccaaatggcgaagtaatattagtgtctttttttgataattaatttttgctgatttatcattcatttatcgaatttgttcttaatgcatacgtacttaacctatctcatgagcacctctaaaaaaattggtccgtatatcttgagctcgatgaaaacatcacagacatataagctcactcttatataatacacacgtgtacatttggttctaatgaatacttttgaagattgagttagtaatatgttaagattgacgaggttaccggtcaccactggtgtctgtatatacctacaaattttgagttcgacgaagtcaccacaagtaatatggtacgttgtccaccactaaaaataattagctataaatacaagcacatcatagactcgctgtcaacatgtatatcgctaccagtgaaaataattactccttccggacatgtctcatgtccagattcatagtcttagatgggtctcatcccatcatagtttgctata

SEQ ID NO: 98157 - DNA, 508 bp, Oryza sativa
cacatcattgtgcttcaaatacaagtttatagacaaatatagtaatatttataatattaaattagttcattaaattaatatttttttaattacatggtacaacgcagatactcacaacacacacgcaaaccatacccctatgagcatcttgccatcttcgaagactgggctggcaaatctatcctggagattaatgaagtcaccacagacgcctcgctgtagacaggtacgtcacttaccactgaaagcacaaagctattaaatcctggaaaattcgctcccattttcttaataaatttgtcttgggttgaaaatgctattatttttgtacaaacttagtcaaacttgaagcagtttgattttaaccaaagtcaaaacgtcttataacctgaaacggaggtagtaaaagataaattggattgtccattgcttcacaatccttatagggatctctgtcttctaaaataacttacactcgtcctccgcctccacttcttccccttcgcgt

SEQ ID NO: 98158 - DNA, 651 bp, Oryza sativa
ctccacggcaaagctcaagctccccgacaactaagccagcaactgtccctttgggtgcacgatgaggcaagtcataccaccgatgcctgaattgtaggtaactgtccaggaactcatgcagggaagtattctgtgccactgggaaaaggtaacgataagcattaaaaccattggtaaagttcaaatgcacgcggatttattcataagttaaattctaggagtgaaacaatggataatcacagatctaggcgtgtcctcaactcaagcttttatgttgactcatctactcgctcaattattgttcaggcttagtttgcataagaaaaaatgccaaattcctctgattgtagggtagttattcctgtcaatctgaagttcctgtcaatctgaagggactaggattaattccttcccattaaaactatttcaaaggatcataggtcatgatagtgataagaatatgattgcataggctttgctttgcttatgcaactactagccacttcaactgcaaatgtagtaataaatttaactgcacgcattttatcttgcgcttaaaagtgcaaactgacatttgaacaagcatacactagaattttacacataatccgtagccttagataatcacagagaccgaagcatcagaagatg

SEQ ID NO: 98159 - DNA, 560 bp, Oryza sativa
tgtttaatatagtaattttaaacttttatacagattatagaaatacaaggactaaaataagaaaatattagaggctaacatgaaaagttgaaactatttcacgagaacaccatgtattgtgagggattttattttagatatatggtctcaacatatatgacagccatgtgatatcaagctactcaatgagaccacgtgcactgtaaatgtccttaatatccttaaaaagaaagtagaaaacatgtcactatactccttcaagacagtcacaattttagtacctctcgtcagatagagaagcatccaagactaatcactcattgtcaattgtttcttctggtttaaatcacgcattgacaattgtttcttcttgtttccgcccgttccctaaggctgagttcttttcccaactttccaaactcacctcccttattttccgcacgcacgctttttaaacgattaaacggtgtgttttctgcaaaaattttatgtgtgaaagttgttttaaaaaaaataatattaatctattttttaaaaaatattaataaatacttaattaa

SEQ ID NO: 98160 - DNA, 643 bp, Oryza sativa
cagtccaataataacagtaatgagttcaccaacacagttccatcggtcgctccccaatcagcgagaagatacggcagtaaactagaaccattcactgtatcagactggttcctgaggaaggggttagttaccgagcacgaagaaagcgacaaagaaaacgtacgaaggcgcggttagccggagaggtctcttcgtcgtatccattgcgagaagctgcgccgcatccacctccggcggactggcggcgcgccgcccttcccgtccatcgcataggcggcggcggcggcggctaagtgggttttttcgcgttccgcgcggagaagaaaagctgaagagccgtttccccgtctcttcttcattacagcgacaccaacgttgatttccgctaacgacacaggaaggcgtattctggataatgggcccacttgtcagcctcccgtgaaccagatccaggttcccaccaaacagaaaaacagaagctccaccactgcatcgtagtcgtcttcttcacgcgcacggcgcacccagatccaagcgtccatcgccgcggccgcatccgccatggctccgacggcgcccacggcggcgaagtccgcctccccgtcccagccatccgggtgcgccaccctcctgctccttcact

SEQ ID NO: 98161 - DNA, 711 bp, Oryza sativa
attcctgcagcccttttgcttactatgttaatgagtactccctccgtccccaaaaaaaaaaacaacttctggctatgtatctagacataggctatgtctagatacatagccagaagttggctttttttgggatggagggagtagtcggtaaactcagtgaagtcaaatcaagtactctgtggatagcttctattgtaaacatcaagaaaagtggaactggtcaatttctcggttttctcattaacattcttttaaagttggtcaaaaatgccctgtgaaaataagtgatcgacactagataaacataaaaacatctggccgttctatccagcaggtcttagcaacaaatccttcagatttcaagtccactgtgtgcgtctttactagttatataggaagcaaggaattggtggtggagttgatgttgatctaatgtgaattaggcatgaggtaaattatttttatttagacatgaggtaaattatttttatttgtgtaatgattgaattcatgtttttctttctttttcttttttgagaattgagataatgcatggacaaatatgctagtataccaagaggtccgaccacctaggagctgtggaagttgccaaccatggcttattgtcctgggctcctggctactctcctattagtattatatataacatgagtttaccactcacttgaccaccaatgaccgatttaaata

SEQ ID NO: 98162 - DNA, 1407 bp, Oryza sativa
tcctccgtcatctttttactgttgagtgatgccaattgccaaatggatgtctcttcatggagtatcagtgcatcaaatcttccaattcatggtttggtcatgtattatgtagcgatgcataagcaaacaatcatcggcaaaatttgcctttaactgggccctgggtggaatacatgaacgttgtgagacataccatcattggttttgaattgccttaaatgtgagcatcatagtaatgtctagtgcagtctcatagcagtgcaaaaccgcccatacacctggttgaacaacagtctcatttttccaagactagcaaaatacctacgcaaaaccaacaattttccctgatttcttgctatgtttggcttacaggaacaaaatcttgtttatattaccacaagaaaataaaataaggtgattcttctatgcttacaaagcagatggtcatagccagtaatttacgactgtgtcaaaataaagtactaatctagagttctagactatatgcaacaagggtactgaatggtgctaatacaaattaatttgctagtgagttcatggttttggaagatagcaaagttttaatgtgatacttatctgtattcactcctattctcttctctaatccgcgttgtatcgttccatcttagcatgtgtctataggacacgcatgacctactttacaaccaaatttgttatttccaagtttgtcttagtgcctaaattctactatctagaggaccgttctaatttttttaaagaaatgtcaattcagatgttggtttttttgtattgttatcacctctgtacatttggggtgttggttaatttccagctagtttgtatggaaaataaaatttagaatgatgtgttagtatctcacttaaaatgctattgacttcactagggaagatgctattggcagtacaggaatgagtgaagaatttgtatatgtgtttatcaagaccactcaataagtgaatctacagcagaataagtactcattagtcattttcaataagctaaggaattcttagaagctgctgcagtagcagcatattatttttctcaaagcatttcaattctcaaaagtttataggtcctaagtagctagtactccctctggtctcaaaaacaagttatttaagaatgcgtgcagtcacacaagttaattttgaccataaaaatcattcaaagtatagattttgggtatataaaaatgatattcaagtttgttataacaagagctttcataatattacacttgtgtaaccttttttttaatatgtgctaaagaactaggtagtcgaagttgtatatatttgaccatggaaagtccaaaacaacttggttttgagatcagagggagtaaagtactcctggcaatatagattctgaatcttttat

SEQ ID NO: 98163 - DNA, 644 bp, Oryza sativa
ttcagtcatttgctaaaaaaaagctatatctaattattatggttgattaatgaacggctataagttacaaaaccacagggtatttagctatttgtcattattagagttgacgtttaactatttgtaattcatgtgttggatcaggtgtggtaaatagttaattgtcacatataaggatggtaaatttagagatggttgtctttcttagagctaaactagaatctctgagatgagcggctgattattgttttgattaaactagtatggtggcccgcgcagattgcacggctagtatcattatatcttctctcatataatagcatatatgttttctcaacgtattattcaaatatattaaaatgacaacataattttaaattttgtactaactttacgaaactactaatgtgtaatattcatattgtattttatatacgtgttagttattaattatttttaatatcaaactttagtaatttataaattatattcctatatggactctagactcgtctttcaatatatttttttaattccgaattttcgttacctgtaaattatatttctatatagactctaggctctttttttaatattatttatttttaattctgaatttttattatttctaattgtatttctat

SEQ ID NO: 98164 - DNA, 1203 bp, Oryza sativa
atggttctcaagtgaatcatatgcactagcatactagaaaacaatgaaagacacagtcctcattatttatttacttttatcaatttatcaattattcaaattcatagaactcatgcacatttatgatttattgtaggttggctgaagatcataccgatgatattcttgcaagttatgcagttgctgcctcaagcttgctgcctcctgttgccaaagctagtaaaatgaacacattaaattagtatagctgggcggtttatctagcagccatatgttcttctcttcagctcatgaatttctatttatcataggtagaaagtggcaacaacattagtatgagctttccagtcaaaaaaaaaagacacattagtatgagctagcaacacttttgagtttacatgttctgaaaatgcataaggatttcagattagtgaaattaagtattctctagtcatatatattggacgttgggaggacaaaacttagctctcccaacatcaattaaaaatgactggagggagtatttgggtttttattttttaaatttctggtggtacatgtttgaatcgtcaaaccggtagtggttcctttgacatcatttgtcatccttctttaattaactagaatattcatcttatgaactactctgataatattcttcttaattacatcaattttttttcttttccatcttttgtgatgagaaccagggtttacgattccgacgaaatccggttggatttcgcgaaatttcgatattccgacgaggttcgaaagtagaaaccgtctgagatttcgagaagtttcatccaaattcaaatttgaattgataaaaaaaagagaaaaacaaataaaatcttataaatactatgatattcatagaacctattgggatataaatattcaaaaaaaaatgtattgtgtgtatttactgaaacttatatcaggaaagaaaaaaaataaagaattaaaaaaaagaaaaacacttacatgggtcggattgcatgtactaggcctagttagtagttggtccaaattacagattacagatcgaaattttgatgatttcgatcggaattttgccaaaacgactggttttcaagaacttgtcaacaaacttagggaatttgtattcaaattttgatttatgaaatttgttctgaatatagccggttttccaccggatttcgcgaaattctgaat

SEQ ID NO: 98165 - DNA, 1939 bp, Oryza sativa
agttacaattccataccattggttataaagcttaaaatataattcttttatatatataacaagtacatgatttctaaattgtttattcaagctttcttacaagtaccgtactgaattctccgctagctgcaatatggggtacgtattatatattttttagcacattgaactccatctatatatatatcgagcaggcagctataattaagaaaaaaaaaggtcatctgattaattttcagtcatctaaaaaaaataccataaattttccgtgatttttatacggtccatgcatgtcacactatataattagtgctgctaatagcctttaattatctccttacagaacacgggctaattacacgtcaaactagctaaacgtagctcagctttttggtggtgtttggggttgtgacgtccactgccgctagctgatggataatgcgcacgatctccaaagcaacatattaattatattagtagtagtttaattaagcatatgcgtattaagttatattccgtttttctgcttttagaaagagtataattctctagagtagttttcttgttttttattaagctgtaattttgtaatttatggtttttcatcctgcaaattttgtaaaagttgattatagcttcgctgaaataaggatcaaaataaattatattattaaataaattgattagtatttgtacatttctaatacggtgtcaagcggccagtattaatggtcacctccgttggcaactttttgtgataagttgacaagcacaatcgcagcacctaaaactttgcggtgatcctagagtcaccaaccacctcaatctagcaaagctaaatcaagatgggttttgaaaaactaaaccggctagcggagctgatctagatagaacgatagataactacccgtctcgtgggcaaaacggaaggttttcaggacaaacctacaaagaggtgccgcactcttgcagcggcggcggacgatttacggtgcaaatcaacaaagatggacaaactaaactagaactagaagcaaaagtaaaagaacgattcaattgatcgatagttgattgttctttacaatgaaccggccttgtctcttatataggggttagtcttgctctctacatgccctcgtccacgtccaactcgggctagaaacagatggaaacacgaaacatgccttcccgagcaaggaaacccgagacccgacgaaaacgaagtttgattcggactcggccggttagactggccacataccgccggtctgaccggcccactggcggcagtctgacctaccaacacacggcggtcagactgaccctctcagaggaaaatcggtagatcgtccaaactttggcaattttcctattttaattctagatgctaaatttgggtgtaaacaacctcctcttttggtattggatgttggttaattaattagaataattaaactaatgttgtggaacagagctgggaagggagtatactcaatgcggttttcagcgcgacagggtttgaagctaagtactcttctggtatttttattttcctttttgttatatatataggacgtattttaaaacctttcgtgaatatataggtcagatttttatccattataaagaaagaaaagaatagtttcgtgtgtaattaacctgacagaaggccggacgaagaacggcaggatgcacggattgggaactggatatatatgcagcatgatggtgacgacgacggcaccaccggcatccattatatcacaaggccaccacgatcgaccaccgggcgccggacaggagctagcggcgggccctgcatatgcccttgataatcatcaacacgcaatcatgacgtgatccgcacttatgaagaactccactatggtgatctctactcgtaataaaaagcaatctgaaccgttggggctgcaggaat

SEQ ID NO: 98166 - DNA, 1386 bp, Oryza sativa
atgcgaatgctgcatgcataaagctagggggccgaccggggcgggcagccgccggtggggatcatatgaacaagtggagtggaggggcaggcaggcatggtccaccaccggccggcctcggttcatgcgcccccgtgctgcattttgttggggccttgccgccctccgccgcaacagcatgcaccacccttttatcctttacatgcacatgcatgctatatgctaccctccggcttctagttttgtcccatatatgttgatcttgcacccaatttgttcataccttcgatcgatatatatatatctcccctcctacttgcgagcaaattaaagactcagcttaatctggagctcacattgggcctagctagccagctaggtacgtacgtaggtagtctttggatccagagacgttaactttagtctctatatttagacactaatttaaagtattaaatatagattacttacaaaactaattacataaatgaaagctaattcgcgagataaatttttaagcctaattaatccatagttagagaatgtttaccatagcatcacataggctaatcatggattaattaggctcaatagattcgtctcgtgaattagtccaaggttatggataagtcttattaatagtctgtgtttaatatttataattagtgtccaaacatcttatgtgatagggactaaaaagttttaggtcgtagtatatgtaactaggtatgtaaaataagtgagacaggagctaacatagctagatggatgtatgaggtatcatgtatgtagcatcatatcaaaacatgaaaaggatctagctagctagctactccctccgtccaaaaaaaaaagggcaaaccatgggttttcgtgtccaactttgactgtccgtcttatatgaaatttttttataattcgtatttttattgttgttagatgataaaatatgattaatattttatacgtgacttgtctttttaattttttttcatattttttggaataagacggacggtcaaacgttgggtatggaaactagggtttatttttttttaaggacggagggagagtagctcgagcaaactgtaggtacagttcatgctacatgtatatagtacacagttacacactgtgtctgtatgtccactctccatgatggatgaagtgaaatgtttgcctttgccatgttaccattttgtaacatgccatatgatctaggcccacatgcaggtgagcattttgtaatgcacgtgtccctcgtctctcaatatataacagattaaacattcctctccaaccaagtccacccaattttggccacatagatgtatttatggttagaatctaaaccagctatgtgataactaaagatcaagttctttt

SEQ ID NO: 98167 - DNA, 672 bp, Oryza sativa
tccagggattagagtacacatcgccgtaaagattgtccagaacattagtcccctaattcaagattttcaatctaacaaggcccaatatatatcggcacgcatctcatgtttatgttcttcacacatcaccagccagaagatacatggtcaccgttcccagcatgcccctctggcagatcactagattcccagatgaacacatcaagaaaacctcagctcaaaaatgatccaaggattcaccactctttcgtacttcacaaactgtcaaaatttcatggtgaattggcagtaatacggtgtatatactcatctctatttatgtaaaattcgtgtagggtcaaggtgagttctcttatataaagagatttgctcaagcatacatacctcgcaagagcctatacatggggataatatatgcacactcagtacacacacgcacgcactcacacactcatgtactcttcttcgctttcagttgatggggaagacgtggagattgattcagcaccacatagggctgctctgctcgcaaacgcgagcaacacagacgcacgcacctaaaacacctgcctgcttgcttgcctgccttcttgtctgcacagagttgaggcatcagcatcggctgcctagaatagctggaaaaagaggctcgttgagccatcaccgaacgac

SEQ ID NO: 98168 - DNA, 659 bp, Oryza sativa
tcactggtttggccggctgtgctgtacttgaaccaatttctggcagtgcttgagaattaaaggaattttatgcgacttatcatggaaaaatgactatgtacaatcattttcttacttagtgtgtttgcatgagcatgattcgagttgaaatcacaccagaattcaactttcggtgtggaattataaacctccatctcctcaaaaggttctaacagcgtaccgtgtatcagttcatgtttcatgggattaacctgaaatattttgttggtattcaactaccactcttatcagaggcacaactactttaagcagttaagcataccagcaacatcgcacagctacgaaagggcatgtagcctagtggttacagtgacctgagtacccaaaggtcctgagttcaaatctcctatggagcgaatttcaaattgggttgtttgcggggctaagttccctatctcaatagccgtatatatctggttggatatgtaggccgtatacagctgcctagctgcattagggcatcaccaatgtttactagctactttgtgaataagggttactactctcacaatgtatataacctgttagtagtagtattttattccttactacccactttaaatgcacattgtggatgcccttaccagatgataacctat

SEQ ID NO: 98169 - DNA, 1264 bp, Oryza sativa
atttgtaaatatgcatatcagtcgagacggcgctacagaagcgagggggcggaggcggctaccgcagccgtcgcaggcggcggcggctgatctgctcctggacatccttcgccaacacctgccgcctcccacctcgtgcctcctccatttgctaatctgcgtctttgttgtcctcttatacgtttacacatcgctcgtccttattttcgtcgttcggtggctcgtcggagctcggggagacatgctcctcagccggtgcatcccgtctgccggtattggaaggcaatggtggcgcggtccctattgcggttgccggcggctgatccatgattgagggcgaggagcctgcccgaggaggctgaggtccggggcgatggtgacaactgacaacagatcagtgactgaaggtacagggttaaacttttgggtttagccgatttgatcggacatcactaaaataccaaaatttcggtctgaaattttcaaaattttgaacaaaatttatttaaatttgaataaatattatcaaaatttatgaatttttttaaaaaaaaaattgaccaaaataatatcttatcgaagggatccaaaatgtccgaaatttccaaccctgtgaaggcgtggagatggcgcaaccatggctgttgtggttgcagcggttctggctgtgagaggcactgaagcagcatattattatactccctccgtcctataatatagcaacctaggaccggatgggatatttcatagatgtccggattcgttgtactgtgtcccatccggttctatgttactatattatgggacggagggagtacaagataacctcctgtccatccatttcctcccccatgcagatcaagtttttttttttttgaatggatgcagatcaagtattgatatttgattgctctattctgtgtcgattgttgtaggtgtatgcgaaacctgaattttgtacgtagctgtgtattgcatgactgatgagatgaataaaaataatttactccctccgtctctaaatatttgatgctgttgacttttttaaatatgtttgaccattcatcttattcaaaaactaaactatatgtatacataaaagtatatttaacaataaatcaaatgataggaaaagaatcaataaaacgaatgatcaaacatatttagaaaaatcaatagcgtcaaatatttagagacggatggagtagcatatagaggtgccatcgcctttgactacttggcgctaccgcaagagctgggcgcg

SEQ ID NO: 98170 - DNA, 1106 bp, Oryza sativa
agatcttgtgttgaagtgagaggtgactcgagtcattgggtgtgattcgtgaagttagaatgaaatgggatacagtatgttaagcattcgcccacattgcctgctacgatctgttacctaagtgattattagggggaaatgattccagtgtttttgtcttcaaaatttgcgtgctactatctgttaactagctgtgtgttgttgcctcccttcctatgcacatactccctccgtttcgtttatttcacatcgtccgacactcaccatgcatgatgtactaagaaagtagggaaagaaggaaggaaggggcagccagctggaggaaataatcaaaggggtcatgtgtatcagttgactccggccaaccgtgtatcaaacaagtgtggaaaagaagtgatgttatttcggtggattcagacatggatccaagtatccaaacgtcggagttcggtagtgttttgtttttttctttctatggctgccggcagtttgtgtttgatatatctacgtgaccatgcatgggtggttttctgttgaaatgtcattacaaagaattgattagtgagcttcattcgcatcaccatcaactatcaattaatggcatatcatctcacaaacatactggtattgatgccccattgcaaacgttctcctactttcttgtccagcttggcatgtaaagaaagaaaaacatggtccatgacttgtgtttttcagtagtgaagacagggaccattgcatgctactgtaccagtaaatgaaagtgtttttttgggttcataaactcgttaacaacagggcagcatatctttggggtatagacaatctaaattgaaggagcaaattaaattaatactccactcggttacaaacaaggtaattagtatcgagatacaaatataatcgttttgatatcgggatattaacataggatcagaatactatcggattttagaaagtacatgtttgtatataaaatatgtaatacgttgtataaactaaagcatgtagtattgatttttgtaaatttgattggtttttatgtaaatatgagcatattatttacattatttcaaatccaccttattttaaataatatttggtat

SEQ ID NO: 98171 - DNA, 562 bp, Oryza sativa
tactacttgccgcaaagctctaaaagccaaaaagttgctaaaagtacacataacccagtctggccaacaatatcacagagaacaattgacagttctcatattgtaatgcgtccatactcttcccaaaaaagtgaggaagaacaaaaaagaactactgtgaataatatggcgtactccagtaggagtatatctatagttaacttctggacatgtttaataattgaaactatatatacacacacatactactagctaaagcagtaatcaagcatactgtgtaccaacagtgtttgcagcagtacagcaccctacaactatatagtttggtcaattcaacatatgtacgcgcaaaagaaaagtcaggtcaatttgagtagtcaacagcaagcatataaaagtttctcaagaaagaaagatcacagtctccgagaaggcaacaacagacaagtatttctctatatatagagattcacatcactaagctgtcttaccgtaacagcaacccctaagagaagcagcctccaccattaggatatatagctctactattcatgtacgcatg

SEQ ID NO: 98172 - DNA, 636 bp, Oryza sativa
tcgcggttattaagcaccgggacatttaattacacttggctagactgtaaattcttaacatgtgtgggatgggatagtgcatgatgatttctatactgatggagccatttcctgagaggagggaagatggacgtcttcagaaaaaccaatgacgactcaatggccagaagctattcttgggatcacaatggatggtggatagaaccgtcgttgtttaatgtgaacactggtactaaaatttgattagtctatgctaggtcttaggcttgtgaaaagaattacaaaacttactttgcgcaaaagaaccatagccatcctttgaatacccctatcatgtgcattgttgctgtggtggcttgctgagtacggttggtactcacccttgcaatatataaacttaatcagaggccggagatgaagcttcggaggatccctatgactattaccaggagggtgatgaagacgatggcgctcagtaggtcttagttacggtcgttgcctgtggcaatggcgtgccgctgccttaactccgctgccttatctacttctgcttttggaatgtattccggaccgctcagtccgatgatctaagactatgcctgcgggcttatgatgtaataattcgcactagactct

SEQ ID NO: 98173 - DNA, 642 bp, Oryza sativa
attattaagctaagacagcgaatggctgacgtgcgtggcatttgtctcatgctgctgcatgccactgttgcgcgtagtacagacatcacaaaagtttagttttggtgagttgtttgtttaaattaatcggctaatctgtgttcatcactgccatgaccccatcttgataattgacgactaattctggatgaattgtcctaattaaagattaattcattgcacatagcaagagagatgcgccaaaagattcctgcatgcggcgtgcaatgatattgatcgatctgtatttttatatgtcccatcaagaacactttttaggggggacgtccgatgattattggggctagctaattaagggcacaaattggtgattttggagtaagataattaattggaatctaatgatccatgtggtagagtagaaggcaaacctggattaacttgatctgattagccattggatatatatagctggtttcaggacattgttttgttgatcatcgaggaaaagaatcatttaagctgatccacctcactagcccttgcatgattagtagtactgatatttgagagtgctaatcagttctaataactgactattacggcttaagtacttcttcgtcagttcgtcaccttaagttt

SEQ ID NO: 98174 - DNA, 687 bp, Oryza sativa
aacggttgaccgtgttcacaagaaggctgacctttcccacacaggaccccatagtagttgactaaaccaagaaactacccttgggaaaactgcaaacagtattagagtgtgtttcaatcaggaaagtgtttctgagctatgaatagaaaacaaacaaaattcatgcagcaatattaggtgatagccaataacagaggttgtcaaggaaagaagagtgaatgactcttcaggtcacatatcacaagtaccaagtcaaagaatgaatagtacctagtctctcacctaagttcagttcagaacataactttttttttagaggttgttcagatagtaccatcttatcatcaacccatgatacaacttccaaacatctgctagattttacacagcacagatcatagtcctaaccaactacttgatgtatgaacaacataaagagctttagtctcaatcctagctggtatcagtggtaggacaccatttaggaccaagaatcaatcacctacagggtacagaatcatagtcatcaccccatttcacctgttcttttctttcatatccacatccatcttcaatacaacgacttcttccaaactggaagtatggagcccagaaggcaaagaattgacagagttgcgaggccaaaaaaaaaaaaaaaggaaaaacgccaagcatccatggccatga

SEQ ID NO: 98175 - DNA, 510 bp, Oryza sativa
agttctttggtatatgatatgaacagggagtagcccagattaaagtgtttggaggataatgataaccactgatgcatgctctgttttcttgcacgcactgtaaaatagtttgcattggaagtacagtattacaagtttttgctgtttcttgatgaacctaccaacaaagcattgctctccatgatatgagttggcatgtttaattagtgttgactcttgcctgttaagagagaaccaaattgattaatgccaaaaatgtatccatgttggatgttgcttatatctttagacttaaaagctcaaccttcctcctcccttttaagttgcactgtttagagttcttataactcttatttgccagtattcaaaatttctgctcaaatggacacactatgttatctactgcagtaaattgcgcctgcatatgttttcttcttaatgaagtaagaaagtgtgatctttatgttcccatacaatgtactataaataaagaattggtggaccatttgt

SEQ ID NO: 98176 - DNA, 610 bp, Oryza sativa
acgccattgatgttgcacactctcgtcctccactgtagctaggcagctaggcatgttgcaactttcagtttcacctgaatttcactttcgggcgtgtatgattgctccatgattctttaaatcagtccaaatggttaataaataagttacaagattctaaaattcaaaactgactgtggcttataaccaaagctcaaacagaccgacccagaatttatagaattcgtagttatatatactaatgtcataaatattgtataaacgaagcatataattgctcctaaaatatgtagaattcacataggaccgagcatagaagcacctctcatagtctcatagtctcatggaggacaatgatgtgaacatcggtggatcctaacaaaattcagtgtactatgctacacctacataagatccaacatgtgctttccttttccttttgccttgtgtttacactgtcagtgcaactaataagatgcaaagaaagcatgtaaggaaccctaggattaggttgtaaggttgttgcttagagcaaatcatggaggagcaagagcagcgctggtccaatccttcattactgctgctactacctagcaacagaatgagacga

SEQ ID NO: 98177 - DNA, 814 bp, Oryza sativa
tgggagctcgacaatgccaaggtaatatccattgcaccctcaagcaattctattttcattgtcggtttggaccgcgaaggtaattgttttgcttgtcggtccgcattgtcgaacttaaccccccccttttggtttaggccaccaaagtaataattactctttcctatcaatttaaagtaatacaagtagatgattttaaattgataggaaagagtaattatatagtaagcattcgtttgcacccttgtcttatatggttgagggtttttcgactccactgagagcggtcttagtgttatgtttgtatgaaaaacccgaaaccaatcttcaattcaacaccgagcttcttgaagagacattgttctagagagtgttgcgttgtcctccctatttttttccttactatatatagtagagcaagttgtagcattggccacataacatattcttaattagtgtctattttttaaaacattttttttcttttatttttttgttgtatatgcattcttagttggtgtgcaaccccaaatgtttttattgattaatggaaaattccattatccaaaaagggttgggtatgaaataactctatccatctgtccttaaatagagccactaattgcattccacatgagcagaagtcctatatattcaaggacaaaaatttccctcattaatttaaaactcttttcaaaaaaacacccgtttaaaaactaaccactctgcttaatatcttcaataatgtacaccctcctgtttagctatccagttctctgcagcaatattcatggagagagacagagagagaggc

SEQ ID NO: 98178 - DNA, 687 bp, Oryza sativa
attatctgagatcaataaaagtttccattatctaaaatttatctcattacttaatgggaaaattaatcaccaaaatagtgcctctagctagggaggttaaaacttttcgagcccatgcttctatatatatacacaaggcaaactaatgagtgctctctaaaatttaaattgtcttaagcccatccctaaaatgccaaagcttaaaagtattttagacaatttttaaaacggaattactaaccttctatcgatagaaaatccatcttcaaatcttacagattttggaccactgaatgagctttgtgattcatgctccaggccttctcctccaactccggcgacctcctcttcttctccggcattggcgacaccctagactctaacagaggaccctacgggttagggtcctaggttggagagggggtgggagggggaggaagaagaagagggagttcgccagccttagagggatggccgtgggaggaggcagcccagcggtgggcagcgtggcggtggcggtgtcgccaaagccacgaggtcggaagctagtgatggaccggtgtagggagggggggcaaagtggaagggttcttagaaggaggcggccggtggtggcacctcgctaccggagacggggaagacggcggcacagggatagctcatcgccattggcttgaggaaagaagg

SEQ ID NO: 98179 - DNA, 668 bp, Oryza sativa
atctgatatccatactggagagcatgtgctaaggagtaatcgttgcgtaaatcatggtttgctgacctagaccaagtcgtgtagcgagtatgtagaattttcccagaaaagctgaaattccgtcagacacaatcatagcttgcatgtacagaattagaacgttcttttagtcttttaatccgccatgacacacaccttgagagtctcaccatgcatcagcattggacttttcctgtatgattcttttccttgctgaggcgatgcatggtggtgatgtcatgatcagcccgagagtcttttgcgcgataggtatttccctcggcaataaaatggttattagtccatgtaccttgtatatgagcaaccgtaagcgatcatggtcgtttcaatagcgctttagcacaggcaaaagtataagtatacagtcttaaactattactatccattcagagacatgacagcttatgagccgtaccagccaataccatgttcggtttagctcatcggttgtttccctaatagattaaaacatgcatgaattttatatgatatattatgagcatttttctagagtacccttgagcgaatgtgatccatccgttaggatggattggatgggtcagttataatcatcataccccttgaaagcaggtgtagtatgtgtagta

SEQ ID NO: 98180 - DNA, 748 bp, Oryza sativa
cccgtgagagcatcaaatcttcgcccgttcaaacagtatacaccctagctctacatttcaatacatagccaagcaaaaattcttgtacatagaacgcagtattttgtttttcttgttttgtttttgttttcaggtgggcagggtggcttccagattgccatgcagttccagctgcgattggtccggaggcaaaatcaaacaggtgacacattgttggctgcgtgcatgcatgtacacgcgctggattcagcctgcctgaataacacgcatatccaactcttatccatatattgtattatgcttgcgtgcatataccattcgaccaaaaaaatattatacacgaatttatataatagagactatatatctaaaagttcacaaatggtattcaataagtttgtgctttatttgtttctattggtgttagtgccggcgtgcgtatctgccggttcggaacttttcttatatattgttttagtgcctgttcgctctgacgaaaaaaaattatcaaaactttagcatagttgccaaaattttagtaaaatttcttatagttaccacaatttgatagtaaactaaatgtagctacttttttaacaactttaccaaaatttggtaaggttgaaaatgacatcaaagtgaacaggcccttaagctatgattgtgtttggatttttttttaataattggctgtagcctatgagcaaaggctggattctattccgttataaaaaagggctgcaggaat

SEQ ID NO: 98181 - DNA, 682 bp, Oryza sativa
cgaagtaacggtcttagatatcatctatacacagatacaaaccgttcgttatagttaccagcaaagtttcttcagctagtaaaacactagtaaggacacgtacgtacgatctgatggtgatggttagtcacttaattagtcaaatacgtttcccgttctgaaatatactcactctatcccatcccatcccaatttgattatcacgtaatttttttgagatttccaaaatgatcatgatttagcaaagtgttttttacttattcgtgcaaagagtaaatttacatcgtaaaatgcattgcatgcatgtatgtaaccaatcgagtgtaattttcattggttcaacccatacaacatttaaagtgtgaattttttaccggacacgaagcgatctatggagtaccttgattgatgagtattaatttcataatgaggatgtcttggtgttcctagtctttgtgtcatttggttatatgatcaatttgggatagagaaagtaatttccagtatttaagatttatcccaaaacataataatttttacaccaatgttctcctttttaccatatcttcacttcttgaccaatcatcacattctcacatttaattatatttcttttttaatacgtgtgtttaattctgcgaacctcatattatgagggcaacaacagtatatatagcaaaag

SEQ ID NO: 98182 - DNA, 672 bp, Oryza sativa
atattgggccttgttagattgaaaatcttgaattaggggactaatgttctggacaatctttacggcgatgtgtactctaatccctggacatttgtcatctaaactgaatgaatatagactcaaacaggtctgcgattcggagtatataccctggccggttccgtgcttgcccggcttctccactgaacttgtcaattccattgcagcacgaaaagaagctttgaaaatttcattgcagcacgaaagaagatgcattattttttgtttttttaaaaaaagagaggagaagtgttcttaataagaacacaaagtctgcacgaaaataaaatactacttcctccgtttcaggttataagatattttgactttggttaaaatcaaactgttttaagtttgactaagtttataaacaaatattttaatatttaaattaccaaattagtttaattaaataaataattaaatatatttttataataaattaatattgggtaaaaatattacttatttttttataaatttagtcaaatttaaagtaattaaactttgatcaaagttaaaacatattataacctgaaacggagggagtaacaatctccgtaatgacgaggaaacgataaaaacggtaacaaaaaacataaacaacatataactattagcactacaatatat

SEQ ID NO: 98183 - DNA, 654 bp, Oryza sativa
caagaattactttaagtttctgaattgccaccattagaaagctcctgaagctaattgattcaagcgtagttgtacttagtctgtggccatttccccctaaaggccccctttgaacttggtgtgtgtaggtgtcctgtgtccatggtctcaatttctcaaagagttttcctagaagagatcagctgatcgaatgaagaaattattatttcaggttggtccaagaacatgcatatcagtgaccatcttagttggtgcatgtgcaacaactgtctggattagggaccttctatagttttagattattttactgttataaactcttaccatcattggttccgagaagtagttaatatgaatggaaattggcccccaaattatttggaacaacttctgatattttctctgtttgtctgggtccacttgctagctgccagagagtatgacaaattatttgtaagattgcttcatatgcatgcctagctgtgttcattaattctatccatattcacatggatggcaagatttcctctaaagatatacaatacaattatctgagatatcaaatataggtttatttgttggcatgatttgaaaaatgcagttgacattgaaatgtcctggtcgactagtcgaatggccattactctcctggct

SEQ ID NO: 98184 - DNA, 527 bp, Oryza sativa
tctcaaaaactgaaagctaccttgtaaaaggagcttgtggactcggattgggttattgttgccaagctcttttagccagagcagataatgcaactgattcagaattagaagcgactacacaacttactgagcgtgcatcagttgaagaaattcttcacactttgacgacttcattagttcagctatgtccattttcatgctattccctcaagaagctaagtatttgtggaataaaatccttggaaggaatggaagaaaaatatgttagcttagaagatgatccttgggctgttgcaggacttgttcttggcctgggaaactctgttgtttcactatataggcttggagcttatgaagctattattgaagtcaagaatatattgatatcatggataccagatgtggattctagctctttgttatttgatgaagaagattcggcatcgctatgtatgggctcttgcccttgcccttccatctgttttagctttttgccagaaggtggaattgctgaatgatgacttgga

SEQ ID NO: 98185 - DNA, 689 bp, Oryza sativa
ctaaacttttgtgatgtctgtactacgcgcaacagtggcatgcagcagcatgagacaaatgccacgcacgtcagccattcgctgtcttagcttaataattaattaactttttggccatgttgggtatatcattaataatagatgtatatatatatataataaaaatcaatagtaattaatatagtctcgaattggttaatcatgcacacaccagatccagcacactacaggcagcagctgatgcatgcatgcgtaaggggagttaaattaattacatgattaattaatgtggtcgtgcaagttggttaattgattactaatattaattaatcgttctaattctgattggggtagctatggccagcctcgtgatcttgtcattttagtagtatatcttctcatgcacgcatacttagacaaggtaattgtacagccttcatatgttagtttagtgcatataaaaatatttggccgccacaaatttgtcctatatgcctctctctctctctctctccatgaatattgctgcagagaactggttagctaaacaggagggtgtacattattgaagaaattaagcagagtggttagttttaaacgggtgtttttggagaagagtttaaattaatgagggaaattttggtccttgaatatataggacttctgctcatctggaatgcaataagtgg

SEQ ID NO: 98186 - DNA, 581 bp, Oryza sativa
  unsure (1)..(581): unsure at all n locations
ctacacgaatttcttaaaaaaagatgatcaaatattgaaatgtttaatttatgacaaaactagaacaataagtaatttaaaatggagagaatggaaggaaaaaaaatgataacgatagtaatcttgttctaggataggtaggcttttcaagtcttaacaatcatcttgcaccttttatataaacatcaagatgcaaagttttgccaaaagcttatcttttacccattgggatttattagctactttaatttatacccagagcaatcatttggctagtgcgctggttgattattgtatgcccatttaatgagaaaagtgaaattcacctaaaaagctaaccaatatttatatggatcgtactgaaactttttgaagtcatttggagatttgattgatatgtagcgaactttcatcgtccaattctttttttttggggggtggggggggggggggggcttantgcaatcaaaagagtgtatagtgtactagtactagacagacaaaaaaatttttttggacaagatgaaatatgcgttaacaggatgtgctaatataagggtgcttagagagaaaaaaaagag

SEQ ID NO: 98187 - DNA, 678 bp, Oryza sativa
cattgctgcgagaatttagtatgataacaataaaaaaaataacatgtaagatagctagataacatcagattaagtaaattaatgtggtttatgataatttaaatttaaatagtatgtagaatggtgattcaaacataaatagtaaggtggtatgactttatgaaagaagaaaagtaggaagatagtttgtaccgcagattaatcatctaaaggctaaaaataattgatgtgatatggcttagttagaagaataaaggaaaaaaataatttggaccatagattaatcatttaaacactaactaagtgaggatgaactatataagtatataggatattataaaacataataaagatatacattgaaatattatgtgaattatgttggatgataatttaatatatttgtatttgaaaagctgttaaattatgaaaactataaagatatagcatgtttgcatgatgtttaaatgtgatgattattagtggatgatgatgtggcatcttgttaattagtggatgataatgtgatatcttgttagtgaatgatgatgtggtatctttgtatgttaagcttaagaagttagtggaggataactttatagtaagatagtatatacatgcttctgtatacatgtttgaatcaaaatagtgtactatattttcatggcatatttcata

SEQ ID NO: 98188 - DNA, 762 bp, Oryza sativa
ttgaaataagtgtattttatgtaaaggggaaacatcatatcttctcctgttgcacatatactagtacctttctatttattagcttctaccccccatatattatgaatgatatagctaaaaacgaacaaagatcttggtattcattaaatctgtgactcatcaaaccctcgtggtggcatagctgagtagtctacctggataacttttgcctatctgacttatttgttatgccaaatttcttatttaactagaaaaaatacccgtgcgttgcaacgggtgaagtctattttaatattattattgttatatggtttagttaagatgaaattcactataggagttcgcttggatatatatatttttagaaaatcatgagctatagttaggagtccgatcgtctcaagttagcatgcgagtttttttaaacatatttcttatatgattccttctgtattaccaaaagtgaacgatcttaaaaaccgactcatacacggatgacgtaccaaaataccggtaaaaacatcttcaaattttataatagtagagatgcatatattttcatgtggtctgtcctattatgtggttgttggcaggagataattcacaagatggcaattggtcactgtttgaatagatatgccatgatatactagcatacttgaaggactgagttgaaagtcctccatttcacaatgtaagactttctagcattaccaacattcatatatatacaaatgaatctagattcatttgtatatatat

SEQ ID NO: 98189 - DNA, 681 bp, Oryza sativa
aattgaaacctatggagaattactgtgtgttcctacacatcatgttgatcttttactaaaatacctacatgtactgcctttgccttgacccaatctagtactcctactactgaagtcatgttaaaaacctgcactagtacttaacacatgtttaagaaaagtcaaaagcacacatcatcagttggttgttgagggcataattgcatcaagcaaaaagaaaacccccaaaggcagcaaaattacaaaggagatggaatcttagcccccctcctttgcactttcctgaggggccttaatcatttggtgcacacacctagcttggagagctaggggcccttcacactttggcacttgcacttaatttatccatttgagtacaagatagtgattaagaaggtgggtcaatataaaattgtcctggttattaaccaattaaccaattccaggtgtgagccttgtggttggcttagggttcatgctttggatctggagctactggctactacctcagctactgcttgtctggtaggagccaagaagcgaggaggatcaaagtggtggtatattctgagcatgtatagtctagatctgaagaatgtctgcttcttgacaaaggggatatacttctcctttctatataaaaagagaaatatccacatcgatacaataacgtgtgttgat

SEQ ID NO: 98190 - DNA, 548 bp, Oryza sativa
aaaaaaaaatttgacatgaaaaacaaaagaggaattaaatgactgagcccagtattctgaacaaatttcagaccgcaaactgaacttatgtacatagcctaagaacaaaaaagctaaacacacttttttttttcacattgaagcacatagaagaaaatcaaaacaattctggaattttctgtcagagtaaagcgcacaatccgttggaactaaaccaatattcacaggtgtgtgtagagaccagatattaatcgtagtgaagaaagaaattgcagtgggggcgtgctgaactcacgtacatgtacatcgacgtcctcgtagccacaggcagcgtcgttggcaagacaaggtaacgtacgaccgttgtcatcgtagacgcttcccggattggaaccgccacgtcgtggattgccggcgaggcgagctcctccggagacgagaatagatatcagtgtgcatcaagatgatgccgccgcttctggccactccggggcaaacccacgatcgaacaccttgagtgcagccgtctttcgttgttggtggtggtg

SEQ ID NO: 98191 - DNA, 1076 bp, Oryza sativa
acggtaacagtgcactcgatgaaacgacagatttgcccctcccatcactctcactcacaaaagtttgcttccattggagagcaaatgttggcactctccattctgcagccatatgctaacgaaagagaatatatcatgctctctactagcattggtagtaaatttttatggaacatatattttctctaaatgttttaaatggaaaaaaaaattacagtatgtccacatgaatacgagggaagttcctttacaaagattaaggttccattgaaaaaaaagggtgaatattgtatcaatattcggttgtcatccactaatttcacgtagttgccaacaatagtatgctcaaaattgaatatcataccccttcagtttttaaatgtactacatgattggctttagacatgatgtttaatcactaattcgtcttattaaaagttattatttattttgttgtaacttattttatcatttgagatactttaaccatgactcaattttttttatattttacacttgattagttaaataagacgaataataaaatatcaggcctaaaagtcagcaatgtcctattttaaaacaaaggaagtattccatttgaaaagtgagaaaaattctaatttctacacaaaatgaattatatttttgttcttgcatgtgaaaatcctttataacatagaagaaccttcagggatggtgatgaatgaatgggtccataaatctcctcatcagtgtttaaatcttagtgtccataaatattatgtacgtataggtgcctctttaaataaaaaatcaatgagatcaaagatttaccatattttctctattttatcagaaaatgtgtgaagggatggaagtacgtgcctaaaccgtgtaagtgacctatttttctgattaagatacatatattctatctcgattttcgttagcacatttttcacacgaatagactatgtgttctgcgcgaaaactttctatatattaaaatatgcgataaattcaattttcaaattaaaataattaaaactgaattaatcatgctcttttcttttggtttttagtgccgtacctat

SEQ ID NO: 98192 - DNA, 548 bp, Oryza sativa
tcctgtttccgattgagatctagaacccaagcccatcagctatttttttctctgtgttctttcgctttctccttgccgaacttcaccttgtgtctagtctcccggggatcaagaatttcatttatcttaatttcctctcaagctcggtcccccacacccgatacaggcccctcttgatcccggtcactaactccctatcaatccgtactaatctaagtaaatcatgaactgactggacgtataatcgactaggtcgtagcaatcagatgatgtggaagaaagagagggaagaaaaaataaacattgttattatatatgacaatgacataaagtagactcttagcatttagtaaatggaaactttgttacatgatggtgcagaaaagcaaagaaggataataaaataatatctatactattatattatcttttctattatagtaggatatagtctatagtgacatgaattaatacgtagactccatgttagactttaccgatataaatgcctaagtaaaataagcaacagagatcttaccattggcgct

SEQ ID NO: 98193 - DNA, 528 bp, Oryza sativa
actccccattctgaaattatgataagtcaaaataacattattaggttagtcatgaagctattatttattcatatttttaagtatctactatgaatatattgtaggaatttcaatatattgtacaaatttttattttcagatatgtttaatttttaacacaaattatgctttttaacttaatatagcatgaaaataggagagataattgaaggaaaataggagaaagggattgagggataggggcgtacgtgatgtacgtacgtacgtccaagtataggctctgggtggggccaggtttgggaggcatatatttattttcttaaaatagatctaacggttgtaaataatgggtccaccagatttaataaaaatctacggttagatattttgttttttcttgaatttccttttaatttattagaatgacacatggcgatttaagagcgtttgtagagtgccacatggcaatctaatagtgtttataggatgtttaatgaacttttagtatatactccctccgtttcaaaa

SEQ ID NO: 98194 - DNA, 565 bp, Oryza sativa
  unsure (1)..(565): unsure at all n locations
ccggctcgcggcgaacaaagtagcccattaggccctttgctataatgacactggacccacatttcatagacacagatgggcccatttgtcatccgctcggagtgtcaaaacaatnnnnaaatccccaatgtttgctatcccaatattgcaattttctcgcaaatatgcccttctaatgatcgccaccattgaaatttgtgaatccaacggagcatttgtggtctgcaacctcttcctcccgctagcgaggcagcggcggcggccggtctcgcgtcgccaatgggcaatggcgggcattgccacgtcaccgatccccgccggccggactcgccgtccctcgccgccttccgttcgctggaagtgcaacttttccgatcgaacagagcacgggaagccggaagcaaatgcatatggttggtaatggtcgccacggcgcgcgaactgcagcagcgccgtcgtaagacggcgtggccggccgccggccggtgcgccggcgccttccgggtgcacggggtgcaagctactccatcccccaaccaccgatctagttggcctcctcttgact

SEQ ID NO: 98195 - DNA, 794 bp, Oryza sativa
tttttcaggtttgatccgggtcactcatttttttccgtctgatatggtttttcttctaataatacacatggttgatctttttttttaataatacacatggcttttctactacgatccaggtcgtcaagttttttttctgtccgatctggtaatttttgttcgggtcgctggtggatagtttttttttggtttgatcttgtttttttggtcgtgttgccagttgattgttttttccagtccggtttggttttatccgcgtataacacagatgacggatgaaaattaaggtgagtacagaatatcttcaatttttataaaaggtaaatataaagattaggtaactatttaggattcaatccttcgtgtgcaccaagaaaaaaccagaaaaaaaaatcgtgacccactaaaaaatcggacgaaagaaaccagacaaaaataatttacggaagccttacttatttttaaattatatatatagagagagagaaaggaaaatgcaaatatgagctcgggtgcatatgtacctgcaatctctcccgtccagccacgcaaagattcgtgcgtacatggttaaagggtggcgccgcagcctagcttgcttaagcagagagcagatgggagttaacgcaagggagagacattcaggccactttaaatcgtaggaataaaaaaacagataatagaaaaaatacaggattctgacagaaatataattataaaacagaggattataaaacacagaaaaaacacaagaatagcgtttgattggaccacaggaaaaacacaggaatcag

SEQ ID NO: 98196 - DNA, 682 bp, Oryza sativa
agtatcgacttgctgctgtcctattattggagtctcatattcaaactagctatatgattagaacttagaagcattaagactaacatttccagacctgtaatactgtctcattttattaatggaaatggggggagcaatgctctactagttcaaaaaaaaaaaagactaacattagcaattcattataagtttgacttgaagactaaagcgtcattaaatagcattagctgataccaaatgaggaagagaaggctgtttgtggtgctttcttcctggaagaagcactacatctgcacatagttacctcaagcacatcggctctagcacgacaatggactctctcccccatgtacaagtcatatctctattggatggatggttagacatggctagagaaggagtcgggatgatcaaaactacccaaaaaaatatagagagagtaaactggtccaaagtgaaactttgacaataaaaaatggtccaaacggcaatagatactgttgatattgacatactacaatactttgatagggaatgcttcctctcaggcttactgatgaaatgcatgctgatgctgcagccggccgccggtggcggattggccatgataatcagccaagcctgaccggagaggaacatgcagatcttctccttttgttttagcaattaggtctacgatggt

SEQ ID NO: 98197 - DNA, 1342 bp, Oryza sativa
atgatgcttgtagtgacctgcaagacaattgtgaagaaaaactgataagttgcaacacagaatattgtagtcatagcgcaaagtagagataaagctataagagagtgataatcctaattcgtgcctggcgaagaaagtagtcctaatccatacatgtaaacatggcttgtcatatgcaacttctgagcgttgaaacgaatcatgcctcatgaattaggatttcagatgatttagtgaggatgacaaaagtttctcagcaacaaattcttgcaaggtggaatagcacatttttaatgatataagctagggattgattcaataagtatctttatacattttaattttaccatatggccaacacaacacatgactttttagacgttacgagattttagcaaatatcgatatagcatactatgattcttattatttagtccaactaaaactatagattacagtaacattcggatggagtgggaatataacaggaaaagcattaaagttttcatgtaaggacgcgagtataacttggtaaattagacagctacttctgagagttgcaacttcgaagggggatcacatttccaagaatgactaaaggcaccattaggccagcctactttggaccaacttttgcgtttagtattatttgataattttaagcaatgcatcggccgtcctttatttgaccaggacacaatctactaactatagcatctctactgattggaattttggaacttagccaatcttgtcccaagttatcctaactcatttccaaagatataatgaaaacatgcatccacatcttatctctcaactgactcaaatctcaagtggacttgttggaatccacagggtgtgggcaaacagataagtctagcccacaaatgggtccacaatataaattaaatcaattcaacactatttttggaaattttagagggccaacataaacaattaactcctagcactatttctggactttgtctggagtaacatatcaatagataaacaattactggggagaaatgctaaaagatggtcatattttgtcaaacttcatgtcatcctaatttaggacaatccaatactgaaaggaggtgtagtttgatatataacatggaataagaagctcacctacatgaggagaattttgccatttaactaggttcacatcaccaccaagctccagcagacgtcgaccaaatttttgaacaattgaacacggagcaagttcatcgtcttcagaacagaatatgagtattggaccaacatgctgaaagtacaatagaccaatgtttactcagatatccacaaacacttccgttgacaatcagat

SEQ ID NO: 98198 - DNA, 657 bp, Oryza sativa
aaattttggaagtttttgtcataggggtattttggtcatttcgacaaatttgtacagtactaacggtggctaaccggacggcgatggtaaatcgtagaagtttagcaaaagtcgatggcatattgtagaacgtgacaaagtcagtggtaaatcgtagatgtgcgacaaagtcagtggcatataatggattgtctcaaaattttatataggattgaaatcctctaagggccttttgatttagaggaaaaacatatgaattttgaaagatttcaatcctatagaaaaaagttctatggatgcctttgaatcaaaagattgaatcatacccaatgctttgaaattcctatgaaatggacattcatatataaattttggaggaaacttagcaagagtttaaagctagctcttagaaaatttcctttaagtttatctctctcatccgatttatccgatctatgtgtttttcctacggtccaatcaaacgatcattttttgtgttttttctatattttgtaattctttgttttacactttcatttatgttagaatcttatgtttttttattccttcattttttcatttttacaaatcaaaagggtcttaaaattgtagagtaatgtttttcctccgaatcgaagaccctcgatgtgagcagca

SEQ ID NO: 98199 - DNA, 651 bp, Oryza sativa
gtggagtttgagtccagcgacatatgtcccccccgcttggtcattgtctagactgaaaattttgtagttagtctcgtactccctccataaaaaaaaacaagtctaatagggttctcttttagcacaacgaatctggacaaatcttttttaggttgggtatttttaagacaaccttaaaggatccctttctagtacaacgaatctaaacacactctttctaggttggttttttttggacggagggagtatgctccaatggcttgctcccgggctaatgtactattatttggtgtttggacacgcatatgcatctcttccatagttggaaaggaaaatttctatctattgaaggagggctcacactaattaacttagtgtttatcacgtcttaaaacaagacccaatctaattgggggatgtgcacgaccaacttggtataatggatttagatataaaggtatccagatttgttatactatattctttcttttgtttcataatgtaagtcattctagtatttcccatatttgtattcatgtatatgtatatatatatatatatatatatatatatatatatatatatatatatatatatatatatatatatatatattcattaacataaatatgaatgtgggggctgcaggaa

SEQ ID NO: 98200 - DNA, 1569 bp, Oryza sativa
ctttcgtcttcttgtgtgactcacttcacagtagttgtgcatcatctgcttctttccctgcacagcatcttgcctcttagatgtgacaatggatcatcagatcaccttacaggtgtaatggtgccgtcgtgtggatgttgatttacttggcacttggcatcaggatggactttgattgattccaataataagtacttattccatttaaaaaatgaattttattgctcgaaatttatctaaactggagtaagttgatttttagtctcccctttggttcttaggtagataagtttttatcttttcggaattttgctaggaatcaatttattttaagacttagagaatatagcactatctactagcataacaaatatcgcttagttagcacagggtttcctggtcatcatcgttggatttagaatgacatatttgcaacaatacaatggttgtgtttatctataattacagtagaacagttaaatagatctctgtcatattgagtagagaaatatgataactatatattacgaatcttaaagcaaatctaacgacaattgttagaaacgtacatgtagtatggatggttttcctttttagcctacgatacaatacttcaactataatatttcacttgtataatgccaaaatgaaaatgtttctataagataaactcaattatgtaaaagggcatgtagcttagtgattgcaatgacctgagtagcactttaaagtactgagtttaaatttccataggagcgaattctagattagcttatttgagggctaaattccctgattaataagcaaagtttctaattttaaaatgatgtatccggttggatgtatataaactcaattatgtcattattcataccacccaccttatttgagggctaaattacctgattaataggcaaagttcctaattttaaaatgatgcacatatccggttggatgtagataaactcaattatgtcattattcataccacccaccaaatccacatgcttaaacacacacattaatgcccaagatataaaatgatcgccctgcaccctgcatacgtacaagatatatactccctccgtactcgtaaagaagtcgttttgaacagcgacacggtctccaaaacacaattttaacttattgtttctataaaaatatttattgaaaattgatatatgtatacttttataaaagtatttttcaagataaatctattcatataatttttacattttcaaactcaacaacttaagagttattcatgatttatattcccaaggtttgacttaaacattgtcctaaacgacttcttttacgagtatggagggagcacatgaatataaaatcagaaatgctgtaatccctgccatctcaccacgattatataattactccctttgtcccaaatataagatctatacctttttttacacgatcttcaatacacaaactttaacaattaatttattccatgttttactctcaacgaatacgaaattagcatcacatagtttattcctatattttgcgacggagggagcatatatcaaccgtcgacccacc

SEQ ID NO: 98201 - DNA, 1331 bp, Oryza sativa
ccaattgatgtagggaagtcatgccacttggacacttggtaggtaggaaggtgtttcatgacaaatagacagaagttgtctggttccaaataggaaaatatctctactattcttgtcttttatcaataaacagtaatatgctgtactttggtattagatttctgcaatgatttgtgcgatgcttgcagcgttggttcacatcgttctgattctaattgtcatcctaggaaataagcttttcctttcttctttataaacaaaagtatttgcagaaaacacaaaagccaagcgcattatggatcatggatcgactttttgcctgtgtgcttgtggttacatagagtcttggagctaaaaaaaatgaccaactaatcatgtgaaaatcatttttaggaaataatagtttcaagaaagaacttaatgtgaatctactacctctagaaaactgaaaagtatccactttcacttattttttacagttgaaccagcaagtgacagacctaatggacatggaaggtgtgaagttcctgtttttgttggcctgcaactgctggggctttgagcaattggagtgataatgttgggtatgactcttttcttgaacctcttcaattagttatatggttatgatttgttcagtactgactgtattttactgaataaatctaaaactagaaagtttgtaagtattttctttatatcacgccatattctgattgtaatacttttattatatatgatctcttttgttctgcctgtagtggtgggatcacatgctttaattatttatgggtagtattgttgaattgtaaaatgaatgttaatacttaatgggtagcattcttgatgctgatgtaaattttactggtatttttaaaattttgtgtgccattattatcacaaagagttttcttaacttattcgcatgacaatcagaatgatccaggctaccagggataaatacgtgagtggtaaccggctagtaccatagctacgagtactgatatgctatgttgtttcttgtacagttacccattcgtatgtgttatttggagttagaagttcagggaacctcatagaagattgagagaagattttacatttgcattgttgaatagtgattttgacttttgagcatagtcaaactgggtagtaattagcgaacaaaattatttgatgactatgtccatacagtagtaaaacttgttaccgctagtaactggccatgaaatgttgactgccagggtactgtattttttcctcaattgattttgaatagttggattggaccactttgtcatgcatgaaggttactgttcattcattattgt

SEQ ID NO: 98202 - DNA, 611 bp, Oryza sativa
ggaggtcaatagaccaagagccattttttctgaactgcgatgatactatgcagttggggttgtgttgacggaaaacacgacaacctggggaaactgcttaactccagtgcaggtcaaaggtttgcctcgagtgtgctaagggcgtaccagctggtttgatcctgcaaccagcaaggaaacaataaagcatgattagtcagccgatagccgatcggccgataggccgatagcatattaatggtggtctcagccgatgtagaccaaattggctatagactagatagatcaaagaatataaaaccctaaacatgcctcatcggctgtaacattgctaatcaagtttaataaagaagttcaagacaatattacgaaaatagccaatgaaaccgtatttagagcagaaaagatagataaagatagcgtaccagctaatactctagtacaaacctatatatgcaaatcaatctatagtaatatatcaagtagggatcaattgtcaaattgatagcccagccgatataacctagacttgatatattcctataaggtgatctgtctatatgcatgacaaatatacacgactaaggatgatgcacctcaaagtatgaaaa

SEQ ID NO: 98203 - DNA, 798 bp, Oryza sativa
  unsure (1)..(798): unsure at all n locations
agccatgtagaatatgtataccggatcgacaccggcnggaggncgntntgaactagtggatccccccagaacggtcttttcnnatcaaagatatgctgtganatggtnattanacaagttaagtggcaagaaagaagacagccaagaagtgaatgggagaaatgtgccaaactacatacaaaagaggcannctgaggtcccccccccggaatgattgcaaacactcctatataatctaaattcaagtgaaacaagacaaaaacattcaaattacgtttttgacaaattcttgaagtcactttacctggattgcggaccaatgacatttttttggtagcccccttgctgaattgacggccttggtctgctaacatgaacttcaagttgagcaagaatgaacaaaataaggcaaacaagaaatgaagggacgcaatgagccaaaccacagacaaggtactagtatcacaaattaacattgtaaagcgttacctactgaaaagagggtataaaactagtatgaatgtaccttacaacccgcttagcaatggctggttgtggtggcctttggaatttttaaggtaacaagttttcttgtaagttcctccagagaaccatgatgatgggctgccattatcaactattactataagtatcgaaaaatctaagagcagaaaagataccccaaaatactgtaacagattaataaaaaaagcgatttcttcgagaccatgttagtaccttaacatgtaggttaacaactgtgttattgtttagagagtgtctgaacaccagaacgac

SEQ ID NO: 98204 - DNA, 1891 bp, Oryza sativa
  unsure (1)..(1891): unsure at all n locations
ggtgagcttcaaaaggcatacacagtgtcaaattgcttatcatggtactgtatgtacctgctggcttcaaagcccaaactgctcccagaaaccattttgatgtccaagaaggcctttcaagatgctgttcagtgtgctcatgaaatgctcagtgattgtcactcctggcagagcatatacaacaagcttatgaaagaggcgcagaaagctcttgttcaaggtacgcatggtctaaatctgagtggaaacatattgcaacaaggtgctatactggctaatgaactcatcaagaaggaggaccaaaaatgtcgttgggagatcctatctgatgtgtgggttcacttgcttgtgcacattgctcccagttctgacgcagcagctcttgccgaggacctcaaatccggtgtcgagttcgtaaccgtcatctgggctttgttttgccactgtggcatcgagaagagcaaattatggcaacagcagaagagtgcaaatttcaggaacagcactcctggaccatctaatcagagcagtgatgtgtctacccatgttcaggacacagtcagctctagtccacctgctgctcgatcttcagaaattcatgtagaggctagtcctacttctggtatgtcctgaaacctgaattgctgatggctgatgctctgctcccctcatggtttcagttttgtcggtaaaatttgcatctcatcatgacatttgaacactagtatttgtttcttgtgtgaatgttttctgtgttgtgattgtaacaggggaatgctcttgatgcaatattatgtgttatgcactttttagagcgccatattattgtgtgtgttgtgattgaattactctggaaataatttgtgtagttgacgtgcactcgttatttggaaataaattgttttttttttttgagcaaagggcgatgccctccatttccattaaagaaatgtaaagattcttacaagaaacagagtctgaaaagcaaaaaagacatcatgcctaaagcacaagctagagttttcctaaagagaggcctccacttctaccacacagagccaaacagaagatcaaactacctagtaagacaaaagcccataattgactatctccagtaaacgccatcagccattgagcagtcttctctgtccaagacgccacccaaattgcgatttaaaaacttcacttgctatttgctttagcaattgtactccccattgcaactttccttgcctttcctccgaactctgcaaaatggcccaatccaacattagagagcaggcattatacaagatatcaacaaggctatttggtaaaatatgatcaaagcaggctttatttcttgctttccaaatagcccaggataacagctgccacacccactaacatcagttgttttgttgttttatcacaagtttgaatccaatagcttgaaaataaattgtttagttgatatttctttcctccaacatattacataatatttcttgtcatattgggcactaatctacccacaatctaacccanaagttaattttcctgtagaactcaacttttcaggaaatgatcatatcaggaaactttccatccagtctgtttgtagcatagatggcaaccatactgtacgaccagtagaatgccatttaccatcgtagacctaattgctaaaacaaaaggagaagatctgcatgttcctctccggtcaggcttggctgattatcatggccaatccgccaccggcggccggctgcagcatcagcatgcatttcatcagtaagcctgagaggaagcattccctatcaaagtattgtagtatgtcaatatcaacagtatctattgccgtttggaccattttttattgtcaaagtttcactttggaccagtttactct

SEQ ID NO: 98205 - DNA, 883 bp, Oryza sativa
tgtgcaattatttttttcaatctatatttaatgctcgttaataaggtcgaaggtcaaagcagaaagggtttgagcttctttggcaacttagctattctttggcaacagagctatttgcaaatgtccaaagattcgatgtgatgtttttagaaaaaaaatttggaaactaaaccaggccgaaggttgatgctgctataggcttaactctgcgatgctagggactttgaggatagttacaagttacaacaatctttattatcagttgctagtaaaatacaatcacaatccatatgttttgcatcagaaaggagatacatgtaagaattatataattgtatggctaagtatatttcttaactagtctggagttatatggtacaaaatggaaatgcgaataaatttatgaagtatcggaaatatgtcagctgttaacaacttatgataaaatactttagccactagaagaggacaaatcagccaaaagaaatattgtatactccccaagtattaggtagtaggtggaactaaacgaaaatattgttattgattgagagaagaaaatatatggagaaattgttatattttaagataaattttgaatgctacgttgttatattttaagagggagggaatactttctagtccctatgcaattcttaaaattgctaaaaaaaaagctattgatggaaaaaaaatactacacatcattttgatctgtgtttttttgtttttgacaaaataacaatgtaaatattttggtaaaattatcaagcaacaaagggtgcgacgcaaactagtcgaaagcatctatttgaagctaaaagcccaaaatagatagttgtttcaacaaaccggcagattgaaaagtaaaatataaaaacca

SEQ ID NO: 98206 - DNA, 2080 bp, Oryza sativa
attcctgcagccctaatttcgaattttagttatttgtaaattatatttttatatggactctaaacactactccctccatttacttttgatagtcatattttatcttggcacacagaccaacgataagtgattctacttatcatccatttaaacatgctactagtcattcctcgtaaacaagcgattcattaatatttacatttttctatgcccatgtaaccaatcttgtgtgcaagaatagagggtcacgcattaaatttaagaaagtcattaagatgataagttgttagattgaaatatgcatatcaaaaataaatttttcaaatttggaaatatgactatcaaaagtagagggagggagtactttttattttattatgtttattccgaattttagttagttttaaattcctatatgtactctatactctacttctaatattccttattttttaattccgaatttctatttttttttcttaattgtatttctatatggactctatactccacttctaatattccttatttttaattccgaatttctattatttcctaattgtatttctatatggactctatactttacttctaatattcctttattttaaattccaaatttcagttatttcataattgtatttctatatggactctagtctcctcttctaatattccttattttttaattccgaatttcaactatttctaaattgtatttctatatggactctagtctcctattctaatatttattattttttaattctgaattacagctatttctaaaatgtatttctatatggactctgcttttttatttttctccgattaatgtgagaatttctaggtcatgagagcgaacgtggaggctctttttttttccgaatcttagttagttttaaattcctatatggactctatactctacttctaatattccttatttttttaattctgaatttctatttttttttcttaattgtatttgtatttatatatggactctatactctacttctaaattccttatttttaattccgaatttacttctaatattccttatttttaattccgaatttcagttatttactaattgtatttctatatggattctagtctcctcttctaatattccttattttttaattccgaatttctatttttttcttaattgtatttctatatggattctatactctacttctaatattccttatttttaattccgaatttctattatttcctaattggatttttatatggactctatacttctacttctaatattacttattttaattccgaatttcagttatttcctaattgtatttctatatggactctagtctcctcttctaatattccttattttttaattccgaatttcagctatttctaaattgtatttctactctagtctcctcttctaatatttcttttttttaattccgaatttcagctatttctaaattgtatttctatatggactctgatttttctttttctccgattaatgtgagaatttctagaccatgagagcgaacgtggaggcccgaatttcagctatttttaaattgtatttctatatggactctgctttttgtttttctccgattaatgtgagaatttctaggtcatgagagcgaaaaaaaatttataatatatcactccaaaaaatgtaagttcaaattaaacttacacagataaaaacaaaattaatatttttaaaaaattttaggcgatagaaaatcaggcgaaaactttatattttttttgttgtcgggttggctttggagatttgagtgcaggatggagaaaaaaaatcaaatgtgcccattgttagataaaatgatatgtaatgtgatcttatcacttgtagattgtaaccacatggcatggctggatatgatgattgtaattcctagttagttgcatatcttatccagcaataccatctactccctccgttctttaatataaaggattttaacattttgcttgcgctgttggaccattcgtcttattaaaaaaactttaaaattattatttattttatttgtgacttactttattatc

SEQ ID NO: 98207 - DNA, 1403 bp, Oryza sativa
agatgtagttctcctgattccatttgatgagaaaatttgcaataaattcaccaggactcatttttagtcttcccacagaaaagtatgtagccaaaaataaccccaggccctggtcaagttaaatttacaaaaagtaactttagaaatggttaccagaacatatggcaaattaaatgtattgaaaggttatgctgataatgctatactggatcattgcaacaagatttacatgcttcaagaaagcatggcttcacaggctgcccatatgggacgggaagggtggtggtgctaacaactgatctgtatttgatagtagtgaacacaatattgattaatgaaatagagcacaaacaaactgaggctttccatgaacatactttaaaaccagaaaatattttattgcagaccttgtttgaaaatattcctttacaggagcctgctacagcagcagctctgtttgtgaaagctgagtatgttatactccttgcaatctattgcttcattgcttgtaattgcaagaaaaataaaacggcgagtgtgatctaataatgcaatgcaaatactgaaatacaatttcttaccaatatccaggattcagtagccactcatggacgatgtccacagcatgagcagatgtagagaactctagctaaggtattcagtccttcagctggctgacagcactgacatatggaaattgagaggcctggcctattgattgtttaaactagcgatgacttatcacacttctccggggtcttagctagtgagacagccagtatggtgtgaattcactgtgacagattgtgagctgaggaatgtctgctgatgctgcagccgcaccggttgccggttatatagcactccggcggcagattggccgtgataaacagccagggttgaccggagaggaggacgacgaagcatgccttttccttttgttctgtagtttggtctacaatggtagatggcatggaaattggcattcttcaggttgtacagtatttggtcaatgctaccttccgtgtgaatggaaggtctaacactttgtcaggaaacacttgtgattaatttactcctcaaatgatcaaattgatcattgtttaggtcttttggctaatataaacgtggtgataaacgagcaagatggtttggatatattggagccattgtctgctagtaatagacattacactcctaccatcaacttgctgctgtcctattcttgtactaatagatattacattgtacctaccatcaacttgctgttgtcctattcttgtagtctcctattcaaacttgtactaatagacattacattgcccctaccatcaacttgctgctgtcctattcttgtagtctcaaattcaaactagctacttcctccgttccacaatgtaagt

SEQ ID NO: 98208 - DNA, 1632 bp, Oryza sativa
cacgcggagtccggctatggcgacggcgaggagaggagagacgagaagcggaggggaggaggtgagtacgatggagacgagagaagtcggtttggtagatagagtaaatgagaggaaatgagagagagaggaggaggatatataagagaggggtagtatagtaaaatacctccacgggcattttgggttaggggtacttgttgggccattagggatatcctccattgtagggggacagtggcggattcaccgcccggctagagcgggcagttgcccaggctcagcgtgtgatccattgagatccgagtgatttatgtgtgttgatttgctgcttttttggtaaagtgtcagttaatcacctcatctagtaatgtatttcaacgaaggagcttgattctagcaagatgggttcttgattcttgctggtgcatgcatacaagttcggtggatatcgtctatttgtgcatgcactttatgccagaaaaaatagttatgtgaattaagcagcattcaagcatcagtagaggagaccaggcatactaacagtccacttctataataatttttttgttattttaactgtacgttgaatatgtgtggcaacggtacgttttacttaggtttgcccgggcttcacaaaatttctagctccgccattgtagggggagtttatcagagagtaccctcagttagtgagggcacctatagagtgtccctgattatagatgccctaatatatgagaaacatatagccctcgattttcactgagactgcacgcagaatgttgttcactttgcttgtctatcagactgtccctgatcggccgcccgtgttttcattcaaatttctctttatcttagtttccaatcacccctcgtttgatgaggggcatgtagatcatcttcttttctgttaatttgtctttttaatgttaaaagtgttttttgttcggaaaagaaaaaaacaaatgtattttaggaattaggatggaggtagtagaggcattcttcaagttgtacacattagttggttaatggctcaatgctgcagccttgttttagcggtaagctacaaaataggctggtgaagtggtggatggaaggtgcaacacatttgaggaaaaacttgtgattactttggtcctgatatgatcaacttgctcgctctttttttaaaatcttttgactaatatgatatgatattgaagctaaacaagttggatgatcagcatttggagtggttgtctgcatcaataggcattacataattcatagtcccccatcaacttgctgctatagctatatatattctgaagtacacgctaccaaattcacactagactgattgaaggcatttatagtagtataatcatatgatctgaagactgaagtctcattgaatatagcctttggatccaagtcctttaacataatagtacatgctaactgcttgctgataataaaagatgaagagaatatgtgatcttcttcctggaagaagcacatctgcacatgcatatgcattatgcatttcatgatgtctttgccagtatttttgtaggttgcttgattgcaccaaactgagaccactcacgattgtggcttctccaaactgaaactgggctgcaggaa

SEQ ID NO: 98209 - DNA, 616 bp, Oryza sativa
catcaattggatcggaaaaatgtttgattaattatcctgagcagttcggcaccaaccaaatccatttataagctgtactcttaattacatttgaaatgacctatcaatattaactttagcaaatgctctgaaccagctcggatcactgtatatatacctaatctatataccaatcaagagttcagaaatagtctcctttcccagttatcacccataaacaacacgtcaaatatcccaccagaaaacaaaaggagacaaaacttataatcagcaattcaatcagcggtcaaggaactcaatcgaagtcatacgaggaattttccggttgtcacatgttttcctaatcagttaattgcggccatgagacgacctgtctgttcatgtatccgagaatgcttctgtaatttctcctcctctttcaacggaaaaaaaataataaatccaaatatagtgtaaaacacacagctcaacatatagaaatcataaagtctacaatctaggtagtgggtaacaaccttactccaaaagaaggttactgttccaaatctaacgcaacctgcctctccaccatctgcatccttttccccactaaaggaagaaaaacgcaagctggttg

SEQ ID NO: 98210 - DNA, 1716 bp, Oryza sativa
ggggagggagcgagagagagagagagagagagagcgcccagggagagagggggccggggaagaggggaagatgggccgagcgagattcggcccatcgacctcgggggaggcaaaatagacttttgcggagaaatttgattggaaggatttggattcggaattgaactcgacgatagatcggggattgagatcttgagatggcacggacactagacaacaagcaaagaaacaaatttcgcaattagggtttttaagagataattttcccgctaggcgccacgacggaaggggcgctacaaggcgccggacatcgtcgttgtcatcgcagcttgacgtggacggcagcgacagtgtgcttgacggcggcggttgtcgttgcaccggtgcttgtgggcgatcccggcaaggtcgtggcccggcggtggcgtttcccatcactgtgtgcgccccctcgatcggattagggttttgtggggtggagttgacggcgccggtgaacttcgtaccttgtgccgtgccggcctccacccctcttttatatggcgcagtgtgacgggggcccaccagccattgggctgggcgcccccgatcagggcgcggtcaaggcctccttgagccgttgggctcaaggggagggagatctatctaacatgagtaacttttgtaattaacttttttaatatatgcactataggatactccgctacagtattctccaaaagaaaaccatgagaggtgaccacgggtggaggtggcgctacgcaggagtgcaggagggcggcactttggcgagaggcgggttttctatcttgatccagacaagcagtgtcgtggcctcgtaggttgcataatcaatagagatagtactccctccatctacttttgatagttatatttcatcttggcacacagaccaaggataagtaattctacttatcatccatttaaacatattactaatcattcctcgtaaacaagcgattcattaatatttacatttctcaatacccatgtagccaatcatgtatggaagaatgaagagtcatgcattaaatctgagaaagtcattaagatgataggttgttgaattgaaatatgtctatcaaaaataaatttttcagatttagaaatatgactatcaaaagtagatggagggagtataaaccaaagctcttgccttttttatccctcctttttgtttacttttctgccccccccccaaaaaaaaaagaaagaaaaagcttaatgcaaggatgggcaaagcttatgcctattctcgaaaagaactgaattcatctgcaaccacagtgaattatgttctctcagcacatgggagtaccttagcaagatgtatcaacttcgcacatgtttaaaaaatgttccaactgtgagtttgcaagattcagaagaatttccccacgtgtatgcttgtttgaaattcaaatattacttggacagaaaagctgaagtactacatgaatgatccaacatacaaggcaaatactcaacaactgaatatatgcttaaaccacgaaagtaattaataagctacttgtacctgtactcagtagtttgcacctagcagctaatcgacgatgcccagaaccaccgatacaatgatccgttagaactcctgtgaactccagatcgcagatcgctctgttttggagagagatgttgtccagggttctcggtatcgcataaacagttggatta

SEQ ID NO: 98211 - DNA, 560 bp, Oryza sativa
catttagaaggctgcatccaaataggcagatcacattacgaataattcaattaagacaactagacaagttggtgcatcaaagaagattagaaatcttgcaaccttcttccttgacagatgaaactagcatggcaaaatcaagatggaatgagtaatgcagatgctcaactgttaaactaatcttgttttttcccccaaacttcaaaagaattttctgttgtgaagtgaaagatccaacagtagtagaatactacatgctggtatcactaggatgattttcatgccttggggtagttactattcagacaaaaaagatgggagctaagcaggagttccttcactagaaggtgtaaaacgaaaatgattgttacacttccaagaacattaaatttaaaacaactatctgcccacaaaaacttatatcttcatggcatcatgttacacgtaggcccaaactccactgaatgcatgtagataggaaagatccatcaataaagcaatgatagatcccttataggacttcatagtagcacttggatagaagatcaaactcctcatcc

SEQ ID NO: 98212 - DNA, 804 bp, Oryza sativa
ttaaaaagaaagcacattctaacgtggatgtgaaaagtgaaagatcggtgtttccatcgtccgtcaaacaaaccggacgaaaaaaaccatatctgtccgataaaaaaaccaggtggaaaaaaggaaaaaaaccaaacctttccaataaaaaaaggcgtaaaaagaaaaaccgggcgaaaaaaccaaatctatccgattcagaaaaaaccgggtgaaaaaaagaaaaaaaaacaaacatgtccgatcagcgaaaaagggggaaaatcggatctgtaaaaacgaatccgtaaaaatgaatccaactccttcgacgttgtaaaaagaagaacaaacaaaaataaaaaacgaatctgtccgattctctatccttctctatctctaaacgggaaaaaaaaaatccaactctagatccgattcccccttaaaaacgcacctctgtagatcccaggtaccactccgctaggttttaatctataccgtgatatcccatacatcttggtgaaaaaattaatgtgccggattggagatttgtttgtaaaaagggaacctacatgtcgagagcattctatttttaaatgattttaatttttgggtatgtacttttgtattttgagtccctgtaatttttatatttacatttaagtccctataatcgtgcaataaggtatttgaggttgtttttgataaatagaataataaaagggagataacaaaggcagaaaggtgcaaaaaagaaaagaaaaaccgcaaaaaaaagaaaataaaggaaaaaacaaaaacaacaatgacaacaaaagtctgatt

SEQ ID NO: 98213 - DNA, 1028 bp, Oryza sativa
aattcctgcagcccggaagtttgatgtgaagaaccaaatattgtagaatgatattcagaaataagatgataaggtctggagtctggacaatggaatctggaccacacacaggttctgacgataaggtgtaggactgtatgccagaacttacaagttgttggattatatgcctacaactacaattgcaaggtaaatggcatagcagcaattttatttgccaacctgttagttgggccaggaacaacatttgatatcacactttgacagattctgttcttttaatcaaacttcatatcaataacgtatcgcaaattgtagagcagaaggccatcccttccaaacagctcagcaccacctgcatttgtatgtgataaaacattgattttgtttatgctgcaatgaatcttgaactagaaagctgcacagtagcattcacccttttttactgtaactgatcaatgatcacttagcaattcctacatcttcatttatgtttctgtgaacttactgaatttgattgcagcgaggcagacagaagtcaattacttctgatctcaatataaagatctgggtggttggacttgtcagttttattttaggagccttgtatggaagtagattgatccgatgcaattatgtttacttcacttcttccacagaacatctccttgcttattcaggcctctgtcgttactccaattcatcgagctgctacctcaaacaggctagagaatttgaacattattcatatgtatattcatgtatgaaaatttgcagatttccatatagcacagctggggatttagtctagtggtaagatattcgcttagggagcgaaaggtcccgagttcaattctcggaatccccaatctgaaatcccttttgcaatgcatgtcaaagttttttcttttccagagagagaaatgcatgtgaaggctatctatatgtttgtatgattttcagtggtctggactctggagagatgaggttttggaccacaagtttgatgaggtcctgaggttcaggta

SEQ ID NO: 98214 - DNA, 1128 bp, Oryza sativa
  unsure (1)..(1128): unsure at all n locations
caaatcatttacacatagaaaaacttgtccttgttctgtactgctcatttgctgcccctaactgttagtaaataatataaattgtcgctcgtatagtgaaaactccatccgtcctaaattataaggcttatatttttttacacggtcttcaataaaccattaatttattccatgttatgttcccaacaaatatgaaattagaatcatatgaaagtactttaaaatatgaatctagtgatagatataacatgcaaaatacttagcatatttatggttagtatgattgttagtcaaactcaccgagttcgatttttcttaaaaagagggcaccctataatttggaacggagagagtataaccctatagtgttgttgaagaacatacattaataagtctgttttctacagaattattttcttttacaaaatggtactcattatatgtggtacctatgtaagtatttccagaattttcttttttgctttagtatttacagctcattacataatggggggtacttaaattctgtcatagaccacaatgagctgcaaatactaaagtaaaaaaagcaatataattgatcagctaactatccaagatccaagccctttcacattttcactttatgctgtaggagtaagcacaatgaatccccgcaaaaagtaggaaatcaaattgtgatgattgctgacagcaaaacgaatcatccagctgtccaacataaaatcatttcagtcattggaaatctgccattctttttctttttctgagaaaggcatttgacgttcttaagaatattactctttcttatccactttgcatgttcatgcttctctaaatccatggttggtttgtgtatgtgtttctagactccctttaacctttgagtgtggaactctttcatagaaaagaatgtaggcctcacattttaatacattttnnnnnnnnnnnnnnnnnnnnntctcatcatttgcaagaaaccatgaatgagtgtcactgctctcccgcttctggcctccagtcctgcttgctcttacataggcaaaatagtgcccgccatccaacttttgacctccgtgcacaattaccgctacaaggcaatatttgtactcattgtccagatatctg

SEQ ID NO: 98215 - DNA, 1546 bp, Oryza sativa
gggcaacgagttcagtgcggcagatgcaacagcctcccgagcagggggaaatcgcaacggcgaccctaggggaggtaggcaaatgcagggacgccggctcaactactactcgacctcctcctcccttctttctgtgctagtacagtagaggcagtgatcgtcggagtggacgacgacagcggagacctattggatgtcggcggcggcggactgtagtcagtgccgtgctcctcccaactcccctcagcgcctccactcaagtcgggtcgtcgggagatgttgaaaaagattaacccgtccattgattagttcaatcggatttttccttttccgatataggtgtatatgtttgtttgcacagcagtatcgcagagggcaagatctggtttgggaggtattcacgtgttctccctcgaatccctacccattcaatttttcttttgtcttttctcctctttctctcgtgctcatgagaagacagagctcgcagtccatggcgactgcctcgatgcgccacggcggcgcgacggcctcgatgggcggtggcagcggcagcggcgacagcggcctcgatgcgcgatagcggcgacggcctcgatgcgcgacggcctcgatgggcgatggcggcgcggcgtagacggccggcaacctgatacggtagatgagagagaggagacctcatttttgttagcccgattatacccctcttaaaccaacggttagattagattggtacctcgtacctcatagtacctcgtggtacctcttcaagtatgggaaagatgctaatataaataacttgtttgttttcagacaatgtaaatatgatatctgatataaccctttaaaagggccaagtggttcggttgtcttctggagtagtttatcttctagcttgccaccttagctaatttccactttatatttgggctgttatcttttggtttaggggtgatagatttaaaatgttctatctgttatctccttgtaaggtggtgtcctctacagttacctagtggtaccaaaaaaaatccttactatgtttctttcaataaaagcatcaaaactcctctcctttttttcaggaaaaaaaaaggggaaagggggggcaaatcagttgagaagggcacattttatcagcatcagagtttgtacagttatcaccatatatatagagtagatgataggggagcaatccaatcagaaaataatcaacattcttgctggttgtcagctaccgtgcaagaaccaagaagaaggccctgtattctctgtttcgccttcatctaatccatctgattccaccgccgcttctgctaataacttgttctctttgattcgattgatcagagcgacagatcgatgggtcgacggcgatatctgaatctgttggtgcacaacaaccaccacgacctgtatttctgcaccgcatacccggtacccgccaatcgtctcttctacccatcaacaacagcagccgaagtagcagccatggccaagacacaagatgcaaccaagtcctacatcgatcacgatggcaagaggc

SEQ ID NO: 98216 - DNA, 990 bp, Oryza sativa
gccgatgccgacgcctccgaatcccacagggaaagggcccccgtgcccctccattccaaggtaataaaggaaaaaaacaaacaatctttccttgctcgctccacgctattcttgggttaggttacctgacgcacacgtttcatgatatccccttgctagaggactaacgctttaatcctactgcttaattcctgctacgagccccatttacccccctcatatggcaaataacaacattgtcttgtctttgacttctagtttgctgttgctggatatgaaagctagcgattctaggaatgctttcttcttacggctgaaagaaaaaggaaaattaagtgctttggaaatgtttctggcatgcctaattttcagataaatcacaaccatgtttctttttagtgcacacaacatgttctcttgtttttctttttacacagctgtacttcacttcactacacataattgactcatgaacagcaacaacaaaaaaaatccaatggctttcatgctaatttttagattcatggcttcattttcggtcatttttttcaggcttataacaattagaacaaaatgtttcagtacaatattgttgattcctgctgattgtctagagcttggaggttgaaaaggaactaacacccgtcattccaaacttatatactgcaaccactgttataatgcgataagcaaagatattgcctgttcttattccaaagaaaaaaaaactgcatgcaaattatcaggaatcatactaaaacatgagctaatttgaagtatttctatagttgcagtatgcttgataacaaatcttacttaaacagcgaaatgtagttggctagttggcagtgcttcttacattgtgttaaaccatggtatcatggttttacattgtgaacctgtccttatggattatgtaagcataatagtttatacactggagatgctggattgttgaaagaagtactagggaaaagattgggttgttgt

SEQ ID NO: 98217 - DNA, 675 bp, Oryza sativa
tttttttgagaattaatattatttttatggaaaatcgcaaaagtagtggtcaaccggggaaaatcgcgaaaataggtccctgtcgaacgggtgcagttcgatagcccgcctatcgaacggccagagcgcgactggcgacgagatcggaaggctgccgttcgacaggacctgtcgaacagcccccgttcacaggcagggctgtcgaaaggggccccccccccccgcccccgttttttcccgacaggctgggctgtcgaactgccgcagttcgacaggatgtccgtcgaactgccgcagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtcctgatagtactaagttaatcgtaaagtgtttctcaaatagtacggacagaacataaatgactaaaagtttaatacaaatagataagtcaaggacgatca

SEQ ID NO: 98218 - DNA, 4434 bp, Oryza sativa
ggggggggggagtgtacgacggattggccgagtgatgacggccgtcgttgcggagaagcgcggacgcggctcgtggaggttaacgacagcaagaccatgccaagggagcgcgggtgtcgacgctatctcctctgacattttcgagtgacactccaggtaggaactgtgtctagtttccctgaacgggtgaacgacggtgttaacgttatgttctataaggtcttgtttctatatgtctcacctagctttaaacggttaagccgtcgcttttttgagtgaagttgttgagcaatctaaacccagctccacctttctaattcattttataagactgtttcattcagctccgcttctattttaggtggagttgaaactatttggctgggctctagcttcatgagaggtggagctaaagctagagctgtgtcaaacagaaccttagtggacagacacaactggtttaaacttataatactttaattaggtgaaaccccacgcgttactactggagtttatagtatgattacaataaataaaaataatgtgtaaaatagctagaaaacaaaaacttatgtacgtcgatgtggtttatgataatttaaatttaagtaatatatagaatgatgattcaaatgtaaaagtaaggtgatgtggtttatgagagaataaaaagaaggaaatagtttggaccatcgattaatcatctagggttaaaaataattaaggtgagcatatggtttaatgagagaagaaaattagggagataatttgaaccatagataatcatttatggactagaaacaattggtgtagtattgaactaatcacaataactagtaggatattataaaaaatgtgaaaagtatattgaaatattatgtgaattatgtgggatgatgatttaacatgcttgcattttaaaaactctaaaatttaataaattataaaattatagataatataatattatatatgcttgtttgtatttaagtgtaataattgttagtgaatgatgatgtaatatcttgttagtggatgatgatatggttccttcgcatgttaagttttagaatttagtgagttgtaacttgatcataaaatatatgattagataaatgtgttaatgataagatttcttctcgaccacttttgctttatataccgatggcatagaagagtggcaaaactggcccattttagctaaattgtggttagaaacttagaattccgctcaccaagtcttagacaaatcaactaaaaaaattatgacgagcttagttgaattgaagtactcaatcaaataaccccttttggttctcttttattggctattgtttcatgagcagtgaagttaagttctgctaattgttttggtgttatatgtgagctttttggtagatatggttttaattaggtggtcctgtccttaaaactctcatgtaagctagagtcccatcagaatttgttgtgaaatcttttcagcttccatatttctagcaatattggtggatactatggttgagatgaaattactttgataccatcagagtttacttgactggaaaatatcacactcaacgtatgattagaagatactttccccattttataatataagactttctagcaagaaagtcttataacctaaaggagggagtagtactttagaaatggacatattttaaacactaaaaatagattttaatcactagactgcctacctgatgagtctttatcgttctttgatgccactcgatgcgaagtactcctactgatccgtgtctggtacaattactgtacaaacaacggctatataatgccaatgtaaaagaagcacaggcggaaaacgtgcgataacaattaagtagcgatcattactttcttcaagtctgtatcaatctgctgcattgctatagattatagttgaggcggcaccgccatggaaacattttgtgcgcccgtaatgtccctcccgtatccacgacatcagcagagattcttcagaatcttgaaaagacgtcggagtgaactataacgatgccatactggattatgctccttttgcccataaggcaggtatggagctgacgagaaatgatgatgaaatcgtgtcgattcccaactaatgctcccactgatatctctttccaggatgtttaaatgcgatgtttcttctgccagtttccaggaagctactccttacagactaccgtgatgcggtgatgcttataagtgtccctagggctatattaagtactcatccattctaaaatactactacttgtttcatccgtctaaaatattatatatttaaatcgatagtattagaatgtgtctaacgttgtactgacttgttacattttaaatgaagacagtagtcaagtacaatgtcaatcagaatgctgaataataatagtgggctgtgcagctagccatatagtattgattcggaccgtcttatttgatttttttaaaaaaaaattaaaaaaaatataagtcacgcataaattattattcatgttttatgttttatattagtaacaataaaaatactaaccataaaattttttggaaaagacggacgatcaagttggacatgaaaacttatgactatacttattttggaacggagatagtagaaggtaactaatgatgatcaaatggagagtaaaattagctggagaaattaggtgaataattctcctacatgagatggacaggcacgatctcctgcaatccgcgtgttcataattaagcataacatctagtattacatgtcggcaggaccgtgtggaaattcatgcatcgtgtcgttgatgcctactagaccggccccattgtttggcttatttgtgaaataagctaaacgatatatttgtaaacgagaagtaatttataaataaaacttttatatacacgttgtgttgttagcgacctaaaataaaggctgaaaataaactttgatgaaaaaactccaaaatctccgttaaaaaaaaactccagaataagcttcaaatttatagttgaaaaatttaaattttagctaataagcataagtataagcgaaaagataatgtcgctaatccttgcagcatttcaactaggggtgaaaacggtaacggtaattaccggccgaccggcgttcgttttcgactttctaccggccgagccatatggaaatggtaatcgaccgaaacaaaaatgaaaatggtaaaaaatatggaaatgaaaatggaaatgattttgctgttataccgatcgtttccgtatttaccgtattcttgcggaaattaccgtttcttataatatggtaattaccgtattctaaatatgtcgatattataggacatgtttatacttgacccacagcttatagattgaatgactcttcaataaaatctctaacttttgtacatggctaaaatgaagttaatttataatttatatagtataagcttgaatttatgtatatatataacatacttatgtaaagttaaatatatgtttttatagtttaatgtttccgtatttgttaccggtttccgatctgtaccgacatgtttccgtccgtattgttccgtttccggttttccgatatttccgatatcgttttcgtttccgactttaccgtttccgatttcgtttccgagaaaaatatggttacggaaatggttgaggctgttttccgatcgtttccgaccgttttcatccctaatttcaacacgtcaggattgcaatcttgattcttgcaggatcgtcctttttcatcgatcagactatgactgtctgtacttgccaacggtgttaaggctaggtcgttcttctcaactttcccaccctctcctttcgttttctacgcacacgcattctaaaatattaaacattgtgttttttataaaaattttcttaaaaaagttgattttaaaaaatagtaattcattttaaagattttggttaatatttaattaattatgctttacgcattctaaaatatataaaaatgattttaaaaatatactaattcatttttagtttgttttaactaacacgtaatcaattatatgctaaaccacccccatacacagctcaatgagctttgaccgcttgcctcttgattagggatgataatagaccaaggactataggttttcttaatcttatttatacttcatatttccctcatatattttaagtcaagaatatataaacaattagtttaccctattttagaccagctcttaaatttttcaagctaaaatttcgaagccattaaaacccttactcttgactattggctaacactattggcatctggacaagtaaattaacactactagtggtgctacagaaatccttatcgttaacttgtaataaccctcatctataacaaatatgatcaccgttatagattaatgcttactaatgtggaagctt

SEQ ID NO: 98219 - DNA, 667 bp, Oryza sativa
tcacaaataaaataaataataattctaaatttttttaaatgagacgaatgatcaaaacagtacaagcgggttaaaatacgttatattagaggacggaaggagtactaccgattgattgatggatcgggatggctttgaggacaaatatctttgctatttgcttaactgcagtcgatcgagcagttaactaattggtttctactccatggagtaaaaggaaaaggaatgaagcatctattgttctctgaaaattgacaacagcttataccactaaacacgctaagcatgtgcaagaaaaataaaagaagagcgggtaaacatatactctctccgtcttaaaatataacaacaatcaattttgtatgttcagatttattggattagaatatatcctattcagtacaaagtttgctatattttgaaagagatagagtagcagtacttaaagcgctaagcatgtttttagtaaaagaagaagaaaaaagcgactaaggtcttaaacttatgcttaacacgctaacatgtatagtcccaacagtccatgttttagcggcacctttggaaaactaggggcacctttggaacgtttttatattaaaaaaaattggtgaattaaaaacacataatttttacagagataaaagtccgaacaaagttcattaacata

SEQ ID NO: 98220 - DNA, 595 bp, Oryza sativa
  unsure (1)..(595): unsure at all n locations
atggcttgaattgcanattaagttcacgtctcctatacggcgaattcgagctcggtacccattaaaaagacaaatcacgcataaaatattaatcatgttttatcatctaacaataataaatatatgaattataaaaaaaattatataagacggacaattaaaattggacacggaaatctagggtttgtcttttttttgagacggagagagtatggtacagtggttcatgccatgtcaatgccggcctcacgaggacggctagctcgccgtgtcgaccgcgccaccgcgaacggggcgtcacggcctgaaactgcaagtgtgttccttattctcggttagaattcagaaattactgtatttcctctgaaacctctgcaggtgtacgtacgtcgtcgcgcttggtcggtgacatgaataactagtccagtacgtagtccgtacgtacatgtacgcggatgatccccgtgctgcgtggtccgggtgcagcacgtcatctccggcccagccagcctacgctcgtgacaagtgttgctcgatcgttcgttgcaattgaccttggagctagccggtcgggccatggcttcgcttaagaacg

SEQ ID NO: 98221 - DNA, 1211 bp, Oryza sativa
tgaactcacgcttctggacaaatgcccacctcttcaccgcatcttgtaagtgacctttgtcatgaaacatctgtccaactttcatctgcttactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacatttttagcttgtccaccttccaacggagtttcttccaccacggcatgacttgactcccccgatcgatcaacacattttgtcttctgcaccactattgccgggctatagcctttctcccttactttactaacaaactttctccaactcccagttgacgcaacctccactactctccactgccatccatgttgacccctcactggccacacggcatttatgacaaatttatcctgtactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattggacttaaggattactaatgtataccttaacttcactgct

SEQ ID NO: 98222 - DNA, 518 bp, Oryza sativa
attcgatgtgatggatgaaaaatttttattttagcaactaaacaaagcctttgtgctacatggctgaatattaagtctttcgaagtggtcatacaaaaattctcgtttgagctgtgctgcaagaaactctgcatctatcgccctgacacgcgcttcattacgatgaggttggcaagcctgcaggacatcctcgtctagtcgtttgcacatgatgtagcctgtagcctgtagccatacaagagagcacgaccaaattactggagtatggtacgttgctgcaccgcgtactgttgggaatggaaggcgactaatcaacctcagaggccacatcccatgtggtcctcttcttgaagacgtcttttaccctctactggaacggcagcagtaaatcgcattgcctcccagtagtcaatggccatcgatcacgagcaagcaaggcattgatacgcgcgtacgtacagtcagtcctacacacatccgtagtggtatatactccctccgtaccaaaaaaaaagaca

SEQ ID NO: 98223 - DNA, 614 bp, Oryza sativa
tgatcgatggccattgactactgggaggcaatgcgatttactgctgccgttccagtagagggtaaaagacgtcttcaagaagaggaccacatgggatgtggcctctgaggttgattagtcgccttccattcccaacagtacgcggtgcagcaacgtaccatactccagtaatttggtcgtgctctcttgtatggctacaggctacaggctacatcatgtgcaaacgactagacgaggatgtcctgcaggcttgccaacctcatcgtaatgaagcgcgtgtcagggcgatagatgcagagtttcttgcagcacagctcaaacgagaatttttgtatgaccacttcgaaagacttaatattcagccatgtagcacaaaggctttgtttagttgctaaaataaaaatttttcatccatcacatcgaatatttagacacatacatagagtattagatgttgataaaaataaaaaccaattacacagtttacgtgtaaattgcgagacaaatcttttaagcttaattatgccatgatttgatactgtggtgctacaagaaatatttgcttatgacggattaattagacttaataaaatcgtctcgcaatttcatgggga

SEQ ID NO: 98224 - DNA, 511 bp, Oryza sativa
gttatttactcttgaatgcatgttgtcaatgatcaatctttgtggcttgagttgccggttctaactgctgtgtcagtcacactttttattgtgaataagatagcacattacagatattcgatactgaatctgctagcccatttcagttttaatagataaatacttgaattagagaagaatgtttttgttgtgatgaaatatattttataaattcattaatgatattctagttctctggttaaaggaagcctttgcagcagtcattcaaccatgacacgtcggtaataaaattgtcataaaataattgttttcagttgattgtgggatcacatactctaacgaaatacagatatgagtgactaatttggcagagtcttgtgtacttccactcaagctgcccttagttattcaaaacctgaggcaacattcacaaatttaagcctttctaaacatgcccttatgattgcttatatttttgccgggtcggccgaaagatttggtcgaccaattt

SEQ ID NO: 98225 - DNA, 591 bp, Oryza sativa
cctatagttttctttcatttttcttttgtggagatggtaagcagcatgcaatcaattttttactgaatacctgtacctgaaatctggagatagttcagtggacaggcctgaaagcaaccaggatgtttggtggttcggcctggcctgccaaaagattaggctaggaggaaaaaaaggacttaacagaatgctcatacaaaattgtaataggtacacatagtgggtcagagcaaagtctctgaggcgaaaatactaaattatgttgattcatcattaggaaactccaacctctagtccaaatagatgttgctctagcatgtgttattccaaaatttgattgctaaaattataaaagcatttaacttatcaaatcaattcaaggggactcaactatgaaggtgtaagatcaggtttagttggtctttccagtttgccggctaggccctggctctctgactctaaaccttttctgctcttcctcataaaggcatactccaagagaaaagtttgctttgaagctataaaaatgtaccagaacaaaaggttgtaagggaactacttgaaagtaagctgggcaaattagccataatg

SEQ ID NO: 98226 - DNA, 518 bp, Oryza sativa
tccccctctgtcaaaaaaaaaaaaaggtccaattctaaggacaaatctggattctgaatacatgcaatccagatttatctctagaattaattttttttgacagagcgattaaacttgtagtagaaaaataaaataaaacatgggccaactaataccacctaagtactccatccgtctcaaaataaatatagttttgcactattcatgttcaatgtctgttcatcttacttgaattttttattagtatttttattattattaaatgataaaatatgaatagtactttatacgtgagtcttttttttcataattttttcaaataatacagacagacaaacgttggatacgaatatccatggctacacttatcttggaacgaatgcagtatatactaactccgccccgaacaaatataagtttaggttgtttagcatgtattaagatttgtgaagaaagattattatgcctcgcattaataataggaaataattttaatgataagtaaatgatgggacaat

SEQ ID NO: 98227 - DNA, 609 bp, Oryza sativa
  unsure (1)..(609): unsure at all n locations
tcaagggtgcccaaaagtacacgtcaaaacccgatcaaatccgagtctttgactgacctgcatgcatgatcaggctgcaaagctacccttgccggctccgccgtccggccgccgctgccgtgattaattaaccgcgcctagcccatggtaacttattaacatctctagtcaactactaactccaaatcatctagagccaatataataataaattcatacaataattgcttactatactattaatatttagtcccacctattatacacacgctacgttttgaagttcgtgctacagctgactacagattctatagcccgctgctattctctcttttttttatctctttaaactatgtttatagctggcttaatattctgttatcgtacttgctctcagctgcgaactactaatgttaatgtacttaccttacatcatttagctggctcnnnnnnnnnnnnnnnnnnnnnnnnnnnnnntctatttttttcttttaaaattaaaaatatttaattttgtatggaaggtgttttcaccctgcctcagctcgttatgaaacaaaatagtaaaaaaaaagtaaatcatgattttgttttcgaagaaagcttgat

SEQ ID NO: 98228 - DNA, 585 bp, Oryza sativa
gtcgcgccgcattcgaggcctctgcctccttatccctcatcctgcgcgcctccgccgcgccgagcagcgactggtattgccgccgcctcgccttgccgagcacgcgatggagcctctccgtctacaacaagcaagcagagctacaccacaaccatcagaaaaacatcgctgaacaacatagcaataacaaaacaacacgatcaacgacgaccctcacatgatcctgaaacagatgcaccatctcgttctcgtactggtcgaattgcgtgacgagctcgtctcggagaggagagacgatgcggaggaggccgtcgtcgacacgtgctccgacccgccatcgtctaactcgagactgagcaccgtcaccgccggccgcttgtgcagctgcgcgaggctcactaccttgtgccccttgcccctgcgcctgcggctgcaacgacacttctgcatgcggcgccaccatgcccgccgactttgtctgctcagacgattcctatagttgcccccatctgcaagccagggggaagaaaaaggaggggaacgaaatgatcaaggggcgcgccaagagtgtgagcctgtgagagg

SEQ ID NO: 98229 - DNA, 782 bp, Oryza sativa
ttgaaaaaaaatccaaagtgactgaaactgtcaggggcttgggatcacatgcaagtgggacacccatgttatttttcaacttacatggtactgagaacgaactattcatgcattaacatgtataaaaggtgaagtacataagaaatatgagcatgaatttatacatatgaatgcaaaaacaggaacagaaacaaaaaataacaagctaattcatctaacctgcgatgatagctgaatcatcagtttcaagaatcgaggaacaaatgaccaagtcatcatatatgcaacagttataaatacggataatacaagcagcctgcatattagagatatttgaggttactgatgaaccaaacaggcactaaaacataggcatgcatcaatatgataatgaaatttagattttattttaacatagctattctgataatagccatacagtttagccattgacatcacgcctccaaaaatgccactagcaccacccagaactggaaggagagcaaataatagtccaacggcacagtcctggagtaaaggaaacatggatgtgacctccaaaaattgactatttaaattccatatagaatattaaaagggcaatgactatttaaaattcatgaagaatattataagggcaaatgtacatatttgttgattatcagcactttgttcacatgagcagtatatatgagaattgcccaggaagttctaagtaaaggcatcttattttattatattttctgttgaaaagagtgagaacaaacaggggctgcaggaat

SEQ ID NO: 98230 - DNA, 588 bp, Oryza sativa
tgcaagtggtacaaatggaatgatattgatgatcatcaacactctgctgcagtagtgttatgacttatgagccaagtgttattagattaccacatctcagtgtcaccggatgtagctcctaacaaatgatgtggccccgatgctacttaggctgtcagaactctgtaattgaaggaccaattattatttagaagctatatatgaaagtgaaatttcattcaaattgaaataaggaccaattatactatttttaaaaaaggtacctgggacttgggagatggaaacacgttccaaaaccgaagcgtttcatcaccagcgccagttactatagtctgttgacataaaatgtcaaaaacacagctatgccaaaatattctagatacaataaacagaattcagtagattcaaagactcaagagataacttcacctgtccatctggggagatggctaaatataataccctatatgtatggcctgtcaatgtggcgagctacaaaggagaaatcgagcacaattaatacaagaaaaaggtaaagcgtactgagttaagaataagcttgcaagcatacctttgacattgttgggt

SEQ ID NO: 98231 - DNA, 694 bp, Oryza sativa
attcctgcagccctatcgcagccatactttgcctgctctgaatcattcttctttttatcatgtgtaatgacagctacagtctccagaacagcctgtaccaaaaaaaatgtttctcaacataccttgacataaacaaactaataagtcaacattaaattctatgtaatttgaatagggttcatttgcaaattggaacatagtaggcagctttcctcatggtgtcaagagtacatattaagagtatacttgaggaagagatttagtaacttgacacaacacatagagataccaaactaacataacaggagatcccacataaaaaataacaaaaagtgtatcttggctcttggcaaggagtcaaccttaaatacttgtttatcagcaaggccatttaatatacatgcagatgtatttgcaagaggaaatcagttctgattgaagctttcgtttgcttttagttcacagtataatggaactccctttctcaaataggctttccatattggtaaaatgactctgggtcgcaaactctgtagcgtagcaaggttgtctggtaactttctgttgtattaactcaagtgatctattgtgcttgcaggtagatcattaactctgtatattatgctgcctctcataatgcagaaacacctaaagctttgcatattccccaaaaacttcagttaaatgactaatg

SEQ ID NO: 98232 - DNA, 637 bp, Oryza sativa
acatactctctccataaaaaaaacaaatcctggtttccgtgttcaacgtttgaccattcgtcttatttgaaaaaattataaaaaaaataaaaagacaagtcatgtataaagtattaatcatgttttatcatctaacaataatgaaaatactaattataaaaaaaattcatataagacggacagtcaaatattggacacggaaatcaagggtttatcttttttttttttatcggaaggagtatacttgcatacagacaatgtcaacattaacagcatttgtatgcttctgtcttggaatgatgaacctcgggctttgattccatcagacattacagctggttccaaatttcagttgtatagagttgttgaaatatactactcgtactcacctgcacctttgtctgtggaggggaactttcaacaaatctctcctgatcatgtgagcgagtctctacttgtactataaatctttgtataatacagtagcatcgtgtatgtgtgatctgattttctttataatggataaatatctggcccctatatccacttgtgatctgaatactgcagtatatattggtagtaaatcttgttgtaatttatgaactgtctttttcctggacgatcgattgattccaaa

SEQ ID NO: 98233 - DNA, 768 bp, Oryza sativa
  unsure (1)..(768): unsure at all n locations
gcgtgctttgananctcggctcggtacccgatgctacagtaaattttttataattatagattaattagacttaaaaaattcgtctcacgaattagctctaatttatgaaattagttttttattagcatatttttaacactccaaattagtgtccaaacatccgatgtgacacggactaaaaagtttttagtcccatctaaacagcccctcattactccctctgtttaagatggtataaattataatacaatgtatctggatatacctctgtctatatatgttgtattagaatatgtcacattctattttaggttgttttttttttctggagggagtaggcacgaatgcacgatgcggatgcgagctgagtcatgcatattttggaatggaattattctcagatcatcagcaattggtgtattggagattaaggtctttcctgaagctggggttatctcgttgccgctgggtgattggccaggttgagtcaatcgctgaccaagctcaactctgatattgaccaagttaggtaaagtagggtagtatatcttagatacactcgataatacagtaatacaccgataagtggaatgtgatttcaaccctaaaatttcgtatttaattctcaacacgcttataatttcttcgtgaaaccctttcaaatctcattntaggtaaagtagtgtatcaagtaaaaaacaagccaaaaggaaaacacttgtttttttagtttggtccgtcgatgatgaagtacccacgttccactct

SEQ ID NO: 98234 - DNA, 1140 bp, Oryza sativa
  unsure (1)..(1140): unsure at all n locations
tacgcgaaactccgaaggctaatgaaacgttaagcccacgcgaatgttaagnaatattgccaagtttatgcatnncctatctaccnncnnccccaagaggtttgtgttgatgcncatccncanccnannnagaggaccccgaaagcgaaacaagcnaaaacaagggcggncaaacaaaacaaaanagcaaagcaaaaaaaaaaagcaaagccaaacacgcnaaaaaggggggaggaccaagncaaaaagcgaaacaagcaccaaanaaaacagggcgaagnagaagcacaannccccaaccagacaaaaaacaaaggnaccaaaaaaaccggaaccacacgggggcgcnanccaaggcgcccaaccagaaccccccgnacggaaaacggaacgagccaaaagcgggggaccaaacaaggancagccaacccccgnnccaaaaaaaagacnaaanngagccccccaaagaaaccgggggggaaaaacccncccaaaaaacgcgccgagaacaggncaaaaagcgnacgcgcggaaaacgagagaaagggggnggaaaaggggcggccgaacacaccctaagcagaagcaaccaaacacgggctagccgagaaaaaaaaggagaaacaaaccaaacacggataagggaaacaaaaagcccgaaaacaaaacacgcgctcacaaggataaaaaagaacaaggtaactaaacatgtactaattaagttaaaaaagtccaaaacacctagacgttttactactaaataaaattactaaccaacatgttatcaatacatgtcccaagtaaaaaaaatggcaagcaactacccctctgtcaaaaaaaaaaaaagggccaattcttaggaccaaatctggattctgatacctgccatccacatgtatctctaaaaataaattttttttgacaggagcaattaaacttgtgggttgaaaaaaaaattaaaaacatggggccaacctaataccacctaaagtacttccttccggtcttaaaaacaaaatatatgtgttcgcacctattcaatgttccaaaggcgggtccaattctactttgaaattttttttctagccttttctaattatttatttaaacgggataaaatatggattagtccctttctcg

SEQ ID NO: 98235 - DNA, 663 bp, Oryza sativa
cccatgtaatatggaaaaatatgatactagggtgtgttggccaacccatgttcctaacctctttctctcgttttccacgcgcacgcttttcaaactgtaaatgatgtgttttttgtaaaaagtttctatgcgaaagttgctaaaaaaaataaaattaatccatttttttaaaaaaatagctaacacttaattaatcacgtgctaatggattgttccgttttgcatactggatgtttggattgggaacctggggtgccgaactaagccttaaaagttttgaagcttacctaatctataagatttgtgacacaggaattttaaccgctaattctcaaccttggttggatgtatcccaacatgccaaaaaccaaccgctttaattaggctccagagtttaaacaaccgtgacgtggacattggctttggcacggggtggtagctgggctccgcggcacaggtcgagcccgagtcaagccgttgcacaaccagaaatttgacctcgcagctaccacctcgtgctgtcaccgctcagcacagcaagcagcaacagcaaagtgatttgattcctcctcctacccaaacagatctgaggctgctgccaaattaatccccttcctcgcgtggcatgtgcacatccctactactagcgtagaatattgcttt

SEQ ID NO: 98236 - DNA, 769 bp, Oryza sativa
  unsure (1)..(769): unsure at all n locations
cgtgcgctttgaaancgttagacagctcgtaccctaccaaaatatagcccttctggtgtactacttgtcccatcaccccccccccccccccgaacacacacacaccaaaaaaaaaaaagcttcccatattacccccaaggccccaaccatacctcatctatgagggggcatcatagtttcttttctattcacttaatctttgctaaaaccctagaaatgcttatattttggaatggagggagtattgttcttacttctttatccaacagctagcattcgtaccacagcttacagagaatatatagttgtctcattcagaaagctgaagaattttgctaaaatacagggaatgagatcattcagctcacaacattacaaagggacgtctcatcataggcagaagcagtgagatcatttaagtcataacattccaaatctcctctggtagctagctagctttcgtctctctgactcttctatcctgtaattgtgcccattgtgcattattctgcattgacgtatgcttgcctttcgctataggcttttcctgctcttctctttaagatagctagctagtcttcagtgattgtactgttcctttcttgaaaaagaaacgcatatacagtctgaggataagatattgagatgcatgcacacaaatgcaataaaaaagaaatgttaaaactttggagaaagaaaaaaatatgagagagagattgtccggttagcactttcccttcttctttgaaggtcaaacgggggacaaagg

SEQ ID NO: 98237 - DNA, 664 bp, Oryza sativa
gttgtaactattgtagcattgaaaatgtagtatgactggaatttggatgcataaccacccatttggccatgatgtgatttatatgggcgattttacatagcactgtaattcagtggtagacccagtataaaattttagctatgtcggaactatatataatctcaaacatgtcgatacgtgataagatcccttggtaatgaatttaggtatatataagtaaaatttaaggtttatactataataataaactatacatattgaaatttctgctaaaaagtttgttggtaacaaatagaaaggtaaacaacatgatccataacataaacaattattaatattttctcgacgcctcaaatagctttataaaaaatgcagcagctgcaatactaatgatagcagagtggatagaacaaataaaagtttaacgaggttcatgaccaaagcaactcaaataaatattaatctgattcactcaatggtgctccttctttggcagtgtaaaaaggcttgaactatgagctatttatcctacgatggaagacgcctaaggcctcgtgtaatgcattcacccacgacctttctatagacataagctagcttgagtgataggctcctagcgtacactcgtttctcacccacaataagctttctgctaacgccacat

SEQ ID NO: 98238 - DNA, 785 bp, Oryza sativa
ttgtcatccagttgatgttctgcattttttcttcttaaagcagaagattttctgctcgtcatccagttccatgtactgcccatatatatagcatcatcaaccggccaaaacaagcagaagatcatgcacttgcatgtgctgccccatctatagaatcatcaaccgactaaaacgagcagaaggtgagatccacaaccttctgcctatattaatttccatagaaccttctgttcatattaaccttctgccctatacgcctatgttaatcttctaaaccatctctatatggttattaattttcatagggaacgagcagaaggtgatctaaccttctgcctacattctggccagggagcttcatataagaagatgggatttagttacatgagcagaacataatgttgtttgtacctaatcacctattagctagggagcagaaggtcctgcatgcacttgatattcgacgaattttttcagttgatgttctgtcattttctgttgagacgctgaatttttgtagttgatgttctgctgttacatggatttttctttcgtttgatgttctgccgtatttagttaatagttagtttgagaggcagaaactccatgctagaagctagtttgcatgcaaccgttaattaagtgatttattaaactatttagttaattgtttaatctactgatttattggatccttgcttataccactaacccactaagggaagggagtagctactcccggtagtaggaaataggcgtcctatatatatatatatatatatata

SEQ ID NO: 98239 - DNA, 591 bp, Oryza sativa
ataagacgagtggttaaacgttacaagtaaaaactcaaaatcccttatattataggacagagggagtacaagtgtacgagtatttcaattcgtctgagtggtgaaaggtaacttcggtgaccattttgggatgagatcgggctgtttacattgcatattgcaaaacttggaatatttttatttgcacttgggtatggtgcttccttgctagcccttaactaataattggatgaagggatagattatacatgaacatgtttgtacataccaggagcgaattctgaatttgcgtgtaacttttgttattggtacaagatatccatcgtgttgcaatgccactgtttttctttaaccatttatcatttatgggtcacattctcaaaaatttctttgaatgacctgtccaagtatgattggtgttaacaatttacaaactttgcgtgcatgtctgttgcatacgtacagtggattatcctttggcagtatgacctgtttgtaatacacatcaatcttgaatctcatccgcatgaaccagattatagtttaactaaactatttgcattctaaaaaaaaaaactgctatggaagact

SEQ ID NO: 98240 - DNA, 653 bp, Oryza sativa
ttttttttgaaatttcttatttctaatcaaccgtcaataagtggtgaagtatttcatgaaggttggattgaagggttgaagagaacaacgaagagctgctggaaacttgactgacgactacccgtaaagagaatggtgaagagttactggaagggggtgctgtgatgcatatgctggcaaaaaaacattcatactcctactttaagtaattatcggacttcttgttgatttttggagaaacaaaagagatatacgcaggtcatacttatgagttaaatttaccttttattatgtgagagttaaacatactaaaattaatgattttatctgaactcgtctgaaaaccagtagcttctcttaataattcagattatgaatgtagtccaaacacatgatgatttagcttttaccttgcaatctacggtctaccttgcccgttctaactacttttaagcaagtcacttcttccagtttaataacaacttcgcttttgatagatgagttgatttattgtgtacaatttgaaccctaatctgattggaatatatgactctagggtgtcatacttttgtctatgtgagtccataagctggtgatgctggggagaacactatcatttatgccacctaagagcacatgtgatcaagaatgga

SEQ ID NO: 98241 - DNA, 904 bp, Oryza sativa
tagatcatccgttaggtcatgtttggtttgaacaagccctataaaataggcgaagaaattctattcttctatttaccatttattggctactgttgatgcttttatcatttctaagaaactgatggaggatccaaggtcacaataatcttattaaacttccattttcatcggtacctgtgagctttaataatgtatccatagcattaggattggatactactccctccgtcaaaaaaaaccaacctagaagacgatgcctagtacaacgaatctgaacaggttgattttttttttggacggagggagtaaggatacagatctcggctgtgtcatgtattccattatgcatagtagatgttagctattgtcccagttccgatagagaaggttagaagggaatgtaagagcaagtttaatagtatagcccactactagctccaatttatataatagttgcttactatattattaatatatggtcccacctgtcatacacatattgcgtcttggagtccgtgctgtagctcgttacagatttctatcccgctgctcttctctctcatcttttatcttattaaaatatgtttatagctgcctaatagtctgctattgtacctgccctaatggtgtagtagaacttttaactcaacccatttaagcaatgaatgcattttttttagtttacttcattcaatatatgcacgtgcaggctactaccaatagtagcgaactttttaactccattttgtactcattttaggccgtgtgcattttcatttaggtgaaatttggtcaatatgtatcccgctgggtatgactcgtagtcaatctctggaggatatggaggatcataggataggctaggtaaccttttcactattcttttttaaaggtaccttcaagt

SEQ ID NO: 98242 - DNA, 623 bp, Oryza sativa
attttttttagtgttttttactacatggcgttcctttaattacttttatacagataagctttgagatagtggctcgagagaaagaaatgtgcaaacctagaacatgcaaaccggattccccaatatgttctcagcaaatttggaaaataacgtaggctaaggcgctaagcagtatttggttcggattgatagttaaattatgaagccatgcaatatttagactgaagaattttgacgtgtatagactaatctgatgcgtatggacaactgcaatatatgatgatgatgcatattttaaggccattccaacattacctttgtaaacattacgtttgatgattttcgaactgtacttttagtcaaaagcatgccatagctcatatttgataaacattatggtaaatcacttgtaagcagctcatcaaattatgctcaaaccatctaggctatgtttggataatgggaaatgaggggtgggattaggattgagaaatgaatcaagggctaggatgaaataaggtggagaaaatagatggttaggatttaaagtaaggtgggaaatcatttccttttcccattattcaaacggtgccctacatattatgcttaaaaactcaaagctg

SEQ ID NO: 98243 - DNA, 558 bp, Oryza sativa
taaatattgttgttgttgttgttgttgttgttatgaactcagaaatctgcctggtggaagaggaagaagggtgatgcgatacaatgacaaaggttcatgccaaatctaactctgggttaccagcagtgaccaacctcagaagtctataggcagtcctcatcacttccaagttgccaatagtaactctgtgatttactaatgagaggacatacccctggtaatcctgcaatactacagttaaaagacaaccagaggaatccccagcaaaaattgattcttgcactaaaggaaataagaagttgagtaaagctgttactttgaggaaaatggacttaatgggacttgctacgttggcttgtcctaactttgtatttctttccttctacttaatggaatggcatgcagctctcctgcgttgttcgaaaataaaggaaaatagaacttgtttggtgccttgccaggtttggattatagctaacctacaaaccaactaatattattagattgtaccttcatagcaagcaagggccagtatgaaggcaagtgctagcaagtgac

SEQ ID NO: 98244 - DNA, 2406 bp, Oryza sativa
tcactcatagtactttaaatgtgatttgtatcttatatatttgcataaaatttttaaataagacgaatggtcaaacatgtgagaaaaagtcagcgacatcatcaattaaaaaacagagggagtaaaagattaaagagaatagcagcatgaactctaagacgcaatatgtgtatgacaggtaggaccatatattaatagtatagtaagcaaatattgtatgaattagttattagattggctatagagctagtaatagggtatactattaaacttgctctgaggaccaaaggactctggctcctcatgacagatcgggtgacgtgagcctctgatctcctgtgcagatattaagtgtccattggactttatttatgcatggcaaggcgttttttttttttgaggctgcggctttgctgcattcagaaaactgtttgaatttcattgcggccgttcccttgttgagttttgaatggaattcatgggatttcacaacattcatcacccccaagagagattgaagatgatgactgcttatcttaatggaagtagtggaaaatagtttggtggtaaaactggattttatgataaactttatactccatgttgttctaacttctagaaccaaagttgagtggcaaaaataataatgaaaagaacttttaagtcatactaaaattcaaaattggttacgggcttatgactgaagatgcctgtgcataatttagatggattaggaggttgcatagtgcacggaacgcgcgatttgagaggctttaacttttgtgcttggacttctctggttagtgggagaagtgtgctgactaggagtgacaaggcattggcacacgtggcccaatgtaaactggaggcaagagctttgcaactggtatcagtagtagtgcaggttagagggccaaaaagtcagcaacaaagggtacaaaagagaggatggagcctccaggaagctctagccttttttgtgcatcctatgtaaaaacatgatggttgaagataagcctcatgatggctgcaagacaaaactggaactaacaaatcaagaacaatatcttgatgggaaaaaaaaggagggggagaattgcagattgcgcatgcgaagatgggagaggaaatcctggtgcatgttgggttgggttgagcatggaaatactttgggtcaactcgtggggttcaggttgaccaacacatctgctcttttgttagtggggaaaccatgaacttctccttctggttgatgctgcaaatattttacagatattcaacgaatgaacgagaaatttcatccaatgcaaagatgttgccagaagtcaaaacccacgatgcaaacttttttcttttcttttttttttgaaaaactataccttagtttgagattcctccctaggttcactttctttttccttctttctgtatgtgttatataacttggccccgtttaattcgtgaaaagaaaatttttggtgtcacatcgaatgtttgcccggatgtcagaagggatttttagacacaaatgaaaattttttttcataactcgcctggaaaccgcgagacaaatcctttgagcctaattaatccgtcattagcacatgtaggttattgtaacacctatagctaatcatggactaattaggctcaaaaaattcgtatcgcaattccctctctaaccgtgcaattagtttttttaatctatatttaatgctccatacatgtctaaagattcgatgtgatgtttttagaaaaaaaaattagggaattaaaccaggccttagcacatctttctcaacaaaacagcttcacaccaaaacttattttcgtcgtctttgctgagaaaccagtcgcccttcctcatgaggcaagcgcaacagcccatcttccgataaccatgatgttcaagcatggagactcatcacactgcccaacaaggtttaattgggagaatctcaaaccaagggaattaggaaggagatatttgcaacaaattgtcttataggagggaatctcaaacctaagataatatttggagtggcttttatatttttcccaacaaaaaacaggagagggattttacagcacgtcctcaaagtgcaaagtgcaaacttccaggtgaactagcaatatatatatacttggcaccaaagtataagacacaaagatcacattccactaacccaaaaaagagaggaacgaatagcttaacgattaagtccaaactatatgcacgtttttaatacgggaaccattattcgacaaaatgaatgattaaggcagtgcttggggtagataagacatcaatcacaagagcttggccaattgcttcatagaggttagactacaaaccgaaattaagctgaagcaaaatcccaagggtacctggtgcacagtgcggtg

SEQ ID NO: 98245 - DNA, 513 bp, Oryza sativa
ttgcttattcctaagctgaagcattttatttgagcagaacatgttgtgaaaaagatgacgcaaattgtatcgctagtctaattcctatttgagcagaacatgttgtgaacaatgagtaggatgagtacggagtgtctcagtacgcaaattattccatcatatctatatctatactaatctctatctctactattctaaaaaattgaagatgcttctactgtgattttggtatgttatttgtgtttgaattggtttgtaattttatctctatctattataaaaattgaagataattcatactcgcggtttgtttggtacattatccgactaagattctcgcttgcccttgcgtgtggtgtgtcctttgctttgcaccatcatcagctcgtgcgtctgtcaatccactcgcttgacacgctatcatctgtcgttgcgcaatctggatcgatcccgccctcgtgaagtaatccaggattccaaatcgattctggtgtacccgcagcttggtggtgg

SEQ ID NO: 98246 - DNA, 629 bp, Oryza sativa
agagttctttcctatggattttcatttgccacctgatcaaaagttgccattttgtttccatacaaatgcgcatttatccaaagtaacctatatagtagctattcaagtatatgttgcttgctaggttgtagacagaattcctcagagcatagcaggacagaggcataagagggaaacgtcctatcgttatgtacgtcttatgattgggaagattttcacttcatttgtgcttctattatgcaaaccaatggatatgctctctgatttggtaatcgtccaataacgagcaacagttgtgcaataattatctcaatttaccagtatatatatcaaacatcggatgaatgaacaagatattcgacaggctgatagatagaaatgagcaaatgattgggaagattaagattgcatatacatggtgatttccacttcatttgtgcttctattatgcaaaccaatggatatgctttttgttttggtaatcgtccaataacgagcaacagttgtgaaataattgtctcaattaaccgtaggcattgaatggtaatttctaattgccaaacaaaaattttagggccaccatcattcatcaccgatgtgtattcttaattgttgaactactgccatct

SEQ ID NO: 98247 - DNA, 551 bp, Oryza sativa
ttatatcgaaagttttcggacgaaattcaacgattaatagtttgaaaagcgtgctaacgaaaattgaggtaaaatctatatcttaatcaaaaacagatgaaaacatttagtagtttcattaaattcatcgttcgatatgtttttatagtatatttacaagtttattccaagttaaaaatgttgcttttttaaacttaagaagatttgatttagtactccctccatcccattttaagcgtacccataagtttctgggttcaactttgatcgtccattttatttaaatttttttaattaatatttttattgttattagatgctaaaatatgaatagtactttatacgtgacttatgttttttattttttttaaaaaattaaataatacagacgattaaagttgcacaaagaaacttatggttgcgtttaaaatgggacggagagaatataaccataaaataatttatgatatgaaatggagggaatagcataatttaggcacacaaatgactagtactcctactacgcgtagctgtttagcatgtactcacct

SEQ ID NO: 98248 - DNA, 651 bp, Oryza sativa
agacctcaaaagccaaatcagacaggagccaccaaaaattttggaaaatgctgagtattgcttcaactctggaaattctttaccaaaattgaagataagatttttcattgctcttcgacagcatacaaacagacgaagtagccccatggaattacaagattcataacgatggcataccattgccaatagcagcagtctgcaagaaaattgaaaaaatgtcattctcagcaaggagataaccaaaagatttcagttgcagctaagaaatgtgcaatgtgcatatcaccatgcactttcccaaaattgttgtcaatacagattcccaggacattttgactaactaggatgcacgcagttcaccatcacaattcgttgcatcaaaaactgatcataggccttattaacaaaaaggaaatactgaaaaagactagagaaccccaatatcaataaagacaacacaaaatccactagaaataacccagagaaacaattatttacaaagaaagaaattaagttgtaataaacaagaagttcaactaaaaagaccaccaagatcttcataagaacaaataaacattggacactttctctcaagtctcaagtgtttcacatttgtgccctccaattactgccatgagacaaataattaac

SEQ ID NO: 98249 - DNA, 687 bp, Oryza sativa
cattccaacattacctttgtaaacattacgtttgatgattttcgaactgtacttttagtcaaaagcatgccatagctcatatttgataaacattatggtaaatcacttgtaagcagctcatcaaattatgctcaaaccatctaggctatgtttggataatgggaaatgaggggtgggattaggattgagaaatgaatcaagggctaggatgaaataaggtggagaaaatagatggttaggatttaaagtaaggtgggaaatcatttccttttcccattattcaaacggtgccctacatattatgcttaaaaactcaaagttgctttgaataatgcaataaatgaacaatgtgctgaaaattttatcaaacacatgatcgattaagaatctttcattgaggaattttaacatatggtgggcagccagttagagcaggtacaatagcaggctataagctaactgcaaacatattttaaggaggtaaataaggagagataagagcagcgggctacagatttgtagccagctgtagcacggactccaagacccactgtgtgtatgataagtgggtccaggtattaatagtataatatgtaactattatatgaataagctattagattagctatagataaattagagctagtagttggctatactattaaacttgctcttataggaatcgta

SEQ ID NO: 98250 - DNA, 714 bp, Oryza sativa
gtggatcccccacacgagcacctgcatgggctgaccctgctggctgtccatcttgctgcaaacaaaaagctataatgtaatacatccaaaatctgtaacttaacgaatcaagaatcagctcgtgaagtgcaacgacgggatgcggatttccgatatccaacgggaatacattcaataagctgctgacgctagtggccacaagtaaaattaagaatatctagtctaaaaaaagtttattctgtcaaaacattcagataaaaaatcaacgggaccatatgtaatgagcagttcaggaaaaaaaaaacaatccatctgctttcttgaaccacaaaattcaagagaatcgccatcaagctccttgagttttcatgtattgaaaatttcagaaggaacaaaacaaaggagctcaagaaaaacatggctcagttgcaagcaaatgaacctctcaactagcggacccatcgtgctgcccgcagccccctgcccatgtgggatcgatatgccatcgacgaggctgacccatcgcaacagaactaaagcttgtatacccttcatcccaaaataagctcatttataggtttctgtatccaatcgagcttaaaaaagtagctcagttgcaaccccaacaaagcaaagcttcacatacacacatacgatgcgttaattacgtttctaaaattactcccgcatgacacaaccgtgattagatttgag

SEQ ID NO: 98251 - DNA, 738 bp, Oryza sativa
gcggccgaactccactagtggatcccccgttccatttgaagtgcatctacaaatttccgtgtctaacgtttaaccatccatcttatttattttttttataattaatatttttgttgctatttgatgataaaacatgaataatattttatgcataacttattatctttatttttttaataattttttattttaagatatacggtcactgcatttaaaatggttcggggagtactagtagtactacaatacagatggctctgctcccatgtggacgtacgcctcgcgcccccatgtggtgtcttggatttggttcggatttaggcgtaccgagtccatgccaatcacattgtttttccacgccaaattgcgtctcccagaacaccaaacatatggtggccaagaaaatgattgatacgcacggtggatggatggatggattggtggcgatcgatcgattggtttgatgatgaaaagaaaaacaaatccgaggagcacctggaatcggggacatgcgctgaaccgggacaaggaaacagccccttgttttgcgaacttgtagttgtagagttcgtgtggagttgctgtttgctgttgccgtgttggggtatttttctgccgtttcttggagtctttgggcagtaggttcaacagctaaaggagacaaacctctctccggccgtgttgcgaattcgcaatgcaaaatgcaaccgacggtctggtctggtggtgttgctagtc

SEQ ID NO: 98252 - DNA, 759 bp, Oryza sativa
ccccactcgctcgcttcccgaactcggctaaccaggagaaggcaagttgccttttcgcagaatcagttccgaagaacagttccaatcctaccctgggattttacaaccaagccaaggagatctgcggagcggagtggctctgatactaaattttgtcaacaacccacaactcacacccaaattacagagagaattgcaacgatgagagaattagagcaagaggaattatggcaactcaatatagtagtcttctccgattccaacaggaatggagccgccgccgcctacgccaccgtggttgccattcaagtttccctcgagctcgctgatctgatatatatatcctatctctctcttctttccccttgttcacgctagcctattacaatatggacttctattacatggcccagttaggcccacagtacttggggttttgcttaacaggccttgtagtacgacgcagattgcctccctttgactgcacagctccagcttgacgatcttcaacttcgtcagagttttgctccccatcttcagtcaatggaacatcgccaggtaccgcctgctccttgacataaacatgcttattttcttctccgttttgttaattttgccactgaatcttacagatatatgttgttcatcccatttagtagtgcactgtgatagcacatcatcacaaactaggagagccgttggatctattcccaatggcttgattgcagtctctcatgtaacgggcacgtgtgctcttgc

SEQ ID NO: 98253 - DNA, 763 bp, Oryza sativa
agtggatcccccacatatgtatatctagatcaatgatgttcatctatcatttttacatgtaaaaaaaatcctgtaaaattcgcatttacacttgtgattattattattatttgtgaaacacaaattgttcgacataccatattatgacctgaaactataagcaacattggtggttcttttagcttattcggaagttaaaacaaactatatatttgtggatgtcatgtgttctaatgttccaatggatgatggattatacatgaactaagtttattacaataattcaaggtcacaacaaaagaatagatattcattttcctttaaaaaatatattgtagtgagtgatgaacctatcaccacctactcccaccaccacctgatatatggggtccattgaatagtgaatcatgcagacagtcgttccttctcaaacctaaacatgttcaaattgtttgtagcaacgcacgagtatatttacctagttaacactagatttgaaagattgatttaaaaggctctctaaatattgatgaagaagacttccgtataaatcgtaccatttaagaaacaccatgggatattttggccatgtacaacactccaccgtgggtagtggccacagcactctagctaagcgatgggtaaattcccttaaacctactctattcatcatgcgctaatggcctaattcgttttacgtattttcacagccttctcctctcctcttcttttatactcccttagtttcatattataagttgct

SEQ ID NO: 98254 - DNA, 752 bp, Oryza sativa
actagtggtatccccacgacgacggtggtggcagaagaaattcggcgaaatttgcttgatttccctagttaatctactcatcaattgggatgaattggaccacatggtttgatgaatctaatgtgtgtgctctggtcagtaggttcgagactttgggttgactgataaagtgtttttgcagccatgatgcgagatgatggaatattttactatcttcatcacaaaatatataaaagattttctacaatagtaaaaaaatacttggatcgtcttctatttaagagtttggtaggataacattagcattggttatttttcagttacgttagatagggtggtatgactaaaagttcatattaaaaaatagtctactttaaaattagatatttaaaagttcaaaaacaatacaaattctcagattaagtcgattccaagcggaattttaatacaaattctcatatgaatgttgttgtgttagtatacgtatccgtgatgtatttgaacaaataccaagttaggcatctagaataaattattatgttttactaaatacaaatatgtagtacatattgtggacactcgagtttgctaaccgtgtttaacacgtaaggttaaacaatatcatcgtcgaaaatagagaaaaatgagaacaaaacaaaataaaatagcgaaagaatactgagatatttacccccagtatagagaagacaaatttatattaaaattatgaaattttaatgattcattaatct

SEQ ID NO: 98255 - DNA, 764 bp, Oryza sativa
ggcggccgatactccactagtggatcccccttactgcagcatggcagaatatgtgcatgctaaggtgtaattggcatggtgttttaatcgatgcatgcattgtgggagaatgtgtgcttgatgtcttgattgatgtgatttaaattatccttggtcttggtgcataagcatatatgatgatcaatttttttttgagggagtatttggtcagttttcattgagatgattgttggtgtttgattttccaaagttttatagtatgtccaattcgatgtagtccgtttctcatttttagcttgttaaaaatgttgtaaaagtcaaatttacacttggtttttctttttcatgaaaaaaaattgttgaatcgaccatattgtgatctaaaattataagcataaagcatcgatgcatcatttagcttactcagatgcgagaacaaattgtaagtcacattaatcccatctcaggtattaatgagtggtaatggatagatattaatgagtggtaatggatagagtgcaagtgaaacctgcatttggaggagctaagttaagtatcatatcatatagttggctaaggccctgagctatagtcaacaacaaagtttataaaatactaagagaataccaatctattgcaaaggatctaaaataaatacaccattagttccaactttaaatagaaaaaatatttacactaccaatgtgttgcaaaggatctggaaatatacagtttattccaaactttaaatgtaaagaactaat

SEQ ID NO: 98256 - DNA, 623 bp, Oryza sativa
ctttccggattccagacctattttcgaaaacggaatctggcggtcagaatttttttggaatttttcggaaaccaaaatgaattcggaaatattttctcgcaaatggaatcggaaattataagcgcagtttccatcggaactcggaatcggtcggaaactttccgaaaattttctcggaatttttggaaattgtctcggagttatcagaaattttgtgactgcaataccctggattctttttttaagcactaaatagcgaataccatagtgtttggctgttacctttttcaaaaatatttgttatgcaaatctaaaattacataagaatatttttttcctacattgggatttattaacaacattactcttttgaacatagataatttattcaattggatttatcagtttgagaggttttttattccgataaattttcgttaccgtattcgcgccggttcgttttagctccgttttttgtttcgataatattcgattctgttttcgtatccggtgtttccgattccgattctgattcccgaaaaaaaatatgaaaacaaaaacgataaagaggtttccgtccgtttccgtaccgttttcacccctactctctaccgtctttcaac

SEQ ID NO: 98257 - DNA, 583 bp, Oryza sativa
atgtgacgggcagatcaaatttgtcaccttgtggtttcaatgttaaaagaggtttacttgtaagatctttattatttccaatttgaattttgaatatttagttcccaaaagtgttaaaacagtatttaagaaccaaattcttcggatgcatcaaattgttaaagccctgacattctgaaagaggaaaatggcagtgcaaatcatgttgagtttccacacacaaaataacaggtatataaatgaagcatgtaccatataaaaatactttttactgcaatatcaaaaggtttctttcatcttgccaattgccatacctccaaagaaaaaataaatcacagtttcgaacagacaacaggtatcagtaaatcaaaggcgtgggacagacaactatgaactatcacatcccagataaataaacttattgcactgtgaaactaaataaactaatgaaagatgcattttatattgacacattgtgaaatcatttcagctggctcaccaatttttggttttcagttcagcaatttacaaatgcatcagtgtagaagcactgaaatattaaacttttccttacatttgaggg

SEQ ID NO: 98258 - DNA, 500 bp, Oryza sativa
cttagacaagttctacaacctgaatctgcattttgagagtttagggatctagataacacaacactacaagtttaaggatctcctatgcactttactctcttaggtcaattttcatctttccttgtcactcataataaaaatttgaaataattgacgggatatatatattaacatgagatatcgtcacagaactcttaatagggaacggcttatatattgatttatttaaatccggcagctatttatcttttcccgccttcgctaggtgagaaaatataatacagtcacctttgaacaatcataggtgccggttctatacaaaaccaacatcgatactattagtattttttaaaaaagacacatttaatatattataaatttataatatcggttaattaaaaaatctacagctataaacatattacacctataaaatctgagttgagctaggcgagctagccgggtgagattctgatttatccccacaccaagtcaacaga

SEQ ID NO: 98259 - DNA, 627 bp, Oryza sativa
aagcccccgttggccctttaaataaaacgaacccacaagaaaaaaaacacaaaagtacatatgttctattttgcaaaaaaaaaaggataaaattgagacgctgagcaacaatagtggccccaggtgacagaccagagcagcagcccaacgtctgacattaatcgcggggtcgcaggccgcagcacccaacaaaccacgaggacgcttgcctgaccctctcggggactcctaatgggcgcgtgtgcgctggctgtccagctcgcgcagccgcgcacctgttctactggttatgttgattagttttaatgatatttattaatgctaatgataattatagtattagttttttaaaaaaaatacataaacaaatctttcaactcggacttgaaaacattcaagtcaaagatttgaaaattttaatttaagatttttttaaaatttccaactcggatttaaaaatttttaagtcaagatttaaaaacttttaacttagattaaaaagctttcaattcggatttgaaactttcaattcatacttgaaaactttcaactcagatttgaaactttcaattcagattcaaaaacattcaacaaggatttgaaaactttcaactcaaatctaaaaac

SEQ ID NO: 98260 - DNA, 561 bp, Oryza sativa
agaaacccaataaaatagaacaaataaaatgccatgcataataaaatatgctaataaaaaaaagatacatacaatgggattgtgaaaattgacagaagaagtgtcaaccaaattctttttcacttcttgaacaatctacaaatatgaaattgagcaacccattaaacaatataaaattaaattaacacaagtcaacaaaaaaaaattcacataccattttcctgagcacaacagagaataaaccatcaatttcaccatgttcaggaccttcatcaacctaaaaaaaaagaaaaataatgtaataccaaattaaaggtaaacttaaacagcataatacaataataaaaatttaaaatataacttacatcattaccaacttcataatcaacatgtaaatcttcacctccatcagaatcaacttcaatgggatttttacccaaccttgatgtttggacacgaggcatctgaaaaaacaataaataaacatcaacttggacatgagttaaatgaacaaacaatacaaacttcactttacaacaaaaatcatacataaaaaacaca

SEQ ID NO: 98261 - DNA, 753 bp, Oryza sativa
aaatctatcttaattccggttgttgttaccaaccgggagtaaagatatctttactcccggttgttctcaccaaccgggagtaaagatattttcccgctatttccaaattcttttttaaacccggttagggttaagaaccgggactaaagataatagcactgaatattgaatttcgttgaatatgtgtttctaaaatagtaaataatgcattaaaaattctaattaacatatgtaaatcccacatgcatgatttaaaacttttaaaaattctaataatcatatatcattagcatatgcatgatattaaattgttaaaaattctaattaacatatgtaaatcccacatgcatgatttaaaattactaaaaattctaataatcatataaaattagcatatgcatgatattaaattgttaaaaattctaattaacatatgtaaatcccacatgcatgatttaaaacttttaaaaattctaataatcatatatcattagcatatgcatgatattaaattgttaaaaattctaattaacatatgtaaatcccacgtgcataatttaaaattactaaaaattctaataatcatataaaattagcatatgcatgatattaaattgttaaaaattctaataaacatatgtaaatcccacatgcatgatttaaaacttttaaaaattctaataatcatatttatttagcatatgcatgatattaaattggaaaaatgctaataacatatgtaaatccacatgc

SEQ ID NO: 98262 - DNA, 797 bp, Oryza sativa
  unsure (1)..(797): unsure at all n locations
tgtatcaatttactgatccagggcttgatacagttaaacatgtcggtttccgaatcattagttttgggacccgacaattacgtatataatatttgtgggaaaaagtatagttggtgaaccttcatcgagatagtttcttacattttagttgattagtttcttacgttttttctaaagtttgagtacatttgtatatgtatttccatatcaatgaagctcatttatcttcttcagtttgacagtaagaaaaaaatgctacgaaagtcgcatttacactagtcattgttttgtgaccacaaattcgtccatgcgttggtccacatcctccataaatggaaaatgaggaaatgattagtcttcaatatttgtaagttaaaaaaataagtagaaaaaagatgggactgcatagctgctatttgagagatctgcatgctctacgcgagcgaaacaactgggactacccaaaccacatctatttatagcaattgcataagaattcctcaacgagaaagttggccaacgatctccattttgcactgtgcatccatgcctgttttctaaccccaggcgatataaatagatgtcatccacatcctccataaacaaaacatgatgatgtgattaatttttattatataagttaacaaaaaaagtaaagaagatatgtgaatgcattgctactttttaagaggtctgcttgtcatgcgccagcgaaataactaggactaccaagtttgcatctatttataggaattgtattagtaaatggggatnccactagtgggagatcggccgcc

SEQ ID NO: 98263 - DNA, 763 bp, Oryza sativa
gggcggccgatccccactagtggatcccccttttgaagaaaaaaaatataggcatatcgttttcttgtttcaaaactaaacatttaagaaaatatttatagcaaaagctttaaaattttaatcaaatattatcataaacattaaatatttatacaaactagtcaactgcatccttgtttgaatcatttttttaaattcaatgtacgcatctaatagaataaaagatctcgagggtagaggactaaaaaataattttagaagatagagacgtgttatttatgcatacatggatggtttataccaaggaaaatatatagtttaaaccatatacacagtgaaaactgaaaactaccgttgtattaaaaaatagacgcatggtatttgtccacatcaccaagaattaaaaacaaatctcaagcatctatttttttaatccaatgatagttttcaagtatttactacattgcgatttacacttacatattttcccgaacaaatgtagtctattttggagatagagggagtaaaattaacactatctccgttttctaatagatgacgctgttgacttttttgaacacacatttgaccattcgtgttattattaaaaaaatttatgtaattacaatttattttgtcgtgagttgttttatcactaaagtactttaagcatgatttatatcttatgcagctacataaaatttctgaataaaacgaatgattaaacatgtattaaaaagccaacgacaccatctattaaaaa

SEQ ID NO: 98264 - DNA, 693 bp, Oryza sativa
gatgcgcgtcgttcgggaacacattccgccaccgatgtcgccgcctcccaaccaccagagccctggtgcccctcctccccctccttctcgtttgctcggctggaagagaggaggaagacgacgggaggaagaagaaggaaaggaaaaagaaaaagaaaggctgacaggtgggcccatgaacagtgcactttcatcttttctagatttaattcaaaacctaatctttagaaacccatatctcctaaaccatagatccaattccgatgaaacttagacctaaattcatctaaattcaaaatctaccttttggtaccaaatttactattctaatattttatttgaattttcttaatttattcaaatactatttgaataaatatttgatttaaacctatatttgcttttcaaatattttattttatcccaattacccttttagccactaaaaagccgccggttggaactttgcgccttccatggggacgttcacggttttctatccccgacgtcgaaccgttggttgtaaagcccggcataaaccaaacccaaggtcgaagtgctgctcctggcaccccacgcctcgatgcgtatagcggtcggagcttcactattccatcgacctccacagcacgccgcacagttagctctcgggctctgtgtaatcctagccgctccgtcgccactcacggttat

SEQ ID NO: 98265 - DNA, 877 bp, Oryza sativa
gattcaactctcaatttagtttaagcaaaggaaaatatgtaacatgggatgtaaatgatattataaacaacataaaagcatgatcacaaaactgttgtccagcaattccacatttcaaaacacaagctcagataagaaccgtattctaatttctaagcaaccggattactactatacaagatgatcccaaaatttcacatcaacaacatgatatattgtcttaaaaaataaagcacctgggaggcagtggctggaactgacggcgagtcaaggacgtcggtcgttggcaagcacggcgcgggccaactctcctcgaactcagccggccgcagcctggcctcgaaagaaattcagtataatgcggacattgtttctcccgtaaggcttgcctatcagcatagctccagtgagccggatgatgtttctgaagatctgaagaaatgtagattaatacacaactagattatctgcagtgtatgtagcttggacactatgactacataaggagtgttgtcaaacacggttctccaccagaagaagcagagacaaatctgatgagctaatggaatgtggtgaaccccataaggacttaaaaagaagttgcatcctcaaatgcgatgtgcttagcaaccaacaccgggtcccctgacttatcggtgaaagcacaaaccaaaagatagcaccaagtatcctggatagaagagaaaatcaaaagaggatgcagaggaaagtgtctggatgattgggttgaggactcacattggcgtcgttggactggtagatggtgacctcctcctacggcggcgctgtcagatcgagatggatgaggaacgcgccagcgccatcagggggatccactagtggggagcggccgccc

SEQ ID NO: 98266 - DNA, 739 bp, Oryza sativa
gatatttctcatgctaatgaaaaatacattatgagagagcatagatttttggttgtgtaatgtattgacctatactagtgttggagctcacttgtcattgagatttacaatccattctttgtcgtatgggcggtttttaaatattatctctgtttttcaatatgtaacgccattaatttttttataaatgtttgatcattcatgttattacaaaaatgcaaatataaaaaagttatgcttaaagagcatttgatgataaatcaagtcacaataaattaaatgatggacaaatgatcaaacatatctcaataaatcaacggtgtcatatattaagaaaaaacggatggagtaactcagaaagttcagagaacggaatgcatcttgcattatataggtgccaaaaaaaccctaagatggagccggtcaagactcaagagatggagaaaattttcaattcttttgacaaatgacaagtacaggggctacgaccaatttagggagggaatgtctgtgcgaacagtacaataactaggatgtttcatgacttctcgaacaagtatgtacacaagggaaggtggacattagagcaattttaatagtatagcccattactaactttaaatcatctatagccaatataatagccaattcatacaataattgcttactatactattaatacctggtcccacctatcatacacacattatgtcttgaaacatgtgctgcagctggctac

SEQ ID NO: 98267 - DNA, 1664 bp, Oryza sativa
aggaaaaagctggcgtttggtgtgggagtcgccgctgaagactgcaacgttttcttgttcatcacttctgttttttctttgtttcggttggcaatggcttatttggctgcttgctcgcacattgacaaagggtttgtttgggagctggatttctcagctccttacttctaatttattttctaaattctacaaccacagctttttataatccgaacagaaaaatgactatttggaaaagatgtatcagctagaagcttctccaaacaaactcaaagactatttggaaacaacgcttctccaaacaaattcaaagactatttggaaaccgttgtttctgcttatatgtaacatttatggctaaataggatgtaaatcttagtgacttaagttatacatcaacttaaatcaccacactactattgtttttccctacttgagtgatattctctttattttttaatatatgatgtcgttaacttttagagatatgtttaactaaattttgtacaaacatgacaataataagtaatgtttaaagaacttttaatggtaatcaaatcacaataaaataaatgataattatatattgtgcaaacatatataattaaaagaaatggtgcaaacatataaaaaatcaacggcattatatattaaaaatgaagatagcatttatttggatttaaaattgtctggagcgaaaaataactattttacttagggtgaagacaatagacctccagcaaagctcaatgacgaaaaaaaatatatatgactttttattaaaaagaaagtacctttaaaaacgtgataatctcttgggttatacaataattttcataaccaaaccatgcaggctgccaagaatgttgagaaagttgtctgatttttcttttaccagccaagttgtcttcctttttttagataatggattatattaacccggcctctacaccttagaaggtgtacacaacccaaaccacaatcaagagtacataagactcaacccattacatggggataccaaatacatggggataccaaataatagtttaacaaaacggttaaagaagaacaatagtctaagcctcaattctggtgtgtttagttcacgccaaagttaaaagtttggttgaaattagaacgatgtaacgaaaaagttaaaagtttttgtgtgtaggaaagttttgatgtgatagaaaaattggaagtttgaaaaaaaaagtttggaactaaacaagggcctagtgtagttgtatgctatatgtagatcctttgcagtactgtacgtgcagtattgctaactgacatgtcagtctaagaatctgtgagacccatgtgtcagcgagcggtactgtatgtacgtatacgtacggtactgacatgtcagtctaagaatctgtgagacccatgtgtcagcgagcggtactgtatgtacgtatacgtacggtacttcagaggaccctctctctcagttcagagctgtatgatgaaaaactctttgtccatctagcagcacatcggcaagttgttcttttttttttctaaagcacatcggcaagtttggctctccattttcactatttttgccagtgacacatcgatctgcacacctttaatgccgaattaatcacaacattttcactctggaagggggatccactagt

SEQ ID NO: 98268 - DNA, 651 bp, Oryza sativa
tcaagtacttatggagttattgtacagtacttgaactaaaacttttgaaatatttctgaacttagctgcttttgttttcctttggtttagatactctacttttgttaagggcattgcagtatacaatgagatagttaaggggtatttttacaaaaaatccaggctgtgtgcgggcggctttatgcaaatgtgcatcaaataggtgtgatagggtgacctcgaactatcctggccgttgggatccaagagaatggtggagattgaaatttccaaattttcaacagttggactgttttcacctgatatgtactcatttctagagaagcttctaggatcttaacacagattgactggaaatatgtccaagcgcagttgctgattctcgtgggcaattttcttactacataatcctgattccaagctggctagctacttgatactagttcctcgcttccttttaataaggtactctcttttgttcattttttcaatcacaattttgttgatctttttatatgtttaatgacatattactgcatgctagttgtactatctattttcttaccattaaaacatgataaatagaagcatatcattcactctcaactactaaccatcatcttataagagcaggtactctaacaggctata

SEQ ID NO: 98269 - DNA, 1138 bp, Oryza sativa
tggtggagattgaaatttccaaattttcaacagttggactgttttcacctgatatgtactcatttctagagaagcttctaggatcttaacacagattgactggaaatatgtccaagcgcagttgctgattctcgtgggcaattttcttactacataatcctgattccaagctggctagctacttgatactagttcctcgcttccttttaataaggtactctcttttgttcattttttcaatcacaattttgttgatctttttatatgtttaatgacatattactgcatgctagttgtactatctattttcttaccattaaaacatgataaatagaagcatatcattcactctcaactactaaccatcatcttataagagcaggtactctaacaggctataaaccagctttaaatatattttaaaaagataaacgaggagagagaacagcagcgggctatagatttatagccagctgtagcacggactccaagacacggggtgtatattacaggtgggagcaggtattaatagtgtactagtatgtaactattgtatgaataagctattagattggctacagatgaattagagctagtagctgactatactattaaacttgctctaatcggctaaaaaggaagaaaaaaatatacatcgttttcaacacaataaatccagtgatgacctatgctctggccatttaatctagatgtactaatagtggtactactgatgtttcagccctattgattgcggagagcaaacggagttgtctgcatatgaaggaagaacgttgcaaagtagtaccaactaacttacctttctgatgggcctcataaatcatcgtcattaacttacctttctgatgggtcactcttatatcagtattattccaatactctgcataattgcaactggtcacagaattcacagtgtttggtccttgtgctttttatctgaagaaaggaagatgcatatagtacctccttgatgctgactcgtggtacagaaaaacatcgctttagctgctgtttatttattaggtccttcgattatgagacgtataaatgaaacattgtgcttattacacagtgcaaatgtagattactgttggtggctggctgctacccttcgccg

SEQ ID NO: 98270 - DNA, 639 bp, Oryza sativa
accagagagagtaaccaagtattcaaatcgcattagatgccttctcttctgcgaattcagaaacagctatctcatcttataagttcagatttcagaatgaactccaggataattgagccaccagcgaatcctcggcccctccaagcaacaatcgcccagcttcattccccctgctccagctttggggagcaggggagacagggcgggacactggaacagaaaatgaaattgcattagtccatgctgagcaaaagatgaacaaggaacgtcctcttggtgtcctagaacccctggcagggccatgaatgctcacatggaagaatcgcccatttttcgcttgcgattgcgtggcagaataactcacggtctctgaatgcacaaggtgaaaatggttccatgtgtttctggtatcccagtaggccagtatacttctgatcaatgctttgtgtggagatctctggtttctataaaccccaggatgatgatggctcttgtgagttgtgaccaccaatttgtccaatggttgtccttgctcccagctgcacatgaagagcatgagaaagtagtcaattagttgagaacccagtactgtagtactacgaataattgagctctgtgcgatacttccaagttccagca

SEQ ID NO: 98271 - DNA, 611 bp, Oryza sativa
tctagaggatccccgtcgtcaatgagataacgctaaaaaatgactgagccaacatggtggactatatcaaggactgcttatttgcccgtcaagacaaggacttcattatgtgtgcctacaatcaacagtaagcgtgtaccatacttatactcaaatgcgtgatgcgtacaactgtagtttgtaactggcaatttattaatttcgcaggcgtcattggattcttctggtaataatgccgaagtggagtttggtacactaccttaactccaatatcaatccaaaaatatacgattggtcggccatcaaatctgccttgaacgaggcatgggaccaatacgtggcaagtggcgggaggcataaggatgggcatccgaaactcggtcacacaaaagacttcccaatacgtcaacaagttggcgaccagtgcgggttccatgtctgccataacatgaggagcttcgcagacaaggtgacattgctcgaccctgaggtgtgtccttcaattgtttatacacacataggacgacaattttacaagtatgtagactaacttggcgccgaacatgcaggaaaaaatttcaacgattccggaaatcaacttcgatatcatt

SEQ ID NO: 98272 - DNA, 553 bp, Oryza sativa
atgtcactgaggcacatagatcgaatatggttaaatcagatatgattggctgaaactccgatactaccctaatcagcaaccagaggataggctagagattgatattctaagcacgacttaatagatcaaactcaactgatgcatcattaagtatgaaaagaagaacaatatctagacaatcaagccgctggatgtttcataaagtggtaaatatcttatataatctaggacaacgtcgctatttaacctaatcggctgccttctattaatagatgttagccgattgtaggttagatgacgatattgccaaagattatgtaagatatatgataactcgacgaattatataggcaagattagagtgtcataaagatggaagcactaatcttgagaacacaagtcgtcataacaagttttacctcttgttgaagatcgaaactgatgcagctcaacccgcaagcaagaactcgttgaaacaaaactaaagcgaaagggtggcgatgcgccgaaattgtattgaacgtgtgtgttaaaaattacatagggctcgggg

SEQ ID NO: 98273 - DNA, 634 bp, Oryza sativa
atgttgtcttcggtcttttagagtacagtctccattttactcacactggagatggtcttaagagatatgcatacatcatagtattagtaaggtgaattcggattaggtgcagttgcagtaggtaccataatgtacttaaaaatttggtgtaaaatttggtacctcttggtactcctcataatacctaagtacccagaggtaccaaatttacaatagaaaaaatggtacctcctcaaggaccataaaattgctcataaaagaatgttgtcaggtcatttttaacaactgtcagtcgtttgtgaatgtgttctgaaaatgtttgggggataactagaatgaaaatcaattttgagttactcgacagaactttgcagtagatagatgccacccaattatggtcataatgtgttcactaaaaatgtgcaactctcttgcctatgtgctaaaaaattatggtcacatgacatcgcgccaaaaggtttggttatattgctcaataccaaacagccttgaagagataatttttctcgtacattttgagagaaagtaatgtaatgcttctgaggcattccaataaattcttgaatcatgtgccaccaagaattttgttttaaggctaaccgactgtctgaat

SEQ ID NO: 98274 - DNA, 690 bp, Oryza sativa
ctcggtacccggtcgcttgatcgggcgcccgcacgatctccactccgcgtaaccgaaccggataagtcgcgcgtaacttatccggacttcacgccgttttcacgcaccggatttttcggaatgtttccaaaacaaaacaaatccgaattttcctgtagcaaaacaaaactgcaaaaggaagctgcatctgcgcaagggtgaggagccaattttgcggatcattcgacgtgtacgtcgtgcacgcgcgccgccagccctgccctgctaggccaggcgaggcgagtgagcgcgcgcgcgtgttttcccccttctctccaccacacatgcttcaagtggctaggagggcatctcccttttaaggaggtccccctctcctagaataagtaaggtggtactaaacttcacatgcatgccatcccatgtggtgggcttttgtgattttccaaagagttaatcttcgaatgggccttagcccatttattaattccaacaatcccccaccaaatctcaaaatcccactgagatttgccttttccaatgtactgtttatataccagcggtttgatggagaccgattaaggttgaacatccacctagaactccaagctacacttactcacaacttgaacaatggactacgccttgaattgcaagtcttgtgcaagcaagtttcactcagagtcttatctg

SEQ ID NO: 98275 - DNA, 787 bp, Oryza sativa
ctcggtaccctagttaataggagaacataaatcagaagaggtattttttttcttatcaatcctaattaacttccaggttccagttgaatgtttgccattatacaaacattaatataggccacctttataacacatagtgacaaggctgagccaaacaatattgtgttccaggagtgaaaaataatggtatagcaacctataacttagaaaattcataattttttcatactaatacggatgaagaaaaaaaatcaatgctgtagctctctatgcacgagagatgtacaactttcatataggtgaaaccttttccattttatttagatgcccaaatattcgtcaataagttttggaaaagaagggtcaaattaaagcatctatcttattggtgagatggtaaagagcctttgcatgacagatagaggtcgcctgttttactccatttgtccgcatgcacacatatatatttgtatgaaaaaccatgtcatactacttggccttatattttgggggttgcaaaattcaaacgtaattaagatcctactatcaaaatggccagtttctatataactccttttatactccccaaatatctttgccacttaatttgttaccactagttaaaaaactgtcgctggtgccaattatgaaccggcaatgatagtgttttctatagtatcgattataagaatttctctataatttcatggtagaaagtccaactgcaaactgctggatcaactgagtagccaatactctttaccatgataaatgggaacatatccta

SEQ ID NO: 98276 - DNA, 734 bp, Oryza sativa
ttatagaacgcgtcgttgcaacaaatcactcacatattttggaaatcctctattaaggaaatttatttctttttttccaccaaaaatatttcacctaatgtttcactatatatagatctaatgttgcagtgaactaaaacattccattgcaacaaaaaaacccacatattttggaaacccctttattaagggaattcgtttcattttttgttccaccgaaaaatgtttcacctagtgtacttataatgttttattatgtatgaatcaaatgttgcagtgaactgaaacatttttccgctatttgctgaaacattgtttttatataaggtgaaacaacacccgatttaaacgagtgaaacattttcgatctacttagtacaacaattccaatatacctggtggaacatcgtgtaacatttaaaaataattcaataattaggtaaaaaaaatttcgtcggaatatatccatgtgtggtcttgttttgaagatttaattgcaacgaatttaatgatgtaatcggatcataatttaaataagtaatttaagagaaaaatcagtttaaaataaatttacacgtaaatcagacgtcagcgtccgatttcacccctgctgatcgggcgccgacagggagtcgtgtccctgttattcgtacagttaaggcctagtataaaaaatcactgtgctcaaatcttttggctttgtgtcatgaatatcagtcatgcatgacaccgta

SEQ ID NO: 98277 - DNA, 1263 bp, Oryza sativa
aaaaagccgttaatttatgtattgtttgtttcagcttaaaattattgtaatctagattgttaagtcaaattactataacctggattataataagccctggattataataagccgacctagaatactccctcgggttctatataattgacgttttggacaaggttgaggttaaacttttataattttgaccatcaataattttaaaaatatttagtttagagaaactataaaaacatatatagatttatctttcaaaacactataataaaagtaaacatacatttatttattgtatatattataatagaaaaataaggtcaaacgtatatcttgtaaagcgtgttattgtccaaagcgtcaattaaaataaaaccggaggaagtaagttgttactgtttgtttgtctagattattagctgtttgttaggtgttagtcacccaataaactagaaaaagcacctatagagtggattactatagtaatctagcttaatagaaatttgggttgaaaaaaaattaaaaaaatttaaattttaaaatttttttaaaaaataaactatttattttaatttacttctaataatttagattataataatcctaagttgaaacaaactcgttgtttgtcatgtagaatcagagagcgagaataattaatctcagacagcgcgcattggggccatgctcatctgtcttccgtctgatcataacgatatgctcatatgcatggtaatcaagcgttgcatccaaatatgccaagtaggatgaaccgctgttacgtgcacgcatctgctactacggttgcgtgcttcgattcgatctactgtgtcctccgtccgggagctgctagccagcggcgagcacttctcctttccctttagtaactatctatattagttaatatacttaacactaataatagtaattagtatagattctagagagtttttgatattcttttactaacatattgaaaatttttttaagttttaaatttttggatatttgaacactttcgatttaagttttaaattttaaagactttcaactcagatttgaaaactttcaacttgagatttgaaaacattcaactcatattcgaaaactttcatctcgataatcgagattcgaaaactttcaagttctgatttgaaaaatttgaaaactttcaatttgagatttgaaaattttcaactcgatatttgaaaactttcaactcgagattcgaaaattttcaagtcgagatttgaaaaaaattgaaaa

SEQ ID NO: 98278 - DNA, 513 bp, Oryza sativa
tgttacaatttaaatgttatgttgttgttttgtttgcacagatatattctcaattagtcactcctataaataactgacacggttgactatcactattttgactttgatcaataattacttctaaatatcccgacgaaaataattatttttaaatattcagatcaggatgaacaaaagtatggcgcttatatttaggatgcaagtatgtttttttttagtatatgtatttttaaaaacgagtggtgaaagttccaaaataaatattgaccattgtcggtcatttcaaaatggagggagcatagattgggagaaatcgttgagacaggaatgtgtataatatttatttgaaaccatgtggttttttttctaaacacggccggtacaaatgcagacactcacacgctcgcatacttatgctagatgaacacatatgtatatatcctatccctacaaacactcagactgatataatattctcattaatactagcaaaatgcacatgctttgctatgg

SEQ ID NO: 98279 - DNA, 692 bp, Oryza sativa
aatcaaatttatttaagtttgattaagcttataaagatatataatagtatttttaatataaaacaaatatattatcaaaatatattcaatgttagatttaacgaaactaatttgatattttagatgttactaattttttttttaaattttgttaaacttaaccaagtttgattagttaagccacgtcattaagaaattgttagccattggattaaatcctaattatataattgtagccgtttgatcatccaattcacagcaaatcagcaatgttggaacgtacgcaagcaccaagcagtacctgggcccagcttcttcgttgagccatattgcgcagcccatcagagagagacaaggcctcaaccttatccatgaacgcggccgatagctcgctgctcgctgcccctcccacgcctccctcgcgcggacagtataggtgagcatttttttccatagctcaattttgatcgctggataggccaatggagggggaaacaaaacccaagtttttggttttttcagcatctgtctaggactcttcctatgctacagttgacaacaactccgtttttcagatggtgtgttgatgggaattgttcgcttctgctaaacatccaattattttttacccccatttttgccattaaacttctttgtgtggctgatgccatggacgcttgttctcccttatc

SEQ ID NO: 98280 - DNA, 597 bp, Oryza sativa
attattgatggcccatttgattgcatctgtggagaactgaagatatccagctgaatttcttgtggacataacaatcaaaagcatgagaggaatcgaacaaagattgaatttgtgtttttgagaagcctacttaggtcagccacatcactccgacggatcacattggctttccatggtatgattatgagtcctgacaatggggagccattccagaacttcctggttgaactatccagcctgatgaaattcaaggaaatttaccgcgctgagagatccgcattcagaccaaactgggagtaagcgtgatcattcagaaacagcgtgctacagatcaacaccaaaattcctaaattgcatgtccttgccaaaattgtaatagacaatgtgtaatgcttgtattatatttttctgccttctaatatattcgacaatactcttgccgctttcatataaaaaaaccaccaaaattccgaataactgaaggcatggtctatcgtgttgcatgcataccagcaattattcctgaaccgctgagagcatgccgtactgtgttgcagatcgatagcagtattgcgagcgcaaaataaaggccgtaaa

SEQ ID NO: 98281 - DNA, 650 bp, Oryza sativa
ctgtgtctggacaaatagccatacaattgaagggaataatgtggtcaaacctcatcatatagatactggaaagagtatttatacaattttgcttcctcagctatgtaatcaggaccatcctacaaaatcagatgaactctgtgttaaaatggaaaaatctgacaagtatcacatagatcacatggaacagaagaacataaaacaactagtttccatatccatggatcactgataggaaggaattgttgcctaatcctatactacagtaactcaagaagtatttttctcatacaccaagagaaactcatgacatcttatcggatagcctataagcttgtcagcttacatataatataaccagcagctaaatggctatctaattatctatagccattgtattttataccctgcatatttcaatgtatgacaccgttgactttttaaccaatgtttgaccattcgttttattcaaaatttttgtgcaaatataaaaatatttatgttatgcttaaaaacatttgatgataaatcaagtcacaataaaataaatgataattaaataaattttttaaataagacaaatggtcaaacgatagataaaaagtcaacagcgtcatacatcaaaatatagaggtagtattacggaacac

SEQ ID NO: 98282 - DNA, 511 bp, Oryza sativa
gagttaataggaaagccgcactattaagaggaatgatgcattgacatacgaggagtgatcaaagtgctcaaaatctatttttaaaaggtgtttctcctcagtttggtgtgttctggattttttcggagttttccgaaagattttcggacatgtccgaaaattccagctcagcaccaacagcaaagtcaacgaaggatttttcggacattccgaaaacttttcggacaagtccgaaaatttctagtaccaacaacatcgttctggatgttctcggaaaagtccgaaaataactttcggacaagtccgaaaatatacagatgcaaaattgactctactgatgattttcagaaaatccgaaaatcagtttcggacaagtccgaaaatatacagaaccacttttgccttcgcagtttttttcgaaaagtccgaaaatcactttcggacatatccgaaaatttccagaagcgacaatttggttctgtgtgttttcggaaagtccgaaattgagggg

SEQ ID NO: 98283 - DNA, 627 bp, Oryza sativa
cattctatataaaaatttgctttagaaaattatattaaatctattttttaaaaaataattaatacttaattattcatatgctaataattagtcatcttctcgtacctgcgctacccaacctcatcaatgtcgtcctgcacctaatccacagagatactgaacgtgatagcaccaaggacaagggtctgatctgattggatcagtaactggttgacatgatttgctgtctatcatggctactttctggatccatcaccagaatggaaggcttggggtgggttctacaaatctattaacttattaaaggaatagaaaacgaagccgccacgttcactctcatgaactacaaattctcatattaatcagagaaaaattaaaaaatatgagtctatataggaacgcaattttaaaatagctaaaattcgaaattaaaaataaggaatataggaagagaaaactagagtccataacgatatacaatagaactaatgaaaattcggaattaaaaaaaataagaaaattaaaaataaaggttagagtatatatagaaatataatttagaaataacaaaaattcgagttaaaaaaaaggaatatcagaagaagaatacagagtccatatagaaat

SEQ ID NO: 98284 - DNA, 649 bp, Oryza sativa
agatgtaaacctgaacttcaatctaattcctgcagccctggaacagtgtagaaacgtttgctatgataaataaaagggtgaaaactccactgcaaaaccataaagattgtcagtcaattacactactttatgatcaagcattacatgcagtagctaaacaaaccaaattctgttgatgcggagaggagcaaaatacataaaccctctgctatactacaacacaaagaagtgcatctcacattctcaccattttaacatcttaattgtacagaaaattggtgcaacaaatagcttcgaaaaacattttttgttcttacagatcatgcagacaagaccttactaaaaggaccaaactaccatactgtagtacatattggaggtggcaataatttatcggagagcaattgattaacccatggtcataaggtacaaaatcacactaagctaaattatcaaattactttttcactttcataaatcaatctggatagccactattttcaaatttatttctcactgcagctctttcaaattgtgttgtttacttgtcaatatcagcagggctgtcattgccatttacactacaagatttctggctaacttattcaagatataagaagaaagggtcattacaaaacatacatcatta

SEQ ID NO: 98285 - DNA, 641 bp, Oryza sativa
aggtggcagtttgatcaatatgatggatatagagaaagaaagccaaacaatgatcctcaaatccgctaaacactttcagtcacattcatatgtgtaagagatggaaaattgcgtagaccgcaaaaatttggtgatccttcactggtaaacattgtcagtgaaggaagcttgtgagcaactagctccagcttttggcattttttgacaacaagctcaagaaggctagggaatgagcatatgttgtctccatcccatctatgcaacatgtccaacctctccaaatgcaatttctttagagaccggaaactagcagtattgctaccacaaaattgactgcaattcatggagaccaacccatcccatcccttgatgctgagattttccaaaagaggtaatagtccaaggcaagggacaacagtgcatttcttgaaatcatagaggttcaaagctgggttttcaatttcgaaattggattttatgccggggggtgaccgaaatttcgaaaatttaggtaatttcgaaaatttctggccgaaattattttaaaatttgactgaatttgaatgaatttaataaaatttggcccaattcgcaaacaaatgcaaaaaaccgaaaattccgtatgagatttgagcatgccg

SEQ ID NO: 98286 - DNA, 639 bp, Oryza sativa
tgtctagtagatatatatttttttttgtctaaactagtacagtatttattgactttagaatctacaatgattaatttaattaatttatcggctaatgacctggaaccgggctgtcagctacagctgtggtcttcggatgtggttgttgcgtcagcgtggaggttacttggggtcttcagagacttgcaatgggctatataatgtacgtacggcattctagctactatggcatattggcagttgatgtgatgtttggccaaacatctacagtacagcctgcatgccattccacgaagtgcgactagaagtaaacggcgccagtatgccatgccacaaattgggcagagagaaaaatgtgccatatggtccgtggtcttccatcaacaaaatattggtcgtagctacactaactgacgaacttgaattcacgatcgagccgttcatgcgcatgcacgcaaatgtgaacgtaccttgattattctcactgattagttatcagaaatttagtcctgcagagagatgatcataagctgccagccctgagactggcgatcgtatcatgattcacaagtggcatactgggattttctgcggtgatcaccgattaacgggagcaacaccacattttgaaatgaacgg

SEQ ID NO: 98287 - DNA, 724 bp, Oryza sativa
taaataaaaaaaattcgtaggactagcatgtactatggtgttactgcacggcatgctgctgcatgtgagcggtgaaaacgggcgagaggaattcaccgggggggggggggggggtccattttttctcaatgtcgcccagtttgtaaaaaccttcatgtaccattgacgatactgatattaaattgttcctcattttccaaataacatggattacctcttcgtaaaacaataatcttttgtttttcctatccctacttggaccttattgctgctttacctagtatttttccaccattctatgtctttattaaaactgttgttactacataacgtagtcgaccaactaattacccgttatcattgatagatttctactgattttatatcacccctcgcaataaattatgctgtttccacagtccaaagtctcccaatcttactgttgctttagcttattcaaagaaatctttcttttattgttcatcagtctgaaaagtcaaacacatcattccgctcctccattctataagacagtttatatctgcactttgaatgtacacagagactctttgcattgtccttctctatgcattgtatttcaggaaattttctagtatatctaatctatattttaacattactcatttggacgagtctcttctaatccgaaatatattgatgatcacatcctatgaattatctatctttgaggactgacattttt

SEQ ID NO: 98288 - DNA, 633 bp, Oryza sativa
ttaatctgtcattagcaaatgtttactgtagaatcacattgttaaatcatggagcaattaagcttaaaagatccgtctgtaaattagtcgcaatctgtgcaattagttattttttagcctatatttaatacttcatgcaggtgtttaaacgttcaatgtgacagggtgaaaaattttggggtgggatctaaacagggcctaaatattcttggataggatgaatgccagagtaagcgtaaagaaactacttcctcttctgtgctaaaatgtaagtacttttaagattggcacagatattaagaaagtaggtaggaatgattagaggaagtgtgtgattggttgagaagagaaaatagatgaaaggaaataggtatgattggttgagagaatgaggtagataaagaaatagctttattttaggacaaaatactgtgttagaaataggggttgacccaactggggaacaacacaattatatcttggctcaaatgatgcatgatcttgctttacaagtctcgggtgaagattgtaaaggcctgttttagattctatatttgggaaatgggggtaaaaaatagggggggtttaaaaaaattggggcccccccaaaaaaaaaaagggggtttttttttg

SEQ ID NO: 98289 - DNA, 637 bp, Oryza sativa
aaaacactcccttttaaaaaaaaaatatttccccaatttgggaaccccaattttttaaaaaaaaaacccaagaaagtaatttttatttgttcccaacagacaagcatgttggcttgtcaatggttttaaatcatgacattaaaacagagtattttattgttccaacagacaagcatgttggcttgtcaatggttttgttcttgatttttttttcttttaaaaaaggatcacaactcagcaatttttttaccaagaaaaacttgagtagacttttcctatttctaaaccagtatcacgtagctcctggtaggaatcactcgtcagaatagataaataggagacaaggatttaacgtggaaaaccattacaggggaaaaaccacagacacacaaaatgatcactgtgttgagaatgtttacattggaactcttttgccccctttgtttggtgtttcttgccctaggcctgcagggccatatttgtgtgttacatgtagaaatagactacgagtatgaccccataaaaaccaaaattaattcagttcattttttaacaacctaactgctttgctgcaataattttgcaagcaaaaaagtggagtattatctgatattctgatatgcaggatttttattta

SEQ ID NO: 98290 - DNA, 655 bp, Oryza sativa
tattatttaacttgttgattataattgattagattattctacgtaaaaaaatgttggagggagcctggcctctagtcgtccctctatctctccatctctattttatcataaaaaccgaccaattttaccagttttgtaaacaccggtcataacataagttttcagctactttagttttcttgatcgtgcactattctttttttttcactttttctttatttgttgttcaagtacgtaggtactttggtgcagtgccctctccctgtcgagtaaagggaggccggccacggccggttgaattgtctggaatcaatgaaccacccctttgttttgcctgcctgctgccctgctccctgcttctggaattcaaaccaattagccagtctctggagatcagctgttacagctcttgtgcttgtctccttaatatctgtgtccggatgatcagttgctaatacacgcatctctctttacccatatgcacatcccatgtcatgcgcggtactataaatagctagagtcattttttaagcattggctggtaaaccgtgaaaacatgaacgaagcaaaaaaaaaatcattatagataaaacttttttataaggttttttttaaaaaaaaaaggggccccccctttcttaatattgggggcgtc

SEQ ID NO: 98291 - DNA, 3201 bp, Oryza sativa
  unsure (1)..(3201): unsure at all n locations
agggggggggccccccccggaaaaaaaggaaaatttgggggtttttcccaattttcatcttttacaacgccttgatatcagtcactgcaagaccctggagtgtatgcctgaggattgaccgccatgtaatctgagccacttctctgttaggcactgccctcagcttcataagctgcctagtggcattcggcacctgcgagcattggaagatttggagattattgattgtgggcagcttacttgcctcccagatttggatcgccttacttcattactatggatggagatttcaaactgtggttcaattcaattcctgccatacctgcctagttcaatgcagtttttaagtataaataactgcccgcagcttagactttcatgcatgaaggagggaagcttagatcaagcgaagatcaaacgcatcttttcagtatggattgatggggctgaagtgttcagttctgccgacgagtctcgttttgttatcccagcaaagcttcagaaaggctaaagtaagtacatgtgtttgtgtgcctgcatatacacatatataatatcccttttatatatactcttctatcgattatcttgtcatgcctttggatacgattcttagttttatacttggtgccaatacagatcaaatataaaatccaaagatagaaaggccatagatctacattttttaaaaaaaatcaagtccatagatgctgtattttaaacatgatttcctgagcagatttctgcataaataacttataaaccactgtttttcttttcccacctgctgctactgatgtatgtttaagttaaagaaatgtcttgctcagggcctaatttgcattttcctggtcttctgcagttctctggccttcgttgaagttcaggacagctatttcccttcaatggcctgcaagtggcaacgcagaagtaggcatgttgtgcacaattctcggcgtttcccagcttggatctatgcaaaatctttctgagtttcattatctgtcaggctaccataggatcagtttgccaattcaaatcgtggatggggacttcaggaatgactgtcctattgcatcgatgaacgatggaaattctggaggaggagactgaagcggtgaagttgcagttactacgcatttgtgagaaatgtatgatcttgtgtgttttttcgatggtttgtcagaattgtttagagcactctccaggtagcttgaatatatatatccctctaaattctgtaacaaatatgttttgactgcttcatccttaatactacttgtaggtacaaagattagaagtttgtacaatttcatgccggtttttatttacgcttctaacctgagctgacgatgacacggacaaattccagcaagcttgaatgttcagctcatgagctgctactctacacactgagctaattaacctgaagtgaggcatgcaaagcattgccctagccattaacctgagctgtcttgtgttgggttaggcccactagaacgaaccgccaggttgaatcctagccgcacgcttctccatccaacggctgtcttggaccaagtgggggggggggggggtcgcagaattctttcccgcccccgtcggacgccgtaatgggccttttctctggcgggccgggctagtgcccaatttcatgggcttccgcaggatctccgcctcaaacntatgggccttcctctggcaagaaaagaactggaggcccaatattgcgggtgccgaaagttggttgggccataacgggctgaaactaagtgggcctaatctttggttagactcttaccctcggggggggaggcggaggatccatggccacagtacttctcctcccctcctgccacacctccggcgacgccgaaggaaatcctcgccatggccgtcgtcctccccgccggaaacgcttccgccgacgtctcttctccgctggaagagcaagggttctagtttgcgccatacaccttccactcctgcggcggcataagcacgaaaggggaggtagacactgaccttctctctgtccgattctccctgtctgattcttcttcatctcatcaccccccatgaattgcagtgcttgcttcgaatctctaagaaggatgcatttctagatggatgagcgtcactcaatgatttggatgagaggtgcgcgattgcctactcagctactcttattatatgtattttttttctctagactagttaaatgggcaactcactcgcaaacttccttcactgacgaagattacagacttacaaactttttaaaaaaaaaatgaaagcggcaggagaactgccaattatattaattaaggaggagtaaaaaccagtagggattacaagaaaatattacagacttacagtggttatgatttttgagtctatggcatttaagagccggagattgttaaatttggcaggttacttcatgaacccttgagatgaatagccttgtttcactactaagttggcattagtatatgaaatactgtaggatcatccaccaagcgatcaaaattacttactttaacacttcaaaaacatatgtgatgtcttttttgactcagtggtcgagatcataatgctctaactggctagatgcttaggaaatcaaatactgtaacactatgacaggaatatagcttctaaccaacttgattatactggtggattctgttgtttagtttagctactttcttgtttccatatgcggtctttcaggttattggtacattattcttcagaaaaaaaagttttttgggggcacatttcctagactcgtgtaatttcgtcctaaatttgagtagagattgttgcaatacttagtatttagctataggtgtaaacaacataacacaagaacaggtcttgaaatgtcacaaatgaaagatctgagaaaatagctatagacttatggatatatacccagtcttttagcaaggttgttttcaacgttgcgtatggtgatcgagtcactgcctcttggatatatatatacccagtctttttctagctaagttgttttcaaccttggattgagtgattgagcccctgacctcttattgtgctggcaatatctttcattttagcatgcacactaatttttctgtgtgaatttttcaatcatcaaagtgctgcagttgagaattttgaagatggatcatttaaacagtgcaaggagtggta

SEQ ID NO: 98292 - DNA, 677 bp, Oryza sativa
cattaacatcaatgtgaatgtggaaaatgttaaaatgagttatattgtgaaacggaaaaaatattatatatatggagtacatcatagttttgctaatatatatttgtactagtttacgatgaaaagaattgtattactccaagaaagaaaaaccgcttgggcagaattgtggcgccgcgaaatagctatgatagaagataggtgtgtcgttagttggaacaatgaatggatggccccggcaggtgtggcctcctcgatgcatgcatcgatcgtctatactctcactcatgtctatctttgacgattcgatgattgcttttgtgagcttattagtttgctgctggaatggcactccatgcccatcatgcttgtacacttctacagttctactcggtcacttctgtaggttaaaaatatacttgttctgctttgttagattaattttttgacagttactctggtacaaaagagacaatacttttgaatatgagtctgataaattcaatcattttataaaaggtatatcctaatagagcaattttgttagtcaaagagacaattagactgacatgctcccttgtagtgattacagtactacttgcttgattcatttcgtcccttccagcggcccgatcgatctagctagaacaatcgatcgggcaatcaatctcgttcgt

SEQ ID NO: 98293 - DNA, 744 bp, Oryza sativa
cctgcagcccggttaagaatgttgtacactgactaatgtgtgttattcgcagcccattgtatttccaacatcaagggcattccagaaccatagttgggatccaaaagcaaaatggtcaacatgggaatcaagatcgatttacccttttgattttggaccctggccatgtaagctgtcgctactattcatttttttaaaagaaaaaggaaaaagaaagttgttattattcactttgtagtatatcattaatttttgttcaattgtgcatattttttattattcaatcttctgtaaacatccagaaaatttgttctacatttctctgccaaattaagatataaactttgctctaacggtttacagagaacgtcagatttggagagggctcttcgaagcaagacaggatggcagcgtctagtgaaaagaggtgtccacactcttaggaagccacagtatcaggtacatcaaatcacccaaaatttatgaactttgaaagggttgtgcagttcatacaattctgatatgccttcgatttttcagttgtgctatgtggatcctggaattgctagttcagaagaaatggagcagctgacaactattgatagtatcctggtcaggttctagaatgctggtgcgtacaatgagtaatcgtgtcttactttgtcacatgctaatagaggaaaatgatacagtttgctcgctcatgtatatgaaaagtcaaaagataatcaatgatgtacttga

SEQ ID NO: 98294 - DNA, 727 bp, Oryza sativa
atacacacacgagccaaaaaaggcaaactatatgtaagcaaataagcaatcgatcgagatgagatccaacatatatatttataccttcttttgcctgatgctacataagctcttctccagctgcacttcaagctcttgtagctcctgcactgaacacgaccccaggccttcccccaacagcttactgtatgcgtttatgtatgtgcattaattctcaaactaccccaatatatagttagattgataaatatctaatataattaatcatttgtactatatatatttagtcacctcttgtagccctcaattgcttctatcttctttcccagggttgtagcctccgatctccacttctgtgaaaataacgcgcatacccaaacacaattaataagtaattccaagtgaaaactatatatattatatatgtaatatatacatttcgtgcattaacatactcagtcatgcatcttgtgctaatcgatcatgcatatatagaataagcatgatgtttcatgcatgatcttcagtcaaaaacagttcgatcccatcatatggtatccctcctaattaatactctctccgtttcgaaatgtttgacgccgttgactttttagcacatgtttaaccgttcgttttatttaaaaaatttaagtaattgttaattcttttcctatcatttgattcattattaaatataattttcatgtaggcaatataattttacata

SEQ ID NO: 98295 - DNA, 678 bp, Oryza sativa
accgatatatatcctgaggttgcacaagtcattaatttcatcattttttttcttaactgatttgtttgtgaataaaatacattttttattaagcaatcccttcatttgtttccatgcactattgaaaacaaatgtgctatatataacaactgcgtgcattatttgatcacagaacatgtgagatcatgcatattttggatttttgaacaaagacatacgtgacgctttttatttttttgcaaatgatcaatgggttatatttatgctcttatagttatatctgtgtacttatgcagttaatttgcttcctatttgaaacgtgatcttcatcattttacatgatggtattgatttcatcagctgtaatatgttaggagattatatatgcatgcgtctctgttattacacatttcaccaaactgactgataattttcaatcgccagcttgcagaggacaatcgatcgctacctgaaccacacaaaaaactcatctgcacatgaagaaggagaggaatcatgcgtccaggttcaaattttattcgtcctatttaagtactaaaatatcacgcatgcacatatactccctccgtttcgaaatgtttgacaccgttgactttttagcacatgtttgaccgttcgtcttattcaaaaactttgtgtgaaatatgtaaaattata

SEQ ID NO: 98296 - DNA, 664 bp, Oryza sativa
taactactctaccatgagttgagcccaatgttcaactcacaaagactagggtgacaaggtattatgggcaatcaataattatcaaaggtaggataatattaacaattaggtcacgctacccatcgatagtttataaacaaaacaatgcatgtattcaaaacaaaacatttcacaaatgggttcaatatattcaaagagtgcacttgccttgttcccagtattgtccttgcacagcgtcttctgaagcaaactgctcttccgctccaacgtctacacgattgcacacgaaaacaaataaacacaaagaaaaactaactaaataacatcaaatgaaataaccaattaaaccagaaggtagagctcgattttagaagaatttaggaagaagaatggatcgaatcggagttcaaacggaaaagttatggcctccggaagtttgaattcagggaaaatccgagggtaaaagaaaaaggaatattccgagaatattctctggatatttaatttcggaaattgaattaattttggataggaaaatatatgtgggcccactgtcagtggcatagagaaaaggacaaggagcagctgctccatcacacggcatggcgtgctctggccatggcgccatggcggctccagcgcggcggcgtcggcggcgttcgtc

SEQ ID NO: 98297 - DNA, 3639 bp, Oryza sativa
aaggttagtgaaccaaatactagtggaattttattattctaacatggatatgcattgcaagcatgactagttctcctctattttggtaatattgacgggcaaaactgatcgctaatgaccgtcgacaaaacccaccaagcttgaacctttgctcgtcccgagtaaaggatgaatggaacaaagacttggttgttgattaggagtttctactatgttgtatatctcaaaggtacaagtgcaaggtatatatactctgtctctgattaaataatctttggcacggtggcttacccttacccctgattcccacgagacactgcttctcctttccttgggcggttgaaagatagaacagcaactagagcacaaatcacccaatctttattcaacttttattccagaagttttcaaatgattttgcaaaagaaagccaagttcctcatatgattaactcagtctctccaagtgtatcaatatgaattcctcaccatttttgcctttttgattcctactctaaggtttgatatgtggagctcggtagggatcaaacatggcatacttgcattcacatttattaccaaatcaaaaactcagactaaagaaaatgattaaacatactcaagatcaagatcgtgcaaagtgtgtgtgtgatataccctgtttccacaacaaaagtgaaaataaccaaggttagcctacaaagggcagtgattatacagtggtaaatataaagtattagttctagtaatctctattatgaatcttcctcggcaacggctccagaaatgcttgttggtatttcttaacgacattactagaaatataattcccagcaatggcgccagaaacactcatggtatattatggttacagagttcatccgcaagcacatggatataccattgtagcatttcacccgagagtattccaagggtatcatatttatttaatcccgtggaaagatcatggtagagagaacctaactaataatttatatgttacttgtaataatcatagtctaagtaggggttaatataatccaagggtggagagacacacaagcagggagctactcattctcataaaatatctaagctaagtggaaagaaaagagaaagagaatctattcctatacttctagtatacatacatcctagttatccgatgtactagctaataccctctatccgatgccctcctggtatttcgagaagccacccctgactgccgagttccttacgacagcccgtcatgaccatacaaccggggctaaatacggaggagtaccctccctaggaaattaacttaggactatatacacgcgcggaataatacccatactgagctgtcaccatcagcggcccacctctcatccgcagcatataaccccaaataatggtatccgtagtctagacaccacgcctaaactaccagaaactactctaatatcatcgtcatgacatagagtaattgcataagcaaacactatacccgtaccaaagcatctcctacataagctagcagtataattagtataacatgaacataatgtaaagttagcattcatatactcgggaagtattccaataccataaatgtataaagaagagtattctaaataaagtgcaaagcttacaaaaaaggaaaggaaagctactagagccatacccaaactcttccgaaggcttccggactgtgatttctactctattcctattccactaccttaagactactaaactaacttgagagaatatgagagagttcttgctgagtgaagtgaggttgagagctccttttatatcctcccaattgttggtatttcttagcaacactactggaaatataattcccaacaatggcactggaaataatcctggtatattatgattacagatatgatccgcaagcgcatggatataccattgtagcatttcatctgggagtattcgaagttatcgtatttattttatcccaagagaagatatgataagagagaactatactaacaattcatatattacttatatatgtcaaagtctatgcaggggtcagttcaaagggtagggtgacacacagaagaaagaactaagaaccactctcactaaaatatagtctaagaaaagtatcattcatgtacttctagtatacacacatctttagtctatacttgctagtatacagtcatgcaaccaatacctcgtacccagtgtcctcctggtgtttcgagaagccacccctgactgccgagttctttacaatagaccgtcataaccaaaaaaccgaggctaaatacggaggagtaccctccccaagaaattaacttaggactatatacacgcgcggaggaatacccgtactgagttgtcaccattagcggcccacctctcatccgtagcttataaccccaattaatggtatctaataatcgaagcaccacgcttacattactaaatactactctacatccttgcaaccgacagagagcaacagaataatcggatactaaactcacaccaatacacctatctggaaagctagttacacaactatattgattcaagtataaagtaaagtcggcactcaaataatatgaatggaataaactaccgaagatgtataaagaagaatattctattaattcagtaagtcttacaaaataagaaaggaaagcttttaaagccatacccggaatctcctgaagactcgaggactatgaagactattctatttcctactccactagcactaggactactaaacaatacttgatagaactcttgatcttcttcttgaggtgtgtgagggaatgaatgagaggaggggtatttatagcccatgagatgccctgggagtgtggagatgctccaagcatcctaggagcatctttgctctcctcatgacaaatggcatgatgaagcatcctaagagcatctttctccctccttgtgacaagtgtccccggcggttatttcaggtagaaccgatcacaaccgccatggtatgtggataacttccagctgatgaagaactgggctgatcgggctggctactggttcggccgaaccaaccctggccgagcccaatcagccaaccatttggcatgtgtgtctcccagtggctcctcagcttagtggtatgaattatgggcttgtttgctcatgttaatcctgtattaccagcccaactatccaaaagtctgcttctcgatagcgtatgattgatcgttcatctattttttgtcgattctcctccatttatatgtgcttctcctgtatacatgttagtagcatagtatatagtggaagtagatgtgttatttggaatttatgcattgcaagcatagctagtcttcatatattgggtaacattgacggtcgaaacaggccgataacgaccatcaataccaatgacggttgtgacggttggacaggtcggtaatacccaccaaccgtcattggggagccatctcagccgtccagaagaaaccttgatcgaacggcgctgcgaggggttcggccaaaccatgggtcgggccggcctggcccaaaatcggtaagtggcctcctccgttgctctcctacgcagacttgtgaattttggcctaattggtcatgtcaattctgagttcttggctta

SEQ ID NO: 98298 - DNA, 2125 bp, Oryza sativa
aaaagtgcatatataagggacagtcatctacaaatggatcagcactgaagagtgcaacggattaaacaatccatgcaatttactctcataatgagcttatctaatgtatacatatccattcattaaagctattcacatgggatgactataaaacatctctctcacctgctttcttctcgattggtttatttccttctaatggagcaaagttacatctctttcacctcctttcttctcgattggtttgtttccttctaatggagcaaagtttctgtttgctataagaagcacttgagctatcaattgccgttattctgcacatgtgaaaaacacatttgttgagtcatctcataaattcaggcagcaaacaagagtcattctgacctgacatatgcagactgacacatacaagagataacaatttataattgttgccatgtttatctttacgatctgaatatgaaataatagaagattcagatgcattccttttttgaattttcagaaagtttaaaagaataactctgttcttttttttgaataaactgcaagtttgtttgataagtttccttgctatatacaaataatctccaatatgagatctttcatgatatccaaacctaaacaattaaaaatcagcagcctctcaattagctcctagaaaccacagtccagaatagtacactgaaacaacatggaaaacgttgctctgtttttcctaaagtaattatttagtaaaagcttgtactgcttcttctttaaacagtccacaataattggattgtcacatgctacagctaacaaattcaggggagaagcttcgcgacagtccctgaaagagaattttatggcagaaaaggaaaaagaaaatcataatttaccctgaaagcaaatgcagaaaagttattcttttaacaagcctgcttttcggcagttagtcagttactggccaggttttagttggtggaagtgcacataaagcttccaaatgcatacataggaggtgtattaatcaatgaccaactactatagctacagcctaatatatcccagaaagaacacacccaatcagccaatctcatttcaaaatgactgtaagaattcaagcatgaagataaatgccggcagtgatatgatataaaagtctttccccttcaatttgactacacagcaaatctatttcatcagaaattagaaagaaaacccattagatttaactgagaacaagtactatgccacaaatatgcggcggtgtgggagtggacgaccggcgaaggtcaatggcgaagaaccggatctgacagcaatgtggtgactggcggtggcggtgaatcgtgtacggctgatggagggaagctagtcggcaacacgagtattggaaaaagggatgagcggaacgaacatattcgagaatcaacctcgaggtcgacgatcggcgggcggcaatgggcgatcggcgggcggcgtggtcgtggtcgacggggatcgaccggccaggcagcgatggcgcggccgcggaagacgggcagcgactcgtggcagtgtcgaatcgggctatgcagcgcgaccgtgagggcggcgaggcgacagtgatctagcgagagatggaacgcgatgcgaggggacgtgttgcgggcttgcggccttgcgggggatttggcggagattgcgtcattggaggggatggggaggaaatcgcggcaatactggcggcacggatgcggagtgggagagaggaaggtgtgggacaggcggatctgggagggaggagaggatgactttagatcgttggatgtgtgatatgatgaatgatgaatgagtaaaactatttgttgaactataaggtagactacggagagggctctgggtccacatgtcattgggttagtgttttagtctctcatctgagcacttgggtttctagaaattatgcataggttctgaacatatttttccatgagtgatacttctacagtttggaccctatgtttcttgctatttatgtgccaccgtccttcttcttcctccagaactaacgatagacagggagagggatggcagttcgtgatggttgcggccatggcgctacagagggcggcgtctctattaggagtaaggagatggt

SEQ ID NO: 98299 - DNA, 1262 bp, Oryza sativa
tttggtcatattggagatcatcctgcctaatttatgtggcatttagcctatctcataataattctacacttgattagtaccataccacattactaaaacaacttataaaatattatcccttcgacaataatacacttacaatttaaaccttttatatgaagtgagaacgaaagtataagacaggtaattcagtttatccgttggatgactgggctggaccccatggtttctgtaggatggagtgttacaatttaaatgttatgttgttgttttgtttgcacagatatattctcaattagtcactcctataaataactgacacggttgactatcactattttgactttgatcaataattacttctaaatatcccgacgaaaataattatttttaaatattcagatcaggatgaacaaaagtatggcgcttatatttaggatgcaagtatgtttttttttagtatatgtatttttaaaaacgagtggtgaaagttccaaaataaatattgaccattgtcggtcatttcaaaatggagggagcatagattgggagaaatcgttgagacaggaatgtgtataatatttatttgaaaccatgtggttttttttctaaacacggccggtacaaatgcagacactcacacgctcgcatacttatgctagatgaacacatatgtatatatcctatccctacaaacactcagactgatataatattctcattaatactagcaaaatgcacatgctttgctatggtaaaatgcacatacttatttgaatatacgttattcacttgttttaaataaatattagactattacataatattagaaaatatcaaagactaatttgtaggacgtgcaaatttagtgatagtgggttggtcattggtggccaccaccaccattagcttttatagtagtaaaaaaaagacacacataccgttttatgacaaaatagtcacaaattaatgcttcctgttattccgataatgctgtgtgtcgggcgcctgagcggccgaaaaaaaataggcgcctcgaaccacgtgccaagtattttaaatagctttaaaacgatttttctcctaaactaattatctaatctacgatccgatcacactgttgtattcgttgcaattaaatctttataacaagaccacacatgattatattttgacaaaaaatattttagcttttttattgatattttttaaaaatgctacattatggttctttagatgtttcaaccagtagttttacgttg

SEQ ID NO: 98300 - DNA, 647 bp, Oryza sativa
gccatgggatcccttcgtccccttgcctaatccaaagaggagtgagagctgagcgcacgcctgagccatgaggaggaggtggctgcccgcgaggacctccggcgagggccggggaagaggacccgctcgacgagaggaggacgcggccgccagcgacgagccctgcgcagtgagctcgaggaccttgtctgggtcgcgtcgaggcaatggcgcgtcgcggccgagccagtggcaggggagacatcgacgaagagagggagggcggctgcggccggagctacgggaggggcggctgcggccggagctacgggaggggcagcggcggtagtagccggagttgggaaagggagcggcggcggcagtcggagccatgggagggaggggcggcggtggtggtagccgggggagggagcggcggcggtggtagccggagccaggggagggagggacggcggtggttggagttacgggaggaaggggtagggcgacggcggtagccggagccgagaaagggagcggcggcagtggctagagccaggggagggaggggcggtagtggttgttggcgtcagcgccgggtaggtgtcccgcttctgatacccattagaaatcacctgatatctagtaagtagcgcctgatatctcat

SEQ ID NO: 98301 - DNA, 1274 bp, Oryza sativa
tactaaattactttggtcttgtacttgcagaaaaaatgcatttaggacgatgctgtttgaaaccccttcgggatttgtaatgttccgtgtttcagatgttttgtttagatatcctgaggtatgtataacttttcattcaccctagtgtgatgcataattcatttttcttctgttacatttaggccctacaccttatctgattttcctttccttttgtaggacatatggtcgagttttactgatccacgtaccgcacaccaggtacattttaactcctaaatttcctttcatgctttttgtttgtttatatctatttatcgatttattgttttttgcacctttactatctatgtacatcctaaccattactgttttatttttttttgcacctttactgtaaaagtacatcctaagccaactaattattgctttattattttttgcatcttaactgtacatgtaaatcctaagcctttaaatgtgtttcatacaattctatttgtatgtcatttgttctcttggttttattaagatctaagcctttaaatgcatctatttgtaggctgttcgtaccattggttttattgaggttggtaacaaatctcttgtatgggataaggatattggtcctggcgaggatttagaacaatttatcctaaaattcccaattacaaaatcattggttgttccaaacgcacagcttaaattcgttattgagaaaaaacttggaagtttacatctaccctaatgtattttaatgttgatgtttatttaatttttttgttagtgtggaattattaatgtttccctgttatatatttcttttttcagaacattggctgttggtttaatgggcgtattgttcctgagttgatttggggactaaattatgccctggatgaatttgtgcctcaagagaagggcaacctatcaaatgaatgccattttccactgagcaagcaattgcatgagcagttaaaagcatatggatttagtatctcaccacaattagtatgttttctcctttgctaatattgttattattctctgctgaccatccttttattgttttcttccttggtctgttgtgttaccttatttatttatttattgttttgtgttaccttatccttttattgtttaatcccttaaaatatttgctactgtactatctgttgggttaccttacccattattgtttaatcccttgcatatttcttgctattgttgtgttgccttattattttatccttttcattttagattaacagaga

SEQ ID NO: 98302 - DNA, 593 bp, Oryza sativa
ttccagactggccaatcatattttcgcaggcggacaagccatctgtctgcatctcaacgcctgcgaaaatagttgattttcgcaggcgtgcaataggtccgcctgcgaaaatagcttcttgcgctaaaagaaaaaggcagccaccgccgtttccggcggtagcttcccgttcccattccagttcccactcattccctatccaatcgagtgaatccaaattcaattcatccagttcatccaaaaatcaccgaataaattcatccagttcatccaaaatcaccgaatcaattctagcaaagaaagcaaataaaaacattcctaaaatcacggccgcggcccgccgtcatccacgccgctgccgcacggctgcgcctcgcccccctccgaccagatctgggagggaggggccgggagccgccgttgccccctcaatccccctcgccgccgtggccgggagccacgccgcctcgaccctcctcgctgttgccgccctctgccgccgccgtcgggaacacacgccgccaccgccgggagccgccgccgcctccggcctgcggtcggggagaggagaggggaggggagggccggagggg

SEQ ID NO: 98303 - DNA, 676 bp, Oryza sativa
tcctgcagcccgatgtggtggtgtagggaaaggatgcacatcagggtatttatagacgagatgtcagaaagcaggccatgcatttcgtgtatactcctttcgtaccaaaaaacaaattcaggctttgtcgtagtagtagtagtactagtgccagagctgttcttcttctctagcaaaacggaggaagaatggatgaagaagaaagagacatggatctatcctcagtttcgtgcattttggatactcgtatacatatgcatttgggtttctttgactagtaacaatggatcgatatatatgtacgcgtgcagaaaattggtgtctgccaaattaattggatcacaacaagaacaggatcgcaccaaggaaatcatccaagcagacagtataagtttgcaggcaggcatccatggggcatcttatttgttttttgtggacactcgaaaccaattcaaaactttttacatcaacatgcatgtatcaagcttaatttgttgtttgtgtttggacgccagtaagagaaaccatctttagtcggtcaatccaaatccacaatagttacaattccattaaaaaccgggactaaaaagcagtttataaatataaagggactgtgtgatctttagtcccggttagtaacaccaaccgggagtaaaattaagatgatctttagtcc

SEQ ID NO: 98304 - DNA, 676 bp, Oryza sativa
cttaaaatgttggaaaaaaactcaagcttgtaaaggtgtcattcttaattatgtttgtcctgctccttgatggtcaaaatattggttcgactcatttattagcattcctctacctgaggactctgttcttagagcgaaggaattttcccgaaaaaattaaatcgacggaattttacggagaattaaacttaatcatatgaaattcctgtaaaatttatgtgttctggattggcatttaataccagtttagtggtattgttttgctgttatactaggtaaaaccccgcgcgttgctgcggaaaacgcgcgggaattttagtatgtaacaataagtaaaaatagctaaacaatataaacttgcataagcactaaaatcaattgatgtgatatggctgatagagaagataaaaaataacattaactaagtgaggatgaacttacgtaagtaaataagatattataaagaataatgaagatatatattgaaatattatgttaattatgtgggatgataatttaatatacttttattttaaaagctctaaaatataaaaaaattaaattatagataatatagcatgtttgcatgatattaaatgtattgattgttagtggatgatgatgtatcaacttgttagtggatgataatgtggcatatttgcatgttaagtttaga

SEQ ID NO: 98305 - DNA, 776 bp, Oryza sativa
aaaaatggcagggctgttagcctctcaagtctcaacattggttggtagtggggcagtgaggctcaggagcatcgagcagacatgcgaccgtgtgagtgacatgatccagaggaatttcttcgcttcttttactggaggatctagaagaatttggtttgtttggttttggtgtttggcagtattggcacagcgcatgattgaaactaaaagtgttttgtgaaaaggatggaagctcacaactgatccctttcaggcttgagtacacgagaacgtgcacaattgggccgggcgtgtttttgttggtgggcctgttcttgaacctgatgggctttgctggctgggctgggctaccacgagttcatgagtggggtgatatacagggtcagtcagtcattgtctcctcgttgcattcgttttatcttgtgaaactatagtgccaaagaaagattcaacggtacgaattccatggcgacatgtatgtatatgtggtttgacaaatacacctcttcatggacgggtgcaaatttctgctccagcattacggatctgaaagtgagactagcagttttggaaatacagatttttgaccaactcgaaatgcaggcaaaacttggctatcaagtttgcccccccagccaacttggctcccaagttttaccggaccgaagacacgcaatttgcaaataaggcggtggttcgttgggccttttctgccgcataatcagttttctgtttgcaccttttaacgcataacctcaaattatttgtttccacta

SEQ ID NO: 98306 - DNA, 731 bp, Oryza sativa
caaaattagccctgggctaatcttccaaacagggccctagtacgccggatcgccgactaacgaacaggttgccgtcccttgtttaaataaacaaacaaatatttcttccccgttttaaaatataagaaaccgaatgtgatttactataataaacaggttgccgttccttgtttaaataaataaactgtgatattttttaatattataaatctaaaccgatcagacctaagatcggatgggatattttctagtagtataccgattcttaatagtaggaaatggcttatccgttttcggtttagtccctccttcccagtaccaaatgcggcctctgctgtgcatcggtgcatgtgccttatcgagttcttcggaaacttctgtgtgttgcgagttactacttgtttcaaaatagcactattttagaaagagaaagtaaagtctaacacattcacggctaagccggcaaaattctcaattcatgttaaggacctctcaatgattgagataatttgaagaggcatttcatttggcttctacctcttatatgattcaggcagcaatccccgaaaagtaatatgattcaggcagcacacaacgatttagacaatacgcattccaaatcatatttatatattttcacgatgtaatcatgcattacaaataatcgtgcgaataaacaaataagagcaaatagttagagaagctgacagcctgcctaaccactatagtaa

SEQ ID NO: 98307 - DNA, 742 bp, Oryza sativa
attcctgcagccccgcaccactatccatggctcaacttctccctcgcccaccactgttagtactcattctacttcgttgtctgttcatcgatcacatgtgtgtgtgttcttggtcattttttggagtaagtgccgtgcttatgcgttggtatgtgtgtgtgtttgtgcaggtgaaatggaggaggaggagaggggcgcggcggccgagctggccgcgatagccggggcggctccgccgccgaaactggaggacttcctcggcggcggctgcaacgggggatcaagcggtggcgcttgcccgccggtccagacgacggcgccgacggccgccgagctgtacgagtcggagctcaagtttctcgccgccggcttccagctgagcggcgcggctggggcggcgccgccggtgcccgcgctgttgccggcggctgctctagagcagaccgacgagacgaagcagctggccttgccgccgcaggccgcggtggcgccgccgccggagcagaagaaggcggtggactcgttcgggcagagaacgtctatctaccgcggcgtcacacggtaagctatagctaagctaagctgagatcgatcagtctatgcatgtgtcggccataaaatctaaaaataaattcttagctagctcgtctaatttcttgcacgcaaactaatcatctcgtgttcgtgtgcatccttcatatatagattcacatgcatcatcgatcgtattaataggatttag

SEQ ID NO: 98308 - DNA, 503 bp, Oryza sativa
cctgcagcccggcatgtatagtctacttgggtcccacgctgattcagccgttatgtcagataaaaccggagtcaaaaccacctaaggacctaaagtgaatggttttataagctgagggatgtcatatccctggttttgtggttggggacgattttgtaactcgatgacaagttgagggaccttcggtgtactctaatgataggtatatatagagaaagtgcatatgaatatatgatgtagatacaagttagaattacttatctttaggactcccttttatcagtacaattcgtatttaaactctttatctccacctgtacacaactatagctactaacacccacctccgccgccgcagccaccgccgtcgccacaaccgccaccgcccccatggtcaccggagaagtggtgcccaccgccgccatggtctccaccatggtggtgccagcctccaccatgatctccgccgtgctcgtggtgccctccgacgtcaccaccaccat

SEQ ID NO: 98309 - DNA, 687 bp, Oryza sativa
attcctgcagccatgttctgttgatctcggtcacttcgagcgtatgtgaactcacgggacttccatataataaaataaagttaattttgtcctcgtacatctatatacacacacactaatattgtagggcttctatattttttcacattgggcctccaaaaatttaggactggccctgctcctagggttacaattttgtggttattttctatgaacgtctacgtttgtaccatgttaaaaaaatgaaacctcatgacatcttatacagtttgtttaaagggacaatttaaaccatgccatacaaattttgcaaaatttatgatatgtcaccctgacccacatgtcattgactcatgtaggtcctacatgtaattaagatatggatggcatatctcaaattttgtaaatatagggtggtatggttttaacaaaccattgtttaaaaatcattaaaatagtttacttggtgagaaaggaaggggaaaatggaagcataatcagttgtagggggaagctgtagtttagtcaacaccaatcaaacaagatacatagtattccccttctaattttagtttattgactttatcaaattcttttgtgttcatcgcgtaagcgtgaagagtgcagaaacattgttttctctcacactcgcacagttgacactggcacacagaaacagtcaaatca

SEQ ID NO: 98310 - DNA, 1106 bp, Oryza sativa
ttcctgcagccccccttcgctctgccgccatccgttgactactcattgagaacagttgcaagctaaggtatattgatctctatccggacaagactacaatgtcatatgttccctcactgcagcttgaggtatgcacctaaggatataggaatggctgaccgatcttcaagcagcgccatggttcctgataagcaaaaggagcattctccaccctaaagtttggtgacttatctgctactacagaggatttggaatcaatcacctcccgtgagaatctcagagaggggtgtgtagaacacccattgcaatatgggttctggtcaaaactgaatgatccgtagattcctgcaaaagcagcagtcgtcaaaaactacgacaaagctgagagcatcacaatttctagcaagtggagcaagttgtgacttgtgagctaggtgccaaaccatttcgttatcagaaacggtgaccaatcaattgtgatgcagtcaatggtccagtagctacaaactttaagaagaaaaacaattgttcttatcttaatgatgctattttaaagagtgtcaaatcctcattgtacaaaagaatatattttatgtttatgggaaacacgtagcaaagtttaaaataaggaatacacacttaatatacacataaaagatgataatgcaacctccccgttgaaggagcactggctgcttacaagtttggctctcacaaacacaagaaaagtgaaggtcaggatgcaggaaccattgtagttggaaaacatagcagtataagtagtcaagtagaagaacatgtcaaggtcaactgaaagttgttggatagcactcaaacataatcaagtcatactctcatatggaaatgaatgttagtgtttaggcaaagtataccaactatttggaaattatgaacgaataatgctcaatcacatcaatgtgccaaggagtctttacataactgtcaaccttggtataaatttgaaaggtaggaactccccacccaaatctcatcaaatagaaaaggaggattagataccttattttgatgtttaaaatgaagctgaacattgaactttattagaacaaaatctactggagatcatt

SEQ ID NO: 98311 - DNA, 1701 bp, Oryza sativa
ccctcccctcatgatggcaggtcagtcgaatgcacatgacgatggtggtggatggtcggtttggctacggcggatggagatgacagcggtggaggctctcggtggcagctttctaggggcattggcggttaggcaagctccagcgtccagatcttgaccacgaccaggcgaagacgtggggactatggttgtaggtgagaggtgactgtgttggctggaaatgtaacggaggtttgagcaagtaacagattcgggttggcgtgatatatttgtcaaggtgaagtttgttagtgttaggtggagtttgttagagtttgtgatgaatatgtttacaaagtcggttaaagtttaggacttagagttgtaataggtattaggactagagtaagagtcggactctatcctaggatctctcataagtagaagggtgtgcttgttgtaacttcatggcaacttagcatagcgagagggagcagctgccggcggcaaccggccgtgagtcgctgtagctctgatacactgtaatatgctagatcgaagaggaacacctgtaatcagtgccccgaagatgtaggctgcggctgaactccgttactaaatatcgtgtctcggtgtcattatcgtgtttggatctcctatggtgtttcttccgcgtttagctaccaatgtcgatttcggagctagttttataacacatatagatcttacaaaaatatgaattagctcagatcaatactatgaaattctttcattttaagactacatcaaactctaagaacagagtcctcatcgaggtagatgaatgttaaggacagctctagctctagttcgaagccacagttcacagaaggtgcacaaaactttggctctcgatagctacaatgttgacatcaatttgttcaacccacgtaaacgaaaatccctccaacacttgcgtatgccctccctgcacgaactgacaaaaatccaaatgcatccgcccgtctctagttccacttcccttcttcctttcttctatcctttcttcttggcgctgtcatgttcagcgatcctgtagagtacgtgtcgtgcattgcaggtacgagacaatgactaaggcttcgttcttttcttcaacttgagacttaaacttctcgttttccgctagtgcggttttaaaactgttaaatggttaacttccttattttttgttagcacgttttttaaatgttaaatagtgtgtttttttaaaaaaattatatagatgttgtttttaaaaaataaaattaattcatttttaaatatatataataattaaaatttaattaatcatgtgttatcgagcttgcacattttgtatgcgcagaaaattttcttcatttttgaattcattttttctggttttttctttctttttttccttctcggttttttaacatatacgtatacaaactttttatacgtatgtacaaacttggtatacatacgtatataaagtatgtatacttgtatacgtatatgtatacatatgatgttttttttggttttttaatacgtacatatacatagtttgcacacttcgtatataaagtttgtacacatcgtatataaagtttatacacattgtcgacgatggatactcgtagatcggatatagagggtattggggtacgctggtacgaagatctatgtaatacgacatcaagcaaacaagaaataggg

SEQ ID NO: 98312 - DNA, 1649 bp, Oryza sativa
aatctcccctaaattttgtagcagctgaaagggattgaaaactagtagtataatgcaatgaggaaccctgttaagctttcagtaaagccgggctcgcagagccttttctctaaaataatgcaatgagggaatcaaattccaaccagatgcatccccatctgtgaaaacattagattttgcaatgccattaatttcatatctctagttcgttgctctatgatcgacacacctttttttagtccctacatcccacacacattagaccgtgagctgttcattaagcaatgcgcacttaccaataataaatgacatcccctagttttatactacatctgtcccaaaatataagaacctatagagcaggattttagtatcaattcgcataggaatgcaaaaatttggagaattttttggcgttccaaaaagacactattgtgtagttgggccatgttctagtgaccgtacagctgtaataaagctttgtactgttcccctcgtgctcactgctagcttcttgtagaagctttctacatactccctccgtcctaaaaaaaagacaaaccttgggttttcgtgtccaacttttgaccgtccgtcttatttgaaaaaattatgaaaaaaattaaaaagacaagtcacgcataaagtattaatcatgttttatcatctaacaacaatgaaaatactaattataaaaaaatttcatataagacagacagtcaaacgttggacacagaaacccagggtttgtctttttttgggacggagggagtatgtccatatgagcaataaccatgagtgaggactgaggaggttgagcttctcgtggaagcctctctaccgtggatggggcttcattaacagggagtccagtagagaagctagagatagcaggttcttgttttagtgttttacctttaaaatttaaatgagtttcttgttttcccgttctttcatttgaatgcctcacatctctctttgttcaggtgctgtagttttcgcattaaagtttgtattcctttcttttatttttcattgtgtacttaagataaatggactccggaacatgtcaatctcgtaagcaagtaagaaatattgcaatgctagctttgcttagtagtcattaccatgctcatgctagtgcgtgttagtatttgtttggaactgtcatttgtacccccaagattatatttgccagaagctacatacttttaagttgatcttttatgctgccattgtacggatttcagaggtattaaataaattttagacctaaatgcaatttttacagcattaaatgttagagttgtgaaatatttacacttttgtttcttgatttgggcattgaaatttccgtgaagttttgagatttgccattctcaagctagtggagattggacaactcttaggtccctgtgatgtcattacctcccatgtaaaaatcgttgaataaacttactacatgacagaataagtaggttcatagactattttgccacatgcaaattcaacaacctaggtgatagagagtattaagataaataacttctggtgcaaatctcagtatataccttctgttacagaatggtactccttagcacttgataaatataatataataatatttttgttcacaatgaataatgtgg

SEQ ID NO: 98313 - DNA, 608 bp, Oryza sativa
tttgtgcgcatatattgcctcatgtttctgatcgcatcgctgcggatattgattttatcttggatttaatttgggcaatggacattggacagcccgtatggaacggaaaagttgcccatgtctgcctgatcaacggcggcgtgctgcaaacccatacaatgcactacctccctccctgcactgcacctgacgagatccagagaaaaccaggataggagttggcccagccggttcgtggctagtggagtacaaaatttgtgcactgagtttggatggaagaaataggtagatgatgataattcggtcacacacatgcatgcacatacaagtgtgaaatggcagcagggagcactagctcgaccgatcattgatcagtttgatgatctttagcccgacccgactaatgaagtgatgagtgataagtgatgacaatgagataatgttccgcggcatatccgctgggtaatgcataagcattagccaaagtggtttgcgtgtttataaagttctgacgatctctgaacattatttcgaggagatatatcgtgcattcacgcggggatcgatcttatactttcagctatccttgcattatttttctatgatca

SEQ ID NO: 98314 - DNA, 554 bp, Oryza sativa
tagtggatccccccagggttgaaggtgatgaacaggtcaggaaactatttaagccagtgattgcttcacttattattacagagcaacgacttgttcttctgaacacatatttgtcggagttaaagagggcccggggtatatacgacgcatatataccgcatttgataaaactccaggtccgagcaatacgtggtcgctcgtgtatcttgtagaaaaaataggtggtacgccctgttgctagctgctgccgtgttgttttcctgagtttatgtgtgccccaaacgtctcctttgtttgctgttcgctcaatcagccgtccatctgtctacgtgttccagtggctttttttctacggtaatgtgtgcttggattgttgctgctgctgcttgacgacaagggagcatgggatcgatgtgattttatgttgcagtcgtgttcctcttgtagtcgtaacctaaccggtgaaagccaaaggtatagctgtgaatattgagttaatttctctttgggttgtcttttattaccgatattttgttttggattaacttttaaca

SEQ ID NO: 98315 - DNA, 528 bp, Oryza sativa
cttccagtactcgttcaggtgccgtatatatggcctccgcaccgtcggcgtccaagctgcaggagcgcctcctcctccgcctcgctcgccgccagatcttcgctctgtaacacggtcgcggggcggacatcgtgacaggatgtgcggtcaatctgctcctgcagcatcctccacttcctcagcttcttcattatcttcttcatcccttcggcttgcgacgaccaactccagttcatcgccggcagaatctggatttgttgggatttttctgatggattcatggatcgctacgggaccacgccataaatgggccagaatgcccgtgttctactcggcctcagactcctaatttcctttgagaattctcccccccacccatatgtaccagcccaagctcccaccaaatacttctctgtgacttgtgacgaggaaaaagtacaccggacatacctactcttgtcaccgatttacaaaatcatcccttaaccaaaaaaccaaatacaatgtatcctccaacttttaaaacca

SEQ ID NO: 98316 - DNA, 506 bp, Oryza sativa
tcaaaatgtcctagagacataggcctggtttagttatcaaccttttctttaaactctttatttttccctcatattaaaactttcctacacacataaactttcaactttttcatcacattgtttcaatttcaatcaaactttcaattttaacgtcaactgaacacacccagaaagacacaggatttttctgctttcgatacctgacataagagatcgtgccatcgcgataatgcaaaggagaggagaggcagtaataggcctttggatctgcactagtaccattttcaggttagtttttttattttttgtcaagaattttcaggttagttgtgttcatgttccctactagcagcttcgttctcgcttcgaccatgtggcaagggtggcactgcaatcttctctcctataatagcagtagtagattccagaccggcagaagcttgcattcaaagcaggctgattaatctggttcagatagagaatatcgctcctgcgcatgcatggga

SEQ ID NO: 98317 - DNA, 652 bp, Oryza sativa
  unsure (1)..(652): unsure at all n locations
actatagggcgaattcgagctcggtacccatccacgaatcatgtgcagtaagtccactagttgcagatcgatgctaaccacatccagattgaaggagtagcgtgggtaaggaggtcttctacctgcccgccgtcgtcacgtccttccttcccgagcgccgccgagccgcccgacgccgccccttcctccttccggctcctggacgccaggcgtgcgtcgagctcgcaccacgccgtcgcccgaagccgccccgagctgcgccgccggcccaaagccgccgcgctcctatcgtggccgcgccgccgagcacggccgctctcgccccctccccaaccgcgccggagccccctccctctacccggcgcaccccggcaccccgccctccggcgccctcctgcctgcgccgctcaggccgcgcttcgtcgctccgctgccggcgctctcctgctccgaggcagcggagagagagaagaaatgagcgagagaaggaagggaaagagagagaagagaagaagagagaaagggaagagagaaaagcggtgggactgggacctaccaatgctggaatttttacatttcgatcctttntaaaaacttattttacaaataaactcttgaaaaaacttaatccaagaatgatctttnttttttt

SEQ ID NO: 98318 - DNA, 849 bp, Oryza sativa
ccaacaggacggcgccagagaggatggcgccgtcctcctgccaccgtggcgcacgcgaaccgacgtggcaggaggagggcgccagccatgctggcgccgccgcctccattcctgtttctctatatagagttgcaacggggtcatttttattttattttttacggatgttttttcacacttaggatcacgatacaaccaaccacaaaaaaaatttaaactcgaactaccacttaactaaggctgaaaatagctagcataccacttagtctactttgcaccttcactaaaattagaccataattcctttagtaaaactctttgatcagcatgttaaacataatgcactctaccactatatgaaattacttaatctaattcaaaatataaccacatgaaatgacatatataagttaaacagtacatagagatgcaattttttttatttttatttcatttttttgatatttttttcacgcttaggagaacataggaaccaaccgtataaaaaataaactcaaacggataaaatatgtgacttgtagaattttccaaaactctaccgaaacggacaaaatatgttatctattaaaataggcgtaactttctcatacgcactcagaatcaggcaaataatatatgcacggacatctacagaaaatgttacatccgattcttcccagctttgctgggttcggcgatattaaaacctccaaattccgcttgcaagattgtgttttcgaggagagaagtaattcggtagaactttggaaaattccacatgccacatattttgtgcgtttgagtttattttttacatggttgattcctgtgagttcctaagtgtgaaaa

SEQ ID NO: 98319 - DNA, 530 bp, Oryza sativa
ataggcgggaagacacggaacacctggcagcctagcctgcctggccgagactctcccgtacacgcgtcccctgtgttgacctgaccccatccatcgcaccgtcacaagaatcacacgcacgcgcacgcgcatccgccgacctcgacccagtctgccacagcacaccacagcacagcagcagcgcgtagccgatggagccctacgcgtacgcgtgcgcgtgcgcgagcgcgaggcggcgagcgagacggacatgtgggttgctgcggtttgctccccccggcgaaaaaaaacccaccgccaccgccactccgcgccgtcgcgcggcgcgcgggggtttgtttgggcttgggccggcgggcgtccaaccaaaaggctgcagcgagtggcccactgctctgacgtggggatggaggtggcagtggcggtggcacggggggtgacgtcaggttggttgggttcacggcgtgagctgaccagtagtagggagtaggagtagctgctagcggtcagtcaacctagaaaaggcccaa

SEQ ID NO: 98320 - DNA, 610 bp, Oryza sativa
caaaaagtaattcttatcatgtttcaaggctgtgtgtttagatctaaagtgaatccaaacttcagtccttttccatcacatcaatctgtcatacacacataactttttagtcacatcatctttaatttcaaccaaaatctaaactttgcaccgaaaacacagccttcctctctctctctctctttttctcttgtcgcgtcaaaaagaagtcagaaatgtgcagctgtgctcgtgctccgcgtgaacagaatcgtatggtaggttaatgtctccgtcagcatcatgggatccatgcgatgaaatcggaataaaaaatacgctgctagtaaaatcggttttattttattaggtatgtttaattcatttaaactacgttcagtgtttgggtgttacttttataataattggctgtagctctgatgagcaaaagccgagatgttttatttcattatctaaaaaaagtaaaatctgtttatttcacagagcaattcatcatcgcaaaacttgatcaaatttcagcaaaatatatatgaaatagcagtccaggttaacattttgaaatgccaaaggtaaataaaacgcttctaattaacattcgattgggcggcgc

SEQ ID NO: 98321 - DNA, 569 bp, Oryza sativa
gcatcaatactacctcgggatctttttttggacggttttatatagttaaggtattccggttaggagacctcagacagatttcgtgtataaattgagggacgtctggtgaacttagggcctgttcactttgatgccattttcaatcttaccaaattttggtaaagttgtcaaaaaaagtggctacatttagtttgctgctaaattttggtaactatataagaaatcctgccaaaattttgacaagttatcaaaattttggccactataaattttggtaataccaaaatttggtaaggttttttttggcatcaaagtgaataggcgcttggtcctttctgagctaaaccgagtccaaattccaaaagctctcccgacatgggccgccacgatcagtttcaggtggccgtgagaagattccagaatggacggtcatggggatgggggaggtcaacacgactcacaaaggtatagtaggaggcgcggctgccacgagacgaggtacgtggcccccatgcagcacgccgtggcgacacctctgcacactgatcaactccactcacctcactcct

SEQ ID NO: 98322 - DNA, 736 bp, Oryza sativa
aaagctattatattttggaccatagagttagtatattcttaaacggttgaagtagtacatagatccaaggttacttccatgttcaattatctaaaaaagccgttaatttatgtattgtttgtttcagcttaaaattattgtaatctagattgttaagtcaaattactataacctggattataataagccctggattataataagccgacctagaatactccctcgggttctatattaattgacgttttggacaaggttgaggttaaacttttataattttgaccatcaataattttaaaaatatttagtttagagaaactataaaaacatatatagatttatctttcaaaacactataataaaagtaaacatacatttatttattgtatatattataatagaaaaataaggtcaaacgtatatcttgtaaagcgtgttattgtccaaagcgtcaattaaaataaaaccggaggaagtaagttgttactgtttgtttgtctagattattagctgtttgttaggtgttagtcacccaataaactagaaaaagcacctatagagtggattactatagtaatctagcttatagattgtaataatatattataataaactatttattttaatttacttctaataatttagattataataatcctaagttgaaacaaactcgttgtttgtcatgtagaatcagagagcgagaataattaatctcagacagcgcgcattgggg

SEQ ID NO: 98323 - DNA, 591 bp, Oryza sativa
acaagactgcacgcaggcatccattggagttcatttggtcatcttatttgttttttcgtggacacaggaaatcaattcaacactttttacacattaatatttgtcaagcttaatttaaatgttgttcggtttgaacgtcatagtcactccacctgtttttaaaatatagttgttatagactatcaccgtgcaaaatgtatcaagcgtatatgtttatagctccattttctctctcggtaccagcgacgtcgtcatatccatgaacggtggttgcttgagcttgaggagcatcgccttctcgagaacgccctctcgatgtgtatcttcttcttaattaggccctgttagttgcttcaaaaacgaggaaaattttctgcgcatgcaaaattaagaagctcgataacacatgattaattaaatattaaattttacatatttaaaaagaattaatttgattttttttaaaaaaacttctatataatttcttttgaaaaaacacatcatttaatatttgaaaaaagtgctaacgaaaaacgagaaagttaaccatttaaccgtttgaagaacgtgctaacggaaaacgacgaggtt

SEQ ID NO: 98324 - DNA, 712 bp, Oryza sativa
tacgttcgttgaggaagtctgtcagataatctatctatccaatgctcacttacaggtggggccagcgttttagttggtaggagtagattccatctatcttatcttgctctaggcccctcctcatctttgacatcgtagctattgtactgctgctactcgaagcacgccagcatggaacaactgaattttgatgccgtctgccgatctattcttagtacttcacacaatcacgattctgaatccaattcaaaagttctaagtagtattgcaattcacagggcctgtttggtacagctccgactcctaaatttagctgtaggagttgggtctggagtgaagtcgtggaactgcctaaatctagctccacaacactagttcattatgtgaaaaaacttcacatatctccactcccagttttaatggagctggaattgtttggctaagctccagggatagagctgagctgtgccaaacagaccatataatataatcgtatacattaaaaccgtgaaatcgtaaattctacctacgtaaaattgtggaatcaagcatcttaattaggatcataaattcgcatgacagagtcgagattttaaccttgctcgcaactactctctcatgcccttatcctttgcaatattaacttcttgttcacaactactctctaatccccttatccttgccattttaacttgaattgctaagcagacag

SEQ ID NO: 98325 - DNA, 740 bp, Oryza sativa
tgcatgcatggtaagagatatatgtgtgtgaaacaatttatctctttccgactctgtgtgtgaaacaatgtatgtatgcaccgctttattttcgttcaataaatatgcagtcccgtgcacctaaagagatgtatatgcaccaatatatatatagtcccgtgtacctaattagtatactccctgttgaatacttaatacgtctcaaaataaatgaatctataatggaatgaaatatttcatattataatgaatatgaacatgctagaaaattacacattctatttaagattggtttattttgagatagtgggagtatttcttatttgcaaatagttggatttgtttttgcaaaactgtaagtcaattattcttgtcttttgaatacattgaaaggcataaatacgtaaaactacaaaagaaaaagtaattagatgtagtagtagagtataaggattacaaaaacaaacgaaagaaaagaaaaggaaaaaaaaggcataccttgtctccgtgggctgcatcggaggaaaatataataatttctaggtctatatctcccaaaaaaaggcataccttgtctatgttttgggatgaaagtagtaagtaactaacaatgtaacgatgaagaacattaaataatagaatagtacgcactagtgtgcaggacagatcaagcaaccaagagctacgaacaaccatctcaggtggtgtttgggaaggaaggattaaactttggtctctct

SEQ ID NO: 98326 - DNA, 866 bp, Oryza sativa
tatatacaggggtgttacaaggttcatatatatattggtcttgactaatctttcacttgtagcctagctagccatgtttggcctcttgcacgtaagtctcaggtaactgatgttttgtgtgatgcaaccatgtagacatcaccagcatgggcgatggcaagcaaggatcggaagagtggctggcaacaaggatctctacctcggaacattcggtaattaagtttgtacattaatttccatgttgaatctgtcgtccatgttcattttttttgtttagcagaaatttgttaagcctttttttgttgccctcttcttcaacaaatgtatgacctgataagaaaaaatgatatcaataacccaacaaaacctctcaacatttgactaattatatctgggtgatgtttgcagaaaacacgcatgtaggcaatactttcatgcatgtaggcaatactactttcatactaatgttttctaatactagtggatctactgacaatgcaatgtcagtgtgctcatcatgtagaagaatgctcaagagttttctcgacgctaagctatacataatctttgtcattagaactttcttttatcaaagatgaaattgcaagtaggagggtgcatgcacgtgttgggcccctcattagctagcattagtcattttcttacactcaacattacaatattaagcccttgcacgtaggttccatcttaatttatgctttgcacacacagggcttgtagctagattcgtcgacatattttatgcaggtcaaaaacatctacttctgaccaagatgtaagcatgcccacatttgattcgaaatttgtcatcttttgcgcgccatgcatgatggggctgcaggaat

SEQ ID NO: 98327 - DNA, 647 bp, Oryza sativa
tatgtgtagctttatgcggcatgacacaagcatttagcttttaaataattatcatgtaccccagttctacttatatcattttgtgacaatcataaacaataccatcctagcaacacaagtgaatagtgtttgtttgtccaaagtatgttattccaatgcacaatctcgttaattggtgtcaacagcatgctgcctaagctgctcttgttgggaagttatacaaaggatcgtgttgccaatgcaacttcaagctagccaaccaaatctaactataaatgttaaatagtggtgatgctgcaaccaccaagtaacacaattcaacaaaatctaaattttaaatctacaacaaaatggacataatccaatacatcattattgaccttttcttttttaccttatctgccggctcgctctgcagcaagcatttctcgacatgcagcaccttgtcgaagaaccctggcgcgtgcaatccaagcgaatagccatcaccttcaactttttcctccttcaccacctcatcatccttctcctccttccactctctttgcatccatctctttgttccaaaagagaactccatctggaaacaagagaaaaaacaactcattttttgcgccaaaaacccctcctaaaccctcctaaacccc

SEQ ID NO: 98328 - DNA, 590 bp, Oryza sativa
ggctccctccatctcaaaatataataatttttaactctagaatttatcccaaaaatataacaatttatccaccaacattatcttcccaaccaatcgcaaccctccaccattcatttttcccagttcccacctacctccactactcatttaatcacaaccctacaccattcacttctatctactttcttaataacggtatccaattctaaaacttcttatattttgggacggatgaagtaagtgagtttgagaggagaggaaaagagaagattgagaagatacgcaaaacgagatgagctattagcgtatgattaattaaacttcaaaattagattaatatgtttttttaagtaactttcgtatagatttttttttgcaaaaaatacaccgtttagtagttcgggaagcgtgcgcgcagaaaaacaaacaaactttctcacaatctccttgggccgaacgcagtagattcatcaactaaataaactatcgtaaacctttttagatttctcactatcgatcatgtgagaatgatgttactagatttatcactaaataaactattgtaatatgctacaccgtttattaaaaat

SEQ ID NO: 98329 - DNA, 747 bp, Oryza sativa
gtcgtagcgtatggccaccctactacctctcgatctttctcccgatcttctctttggcagatcgaaaaactcttaaccgcgcaagctggatgtgatgtcacgtacgcgaccgatccagccgtacgtgacagtcacaaatcacagaaacgagagacgaccgagtgaggcgacggatccgttcctttgccgtcccggctcctcccggccgctggtctcgccgtcacgcgtcgcgacaaacacaaacacacacacacggttcgatccccacgcgagcgagccacgtatagtgctccgttgtttcaattcggcgcgatccaggcgtgacggtttctttaattaaaaatttctgcttttggacgaaacggacgctgcagaaataacgcagcgggtcgcaattaattggggcgtgaggtcagccaaagtggacgtgcaaccgcgcgggggccaaaatggcacgtatctggcccggaaatgggagacaccgctcgcacaccccttcaaattttggtaacggccaagcggatgcccatagcgcagcgcgcagtactactgattgcgtgcaccgatggcgacgttgcacagcgagagcggccaaattaacacagctgcaagataaagattttttttttcgcggggaaataaacgatcacggtgagattattatgctgaaaatctttactcctactttattgtgctatatttgttgctgtaaatggaacgggggtgggaggctgagattatggaggg

SEQ ID NO: 98330 - DNA, 519 bp, Oryza sativa
caccgagcctgttctcaaaagaggcagaaaattatattttaaaaaaatgaaaggataaaaatagaaattcgggatggaaaggtgaacagctgcagaaagttgaatgaggaattggacgcaaaaaccaaaatggttatgaataggagatgcgcatataaaatagtgaagcatcaaacacttgagtaagacttaaccatgaaattcgtacaaaaatacaaacaaaattatattacatagtgtgtgtgaggatggaaggctgaaacgctcgttgcggagaactgcaatgtcaaagacaaatccaaaaattccagctagagaaacacagaattctcaaatccgacccagaccacaaatccaaaaaaaattccaccaggttagaattctcaaatccaaccgaaacccagaattctcaaatccaacccaaaccccgggcaaaatggggccgtgcgacaaactcaaccgaaaattcagaaagtaaccgaaccacccaaccaaataaatggacgagagcaaatgggg

SEQ ID NO: 98331 - DNA, 511 bp, Oryza sativa
tcttctgggcttctggctacacggcactcgtacgaaaattaaaactgaagtaaaggcgcatgaattcaattcactatcgggacatgttttctagtaggttcgttggcaaatcattgctagtatatactcctgcgctaaccacctcgccactccacgcaaatgcgagtgcaattccgtactaatttccttatacaattcttgtttcaaaaatatatataatttgcttaaattttcatcaaataatgcactatagcagactcatactagcaaaataaacagagagagagaaaaaaaatataaccttctgccaatctgcctcccaatcgtccagccattcaaaagcagtaagtagaaagatgaacaaacaaaaaacacacacaaaagaaaaagagagagagaaactaaaaaagaaaaaacgcacagagaaaacaggagagggagctagaggtcttaccaaggagcttccagaacgcaaacccgccggcagccggctcaaatggcgctcgctcgc

SEQ ID NO: 98332 - DNA, 1164 bp, Oryza sativa
  unsure (1)..(1164): unsure at all n locations
agaattagataagtacccatatgaaattgctactgagagaataggcagggtcatacatggaaatcagcacaagatttgtttcacggtgccaacggcgccaactctcccctgctaccgtacgtccttgagacagggcaaaagagtcattttttccaacatattggatggcatcacatgcaatttcagccaaatcaaaggtgtaatcccacttaacagccatgacgtgtcacgtagaaacatcaccaggacagttaaaattggcggtgcacggggttcatctcattgaaaaggggaaacgagagaaaaaaagacttggaaaaataccgtcaaattttctagattaattaagagacatgagaaaaatgattagtgattagtttctgctttctagagcctcctagagaagaagcacacgaaggacacttgattgatgcagatcatgctcctccgaccatttctttttctttttatttttctctactatcttttgatctgctccatccaatccttgacttggacatcctgggccaaccatatcaatgattttgtttatgtggctaatcttgattgtggtcacagttaattattttctcctttttttctgaggctgccattggcctgatcattaaacaaatgctaataaaaacaaaaagaaatcattagagtttgttttaataaatggagagatctagcttggtgttgcagaaatgcagactgccagagttgcattaacatgacacctgggcatggtttctctacatcctgacacgtgtccctgggagtcacacacatggctgttgcctgttgtccctctcagatcacaagcaacatttttctaggataaaacagttgtttttttttaagaatttttttaaccaaacgtgtntaagggagaaaatgatgtggatagatcttgttctcgaagacatggggagggcgatntgcaatactaattccacattttgtaccctaaataataaaaaaacatgctgaaagaagaggaaccaggggcatagcgtacggacggtgtctttgacgtggttagtttccatgattgagattatggttgcccccttccgcaatccacgcacattatgaactctgacagaaacgtacaccttgatctctaaggcatgtctcaggtcatatatgcatgttagtact

SEQ ID NO: 98333 - DNA, 844 bp, Oryza sativa
agtgttaggatcagtacatgccacatttccgagtgttcctgcaagattggtcgatcgatcaaacatcgcgttattacaagaagcgtgtagtgtacttgaacatgagaaaattcatcaggtgcaaagttagatcacttgctatgaacaaaaagctactactagtattttgctgtgcttcaaatgtggtatctacatgttcgtttagactcaaaaaacaaatctgcttcacatggattcgtgttaattctcgtcttgtagtttttcatgtttgcgtgtgaaattgcacagagagtttgcatgggccgggaagaacagaagatagctgatggtgatcctgaggatgatgagccatgatccgcctcgagattcgctttcgtccatgatgtgccctgctgctctgcaagtggccaatatcaattcccctaaaaaaaatgtgggcaatatgaaatcacggtcacaaacagagcctgtaattaacaaaaaaaacttgtaatgctaagcttacaaaaataagattttataaattgtaatgctgggcagggcagacagccggggcccacatgaggaacaaaatcggacagtacttgtactgtagtttcatggtagcagggagtacacataggggtacatggttagggacgcttgtgatgatggagaggcgacatttaattccaagctcacatgcttagcttagcctgattgatcacacttttgtttgtatcaggcggtgaatttttttcttttgttatcctttgattctgcttacctagtctgtgtttagttcagtgcaaagtttagattttgattgaaattggaaatgatgtgactgaaaagttatgtgtac

SEQ ID NO: 98334 - DNA, 742 bp, Oryza sativa
attgagaggttttatatatgttcaaaaaaatatctgaaaatataagaattttacgctaaaaaagatagtatctgaagagatatctaaggtattagagtcagcaaaattagcattagaaaatctggtattataccttccttaagatgataaatttatctgtcattcataaaacataagtatttgtaggcgatatgattatgggggaagatatataggcggatagatttctcagatcacataaattaagttaatcgttagacttattagagtcagtcagtcagcaccgtttccaccgtgtttgcaagatcacagagaatcggatgaaaaacgatctacaggagcgtggaaagttcataaatataaatatcgacctgtccacatggtcttgccccagtcatatttgatttttcggtatacgtacagctttttttgaaaactgtatacgtacagcttcgatcttttattctcctcgaatgcgcgtaggccagcgtgtagctacttctatatgttacgtactaacctgttataagacgttttaactttgattaaaatcaatctgttttaagtttgactaattttatagacaaatatagtaatatttataatactaaattatttttatcaaatcaataattgaatatattttcataataaatttgttttgggttaaaaatgttactactttttttctacaaacttggtcaaacttaaaaaagtttaactttaaccaaagtcaaaacgt

SEQ ID NO: 98335 - DNA, 569 bp, Oryza sativa
gagaccttttcctaatttcgtccaatcctggatcttggcacctaaccttgataagtatgcttgcttgcattaataagggcttctctgctctgggtttattttcttgttatttggccaatgccctttattcttgacatgggacaaattgaagaacaacacaagaaatcttcaccttaaccaactacttcatattctccctctttttttgtcacatccagtcacattaaaatctcatcctcaattttatactggttcaatctgaatattcttagtcaaagcagagcaaactagtatctcaaatgaatcttgaattttctttttttaatcttggaaggttagctgaggtgccagtgtgtttcttatcgattaattatttgatctagacgagctgacaaaatagactttccacttcaaatcgctctcattacgtttctgaatttttttttgtgtggccacaaacaaaataacataatatttattcggacgttaagaaggacatgtatggacccaaggaagctttttttaacgatgacgtcaggaaacacctcggacactgaggtcttaatttc

SEQ ID NO: 98336 - DNA, 570 bp, Oryza sativa
ctctctaataaaatggcttattagaaaatatggacaacctatacgactttttcaatattgttaccactagattatttttggatgattttcttaagtttggggttagacttgtttgatgtacagggcaaaaaccgcgattcaaatctgggccggatcactagtatagattgcggcccagactgcatatggacttaaaaatccttccaaaaaaaaaaaaaacagcacgagctgcgctatcttggtttggttcaaacagcacgatgattttagtggctttgttggcgcgagttgggtggtttcccgcgctcgtagcgtggcaatgttgcagcgtgacgagtcaaccaaaaatagcttgggggtctcgaatcgtaccgcactttagccgcaaacggccgaccgactcgactcctccctccatttcgactcggggctccggccggcctcttcttcttccggtgagccaccgacaattcgattcttacatttcgtgatcgatcgattgatttcgtgttgtaatcttgcgtgatcgatcatggtgtgtcaattaatggcaagggcgtggtcatggag

SEQ ID NO: 98337 - DNA, 1099 bp, Oryza sativa
ggtatgcaaaatatatacataatcgcatctctaatttttttctagttatttccgtatagaactgttatccaacactatatggactcaagattgaatacgagaaaatatatagtatccaaatctccttttcttttttagttcatatattcagttattcacacttcaggaagaaaaaggtttgcgataaaacgtacatctattaaacttgttacttttactcagtaaatagtctactacaccaatttactccgtaccaacaattaaattataaaatcatccatatagtgataaaaggatactctgacatagaaatttatcatattgagcggtgctagcattacttcctcaaacaaaaaaaacaatcctgagtactttcgtagtatcaatcaatttatcaatgacacagtgattcgtgtatcttctgtataatgagtttgtaccttaaagcttcactaatttatcaatctggaaatttaggggattcgcaaaaaaaaaaatgcatactttctcaaactatcctgcattttgcttctaattttgctccctacaaaagtttcaaaaactcttcggtatagccatcagtgatagtttgagaatttagcattagctacaaattttcacacaagaaaagatctgacaacatttcattgacgcatgggtagctccaatcacaattgaggatgaggaactacatcaactttggtagtttggttgcctcttcccatctgcttgttctttaagagaacctctcttctcttccgcatgagatatgtcaattaaaaactcattcagcttaagctgcgtcctccacaactaataaaccccatgggggaggttcagttaatgaaaactctatattcttgttaaaacccccacaacatggctttgcagactgcgattccatttccgacctgcaagtctaccaataaaaaagaaaaaaaacagggttttccatcaggggggcatccacgcaagtgttcatcatctatactactattaaaagaaagtagtggtggtgctgagtcttcaaccatcactgacatgtgggacaagatattgggatttgggtgagtatagtcgaactgcagctctttaattt

SEQ ID NO: 98338 - DNA, 752 bp, Oryza sativa
tttctttccagatcctttggttcctgcatgatctgtttgattcacagcaaaaactttttccatgaaagtgatcgaattcgatttgcatctgtcacgtactgaaactctctctctctctctctctctctctccatctgtccattgacagaagagcccatcaaggcgactattgctcgatttgattggcttcattgtcgcgatgtttaggcaaaattttgacaggtttggccgaataaacagcatgcaagatcgagttaatgataatggccaaaattacgggagaaggattttggtggccatgggccttaccaatattcttaccagaaaaaagtttaccgggggttgccttacttaattgcaagtcaactgataactaaccaattgttgggttaccggcttactgcggcacaacaccggcatcatatcatatcactgatcgtctgaatcgcaacagtgaaaattaagctaactttctaaagataaaaattcagcctaatttctaagccttcctattcgaatatccacaaattattatcattctgagcaacgacgtgaggaggaagaagaagattaaagagagtaattaatccacccatggacagggagatcgatcgccggccattactgcacgtacacacacgcacgacgtgatggccgagcaaaattaaagattaataaagaaaaaacctttcgatctcttacggaggagacttggagcaccactcgatcgatctcagctgcaattaaaatca

SEQ ID NO: 98339 - DNA, 1387 bp, Oryza sativa
tttttaaaaaaaaactcatcatttaactgtttaaaaaacgtacacgtggaaaacaagggaatagaagttgaaacctacgtccgaacgcaccctagctagcttccatcttatgatctcacattcggaataaaaaaattaagatcttttattatagtatggcattgtgagatcatctccacatgcatatgtgattagaagttgataaaaaaacatttttaaaaaaaaatattgaccacctttcgtagcaatgaaaaagcattggccgaaaatgaaattagggtgtcctggtttagcttgagctcccctttaccatccatccaaaaggtttgacaaagacgaccaaacaaactgaaagaaagctaaagattaagaatctaattaagcttgctttgtttgtgtgtgaaaggggaggcgtttaaaaattagggcagggagaaaaaaaaaagaagtatgagaaacgttgttcagctggcaagtcaaccaaaccgaccacctgttaggctctaaaacaatactaacttgacaattaaaggatctaatatttttcttatttttgttttcggaaataatattggaatatattattttgccggctaaaaatacttctccgggtcaacgtgttgaaattgcataaaaaaacaagttttaagaaataacatacattttctaaccgtttagatttcctcgctggtttaattgactcacataaaaaacaaacagaataaaagtagtgcaaaaaccatttgggtagaaaagtgatttatattcaaaaatcccaaaacaatcggtatatgtatctccaaaaatctattagtagtaattaatcagattgtactagtaggagtgttattaattttgtcgcgactcacgaggcaaatcatgggggcgcattacttaccactgacaggtggcccccaccggacgcggccaatcaggagaaacccatgacgcgctcgagtgtaccacgtccgcaccttttgttagactgatgtgtgggcccccatccagctcagcatctgatgggccgccaccagcctgagctggcgcacacaaaaggcacaccctgttttactacacgaactcatagtgtctgccttcccgtgtccaatttcaaataaaaatgatttttctaaatttcattatatatatatatatatatccattccttaggtccctcaaacaattcacacagtcacactttacaaaactataatcccttcattcgaaaataaatacaactttcaaaccaaaccacatatgccaatacattaaaaaagagactatactaccctattttatcaaacctcaatataattatttttctcttttatctatactcatttaaaaaacattagtggtgctggcagtgaatctgtcaccgctatcc

SEQ ID NO: 98340 - DNA, 629 bp, Oryza sativa
acttgtatttctaccaatataaacatcaccctgtctattgatctcggtggatttcagaagatggtttgttcgttctgcgcaacgcatcccaagcgaaacttttcgcaaaaacaaaacaaaaaaaccaacggagaaaacaagttttgaaatcatttgtgtattgtgtggccagttactaatgaagcacctccagtaagaggaaggggctatcagcgaaactgccagcatcgatctcggcctcccatgaatcagaagaacagctaagcgagttaatccgggattatgaaggccatcaacccagcaaaaacaccattgcacaaacgcaaacaaacaaacatagatctcgcgggagagaagtaaaaaaaaagaaaatgttccaaaatcaccctgccacccagcatcacgaggagacgacatggatggagctcgtcggatgaatctgaagcacaaggattcatctacgcccgcaacggaaccgacgcggcaccagcaataaatccacccggttctctcaaaggcgatcaagaacacaccaccaaaatcacaaattcaaaaactagaaaatcaaaatcaccaaaatcactaagatgcgagagaatcaagtagatgaagataggagaaactagagg

SEQ ID NO: 98341 - DNA, 545 bp, Oryza sativa
tttgccccaaaccgtgagccatatatatgggtatatacagcggcccccaaattacggcctttgcttaacctgatcgcgacccaaaattttttatccttgtgcagtacttctggggggaaagatgttgcaacttgcaagcctaaagaacagtattttatgcggttgagtctgggagaattaacgacttggtcggtttgttaatgggtggacatttgaatattgctttaattagcttacccacaagaaagttagagagagataccagctactcctacataggagtactatagttatcgtaccatccaagaattaatcaaagaggagatcgacagcaactgtactaacctggtgttgtttattttgatgattatgggttagctatgaccatcatatagttagaccatactacaggaggataaggaagaatctgcagggtgctacgcccagacagatacaaataattaagggagctaaggtaaagctaaaataagctaggcaaagctcacatgccaaagccacacgtgcaggcacgcccaggatctcga

SEQ ID NO: 98342 - DNA, 708 bp, Oryza sativa
ataaaacatgaatagtactatatatgtgagtaaatatattcaaatttttcacaaattttttaaataagacgaacggtcaaacgctggacacggatatccatgactatacttatatatattgggacagaggtagtaatttttatctacatatctagaggattcaaacaccagccgttcaaagtcgacgacgggccttaggtccaccaatcatatactcctagagcctttgacaccacaggcagttcctacgtataggtatagtagcgtaccatgctagcccccatggcctcccatcttggctacatgatgcttacacggcgtcaaaccgatcgagcttgccatgcaccccccggcaggcaacacgccgtgcgctagcttagagagggatcgatggacagcatgggcagcagccaagtccccatcctgtcaaacgtggtgtacgccatctacggatttgagagtttactcgctgcataaaaacaaaaacagtacgccgtacgtacgtactctaggccgggtcgtacagagcgcacgcagccaagccaatgcagcagataaccacgaacaaacctggcaaaataaagcatctcccaacccaaaccgggagaccagaccagggaggagtcgtgcacattggctttcgtcccaattatagccaactccgtcgcttttaagtaaagcagtaattggtactgtgcagaggcacag

SEQ ID NO: 98343 - DNA, 730 bp, Oryza sativa
aatatcactctgcattgtcaaatttatttttgaaaattttcacagccattcattcatatttaatttaagaaaaaagaggtatatgagggacatgcactcaagtgactaaaatccattttatatccaatagtaaaattcattgacatggtcatactgattaatatgatcattgccaggacactcggatttgacgttgtacatacatgatgcgcttccaaaattaagttacatcgaaatgatgatctcaaccaaataatttttcttatcctaacatgggtggttccttatagaagtgctatttattcgacgagggtgaccgattaacgtagggttgggttgacatttatatttggggctttattttccattcaaccatggacctttctggaaaggattcagaattgattgtagttttgataattacagttcaaccatacggtatataaatgaaaagaagtcaaagcaaaactgaaccacaaaagtcaatcaactaaaaaaatgtccagagtgatatgcagttaggatatcacttgaacaaccagatggggagcatggcaagtttgttttttctttttcgagggaatggcagtttgttgctgcaaaatatttttcaatttagaaatactgaacccctgttggatcctagtccttactgttactgtaacagtaatattttagagttttaaatttttttaaagcaataataaaagtaccaagtgtactcatgcgt

SEQ ID NO: 98344 - DNA, 505 bp, Oryza sativa
gaacctgaactcatcttgggccccatgtttgtggtagaggattatatttcattgcggttttctcccttggccttcagaatttcttcttaaagtcttgaatttcaacggcctttctttgtttcacttgaaccccaattccttagcatttcttagcatcttctctcatcttttagaggcctacattggggtagtgccctttcttgacctcttttgcttctattacgaattgcgtttgatggaatccaacagggtgtctggatgcatcggattccgacttcggaatggcctgaagtcgcgttatatccccttccagtgcccttcttattgtagcaagtggcggacgagatggttctatctctagatagaaaactcggaacccgtccttgttgtccctaaggatcagccagaagaaatcccagagtggaccgcaaaacaagccctgactccctccctccaatctttcatcgacatcattgatgatctccgaaaacggcggttgtcgggg

SEQ ID NO: 98345 - DNA, 630 bp, Oryza sativa
ttaccctaactcatgtgttattgtgtgtcagatactacttccttttacttctccgcgctcgctacctttgttttcaaacttacaactgcgttgaaattccactgcctttttctttcgaacttactgctgcgctgaaattccactgctattttatttcaaacttgctactgcgctgaaaacctgaaattcaccacattttgaccccccataatacgcttaacaattccggcattattactacctgcatttttttttcgcagcagcatttcgttcaactgcatcaaaatgtacatggacggatatttgtataacactcagaaaaaaaaaatccattcccatgccactttactcgcgcctcgtgagatgactaatacagattacaaaatgagagatgactaacaaacgttgattaccattcactagcaaagcaggagcaacggcataagtcccatacagccaggttcagagtcaaaaaaaaaaatcacaagaacagtagtacagtcggccggccagccagcggcgcgtcgatgggatcccggcgaccggccgccgccacgcttcgatggggagcccagcgcccggccgcgcgtcgatggggagccgggcgcttggcagcgcgtcggggactgg

SEQ ID NO: 98346 - DNA, 514 bp, Oryza sativa
aactattttaaatttcaaaaatggactaatatgattttttaaagcaattttcatatagaatttttttttgtaaaatacacaccggatagtagtttgggaagcgtgcgcacggaaaacgagtcacaatctcccccaatctctttgaaagaacgcatacttagtattagtagcatcttacggacttatctattggggtgacagaaaagacatttaaaattgtgaagtgtaaatgatctacgaaatagtggtttaggctatcctgatttggcatactagaaaagcaaaactgcaactgctacgatgctgacataatgattaagattgcaataattcattaaacaaacaatccgtgccgagaaggatgaactcatgcatactgagatgttcatcaaccaatcgcccaaattatgtcttcagcaagtacagcgtcacttgctctctgtccaaattatcatacaaactcatccatctcgtcggggatccgcgatctacatttggtaaccgcggcttgtga

SEQ ID NO: 98347 - DNA, 607 bp, Oryza sativa
actatagggcgaattcgagctcggtacccttaaattgcaaatggttttcaagaattgaaattcgaaacagtcaaatttgaccaaaagttggccagaactgtcgtaccgcccggggtagagatcccggatctcaataacaaaaggggaaccctggtcacactcgtctcggacatgggccctggttagttctaaagttttttttttacgaacttacaagcttttatcgtatcaaacctttcatatacacataacttttctatccatcgtacgaatcccaaccaaattttcaaacttgagtgcggactaaacacgggcatgatcatacatcttgatgtagaaactagatttatcttcattatcaaaagagatctccgcaatattcattatactatcctcatgcagtactgctgacataatgtggtcaatgaaaagcaaagtgctgctgtcacataatctcgtgagaactgaaagatctgaaaatctgtaatacgtgcgttcttcgagccgtcgccatggagaaagggtactattagaagtcgtagcttggctaggcctttcttggcgagacaattagcggtgcaatggcttctatggatagcaacatctg

SEQ ID NO: 98348 - DNA, 611 bp, Oryza sativa
gcctccataaagagggcctatgacacacctgtcatgggacttcaagtttcattctcaaattttggtgttccttcccttcctgccttcttcaagcaactggagaaaaagagagcaagttgaccacacagtgtcacataccaaaatggagatagcattgatctttctgttgagaaaactctaaaatacacaagtactagttggggagctccatagaatattaaatgctatacaattcaagacgatcattagacacatattcttaagcaccaatcatcaaaatctggcattaaattttcatcggatataaactgaggccaaccacagattgacagaataaaaaatgcacgataaccagcttttaccgttgtcaatgatgcagaactgtcccactgatttagaaatagtaccatattagtaaaatagactaacaggctctgcattatttcttatgcatgtacattgcagtacaccacagcccaatgcatctcgtcctcccatgcgtacaacatgtgccaatgaactgtgcaactcatattacgccatagcatacactataaaatatcatgtaaagcatgtcatatacctgaggaatggtgcgcttcaatgtcctg

SEQ ID NO: 98349 - DNA, 1002 bp, Oryza sativa
  unsure (1)..(1002): unsure at all n locations
tagaggatccccgtacgaaagggcccagcccattgctctgtcgggctctcggcccatgatactcctaatttctctctgggtccccgcttcgataaggcccatataaagccttgaatagaagaatcgagcccatggacacacggctccggctcgtcacgcccaatcgcattcgcatcgtgattattctctctcttcctggtcacactcacgccaccgccacggtctaagattccaccggcatctttgcccttgataacaccgaaagttttcccggtttccgcagagccgagccgagccgcgccgtgggcgtttccgccgccgaagctttggtcatgcagcgcgaggagattggcggcaaaaccgcatccaaccgtccatgtccccggggacggagctcctttaacgtaaagtgaaagagccccacttttctctaagggtctgtttggtacagttccaactcctaaatataattttaagagttaaatttagagtggagttgggactgtaccaaaccgacccatagagaaaaggggggctccttcactttacgttaggggggccccggccccggggacatggacggatggatgcggttntcctgattactcattgtacccacttattatttactcccctaactatatctttcttccttttttacactcctacccccttctctattttacctggattctaaacaaaaaaacttctagctagttgccatactcctgacgtcatcccctaaattcaatcttatctggggcgttgactattacctttcgacagtatgagggttcgatctaagctatcattgaagcaaaggtagcaagggacgtatcggtcttcccctgcatacttaagtatctaacttaagctttcgtccgttctctaagtatcctaaacaacccaacgcaccataggatcggcaaacttattctttctgcgcgaaatctaccgtaccgtaaatagtccacacatacctttatgttctcgctccctaca

SEQ ID NO: 98350 - DNA, 739 bp, Oryza sativa
  unsure (1)..(739): unsure at all n locations
tcccttacatgccaacgggggacacggtgttgaacacatcagcatggggacttcatttcactccgcgtgcgccagagcagggccacacaccgcacacatgtaagtcattttaaacaataacacgctttagtttctaattatatgtatcgttgcccgggttaaaaaaaagcctttaaaccgggccccaattaatatntttttggtttctccctcttgtgcaaacagacgatgagtacggttcggcgtcgacgcatcacggaatgcctgcttactcccctcgcacagcattcattgaggacttcttttccactgatcctccccagggagaagtagggatggattactggcacgcagcacctcaggtcacacagccgacgcaggagacggaggccggtcaggggccagacgtgacaccacagcagcagctagagataggcacccccctgataatttgacatatcctactgagcagattaggcgtaggaagaagggaggacctagcaagcgtgcgaagggcactgatcgtccttgacttattaataatttttggggatttttaaaaaaaaaccttttttattttctctcctcccttcatgttctggtcgtactatttgagaaacactttacgattaacttagtactatcagtactatttcataaacttcttcggataannaccnnngggggnccccnnccgnnnnaancannccnnnnnntcattcagatatgaggatgatga

SEQ ID NO: 98351 - DNA, 569 bp, Oryza sativa
  unsure (1)..(569): unsure at all n locations
cacaattattcatcattgttttcatcctgagaaaactaacgagtgaaagaaccttaaacatgtgtcctctcggctctcggccacagcaggaggcatatatgtatgaagcaaaaacatactagtcaataggcattaatcgataagcaataacgcaatcaacagtacggtagaggacatgcgcatggtaagaacgcaatcaaattaggccaagttttagttccaaaatttttcttcaaacttctaacttttccatcacatcaaaactttcctacacacacgaacttgcaacttttccgtcacattgttccaatttcaaccaaactttcaattttagcgtgaactaaacacacccttaaccaaatgatgtaaatactctacaggaaggaatgcccacaatccagcagtacggaatgccacaaccaaattcacacatagccacaaatcaaaaatcaaataaaatctagccaccaagcaagcacacgaccaaaaatatacatcgtgtacgatcctatccgtgctccctcacctaaccggncaatcccccccaagccctagttttcccacacgga

SEQ ID NO: 98352 - DNA, 1126 bp, Oryza sativa
atatctcccctccttctccaacttttcatgaaaaacatcaacaacattttaaccttgatcctccctcatttataccaccttggcagcttcggctagcaaagacaaaggaaaatgagatatatccatgtactctatcttttctccctttgtctccttccaacaagtatgcccatcaccctccattcccaccaccgccaccaccaccacatgttctttgcactcaaaataattcacgcacccaaatctccgaatatgaacaaggaagagttgaaggtccttgcccctctagttcttatggacaaagtattctcaactcacatgatgtttctctaagtttaccacaaaaaggtataaacacattagagttctccaaagtagcctttaattttacaaataccagagaagcatgcataccaaatatacaatatagtaaggatattcgaactaacagtgaagatacaaaactttctgtgatggtatcaaattctttatcttcgaaaatacctcaacatggcacaccaccaccaccaccaccaccaccaccacgtgcatcacagtgtaaaataaagttgtcaattctagacaaggatagtgattcaataccactaatacattcaaagtcttcagattatccacacaatgaactagcaatgtcagtagaacaacaatatccctctcttcgaagacatgaagaatgtgaggtgtcatcaacccaaacagtcattgagttatcttcattgagatattctgaatatacatatcaacatatatccatgaatattgaatataagactccaattctctctccctcggtatctacatcgttgcatgcagattcctcatgtattgctataacaaatggtccttcaagttcaaattatgtcgaggaagtaccaatggaaacaattttgaatcaaccaacattatccattcctttggaagcatgcaaggatgagctattgcattgtaaagaaaatggaggcattccaattccaccacctccacctcctctttgtggtaagtgtgtacaaatttcaacagaaaaattccttgtggggtgtgaaatgttttaaaaaacatcaatgatacctcaatcaccaccctcacccccaccctcaataccatt

SEQ ID NO: 98353 - DNA, 595 bp, Oryza sativa
ttaacgacatcaccttgttccttttatgaagatcatgcaaaaaaatatactagaattcctctaccaccaccacccccagaaggtagccacggaattttagctacaacttctactgaattgattgatgctggtcctcaattgccaccattatctcatcttgaatggaaacggtgtccacatcatcctccagaaaggccacattatcttccaggagaagttggaggagctccatcgccaccatcaccacctccccctcagagagaaaatacatcagtaggaattcaaggtggcattccacctctgccaccacctctgtcaccaactctgggagattatggagtggctccacctcctcctagcattggtgcaggggcttcaccaccttctcctccacctggaggaatcacaggagttcctcctccacctcctattggagggctaggtgggcatcaagctccaccagcacctcctttacctgaaggaatcggaggagatcctcctccacctcctgttggagggctaggaaggccttcagattcaccaccttcagctggatttcgaggtggaactccacctaccaatgcacatagagggg

SEQ ID NO: 98354 - DNA, 560 bp, Oryza sativa
ttctctcaatgaaatgattggatggtaaaagcaatgtattaatgatgaaatttttttggatcccctattacatagccctaaagttttgtgtgagccttcttgggccgcaacacctactagcccttttgttgaagacgagccccattgggcgaaccccttctgcttcgcgccatggcttcacccaacagagagacttgatgacgaaccttatggcttccattcttcgacttcgccttacagcttcatcctatggcttcacctacaagcgaccccttgtgattttagtcggcgctttgctaatctggtggtttcggcagatttggtcgaaggccctcgtgatatgccttcagcaagcccctcatgggcaagagcgagtagggagcttttggcgagaccgtgcaaatatgtggtatggcatgaggtgccccctttcggccgatgtttctgccaaaacctatgtacacctggagaagctaacccttgttatttcatgagttctcttaaacgttttcatgtgtgtttttcgaccttctatcctttttcagacgtgagttatgtca

SEQ ID NO: 98355 - DNA, 645 bp, Oryza sativa
atgtacattagctcatcataaattattaagaactactctctctctcgtcgttatatatggaaattttgtgggtccaagactagtcaatgtggtcatcgagctaagaaattaagatctatggtgcaaaatgtgcctcatatctttagaagtgattaaatggttgattaatcatcatccagtaaagtccctgaaacatgcaataagggacggttaaaggtatgtttgtgctactttatattccattcactactacagaaccaccctttttaccagataaccggtcaaagtgatccgtctcagataacatgagctctaacatgtaaaaaaaaaataccattcgagatatgacaaaagggaactacctgtatatgatgtcatctatgatgagtcaaaattataaaccgtcaaagatcatatatgatgaccccacatatatggcaggtccaatcatatggcccaccagacataataaagacataagtgcgatttataaataacaatcgcttaaaatgagttataatctattatggctctttcttttaacctatcatggaggacatactacgtcatacgctcctaccacgtgttgacgtcatcggctctctttatttctcgcttgctatcccctctctttaaattatctct

SEQ ID NO: 98356 - DNA, 503 bp, Oryza sativa
tctacacagaagtggtaatggagaggaggcgatgcagctaggaagagttgaaagcgagctcggcgttttgaggatggcgacacgtcgtgtacacgtgtcagccacgcccagaacgcctctcctccctctctcacgcctgctggtcggttaaaggagttggacggggagagggcaagcccaagtggctgccaagcgggcccaggtcgtggtaaactaggtggaagagagaggtgtgggtagaaacatgggtgagtttggtttttggacgaatttccggaattattttcctcctctaactttgtagcttcgtaacttaatgtgtgataacttaatgtgtggaccacattaactagtgttgattttactggaggtagatgattatacctagattccatttttatttttggttgggtttgtggcacttaaaaattatggatagattactcacagaaattaggagaagaggggctctttggaaactagtttggatttttaggagacct

SEQ ID NO: 98357 - DNA, 1206 bp, Oryza sativa
agaggagaccggatttggaggggaaatcgacggcaatggcggcatcgggctctgtctccagccggctggaggttgaagatgccactgcagcgataggaaggaaaagtagacttccggctgggcttctacttcttggcccgattgaaagagggacacaaagcagacttcgacagagagagggagaggggctacaggcagagaggagattgggccaagaaagagagaggacttttcctgttgcggcccgaaaaaggaaaagaggaattttaattacttttccaattaaattaatcactgaaatgatctttgaattgttaaaaatacttccaatactcaaataatttcaagaaaaatcattaaaatacttggacactcaaagtacttaacaagattataatcaaaccatttaatgattaatttaatatgtggataattactgaaatgttgtttgtattattaaaattaggaattgagctccgaaaaatccgagaaaattccagagagtataattaaccatggagaatttactaaaaattaaatccatccatgctttatatttaggaaattttatttcccacatttaacttcacttgtaaattaatgatcatttaatataaattctaataataatttattaaataatttataaatcctgaaacgaaaatcaggatgtgacactccctatcttcaaagcagacaagcatatcttgtacaatcccaaatccttcaataatatttccgttcgggtgcttgaagaatttgtttgtcggggttactgccttattgctcagataagcgaatgcaaatgactcagagatgagattaaccccgacagttggactgtaaagaataccaacggcgttcccctccggatggcaaggaatgattcggggagcggtatttatccgaattacttcggatgaaagctctacctcccttagccattcgtcgctcattatggatgttaactcccgaacagtttcccttaggaacccaagttccataggatcaggaggcggcaaggggacgagtggtttctttttactgaaatagttcagggtgttgccataatcttcgtcaaaaccgtccttgaacaaaattgcggcacgatccgagtttgaatttcttcattctcaatggatggctactcgagaactttctcatcaatcgagtcagcggaagtggaaggctcatattgtgactcga

SEQ ID NO: 98358 - DNA, 724 bp, Oryza sativa
acagggtatgttgtatagcgttggattaatattgtttaattattactgaactgttttattaaattctgaaatatttattaaatgctgtttatgcaaatgaaaccctattatgccatcctttgctatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggggtggagccgtctgcgccgtttatttttttttccgctgcttagatctttaatgattgagaggaactatctacctctgtaatgacattttgttcgcttattaactagagtaataattgtactctattatcaatttgttattgtgtgcctcggctgattcctggacgagggttcacacacatgtaagtgtttggaattttggatggaaattccgggcgtgaaaagttggtatcagagcccctttgaccctaggttatgccaaatggttacccatagaagccctctaaaaatattggaaaagtagaactgttctcctctccttctcttttaattaaaccaaactaatggcacatgcatttcctaatatttttttagtggttcccgttcaaaatttattttagcgttgttagtactgtacatctactactgtactaatggcacatttaccagcaaaagttcta

SEQ ID NO: 98359 - DNA, 534 bp, Oryza sativa
tacagagatcaccagatcacagacaacaagatgtaaagggcagacctaaccgagtagtaccatagcaaagcaaagaactcagcaacactaaactcctgaacttctttattccaaacgtcttgcatagattctccacccaaatcgggaactgaagacttcacttgccacttgtcttgccagcttggctcccaacattaagcttctttgtcttgcctccgatttctgcaagttagcccaattttcaataaaatgacatgtaagatatatcagctcaattggatcattgggccattttttatcaaaacacactttgtttctggacttccaaatggcccataatacagctgccaccccccaccatcacaagttgcttagagtgtttgtcaaaattagataaccattatccaaacatatggtttttatctctagcaggtgttatattcaaggcacacaacatcacattccagatcaatttagcaacagagcattcaaaaaataaatgctgtatggactcctccttatcacagaattggc

SEQ ID NO: 98360 - DNA, 2109 bp, Oryza sativa
tgagtcgaaagttttcaaatcttaactttaaagttttccaatctgaagaaagcttcaaatctagagttgaaagtttttcaaatcttgacttgaaagttttcaaatatcgagtgtaaagtttttaaatctgaatcgaaagtttttaaatctgagttgagagttttcaaaatttgtcttacaaatttaaattttgagttcaaatttttcaaagtttgagttaaaagtttttaaaatttgactccaaagttttcaaattttacttgaaagttcaatttcgagttgaaaattttaaaaaattgaatttagatttacaaaatttgagttgaaagttttaaattttatgtatggcttttaatttttcgattgaaagttttaaattttagatgaaagtttctttcacatatagatttttcttcaatctgttagtaaaaaaaactctcctcattaccgtcattatcctaaactaactcagttagttaggttaactccggaatcgcgctctggcttttcccaaactcaggttcgagagtggtgaatctaggatttagattatgggtggtccgacctaaatttttttctaaacacggtaaatctaacgatactaatatatacaatgcaagtatagataatagagtaggcatatattaataaaacatattaaaacatataaaattagtaattgagtgaaattttgacttaaagaagcttatatgaatataaaggtttgaagaatattaccatactactttttctcaacgtcttgttcttgagtgtgcttctcaactataacctagaaagaatgcaatttagaagcattcttctttgctgcatgtttttgaaaaagagatataatgtctctatctttcttcatgtttaaatttaatataacaatatagttaaattataaaaacaaaaattgaaaaagctacagaattaggagacctaaaaataaagaagccggtcaatttgttagagtatatggtagttaaagtcatattaggataggattgatttgcgtggactccatccatttatgtaatccttcgttatctccttcccatgtactcttatatatatcagccccctgagactcactacaatgtgtccaatattcgcaatatctcctctccctacactatccaacatggtatcagagcaggcgatctagtgccgctctcacgcttccgccgccgctgccctcgggagtagcgatctcctgggggcggcctccattttttattttcctctcgtcgtcaagtcgtcatcctgagagattgatctctcatgcgtttgcgtcgtcatcaagcagcagtagcagcatctccggtcgtcgttgatttgcccgtcgccccttccgcggtcggcctctaggacagtacccatcgccgatctgcggcgcgtcaccggagctcgccgcagacgtcgtccgccagtgtctccaccagatccatgccgtcgtcgatgtgtagaacttgcccaggtcgttgccgccgtcttccccgccgcctccctctggcgcgacgccaccggctccatccgcgctgcctgacggcctctaggccgactccacgccagttcgcatccgcaaccaccgctggctagcccctccacggccgctaccaccaagggccctctctgccgatctggtgggacgccctcaggtcatcacccccgtcttccccaacctaaccaagccgccgccccgacaccgtcgatgctcaactccatcatctggatggctctaccccggaaacgtcgacgctcaactccaccatgtggctgcaacgacaccctttgctccggcctctggtctccacatatttaggttgtcgatgccgtccgtcgtcaccccggggagccctctccatgctagaggacggtaccctccgcctttggtgcgccctccgcccactccatctgcgtcgcctgtctccgtgggcgcgagaatgggattgctgcagctgccggcggccgagcgccctatctggctgtcacctgtcagcctgtcaccactgcagtgcctccattcgaccctgttgactagccatccgctctgctctcgatctagtctctctgttgagatcttgtgcatgtgttggtatttcttaa

SEQ ID NO: 98361 - DNA, 3154 bp, Oryza sativa
ttttaagagcacatattcgggtaaggacaagattggtccggactacactaaattagaaaatctggaccaggctgcactaattgattcgtttttgatctgctggaaactgaagatctctactcgaagggtagtaatatgagtaactaggaagaaggcaagacagaatctgtctcgtaacttttcctaaataccgtttatgcatccaacggtagaggtgtaccattgcttcgctctctcttgaagagagaacggaaacaatttccaccgtacagtttcttgtctcatgccacgaatcttaaggcatgagcagacttgctcgaagtctcgcagattatggtagggattttctggatcaaagctagaaaaaggattctccctaaccatgctaattagttcggggcgaatttcatagcgagttgtataaattggctccgatgaaggaggtggctcatagaattcacccctaggagcagacagctcgaagagaggttgatctatagttgagaagagtttgacaggaatacttctctgggtagcaggggtaaaggtagaataaaaagtaaaaaagagatacgaggatgaactgggttcagaaatgatcagcaaccgttccccggcaacggcgtcagaaatgctgttggtaattcttacggtcacaaataaaatctccaagcgcacggatataccgatgtagcacttcccctacaaagtattccaaagggtatcgaatccaagggaacgtgtgtggtcagatcttcctccggttcatccaaggacaccaaataaaggataggccaggatagagaggatttactagtgagaaacagtgtctagggaaagcttaagtttaatcctaacacaatacttcaggcactggcaacccggacaggaaggacttaagtgatctcatactgtgggatacgcaacaattattggataacaattacttaaacaccatgtctaagcaattaatatctactttaatgtttataactcaccaaagcaatcactatattttagttgattatagtgaataataatcccgtaagctatttaggaactaaccaagagataattctcacaagataaatctaaattactcaggaagaatattatattgaaatcagagtaataaacagaataaaagaaatgagagaagattaccgacaactccggaattcttccgacgtcttctactctactctcttcctattctagtatacaatatagtacaagagagcctcttataattcagctcaagcttggatgtgtgtgtgtgaagtgagggagtgaagtctatttatagggcagttatgacggttgcgagaaggggaaatgtccgaactgccgcacaactgtcatcaggagagcatctagagcatccacgccaaaccccaggatcaacggtgatcagagggttttggccgaaccagggggttcggccgaacctgggctgggccctcccggcctagccttcggcctgtggactctcgtgactctcctctgtccattttcagaattttgggatgagtctttgatattctgatggcgttcacaacccatccttgtatgaatacatgtttctcctcactttagtctagatttcctcccaacttcgggttcatcacctgcatacaaatatacaccaacacttgtggaatatgtgagatttaacacctatcactatgttggatgttttattatctagactttatgcagatgttggcggtatagaatcggcatttagcagccaccaacagtagggtagtaggggattggagcacaatctactatgttggtgatatcaggagaaaaatgcaactaaaaagcctaaggtggtgacaaacagtgatttggaaaaaatcaagttctacattattagtggactagagtaagaatgctaaggagttgacgctagaaaacgagtcccaagagctagaaatacctttgagtgaaccttttcggtcataaccagaacctatagagatgacatatgatgaggtcgatagaatagagaagtgtgagattcccacatattataatattgagaggctaaggtagggtgaaggcaaataagaggaatataattttcaagaggtgttacacaagaaaaagagcaagcccagaaaagctaaaccgacagtgacctcaaggacgagtctgagcctgagagaattggcagttgtcccagtgccaaagagagctaaatgttgactgagaggaggaacttggagtcatcagctacgttttctaatccttttgccatttttcaaattatgaatgttgatgaattgaataacatcgatgttgttttacttaaatatcccttgtacattggctgttgatggttggcggagagtcaacataatgtggtgatgtacaatgtgaaaccctcgtaagtggcaatgttgatgtttgtagaccggcattatacgaggtgactctcttatggcacttaaatctattctgccaacggttgacggttgagcgtgaccgaacaaccacgggatttgaggcatgcgagcctggcggttgacacagaggaaaaggtgatgggcattcgcgccagagcggctacaacaggcagaccttgggcagcaggaaggaggacaacaagagagtggcaggctgtgctgagctgataagctgggcaagttcagccaagggacaagaggaagtaaactaagagatggggaaagatgggttggtgctgcgtggcagggggaatgagagtggaaggcagaatgggccagctgggtgagaaggaaaaagaatgggcgcccatgaagcatagtaaactttgttattttccctgagaatgacttgttagaatagtagagtatgagcatttaaatttaaatttaaatttgatatttgacctaagataaatgagagggattcaaggaatgcttctttgagtggatgtcctgatatgttttggaatgaattttgtatttggtttggatggaattggtggagagattatctcttcagacttgaaagttggttgaggttgaaaccaaacactactagaaaaagcattttcccaagcggtcaaaattgatttttgcaggcggaggtttggaccgcctgtagccaaacgactgcgaaaatccattcaaaaaaacaaaaaaaaaaaatcacgggcggccgc

SEQ ID NO: 98362 - DNA, 878 bp, Oryza sativa
attttgatcttaattttaaatcttaaatcttctcggcattacactttaacctaaccaaaatatttaagttggtatatgaacaattggtaaaagcaggttttacactattgaatccttaatagtaacaaaataaaaatggttgcatgtgcataaatactaaataacaccctaagctgctagtaattttagtttgaatttaacacttcagatgatacctcaaataattcctacaactcagctagaaatctggaaaacaacatataacttagcctattttgcatcttcaccaaaatttaacgataagtcatctagcaaaaccacttggtcagaatgttaactataatgtactctaacaccggtgcaattcttaataaaattcgaaatgtaaccacatgaaatgagagtcaaaagttacttaaacagtatcttgactgcagcaataaattaactagtaaacttaatttactaaattacaatagtactccctccattccaaattgatctacaatttcttagatacaccaagaccaagaaaagctaataactctttcatactatatttactctagcaacaaactctaagcatgcaccatccccactatttcctagctaatagtaaatcaagattttgcatgtgggttataaatacttgtgtgcatggatgtatgcatcaatgtccatttactctaatgcacaaataacgaatagacttaatgaatgaacacaaatatgtagatcatttaggaataaccttaaaaaaactatatgtagatcaatttgaaatgaagggcgtaaaatttaaagtgatcaaaacttcaaacttggaaaattgaaccatcaaaaccttgtccaccttgaagcaaacttgtctcctccaa

SEQ ID NO: 98363 - DNA, 503 bp, Oryza sativa
ttttaatttcgaatttcagctattttaaaattgtatttctacttgggtctctttttttctttctaattttggattttattttatttttattttgaattttgattaatcttgtattgggttcttatatggaaacttctttcaatattgcttatttttaattccgaatttcagctatttttagattgtatttctacttggactctccttttctttttttttctttttctccgattaatgtgggaatttctagcctctacagcgaacgtggttccttctttcaaagctgtaatttattataaattaaattttagttgttaaaaataatatcattggatattcatttaaatttaattttatatgattatgattttgttgctacaatgaaaaatttaaagttaaagtttagtttttaagaccgtactaaatttgaacacgccttagcgagttggacggagagatgtatctctaccaatgcataagttttctggtctattttctctttt

SEQ ID NO: 98364 - DNA, 739 bp, Oryza sativa
  unsure (1)..(739): unsure at all n locations
tcctgcagccccaagtttgagtaaaccgggttaggctctggttggctgccgtagccaagtctaattgaacattgataaatacgtcattaggacattgcaaacttcttccaaaagctctttgcggctccattgttgccgagtggcagatacaatcatacaactgtatggcgcacatgggacgacggaatcattggcaaagacatcttgtagggtatattatttttgctgtaaaatatattatatttatattataatcgcataaaaacagattataatcaatacatttaaacaccaaagaacttctacaatgatattggcaaaccgcagaaagcaaatgcgtagctgtgctcgtgcacggcatgtagcacatgaatcgtaatcaccccacttgatgatgcattaaaaaagattgagcgagttagaaatgaagacaagcaatcatatacacaaagatcatatgatgatcgatacctcgtgtatgaaatattactccgtcccaaaatgtaagcatttttaagattggcacngggtatttaaagaaaaanagntnangngnntngnaagggaaanaaattggggaaatttntttgggnaananaaaaaantnggttnngngngntngaatttgttgaaaagagaaattaagtgaaaaagaatggttgtgattggttgagaggagaagataggtagaaaaatagctntattttaagacaaagtattgtgctagaaataactatat

SEQ ID NO: 98365 - DNA, 615 bp, Oryza sativa
  unsure (1)..(615): unsure at all n locations
tttatatcgaatcatattgaattgaatgaattcggatttttttggtagggtctaccctgggttcaaatcttaagtcggccactggttgttgcaagctatcgctggagttggtcagttttgaatagcttcccctaaccanaagagctgggcgtgtttacctgatatgggcaaaaggatgcaggagcagaattggtgaacggccgtccgaagcagagtcggtacaagacaagaacggggcgtgtctcttgttacacttggcgaggcgcctgtacctgtgacctcgtctgattcctattgcctgaataaataaataccttagttagctatgcttcgcttttttttttttttgactattaagggtgaccctcccaaacaccccctgatacgggaggagcatttttcaaantacgggatggtttaatgattaaagaactgaagctaaaaaaaatgagctatgatctggaaaaggagactgctgtgagcctgtgaccaacccatcaacgggtcgagactactccaactacttactccctccgtcctataaaaaaactaacatagtaccagatgtgacacatcttactattacaggccccatcgtttgcctttttccctgat

SEQ ID NO: 98366 - DNA, 528 bp, Oryza sativa
agaggggaagaggaggaggaagtggtggcaggcagaggcggatgaggaacttgcgccaacgacgtggatatggagggggcgagtgggcgcggtggaggaggagggtggaagtggaggtggaggaggcgacggcaatggggaggcggcgatggaagcgaggagatgggcaggcggcgggcagcggtggataattttttttctttttctttttcggaccttttcacctgctcggtgatttttcttttttatacggcacgacggcttctcctattcgcgacgcctcggctggaccatggaccgttggccactggagcattctaccatggtccagattttttttttcactcaactttactacttcacatctgatggctggtgttgaattcattgtgcatccaacggtcattattaaattgataacgtggcgcaatgaggtgacgaaacactttacttttttcactactttagatatgctctaattcatgacatattactctgatcctacagtaatataaataaattattaaa

SEQ ID NO: 98367 - DNA, 727 bp, Oryza sativa
  unsure (1)..(727): unsure at all n locations
tgctgggaccctnttgatggatggccggttagtgatggacctttttacatttgtctattattctcaggtaatgcactgtttcaaaataaggtctacaccattatattgtgtatccattatattaacaatttaaaatctatattaactaatttacacttacagtagaactggtggacatattattataatcattggatctattgtttgctaataaataaagcgtccgaaattctctttttgccacgttcaccgtcactgttaatatatccccatgtagaaattaaggatgaaaaatatatactttttactatctttttaaaggaattataaccctggcctctaaactacaaatgcacatcattatttgaacttggagtaaacctctagaggaaaatttgcaaaaaataaatagaccaagactcgtattggttgagctatatatcctagaaataggaatggagcaacaataaataatttgtcagaaaaaccttttgtggtttaaaaaccaatgttgaaacaaatcaggatacccccccccctacaaaatttagtactcccttcgtcctataatatatgtattttaataatttgcttacacttgttaagcactcgtcttattaaaaaaatctgggcaaatataaaaaacaaaaatttgggcttaaagtactttggataataaaagtaagtaaaaaaataataattctaaatttttttttgataagacaaa

SEQ ID NO: 98368 - DNA, 601 bp, Oryza sativa
  unsure (1)..(601): unsure at all n locations
cagcggntttgcaagctcatgaggactcttagcttatctttgttagcatgcgagctttttttaaatagattcttatacgactctgtcggtgacatgggaccggggatatcttgactagaggtttggggcagccgcggtcacccacgtggcctgaccccctcggggggggtcgggcccgagagtgatgaggctgcccctccctctatctccccgaggggtcggnncnnanaanatnnnnccaaagggcttnatacaccccaaccccccttcacaggaaggtaacgaccctactcctgttggccgaaggccggtgttattctttatttatatggatcacacaagtataataattgggataacctatctagctgtcatcgacttggcagaatagatcatcaacatgtagtcgacgacagagtagtcctcctcgtcgaatacgtacttggcgagatcagagatagcactagatctctcttgtcagcctccgcaggcaccggattgagtccatctaggctatctccaatatcgatgtttagcttgtcttgacttgtgtgttgtgtctcctctcctcctagggggcttgtatttatacccatagaag

SEQ ID NO: 98369 - DNA, 1089 bp, Oryza sativa
  unsure (1)..(1089): unsure at all n locations
gcatctttttgtaaaancccctgtttggacaccccggaccananaaagttggaanagcccatgcgatctgatctgcgaaggatctgagaacctgacaaaaaaaatggccttacaaactgcaatagatttatttcattttttgtttttgggagctgcagcatgcgttccaaaagagtggttctaatctattcttgtgtgctgttcatgttcgtacttacgtttgatagattcatacaacgcgtgaccataagaagaacagcagtagtaggtaatttttagtgaatttttatgagctccattatgacagcatatgctgtcacccgtgatttgtcctttttttctattttttttaatttaaaatcactatggctatatttttatgtttaactctttaccattcatacgttttttaggtttaactatttaccataaatatgtttttaggtttaacttatacggaagagaacatattctcttttgttttgttttccaaaattcagaacagttatactagaattcaaactactaagcctttggaaattattggtgatgatgtgcccaaccaacgtttcaatacaaaaaagagccaaaaaaaactatttatatgaggaactgttactttcagctgcacatcccaaatgcttctaagctctgcatattccctccccctcaaacacaaacacatgcaaagtttatctattcatgtgtcaatatcaaagttccgtgcctccatttaactttttttttcctgcacgataagctgtatggttgtaaaatttgacgaggttcagtgggcgggaaaagggtttaactgtcctggagtgaaaattttagttagctcctggctttatatgtctccatcactgtattagttacaccactatccctataatttattgacctagtgtatgctacaaattcacttcgaggaagcagaacaaaattgcaatgaatcctgtgctgatgttccattaagctgtattacatgcataccgtgctgtgtcaattttgttctggtgaaacatgaatcctccatagaggttaggcaaggtccatctatcctccaagggacgtcaattaaaatcacca

SEQ ID NO: 98370 - DNA, 678 bp, Oryza sativa
  unsure (1)..(678): unsure at all n locations
attttccttaganatcacgtggcttgttcatcaagatctgaacttgtccgaaagcctcgaccatttattggtggagcttgaaaaggaaggtaaaatccacacccttgtagttgaagtattgcagccatttgtatcttgacatgtgttctgcaaaaagtgctacttcctccgtttcacaatgtaagtcattctagcatttcccacattcatattgatgttaatgaatctagacatatatatccatctagattcattaatattaatatgaatgaggaaaatactataatgacttacattgtgaaacggagggagtattttattttattatgagaaatgatgaacagttatgtagctcaacatcaaagatgttaattgtttgttatattacttgtcttgaaacgagataatattggaccaggtgtaaagcacgtggtagtaagcaagaagggtaagtgctacttagttttgagtagtgcggattatacatgccctaaaagtagagcggatctgcccctactttcttccttcttttttgtgaaggtgtcatcaacctttctaaagcgattttgctatatctcactcgaaagattttttcttatctctcactcgattttctcactcaaatttacagtgcattttcttgtaagttatagtgtaatttatgaaacttacactgta

SEQ ID NO: 98371 - DNA, 543 bp, Oryza sativa
ccgtggaaataactgtggcttgaagttatagtaaacctttaccctcgtgcatggttcatgattgaagtctcaccgaacgttttgtcacaacgttatagaaatcgaccccagaacggctcagcaggaaagaggcacgtccaaatgcgcacgaccgagacagaaacaccatagttctgccaccgaacccaaacagtgcgtctgtgcgtgcagcgacaccagtgttgccaccgtatgcggaatcgcagttacctgtaccgtggaaatccttcgtgtagcctggcataggtacgtaattccagtactaggctcccatcggttgcccatttggcctaaaatggcttatttggcttattagaaatttcaaattaatttataagtaaaacttttatagatttgttcgtagcgacttaaaagccaatattaacaaaaaaaatacgttaaaagcattttaaaatcaacttcaaaatcaagttcaaaaatttaaattttggcttattttttgcttgtctaggccaaacgatggggctactagtgttcccggcc

SEQ ID NO: 98372 - DNA, 547 bp, Oryza sativa
ttatgtatctttcgttgagtttcaggtgtatgccactgcattgttttgactaactgaaaaagtcggaactgctactgaattttcaatgttcaaaaattagggtaacttgcatcattcaccgtaataacaggctgttttcgaaatgatgcacagatggaacaaaaagaaaaatatatcaagagccttcctcatttgataaatgatgaacttctatgtgcaaaacgcactcaccaagtcaacgtaacaagcatctgacataagatttagataagctcggcatctctctcttttcataattaaagtacttaaatattggaactctagaaagtgttcctaaaaaaataattttgacggtggtcaatcaactcaagtaaaaccaaaagaatgcacaagtgtgagatatataccacccaaaatggatggaacatgcgaaagaacactgacataatattgcatatttcacacaaaaaggcctagttaccttactaaactttacgtgagattctatataaaatctcgaactattaaaccgggcatcaactcccct

SEQ ID NO: 98373 - DNA, 1185 bp, Oryza sativa
  unsure (1)..(1185): unsure at all n locations
tgcctggcnnnatgagatcatatcccctggcaggnngcagcgcacgtgcttccctgaacaggtctaataagggataaaataatgtttctatgagtatcctggtcttgacgtttcaaaccaagtactccctatgtcccaaaatataagggattttggaccacagggccttctcgcttcacagcgcaaatgcttggaaacgcttgagtatcacctccccctccgacacaagctcctgcgggggatgtttcttcacgacacaatactcctattgcgaggcatgatttaagagtagtcccactgtattactagaaagcccgcagaagcaattccactagcacatgatcacagacagcctttctaactgacctactccgacactactgaaacccacctgagtgagagagagagcgtcactgagttagagacaccgatatatctatcaccccatagcctcactccttccacaactgtcactatatcgggagtacacgggagctgaaacccttatgaggtgctttgacaagcaggccctattattcggtcaccagacctagagtgagcaaccacgggaggcgacaaggcctcgctagccaggatgagaccgaacatcatgccagaacctgggagcgaaaacacaatcaattcgatgtgaatcaccgccttcatttttgggcaccgggggacagactgactggctgtcctaccacgctttataaaaagatggtgcatcaccgtcctcttttgaacccaagctacaggaaaaagttccacttagcagggccttttacctcacaaaatatattggcgcccacccaagactacccgcccaagtaaaaatgtttgggccagccaataaacaccaaatggcttgccaacgttataaagctgacacaaataaccctggtcccaaatacgaaggaatttggcaatggtagggcacccggcaaacactcgcggtgatttcccaccccttaatctttgaaagagcaaaggggtttttcccctatccccgcaaatttgggcctcgcccggggggagctccgccctcagaggcccccgcggaccctctaaccttggtgtttttaccaaaacattttttcctgtgcccaaacaaaaccaccccaccctatctccgggggcctacgaacccccaatagagtccgtgacccaaccacacttacgaag

SEQ ID NO: 98374 - DNA, 524 bp, Oryza sativa
ctcgagttaaaattcagcctatgattttttttttgagttgagatttaaaatttatccaatgatatgagttttctcgagttaaaatttagcctatgagttttttggcattgactttttttttactgagttaaaatttatcctatgagtttttgcaaaatttctcttctggcattgacaattttttttttgctgagttaaaatttatcctatgagtttttgcaaaaattcttttctttgtatttgcaaaatttctcttattttgtgcattgacatttttttcactgagttaaaacttctcccatgagtttttgcacgctcagacattgcagttttttacattgacaatttttttttgctgagttgaaattttgctatgagtttttgaactctttcaaatatggtcaatcctttcaagagctgaaaattccgttgggttttgagttgtctgggaggccttggcgagtttactttttagagtcggagagagagaagggagtcctctccaggcgcgtctatcaggcgct

SEQ ID NO: 98375 - DNA, 1001 bp, Oryza sativa
tttgtgactctgagaccctgtcttagggtctacaagtgtcagcgcgtgatccggaaggcgttggctagcgctctcgatcgcggccgcagtccagtggccggcgggacgcgcgacggcgggctggtaggtccacgcacgcccgatgcgcgcgggcgctgctgcctcgctcgctcccgctttctatcctgtttgccgtggacggggacggctcggtggcgacgagacggaaaaggcgatgcggatgacgatgccgccaagggcgcggggccgaaaccccgtccctgtccgcggggctcgcacggggggaaagccaagccggagatttgcactccgcgaaagtaaccaacgcgtcgtggaaactcatgattttataaaaaaaatatccaagcgaatttccacggtgaattttaccctacctaaaccctataacaataataaaattaatatagcatttacatgttacaatgtacgggcatttttctagtgatttaataaatttgtgctcacatggtgagaaacccgaccttttaaattcttaccaattctctctcaaaaagttcggtttcccaaacagtagtaaaccatctctgctggtggtttcttgatttaatttactccggtacccaagatagcaccaaccccattttaaaatatatataattagtatcgataccgacattggagatttatactattaccaataggaccgacaagggtaaaggtatgtcaattagaacacggtggtctccccttcattaggttcagaattcacttatttttcacattcttaaacacaaattggaaaaagacacattctctcgtggcatcaaaaactaaaaaaatattatttattttacccattttgcatagcaaatatttttttcatttaccaaacttggtacaactatttctttataaaaaaccttttatagggaggattgagaaaccgcaaaacatgtcggaaagggaaaatttttttcatattaaggggtatttttcct

SEQ ID NO: 98376 - DNA, 526 bp, Oryza sativa
ttgctttgatttgcaccttattcacgaaagatttcttgcaacattttttctctgtgagaaacaggtcaattctagctttgttcaggaatactatttttttccatagcaccaaaggcgtgccacaggcatagtatgattgtgctatttccttatcttttgagccatgatatggatgtccgtatgctctacaaacatggcgagaatcgttacccatcgcttgtgtttgtgttgcggggcattcctgcagaaattgataccagcaactaattaatggtactcctgtggagtcctggttcagtaagtgtttaactggcactcctgttaagtcctggttcagtaagtgtttaactgctaagggtatgactttaagtacacagggagattaagtgattaacaccgactagtttcagctgaggtgatggtggaggtaggatctatccaatgctgcgttcgccgcagctgtgaccatcatccggccactgccatcacgttgtcaccatcacttgcttcagccttggtcgtggcc

SEQ ID NO: 98377 - DNA, 1029 bp, Oryza sativa
atgggaaaaagaaaagaagaaagagagaaataaaaaagggaggggaggcataggtacccaggcaggtaggtgcatacctatgatgaggtgggacctcgtagtatttagtttgttctaagatcaatttaatctagcggtttataatattggacctacggatttaagtgagaatcaagtaactgatacttggtcttttttttcttagaatttctaatattggccctaatttattagagtatcacgtgcaggcttgagagcattttaaggaattttaaatgagtaattagaatattagctgcgcaatatataggtatgggacgtatggtaatattggttccaacttggtccatgtttatatatatgtagagagaaattaattttggggctaggcaagccattagatgtctaattaatagcaattaattttgacacctattgacaattgttcagagtaactcttacatattcatcttacgacttcgatgatccgttgatcaccaatttactgatcaccatgactcgcatgaaaaaaatatgtagtacttaaggtttaggatagctgaaattgatgaattatataatttatgtgatagctatttgagggtataaacgaatgaattgacttctaaaaagttataatgttgtttaaatacacgtcactgcattatcatgtgtgatctctgaactatataattgatgcttgttgctgcgcatatgtttccctgaacaggtgtaataagggataaaagaatgttcctaagagtatcctggcactgatgttccaaaacaagcagatgctaacaaacaatacactaagtttctacaatctagtatgcttcgaggtaaacaaatttctttggagagtatttacaagcaaatttgtttccaaggataaaggttgtcatatagaattaagaaacattttatggagaacttttgcaacatcagcttgctctctatatatagcccggtatcaattgttaccaagtatcaatgtaattttatccggcactacaacggcttcaaatt

SEQ ID NO: 98378 - DNA, 1008 bp, Oryza sativa
  unsure (1)..(1008): unsure at all n locations
accaccaccccanaaccgaccacggaccgaaaggaaacacgccgaaagagaaactgacccncgcagcgcacagcaggggccacaccccccagacagcaacgacaacactaaaaggcaccgcacgcggagcaccgccccccccagcagcgcgggcccantttggaatggacaaatcccttgaaacccccccctcccccgagaactccgagggaaattgcggggaacccacaggctcaaggaaaccgggtgggcaaccgctctaataacctttctataaaaagggggacaacttccttggcctaggcggaaaacggaggaacgaacctggggagaaaacaaaaccaaaacggggaggaaataggccctaaggccccggccttccggcaaaaaaagccggggtggacaaaaacaaggccccggaacaccaagcggaaaagggcaaaaaacctccggcaaggaaaagccccaaaccggtgggtcaaaaaaaagcgggtgaggtgggaggaggggaagaaaaaaccggggggggaaacccggaacccggaacggaaacggggggggggaaaaacaccccgccaaaaggggcgaaaggggccaaagggcccgaagggccccccaacccggcggggggggggcccccgccggtacccaaaaaaaaaaaggggggggggggggaaactaacccccgggttgtgtcgggaaaaaagagcccccccccaaaagaaaacaaaaagggaaaaaaacgggggggggggggggggggggaaccctacggggggcccggggggggcccccttaaaaaaaaggggggggggggggaaccccccaaagggaaagggccccggaaaccaaaaaaaacgggcccaacaaaaggggggaaaaaaaggggtgggggggggagagcccacaaaaaaaaaaaaagccggggggaaatatatccaggcccgaattcgccagaaaagcaaaacaaaacgaaacccggcccgaacggggcttaggaaaaaaagc

SEQ ID NO: 98379 - DNA, 557 bp, Oryza sativa
atatacaccatatatacatttatggaagcagatttattgaataagatattcagctggaagttattaaataaagatatctttaggctgcacattttttcatatatgccctttaagcaatatgaaattaccatttatagtcttcatcatgtgcctttaaatactgccaagttggagacacttatcagtcaagtgttcttgagaatcctcatctccaccctcaccatagaaacaggactagagtcctttcacgtgtcctagatttgggcacctttcttttgatcaccgaaatggaacgcaagaatctatatgacataaataatattatccatctttacctctctctcttctcctaatgctacattgtatccatatacattgtgattgctatagctaaagtttatttatatgaatcctatctatatagaccatttttgccatatacattggtgatgcactaacaccggcaatgctgatatgttgcggcttgtagctagcctaggcttctagactacccatctaacagcacatctagactgtagtataaatgagtacaatgc

SEQ ID NO: 98380 - DNA, 538 bp, Oryza sativa
  unsure (1)..(538): unsure at all n locations
ccgtccaatagtacacatcttgcnnnnnnnnnnnnnnnnnnnnnnnnnnnnnnnnnnnnnnnnnnnnnnnnnnnnnnccgagttcttctcccgcttcaccgccccgcgatcctactccaagtggaccagccgcctcaagtgcaacctctactagtaagtagtacggcttctatctcgaatctacctcccacctctgtgcctctcctcacgaatcgaagaatgagtgagctagattggttggcccactgtgatttgggttaaatcgggttggaatagggggcgatgcatgaggtgccaactgtttagattcatttggaacgatacgttagctgctgcagagatgtttcacatttaatgtgtgtagggcatcgatctgaattctacttttggagttaaacgtggaatctagatttgattataacttgttctgtgaggtgtacgtttgctgataattctagttaggtgtagctcactaaatcgagacttgaaatttattggtagcttggctacatcatggaattttatatgtgagacttag

SEQ ID NO: 98381 - DNA, 646 bp, Oryza sativa
tagctttattgaaaatttggcatagcccagctagaactggacggtaaaacgagccttttacactaagacagaaaaccccataagtaacggttatgaactagctatggtcgctacgtttgctccaatgctatacatgtcggcttattaaaaaaaacgccacgctggcttccacgccgggggccgccacccaatgccgcattggtggaggggggaggggggcccaggcccccccgccccccccccccccccccccccccccgcccccccccccccccccccccccccccccccccccccccccgcccccccccccccccgccccccccccccccccccccccccccgccccccccgccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccgccccccccccctccccccccccgccccgcccccccccgccccccccccccccccccccccccccccccccccccccccccccccccccccccccccccccctcccccgccc

SEQ ID NO: 98382 - DNA, 524 bp, Oryza sativa
  unsure (1)..(524): unsure at all n locations
atgaaggaagacaacatgaggacacataaaaaagaatccctactatcaatccccacccaaaaagaaaaaggaaaaannnnnnnnnnnnnnnnnnnnnttcaatgacatactgcttgaaactaacctttggatgaattagccccaaagtcaggtaaggaggctcaacattaaaggctttactttgtttattttagaaatgaaatgccaagtggagcataactattttagaggctttcacttcaagactgcccataggtacaggaacgaaaacaaaggcccagagggaggttgattattaggtgtaaaatgacaatatctcacatgtgtaagttatgaattatatagaacatctaagaattgcatgaatagtaaagtgcattgttattgtcttaatggagtcaaatacctttaggaagaaatgtccacgcagcaattttttcctctataccagcaacaattggatcctacaaatttggacatgattgttcattacataagaattatgtaaatttaaaggaaaattc

SEQ ID NO: 98383 - DNA, 509 bp, Oryza sativa
ttttcttgtcataatcaaatggtacaagttggtcattgtttaatcacctgagcaacgagttagctggagcaatgaacgttccaaccttgatgggggtagaggcgaatcatactcacacaccttctgcactgagggcgtaggaggatgataaaaaacagggaatcagcttccaggtcaagagcgaggaagcaggtatgattaatccttcctacttagaattttctatatattgtatgctcttactttgcttattataatggactgctttcaaacataaaggccttatggattcgttcctcttaatctcaggatgtaattagggggcatgtctcttactcgaccgtagctatgctagtatagtaatatatctgtgacatctgtccacagctgcaagaacataccacttgcaatagcaattgaatgccatccaacccttatgttatggatcatgtataattattacagcggtgtgcgcattctaactggaggcttacactaatgagcttgaa

SEQ ID NO: 98384 - DNA, 506 bp, Oryza sativa
ggtgatctgaatgaacccaatctgcagaatgttctctccctttccggttgccccgggggagggatttatggaatgggatatggtggggggctttattctgctgatttttaatgaactcaccccacacaaagtgctacaggtctaaaattattctcgtggcctatcggataaacttatgatctgcactttattccaaaaaggctaccggttgagattatttttttcttgcagtcaatagttaagtttcatgaacaaccgctaaaatgctgacgctagcgtatgcaatttgatccaaccttgggagctcaatctttacagaacatggatatgcactgaaataaaattctctacaagccgacatcatcacccatgttcaggagattgacttctggatcctgaaaacccccatgtttttctcaagtggctacctcaagataataacaaatcctctcttatggagctgtacatatatccactgaaagataattgtgcttctaacatcttca

SEQ ID NO: 98385 - DNA, 623 bp, Oryza sativa
  unsure (1)..(623): unsure at all n locations
gtctatctttgataataagaatttgccgattcggcctatggttaaaaatgaaccgataaccaaaataaccccaatttacacaatataagttccattccggagcgttttttcttaccatggcggttttaaaccgatatgggcctttaggcaatcgtttgtgcccaatttaacaagcccgaacccccaaacccgtggaccccctggttgttgttcgctcccctcaacacaaatgaaccttcgggggtgtggtgggggggttccccccccccccaccccacaaaggagccaccccctccttttaggccactcccaagaagaggttttaaaggcgggggtatgaggggccccctttctttttctaaaaaaaaatcccccaaaaacctctattatttatttataagagaggttttctttttgcgccctctcctcctttcgggtttntnttttccccccccccccctncnnagagacaacagtggggagaggataaatattattttctctcccnccctccccgttttttcgaccaatttgtgtggttcgctctctcctttagaggggggggtnnnagaggcagaagaccacctctccaccntncgaaaaaactccnnnntgctaataat

SEQ ID NO: 98386 - DNA, 852 bp, Oryza sativa
gggcttcccggttcctagaaaaacgaacaggaaggctcccgccggaacctgacagtagacgcccaatcctcccccccgagggggaaaagcggagagcgaccccggggccatcacgtactaagccggcatatagaagaagtataactaccagcccgccacagcgacaccgtgtacgatattggaataccccccagtcggaataaatcgccgcgttcgagcggaatgtcggccaccataaaggcaagggcacaccacgcgaagaacgagtaatacaaacgctatcccgtaggtcaaatgggagcgacaacgtccatacgaggtctgcctcacgatacggtacccggtgattcccttgggagggtgcggcgactattgccaccgaacccggcggcaataaagaaggggtgaggcgtggccgccaccaagggggtggggcaaaaacccacgtccgaaccccccgtgggccttaatgtaacaatactgttgggtctcaccccgggaacagcaactatagcgcccggcccaggccattggtaccaggttctcaagacggggtgttggcgggctcaccaatccttgagaggggcggtaacccgggcactaagaaaacacattgggaattgcctctgtataacacctcctattaaaaaaaagagagaatttgtaatgaacacaaaacatgtggagtggcggtttttgttgcaaggctataatgcgccaaaaaaagagttcagaaatctgtgttctctggggggggcgccgggggcacaacactctggggggtgtgcgatagtataaaagagagtcgccattattctcttaagagagagttaatctcggagctgtgtggcg

SEQ ID NO: 98387 - DNA, 864 bp, Oryza sativa
gatttgagctcaaccgccttctttacctactttctcatttatatgtaacactctcactctgtctatcatatctttacacttactacttatttctcactctactacataccatcatcgaatatatattttgattttatgtttggtcacacactctctacttatcattattcttcctcgattgtagatctatttaattcactacattccaattttatcaccccatctcttatcgtattccattctcacactccacacttgccttgtcattacttcagccgctcacatcatgccttctttctttttctcattagttcgtttaacttagtaaccattctccatcctcttccagcctttatttatatccggttacaatcattcttacgctactctcttacttccattccctttcctatccatcttttatcttctacaaatataatgttcattcatcgtgaggcttctgttcctcttactccattctacttaggtcgtaatcaatcatcgctctctactcatctctctcctgacatttatcttctaatagtgtgcatctcttgccactagctatctgtcatcatacccactgatacaagtaccggcatccattctattcatcaatgtagttcgacatcgtctgtattctttccttcctgcttcactcatgtacagtgataacgaagatgataatctccgccgctcaattttgttgcgcactattgtgtacaataacacaattttggttttctccctctcaccacatccttaataaacgggagtttatgtctgctaaacaccctgtgcccggtgtttctgttacacattcctcacaaagagatcaagaactctattttctgggcgcggccg

SEQ ID NO: 98388 - DNA, 701 bp, Oryza sativa
  unsure (1)..(701): unsure at all n locations
ccgtgttcaactttgactatccgtcttatatgaaatttttttataattcgtattttcattattgttagatgataaaacatgattaatattttatgcgtgacttgtctttttatttttttcataattttttcaaataagacggatggtcaaacattggacacgggaagcagggtttgtctttttttgggacggagggagtagtaaatttacaagagtgattcagacatatttcgaattactacctccgttttttaatagatgacgccnncnnntntctttcccctccttgctccctttctttttctcctctttttttatctccctttgtttctattcatctctctcttggtcctcttctcgtcttaagtcatacccctatgcgctctttgcacatgtaattcttacgcttactcctatcgcttttgcttttccctattctgtttccctatcttccatgcccactctctttctttttttgtatcctactctcactttttcttcattacctctttttcgctaatgtctcttcgttttatcgtatcggctaaccgtcattctctctctcgttttggctattctttattatttcctcctttatctcccatgtcattatctcttcgccttcgttcttccgtatatgtttatacctttgtttttttcctttcatcccttatgttttatacttcattctcatccccccg

SEQ ID NO: 98389 - DNA, 570 bp, Oryza sativa
ccaataaatttacctctgaattttctggaaaataccggattgatgtacacatgtgatcaggatgatcattagctgcttaaatattcagtgaaactatgagctaattaaccaattaccaaagactcttaccaaaaccatgcagctctgctggctcattgtaccggccaagcttacactggccaatctgaatacagccaaagaatcatcagattgatgtttcgcagattcctgccgtgtagattgctctcacactgccactagcttccaggttgacctagtaatactactcaaatgataactagggcgctctaatctctttccaattgtaaagtacataaatagttatgaaaaaattcggaaaagacagaggactagatatcctccctattcaatattttaagttacgtattggatactacggagtttgcacacactatagttattttaaggtaatggaaacattttatttgagctacagctaatattctaaaattaagttttaaaatttaaaatttgattgcggttgataataaacaagcaagcagcctctgctggttgccacaaaaagta

SEQ ID NO: 98390 - DNA, 629 bp, Oryza sativa
gtggggattagccccagggcatacttgttcccagggtcctcctgttacatgaataatacatatagagcccaactcccggcttcctttcctgtaatactgtagacataacaagtacttttggtccaaatcactggctttaacacttttcactgctttccataccacaccctgtgcaatgcaacttttcaggtcctcacatcaagagatggggtctatttctgcattacttgcattagggctgaattggagacctgatttgatcaataaaatataatgcgagtgatgtttcttggaaccctgccactgtctatggccaagcacaggctagcctgttagcaggtaagagatcacgtggaacatatgatccatcccggccaaggctgttatagactggccagtacctagctgaacaaccaactgactgcagagacaggagtgaacccctctgagatgatctaagcctagcccaagttagcataactccccagctgacttgtagacacattaagcaatgttaaaaggttattgacttaagccattgggttttagggcaatttgttatgcagcaatagctaactgatacacttcctccttacttagcaactgaagaaacatctgaatcacatatc

SEQ ID NO: 98391 - DNA, 587 bp, Oryza sativa
aaccgccagacttttgatggtggaacacccctcgtcgaactcgttaagttcggtgaacaggctcggggtgccggcgggcaagaaagattgcttactccctccacaaagggaataaggtccggccgggtctcgaagtcaccaggggcgaagtggggcgccgcaagggaatactcctaggcaaatgcttcggcggccgcacacttccccttcgccttggccagcggcgaaatggctggctcgcgcacagggctcccgaaaaccctcgccgcagccgacaagatccgttcggcggaggcggaagccccggcggcggcgctaccgcctgccccagcaacgccgagcggagcaaggggagcagccgaaaggtccaaactgcggccagcaggtgaggtcggagtctcgtcagaagactcgtcgtcgctgaaaacgcgagcgatgtcgaggaatcccttcttttttaagatcttcttgaccagacctcctttcgccgccttgcccgacgagaacgcaactaaggccttcgccccttccaaatcctttcggcgaagaggggagctgttcgactccaccccagtctcgttgtgatc

SEQ ID NO: 98392 - DNA, 559 bp, Oryza sativa
atatgcaagtgcacaggataacaaaggatggcatagtagggtttcatttgcataaacagcatttaataaacatttcagaatttaataaaacagttaagtaataattaaacaatattaactgtcgcgaccgagaaaaatacattttcccgaacgctagtgtattaatccccgtcccaggaaaagccggggtacaccaaacaaacatgatacaaaaggcacatctttaatatatcgataatatttacattattacaaaggcacttcggcctgacaaacaaaaataaacaacagcggactagcgggcctacggctccatcttcacaggcgctcaactggggtataagccaggactccacctaagacatcttctccgaagcttctcttactgaaggggggaaagattgaacaagaatgagtacaaccacaatactcagcaagccacaccggcagatgcatgattaatgcaagggggtacaaggggtaataataaaggggttaagttttgcaggaaatagcatttaaaagtcacttagttgcccaaagccatttaaaaagacga

SEQ ID NO: 98393 - DNA, 713 bp, Oryza sativa
cgatgttcccgatattgtcagaagaatcaggaagatcaaagcccctctaaagattaagatcttcttatggtacttacgtcatggagtagtcttaacaaaaaataatctgtattaagaggaattggagaggaaactagtcttgttctttctgccacaaagatgaaactattaatcatttgttgtttgattgtcgttttgcccgcgcagtttggtctttaatccagtttgcttcgaatattagtttacctaatagtacaactcatatgtttgggcattggataagaagacaaccacgcaatttgagatctttggtcttattaggggcaacaaccactatttggtctatttggctttgtagaaataatgtggtttttgaaagaaaaaacatatcttctcctttgcaggttatcttggctccgctcataggctatccttcagaaggtcaatttgcggggtactatcattgcggcttgtcaacaattggagctagtggccatggagttttctaccccggcgcatgggtggcgttctaggctacggttagagggctcctgaagttctttttgtccctgctatttggatgatgagtttatcttttgtttctttcttgttggctgtgtgcactctttgggtgcagaagccggaggtgctctcagaataattgtttcacttgatagaattttactgagattaataaagcttccattatctta

SEQ ID NO: 98394 - DNA, 2280 bp, Oryza sativa
acccgcggggggtttttaaaccagtggatcccccctttttttcttattcttattatttttgataataatattgctacagaaaacactattacttgcacatgaatactaagcagctagctcatgtgtgtatgctccgtaatatatattacctatgtttttacatgaggaataataactattatttttgttaatgatattgtatttataaaaggtatctgactagttttttttaagagaaagatatttttgctaaatataatctagaatgctataaaggttaataatattaaacgatatagtcatataattttttttggataaactagtgatcaacacttgttatgaatccaatgatcataatgcactatatatattgttcaagtgagttgtgacattcactatttactagttacatgcgtatgcattacaatgagatctacatataaaaataagatttagtttatttctagtcttgtttttatgatgtattggattttttttacatttctttagaaataatattgtataacaactaaataatttattgttttataaataaattattttatcgtacccccatctataaaatcctacgtccgccactgccaaaaatcccttcttcacattagcaactctaccagtcaaactcgatttctgcaatataaacagaattgaattgccatcgaatttcagttcaatagtgccaccaaattcgtagtaaaaaaagatcatgaagcagtgtgtcatcgacataattatgacatacatacctagtggatcccccctttttttcttattcttatttatttttgataataatattgctacagaaaacactattacttgcacatgaatactaagcagctagctcatgtgtgtatgctccgtaatatatattacctatgtttttacatgaggaataataactattatttttgttaatgatattgtatttataaaaggtatctgactagttttttttaagagaaagatatttttgctaaatataatctagaatgctataaaggttaataatattaaacgatatagtcatataattttttttggataaactagtgatcaacacttgttatgaatccaatgatcataatgcactatatatattgttcaagtgagttgtgacattcactatttactagttacatgcgtatgcattacaatgagatctacatataaaaataagatttagtttatttctagtcttgtttttatgatgtattggattttttttacatttctttagaaataatattgtataacaactaaataatttattgttttataaataaattattttatcgtacccccatctataaaatcctacgtccgccactgccaaaaatcccttcttcacattagcaactctaccagtcaaactcgatttctgcaatataaacagaattgaattgccatcgaatttcagttcaatagtgccaccaaattcgtagtaaaaaagatcatgaagcagtgtgtcatcgacataattatgacatacataatatgttaacagatggatgacccaaactttttttcttattcttatttatttttgataataatattgctacagaaaacactattacttgcacatgaatactaagcagctagctcatgtgtgtatgctccgtaatatatattacctatgtttttacatgaggaataataactattatttttgttaatgatattgtatttataaaaggtatctgactagttttttttaagagaaagatatttttgctaaatataatctagaatgctataaaggttaataatattaaacgatatagtcatataattttttttggataaactagtgatcaacacttgttatgaatccaatgatcataatgcactatatatattgttcaagtgagttgtgacattcactatttactagttacatgcgtatgcattacaatgagatctacatataaaaataagatttagtttatttctagtcttgtttttatgatgtattggattttttttacatttctttagaaataatattgtataacaactaaataatttattgttttataaataaattattttatcgtacccccatctataaaatcctacgtccgccactgccaaaaatcccttcttcacattagcaactctaccagtcaaactcgatttctgcaatataaacagaattgaattgccatcgatttcagttcaatagtgccaccaaatcgtacgtcaaaaatatcatgcagcagcgcgctcatcgacataatcagtacatacata

SEQ ID NO: 98395 - DNA, 548 bp, Oryza sativa
  unsure (1)..(548): unsure at all n locations
tttccagaacacttctttcctcatccgaagctgactgatgcaagttgtatcactcccattgtacaaatcatctaatcttgttttcctgaccaaatctctatccaccaatggaccatacttccttggatgtcgtctatttcttatacgacgtcgccagcgaataattgccaacacaacagctaaaacacccaaagttctagttcgttgatggacaatatactgatgagtagaatctagatccatctgagcatcacacgacnaaaagggcggngcacgaaaaaaagaaactagtgaaaaaaagcacacattttgacatagttttacttctaataggcatactctctatggatccttgaataacaaagcancnnnanannnnnnnnnnnnnnnaagggaactgccacggtgttctcaccttgctgcagaaaatcgtggcaaagattgtgggggcttggcaatctgacgcgcacagaggaaaggagagagttagaaattttgattcccttcagatctggacaaagtactcttctttttctacttacctgcta

SEQ ID NO: 98396 - DNA, 791 bp, Oryza sativa
actgaaagcctatctacaggaggtcaagagtgtgccacatttcaagactggaaagatatctctgcaagtacaggtgcacttttttcatttcaattttaaactgtatgataccctgtaaattttctttcacagaaccagggttcaagattgaagtgggaaacatagtaatcctggtctgctctgattttctttttttttaaaaaggcatggtttaatttagttccattttttccctcgaacatgcaggagggaatttagttgcgaaaattatcactaagaatttcaaaaccaaacactaaatcattgcaagacttcccttaaaaaaaatcaatatacacctgtaaaggctgagtgaaaatggagtcgaaatgaacaggattgcttgtagattgtagcaattctgttcgatggatcggttgccagttggtgacacatgcattcattctctaattgaatacgataaaagttcttttttcgtgaaaattacgacaatattgtgctggagtatttggactgaaagcaacttgttctctagtattctttcatgtggcaccatgacatcctgtcactacaatccacaaacggctcctcatgcttcatacctagtatagagattgttccagaatttccttggattgactagtttggatgggatttttcttagatccatgaaagtgaatcccgtgtagaactactagttacaccaactctgttaagaagctctgaaccacatgaaagtttatttttttcagctcgtggccctttgccaccataaacaaagttccagttct

SEQ ID NO: 98397 - DNA, 836 bp, Oryza sativa
caaaacggtatcagtgcagttatgcagggtaggttgaagcaagttgtttagatatacgccagtgacgattaaattggtgcgcatgctgattatcttagaaacaaccactacaaaaaaaatattttgtggagtttttttttagaaacacagcctgcgtttgtggagatatttttctagtactatatagaggcaaacatgcctttacaatgcagcagagaccttttaaaaatatgtctaataaatgtattttgataaattatctttagaaaagaatatgtatttttttaatgtctgtacaggcattaaattttgccatacctatagcaaagcaatgtgaaaatagaaaaaaatatatttccttgctactccctccgtttcacaatgtaagtcattctagcatttctcatattcatattgatgttaatgaatctaaatatatatatctatctagattcattaacaacaatatgaatgtggaaaatgctagaatgacttacattgtgaaacggaggaagtattaccaatccttaaactcgtgagtatattatttttatcttcaatgcactaattatctgaaccttatatcattacttgtaaatgtatgtgttgtgttaattctatatatgcacatattaatatttagaaagtgactcaaccgaggtttagatgtcttgagaaaatgactttacatatgagaaaaattttgaagtaccaaaaatatacctctacaagatagatttaacaaaatatgcctaaaaatgtctatatagcaaagtattataggcaacgttaaaagtgccataaaaactgtgctagttttagtggttgttttaact

SEQ ID NO: 98398 - DNA, 548 bp, Oryza sativa
gccaggtatagctcttttcagagattgattagagatgaagttataggaagtatataaacttatacattttgctacaaaataaattaaacctatactttatttctatcattatagcataatatttccatagcaaagcacgggatttcatctagttggcataatggttgtgtacatcgatgtggattttagggactggattgttatcctttatcttaaaaatgttggggaaagtcatcttataggggaccaggcattgataggatcaggaaaaacaatccatatttgtgtggatctggaaaatgtgtagtaaaaaacaattattttacggagcaaggagaaaatgggactacaagaaaattaatgggccacccaaaatggactttatcctatcttatacttactcatccatgtcccgctctctgttttatgtgtccctcaaatttgttgaactaatctttttagtctccctattccttgtgatatttgttgtacacaattaacatttcaactaaacatgttcttctatcccattgcgcaattcacgaatg

SEQ ID NO: 98399 - DNA, 635 bp, Oryza sativa
acttggtccattaaatacattccttctaaagttaaaacttttatttggagactaattagacaagctcttccaacggctgcaaatcttcactcaaaaattttggatattcctgatttttgctcccgttgcaatgatgctgaaaatgttcatcttttcttccgctgtgcttttgcaagacttacctggaaactttaagaactctcttttcacaatctcattattgactcaatgcaaaatgtttctaatattatagcatatttgcttgcaactaataattctgaaaacagccttcaaaaagttccaatccttctttggtttatttggaaagctagaaatgatcattatttcaagaaaaaagaatgggagcctttgcaagtttgtaatgtagcaagcgctatgtcaaagaattatatttcagccttgtctaatgagaatgataatgaaactattccaatcatagatgaattctgttgcttctgttaatttgttgccagtaactggatgtttccttgacgcttctgggaaggataatataacaaggtttggtcttttttctacatgactctataaatcatcatatcatctttgtgtaggccaaatcaactctttatgtgtcgccaattcaggcggaactt

SEQ ID NO: 98400 - DNA, 1195 bp, Oryza sativa
cacgcaactttgttctagaaatgtcatcgccgttagggttgtgcccatcctgccccgttaaatgcattgttcatcctatagcacataaatgatagctcctaacggaaccgtaatggcaatggcattttcgggacaacatcactgatacgacgacatttcatggaactcgcacttgtcgattgcatttcttggaatttggcgcttgtcaatggcatttcttggattttctctattcgattaagtataatttttattttcttttgcttttgatgttcttttgccctcaaagagatgacaaagctgaccttggtatcaaatgaaatctgcaaaagtgcactaatctggtttgtattctgttgttgagctatagcagcaattaattttatttatttgactacagatcttgccaaacaagttgaagaagccagctatcccaatcgcttggctctgttgcgtgggcttttcttctggttggaggtaacttcatactgttttgtgcaatgctagtttttttttttttttttgatcaagggcttgtcaatttgtgcaatgctagtaattatgatgttggagaacttcatagtgtctagctgctagtattcacatttccatccctgttaagctctcaatatatttgtgtttacttgcacaaactactcccaatcagagcagattatttgtttttggtagagttaaagaaccatattttttagtgtaggtttacagtttgtctagccctgtgatgtatgttacacttggactgctacgtgctaaatatggggctgggactaatttctgggaatgatgccaaatgtcactagtttgcttccttttgcagcattagtgttcgtattatcttcgtactagcatgcagtggcataccatttggctacatgcttgcgcaatagtacgattttttttttgaacatttactctagttctttgtagttttcttgactgtgtattgttttgtagaatattgggcaagatgatcaattcaggccgtggagagacgatcacaaacgctacaaaattatgtctctctgagaacacataacaaagttcttacttgcatgtgattatctgcagcatctcgcccatcattgttgtaaatacgtacccagtaaaaaaccgtagaatggaaatggcactgaatttaggcccttctctagtctccatagataggataaccttg

SEQ ID NO: 98401 - DNA, 555 bp, Oryza sativa
cactttcctgatgtgaaactctacaagaaacaaaaactcatgttagatatacgactgcagccaaacaagaaacaaaagtataaaacacattttcatttctgtcatcttatcaaattggttaacgaaatgtcaaatgcggtgcatggacatatgcgagcaccaatgggaaagctcatactaaagcaattacatgaagtgggttaatacatggcaattttccacttgcatggggtggattagttggatgagttttgactttgattgcttttttttaatactaacattatcttacctttttttttttttctgttttcccacattttcttcccttgttccatatctcttagatggcaagacttattggaccacattattctcaccagggttgactactagttccttctacattgaaagaatgcgatggaggctaatagttcgaatcattcacgaaaattgttaatgttgtagtatttgtatatttgtgtaccatgcttattcacagtgcacatagatttttaaaaaggaaggagcccatgtagttctgatccttttgtt

SEQ ID NO: 98402 - DNA, 648 bp, Oryza sativa
atgaatcagaaagggagcatatgaattctcaaaagtcagttgatccacttaggccctgtttctttcagcttgggattattataatccagattattgggagtaagctgaaagaaacagacaacttattgaagtagcttattataatctggagtccagcttattataatctgataagctcatttaggtgagctttttccagattattgggtgaaaaattacccaccatgccaccccactccttctttagacttgcaaacccctctaataatctaggaaagaaacaattaaccgcttattctactatagattataacaatctagtctagcttatagtaatctgactcaataatctagattataataatcttaagctgaaagaaacagggccttaatctgatcgaacttgaacacttctcaaacctgtacaatataaaattgagtaaatttcagaaaactacagatggtttggtcaaattatcacaaaactacagatttaaggagatgtatcacaaaactatagatttaacaataaatttatcataaaactacagatttaaggtggagtattgccaaaccggagatttaataaccaaattatcaccaaactaatagatttggagtttaaatcttaagcactagtgtatattt

SEQ ID NO: 98403 - DNA, 2046 bp, Oryza sativa
cgagactaggcttggggaacttatttataaataatattattttaatgaaaaattgcaaaagtagaagctgatcgactaaaattcgcaagtttaataacttgtcgaactgcgattgttcgacagggttatgaatcactttttaaaaaatagaaaatgacaagaaagagcatgacagggggcctatcgaacatccatggttcgataagtcctgcatgcatagtgctgcacagtagtgtacagtggcacatagtgattgttctctttttttttaattattttttatcccctgtcgaacaactgcagttcgacagggtattttttatcccccatcgaataaccgcagttcgacaggtaccctatcgaattgcggtggtttgatatgtacccctatcaaattttggttgttcgatgggtactaaacttgcaattttagtctatcaacctttttttttgaaattttctattaaaacagcattattactaaaaagaattccttggcttggtatctctttttcagcgcgcgagagcggcaggggtgtggggcccgtggtgtggctttaatggcgtgttggggggggctcgcgatctcacatgcttggaatgctagagtggcgtcgatatcgcggtttcaacacgcgatagcgggagggttgtgggtcccgtggactcgttttattggcgctctggggcagccgcggtctcgcccattgggagcgcgataccacacgtgatcggtggggtggggcccgcggtcttgctcattgaaagtgcgagaccagctttgagaatcgcaagtgacatggggccacattattttttatatttcaaagaaaattgcgcgctagcgttttggagcagcatgcaattacagccactcttcccctctcttcctttttgcacggggagtcacttcatgtctaccacggactccccatttcactcaactttctctttattatttttgctagccgagtcattttatgtcggacacgatcactcagctcgtaacatctctcttcatatgaatccaaggaccccattccataaaaggagaggagatggtccccaggtcaagcagtactgaggaggagacaaagagcaagaaggggagtgtactgagggggagaggaagagctagaagggagtgtactgaggagaggtagagcaagagggatggtgcacataggaagggaagagcaagaggggaggctgtagaggagaggaggcagtggagagaaggaaaaaaaaattacatgtaagttgattagtttttatattagtaaaagtttgtaggatcgaggatttagaaaagattatagttcacatagtttctagtaggataataaatgtttgttattaattatttaagaggaaatttgaggtatatatattaggttgtagattttttttatacgtcacatgtaaaaatactcacataggatgttaataaatataacatatttataatgtagtctcaactagtacaatactagtatattattattgagtaggataatggtaatggaggtagtttgtgtgatatgatttagagtcggttcgggttcaaaaattaggtagacagaattaatttatatggtaaaaaaaattaaagttacaattaatttatagtaattttaccgattaattgtaactctcatgatagccgatccggagtagggacctccgcccacactcattacaagtgggaccaagggcatttaggtcttttctttaaggcatccacgtcagacagggttaaaatgcaaaaaaaaaaccagccacgtagatgaaaaacaggtcaaaagtggcgcatgggagagaatttgggtggggaccgggtggtaaatgggaacggaattttgttagagtggcatttgagaactggatttgggaggatggaaaatagttaattttcccactttgcttgggatttgatctccaaggcattgctgatgaaagctaatgggtgaccctgttgcattaaaactgctaaaatcgctttgtcactagcatctgtctccacccccaactccttagtaaaatttg

SEQ ID NO: 98404 - DNA, 596 bp, Oryza sativa
caaggtaaaggaaatgttttatttttaaaggaatcttgcctttccagatagaccacatttcagtatctttaactcccccaaaagttaaaagcctatacattgatttagcagtaaaagacttattttttgtgtaaggccaaatcacttcatccctgttaccatcaagctggacagattggaggatatccttcacaccatgtaattctccctctctctctaaatttaggcttctcctaaaaatcaaattgcagtcgccattagcccacatctccctaacagtagctttttgttgtaaactcacttcatacagcttggaaaggtcactttcagaggtgcatcaccaagccaaacatccccccagaagtccaccctaccgccatcatgtactatttttttgcaccaatctttgtaagtgacttttacaatggtgtaagcccttccagaattgagagccccctacctctaaactctggaagaagcttcccttcaagtattttctcctgagaacttcatagcacatgtcagtagctctattatccaatttcataatccacttgctgaagaggcaaatattcataattctagtgtccaaaaaa

SEQ ID NO: 98405 - DNA, 1687 bp, Oryza sativa
gagaatacacttgcaaccggtgatggacaagttgcaatcaaggttagtgggatggaaagggaagttaatccagcaatcagggcggaagacgctagtcacgtctgttctcagctccataccaacctacttccttactgccttaaagccgcctaaacagttcctcacagacatggacaagattaggaagaaattcctctgggccggcgatcaagagattagcggggggaagtgcaaagtgaattggaaaaaaagtatgctccccaataaagatgggaggactaggcttgttggaccttgataaatccgagagctttgagactccgttggctatggtttgagtgggagtgccctgacaaaccttgggctaggacgacacccccctgtgatgagttagatgagcaaattttcgcggccgcaacaaaggtaacaatctgtaatgggtggaaggcaaaattttggacatccaactggattggccaccagccgctgaaatacctagcgccagcgcttttcaaccactctaaaggaaagcaatgcttggttcaggatgcgttaaccaatgacaaatggattgatgatattaggcatgagttgtccatgccactgatctgagaattcttcgcagtattccgccttatctgggataatgagacaaacctggaggaaggagttgatggacaaataccggaacttggagacggcgcaacatttattcaaggattgtccattcaggcgagaaatttgggacaaagtaacggctaggatgaaccacaatcaacccttcccggtgcacaacccggacaagagactagtgggaatcaagaataaagcaacaaagcaaatgtcaaagtaaggggatgcaatcactgcacatgctcttgagttgggagatctggtgcgagaggaacaggcgagtttttaaagataaagaacttcaaatccctcaactaacggcaagaataatggacaaaatacacacatggtcggcatgtggggcaaaaaatcttatgagaatagcgccttaacctctcaccctttgttgtaattttccttttttctgctcttctcccccctgtctttccccttgtcaccattgatggcatttgtacagtgcttatctcctgaaatataaaactagctaagctggctaaggtttcaaaagaaagaattaacagtgcttgctagtttgtatttcagatgatactccactcgcatatgaagcgcccgcgtgccctcaagccgatcaaattcagtgtcgacgaggagatagattgccgagtgatagtcagctctccccgtgagctagagctacactacacatgtacttctcccaagtccagcctacaggctggtacgtagagcgatctattgaaagttctgcatattttttattagttcattgctggctattccttaacgcctgtctgtaaacccttaatcatatttgatttggttatgcactctaaatctatggtggttactgattgtacataaccgttatacaccttaatagaaaccattagttcttgaaaacacacaagaaagccatgctcatcattaatttactacatccgacataagcaagcagttcaataacacaggaagtgtatagtttatttttcagctggttagactgagttctggcagattcaggctgagaagatcattatcctcaatcagttgctct

SEQ ID NO: 98406 - DNA, 632 bp, Oryza sativa
aggggtacacatttttttattttaggggtacacatttttttttggatgattttccttagttcaagggtacatattttttttggatggttttccttagttcaggggtacactttttttttgggatggttttccttagttcaggggtacacttttttttggacgattttccatagttcaggggtatacatttctggtattgcggttaggggacctcagacagactcggtgtataattgagggacgtcaagtgaacttattccatgtggaaaacatgatgttgtgtgagccttccctcaagaaccacgtagccagcccaatcgacaagtgggcccacttacatacaccactccacttaaactttcatcctcacttcgtgtaaaatagttaactcaggagcgatatggttagagggaagatgccttataagttggtttcactcttactaaattagcaatgtggtaacagatatgtgcacacagctctcatggatcacagatgtcaaattctaattaggccacgacgttacatatggtcatcaatgaagaagttgtttgtccatcaaaaatcgagagttgagacatgtttagtacgtggaagaaatcttggtgcctgatcgacaaaggtgagatcaa

SEQ ID NO: 98407 - DNA, 2103 bp, Oryza sativa
cctgcagccctagtatattattgttaaagatggaaacagtttgactgcttatcatccacttttagcatgcttgatcaactttagctttgcactacttgcccttccgagtgcttcttacttcacaattttggctaaaacatgacaaattagcctacgtgcctattgctgtgtaattctgtatgaacattatagtcaatatgtttttacaattgaaaaatgataacctattttcgattgtgaaatttatattttccctgttgcacttcatgaacttcatcatactaacctaacaaccctcacagctgtttgttttcttttgaatgaagttcaacatcaaaccatgaaacaaaaaatcttcaaacttttatttccagtacaaagaacccatgatccaacaccagttgattttcttattgattgtttcctgttacaaaatttgttgatttagcgctatagtacatgctaaatggttgatgaagtcagccattgagtccgctatgagaagcactattttgtttgtttccaatttctaacattcatagtttgagtgttactggagtacttttgttggtgctcatggaagaagtgggtctgagacctgggatggctcagcaggagggaaaaacaaaatctgcctatctggttaggcttctaacgataattaagagagatatgtgtaaagactaaaacaagatatttggatttgttgttttttgtttgtccgccttttggcattcatgctttgtttctgtggcccccagaagctactacagggctttgagatagctgcagagccaattgtacagaattaggtggtttgagattatgtttgagctggtcctgattagcatgcattctcaataagacacttgtgttaaattgtttgcagctctttctgttcataaatccagcattggatctctcttttttgtttcggcctaccacagcttgatttcatgacacttttcttcggatgttttgtttgacacttgtgttaaattgtttgcagctctttctgttcataaatccagcattggatctctcttttttgtttcggcctaccacagcttgatttcatgacacttttcttcggatgttttgtttgaaaacagtttgacttgacaagttgtaatgctacgtgaaggattaatgtgaatctaaaattgggctgtattgaattatagaacaggctatatctgtttaatctgcttttgataacatgggcctagcaaataaactattcattttctgttctattcaattaatgaataaatctgaagctacaacttcacaaatctgctcgacttttaccttgtctgccttaaaatgatcatcagtagttgctcgagcaattcccacttttaataatataaacaaacgcctacttaacaatgtttccgtaatctagtactctgtaattcctgcgtgtgcatactacggtttcctggccttctaatatacaatgtttcatctagtctaactgactagaagttctgccactgcaatttatgtaccaaatttggttctgaactctagttttaagcaatgtacgtgtataagacaagactcatatgtgcatggtccagtcgagaagacgtccttggcttagaatttctttttcatttgttcaatgttcttggtcactctgtatgccgttcatgactgggttcgtgcaccattagacagtgataattagtcgctgttatcattattcatgggccatctgatgggcataaaactctcttcatcagtgatagaatatatttgattattgccattagctaacagggcttattcacatattgggcctcagctcaagtacataaaacccaataattgggagataataattgaaataccatggcttaaattgccttaacaccatcacttgtaagttcaagcgatgctatgaaagcaaatccccaataattagaggatgctacaagttgcccaataatcatttgtttgttgaactatttccttaacagatcttttcacaattttgtttagttaaggaaagtgatgaaactaggcaagcacacaacccttacatcgccaagtgcttagcacttgttacaaagaaagggataaaaggccaaaaaa

SEQ ID NO: 98408 - DNA, 574 bp, Oryza sativa
attaatcctattcccatattgttggatttttaggtctaaatatgaagagaaagaatggtcttgctcttgaacaattgttcatgaattctaaatcaacagttcatgagtcccctgcctcaaacactgcacaattttcaatcctctatatatttcacatattgccactcttatgtgttgaacaattatcaaatactagttgagtaatttctatttgttgaacaattggcaattagtagttaaatcaattatataaatatatgaaattatacccaattcatgttatacaatttgtagtttagtactatataattactccttcacgtttcgcatacccaacctgaaaatcctggggccgcccctgggcgagcgtcacccgcgtggccaggcctgggcacctggctgtggctgggccaagcaaccaccagccccagtgtgggcgggcggcgagcggcggtgcgtcggtggtgccacaggcttgcgcctagcgccctcactgtctgtctgtttcggtgtctcgttggttcatgctctcactgtttgtctcaggtttgttccacgtacccaattctttatg

SEQ ID NO: 98409 - DNA, 1029 bp, Oryza sativa
aaaaagttttgagtttttattcttcggaggaacacctccaagaagggttacaatccattgtcatatccaaccattacaacccatcgtcatcgccaaatccaacctgtgaatattagataatggatttctctccgcatctcaagtaccaattctccatggcaaagctttcaagaagcgcacctgtcgacgccattgatgaaactaaccaataaatagtagaaatatggttttcatccttgatgaattattagagcttgtagataatttctcaacactatctaattgctagatccaattaatttagactagattgatggatatagcaaagtgaagaccagatcatcataggctaccatagctgtcgagccatcatgatctccaccctgctgatgaaggaaggtcgaccgttgggaagtcattcctcgaccaccactccctccacattctagctatccccaactctatccaccgccaccataggttggcatgcctagaaaggcatatttgtcaaggtttcatgaccgctgacgatcgcgtaccatcactctccatgcagtgaactacagctgccaacggcccaaagaatctatgttggacgatgagcagtgaggatatggaaatgttgggcggtgcggcgaggatcacacaaccatttaatcggatttgaaaccctattaggtggaatcttccaactaccacaccaatgctgtttcccgagaactctttatagctagggcatgttatatagttttacaacatttttaaccttcttaatgattatgcattctggcatttttgtttattgataatgctgtataccttgttggtatataggtctttttgctatttatatgcacatagtttcagaagtattcattatttggccttatttgggaataattgaaattgtgctgggatatgattcgtactcatttccaaggctaaaaaaagacgaaaacaaatacactgaaggaattttcggtctcgcacccaatccattctcatctcatagctctgtatgttgttgcg

SEQ ID NO: 98410 - DNA, 1104 bp, Oryza sativa
aaaactatgaattactcccctcaactatcgtggttgaccgaattaccacccccccaaacccacaaaaccggacatttgatacccctaaagtattgaaaccggataaattaccccccttggctcaatctggagcgattttgatcctatgtggcgccaatttggcaatccaatcataaaaaaagtaataaaaaactatgggcccacttgtcaattactcctacctcatccctctctctttgctgttggtgggcggggcggggatcggaggacaggaggcgactgcggacgtgacgtacgagtgacgggtgtcggtggccgcgtccacggcggcgatgcacgagatggagctgtgcaggaggcgaatagcagcgaggagggccggcaccgccgctcctccctttcccctctccttctcttccgactcactccccagtgcggtggcggtggtggtccgggcggagaaggcggtgatctggatgaagaaagaaggtcgcggaggggttgggcgagcggcgggccccggggagggcatcctcgctggagcgtaagttctctatcacgcgtggcaccagctccgctttcactaccgaccacccgatccggcgccggccgcacaggcgagctaagcctcagccgctcgccacccgggcgatctgtgcgtccgccgccaacctccagaacgagctctgcatcaatcgctcgttgaccgggcgtgctccgcctccaccgccggccacccggtccgcctcctctgccggacaggcgagctccgcctcagccgctcgctacccgggcatgctccgcctctgccgccggtcacctgttccgtctcctcttccgtgcgggcaatcaccgcctccggtcggctgcacgagtgacctccgcctctagccgcccccgtgtgggcaatctccgtctctgtggctagtcacctgagagagctccgcctcagttgccccccgcacgggcatgctccgcctccgtcaccagccatccggtccgcctcctccttcatgggctctgtagctgactgttcgagcgcgtgtgcaacagagagacccactagggaaggactcgattgaggcaggggtatgacaggtggaa

SEQ ID NO: 98411 - DNA, 562 bp, Oryza sativa
  unsure (1)..(562): unsure at all n locations
cggtacggagggcggcgtgggggtgcagggcggcgccgccgcaccgtagccccttgcccgcggatctgcgcggcggcagcggcggaggaggaggaggtggagtggagtggtggttgnagatgggaaaggcgacggagcagcagccagcaagcgaggaatgagttgttgttgctagggaagagagagacgatggcttctacacgttttttttcctttcttgtgttgaataaatgaaattaatcttaactttttagctattaccagtttaatcttagaaaagtactcgcatgagactacatatacatttgtcgacaaatttttccccaaaaatttaacagatataattatagtacaattatagtgtaattacactgtaacttatatgtaattacactgtaacttgcatgtaactacacataattttgaatcgttagatctattacaagatttgttttggtgaggaagaaaataaatcatagcacacacatatgtgaaataatttgttcccacgacctccattttaccgaaataacatgttacggagagatttttgaaagttaca

SEQ ID NO: 98412 - DNA, 730 bp, Oryza sativa
tcaaacaagtgatcaaacagggaaatgaaaaccttggcatactaccccatctagctacaagtgccacatggatattgacatggcaccggaaatgcagctgattactaatttacggtaatatttcaagaatgaaagggaacaccgaagttataatataatgaaagaagttatcgacagaaacctacacatatgttttgtgtatccattctaaaaaatgtattttactgcacaattctagaccattagttattttttactgaaagggtataaaattgatcgcaaactgacagaaaacaacccatattgccagtgtttcatctctgattccctaaaagatctaatacaatcgcaatttttttcatgtcatactctcatttatgtctgattccctatgtctgattccctatgtctggattggacatgattcatgtagttttcatgtcatattctcgtctagattgcacttcttttctctcatttagattgaattatgactggattggacatttaacaatatgaaaagttcaaactgttcccctaagcatgaaatttaagaattcttgaacaaaaacatatgtactactcccctgttatttttcctttttgatgacttcatttccaaattgaaaaggaaattcatgttgctttttacaaattgaaaagcaattactagagtaatatatgagcaatgaatcacttacccaatcaccaacaacaaacaggcttacaa

SEQ ID NO: 98413 - DNA, 567 bp, Oryza sativa
ccccaccctagtcgagacctggaccgtactcctcaaaatgcatcatcaagaaggcccatcaacctcatccccgtctagatgaccgcgatcgtcacaaccacttgaacgggaggaggcaggagctcgaggaggaggtctggcgaggagcagtggtaggctctcgctcatgtagtatttttgcagtatgaacacaactcagttggatagagtcatggtatgttaggattaggataaggagttctccatctatataaggagagatcctatcctagatcagttagcattagatcaagatttatcttagtgcccatcaaccctaccttgttggtgtgagggagagcatcgtgctatttaggttcagggccattctctattacttcttctattatgatccaatctattcctcttcacctcttttatcccatataatcctagcacgtgacactttactcttttcggtttcctagtcttctcagagatttgggtatgtctttagtactttactctctttgtaaggctatgagcttagtaataaagttatcttgtttatttaattgtgttcgcagt

SEQ ID NO: 98414 - DNA, 956 bp, Oryza sativa
attcctgcagcccgaactagtctcctccaagtatttttcacgagtatgtcggataagcagcttcttttgtctgcgtgctataatttcctccctgagtttggacctttccctattgaagaagaacacaaactataagtctataaataagactagcactaaatttgaaattcttctagaattcaaattggtgaaaaaaaggacatttcacaaagataataaagaattttacaaggaactagagctaaggcagtattatatagaagcttatcgagcaattccaaaaaaaaaatccagaaagcaaacatgtattagtagaactttagttcaccttagcagacaatccgtgcctcctggagaaaatcacaggtgttatttttttttagctttttagtggtctacaacatgtatagttattttttttaaaaaaaaatccaaatgaagtataatataggaaagtaatgtactttctattttcatgaaagtatactctatgggacaaattgagcctatttactcattagtaggctggtttcttctcttatcagtatttttagacgttgaacaattgaaccaatatccaaccacttgagactcatcatacccaaaaggaacgatcaaaagccaggcatgagcgcatgacatgctgactgggcaggaccatatattattgcccataggccatagccccctaaagggcttggcagggctggtctattaccatgacagaaaaatagttcagttgaaacaaatcaggagttcaggacttacaaggaccgtatatcttcctgaatttgctggagctgcttattaacctcattaccatccttatagtctggaaatagaataatatcataacacatcaaaagtacatcgttaatgaaaggatgccttaaaagtcgttagtcttacatgatgacatgtccggaatcatggtgtcctggggatgtacaataaag

SEQ ID NO: 98415 - DNA, 1075 bp, Oryza sativa
agcaatttaattattttcattatgatgaattttgctacaggacatccaaaaaacatgtaattagccgggggacactgtaataacacgtttatgctacagggcactgtaaaaaggtggtaattagttgttggacattcacgatattattttattatacttggaggaattaaagagagaaacagatatgaaaatacagttttacccttcgaacccaataaagtctcactcccactctaggacctacatgtcaaggaatatttcttttcttttatttttctttttctctctccttctctaccccttcccttcttcctgctttcttcttccggttttcgaaagttagcattatattttcaataattttattgctactatcacctttcttaagagattgttattctaggtttctcttaaaagcaaagattaaggttcatgaaaaaaatgcaatgcgttaaatgatttactcctggttgagaggaaatgattgttgatagtagaatgtgagaaatggttgagaggggaggatgtttgagggtagaacggaaagaaatttaaatatggcatgataatctttgtggaataaatttgaatccaagagtaaccatttttttaggatattagaaataaaaaaaatggtaaaatcgtgtgaattatcgatgtccaaaactataagtggaaaaactggaacattaataattatatggtataaatgttatataatcaaattgtatgaataaaaatgccttttatgttggtaatccaaaagattaaatgctatccttggttaagaaattatagtcaataaatacagcaaaagaaatagaaattatcgagtctgtcactctttgtcagttctaaagcctgcttagagcatgtataatagcagactataaacaagctataaacacatattaagaagttagaagaagagagagatgagcagcgggctatagctacagcatgagcatggattttaagacatattgtgtgtatgataggtgagaccagatattaatagtgtagtatatatttatcggtaactattatataaattgactattaaattgattacaga

SEQ ID NO: 98416 - DNA, 668 bp, Oryza sativa
tactctaatactctcattcatgtgcatagactttatacggtaaactttgcacgcataaactttatgtatagaaatattttatatataaaatatttgaatccgaatttgaatttgaatcgggtatataaacttttgacttataaacatttgctctacaaactttaggtggataaactttagatatgtaaactttaggtgtataaacttactaaaagatgaaaatataaaaatatttgaatttgaatttgaatttgaatttgaatcgggtatataaacttttgacttataaacattcgccttacaaacattaggtggataaactttagatgtgtaaactttagttgtataaacttactaaaagaggaaaagaaaaaaaatcaatcactggcagcgatcgatcgcccgttagccttctcgcaagataatgcatataaatttgaaatctaatatctagagatctcattctaaatgaatcttggccttggcacaattttgaattcatagactccctctaagtttaaaacaatctttcttttttgcataaatggtattaaaagtttgtttttcaaatcttctttcctatcttccttgtgctttcacttactaaaatttcaatggtcctacaatggaagagaaatccaagttcaaaggggagagaaactttgttt

SEQ ID NO: 98417 - DNA, 783 bp, Oryza sativa
ttatcagaatataatcatgtgagatcttgttataaatacttaattgttacaaacataacggtgtaatcggatcgtaaatcggatgagtagtttaagagaaaattgtatttgaagtatatgtggataatgtctcttataaatggagtggtagctggtttagacaaacaagctaccactagttgtgtagtcacgtccataaaggtaatatatttttttagtataatttttttacctcctggtacctttgataccaacgatcctatgcatacgctgtagttttgtttggacgcatagttagctgttctagactatttgttacacgatacgatatagttttcggggatatgaaggaaaacgtgtggcctatggcctcacattcatcttagtttattatgatcttttacggtgtttgcgagatacgtaaaggtattgagaggtggtgcgatatagatcattgatcaagagaaaggcaagggcaagatgtgaaataaaattattataaccaatggcagtagggtaagtaactagtaaaacaacaataattttgtttgatgtgaatatctttcttgattgaaccggtacgtattaaaaaagaataggtacttatcttccttatgcttgcttacataggtgattagttcgcaaatctatagactaggcgcacattgatccagatatccgaataccttattctaaatccataaatcctaaaatcaaggaggtagttaattttcaatggcaacaatacaggggactcctaatgggcggttgatcgctccctcc

SEQ ID NO: 98418 - DNA, 539 bp, Oryza sativa
ttataaactgaatcatctgtctgtttaaatttgatgctactggagctattcagttcagtctatctggagtaaacgatcatatgtgtgcgatcctatatactttgctggatgagatctctatcttaatattgatgctgctcttgattcaactggagattagggtgtgtatatatatatatatatatatatatatatgtatattctcgctgcattagaaaggacacatttatcccataccaagttgtacactcaacatagttatgtttacatcccaattttaagagatcaaaagcatttcaagaacaattgatagaacatagacctccaatattcccaaaaaaacagaaaggatgactggaattcagacaaaatttgggctaaatttaaacaaattttgttgaatccaaagcccaatataaattgaagaaatcatttgaatttttttggcttaaagttcaataactattcttaagaacacgaatttctcaaagtttagaactccaaaacaaagatttgatatgtattaaaaataacatata

SEQ ID NO: 98419 - DNA, 611 bp, Oryza sativa
tagggctataaattggggtgctatggactcaattcaagacattaaaccccatttcacatgatgaatccatcgaagtgttcaagagaattgtgtgcttattgaagatcatttgtcttagagtgttcgctaaattctctcccaactctctccatttctatgatcttgagtttgtgagctaatagtgggttgagttgagagtgtgtggaagaaaagatttgtaatctcagagccgccaacgcgtgtggtttgcttaggaacccttgtgaaggctctatttcgcctttgaaagggaagaagtcactgagtggaagccgagcttcatctaggtagttgcttgccagagcgagcttcaccggagggtagttgcatgctatccgagcttgagaccgagtgggtctcttgaagcacgaacttttccttggcggttgcttgaagaaaccaagacaccatcggaggttgcttggagaggaaaagggttaatcgagacccgacttttcggaacccctcaacggagagtaggataggttggatccaaacatcagtaaataaatcagtgtatcctttcctctcttttaccttggatttaccactttctatattggtctattagt

SEQ ID NO: 98420 - DNA, 660 bp, Oryza sativa
aaataatatacataattttttttgagaaataaaatacataattgtgcacgtaaataaaattctattcccatagtacgataagacaatacgaaataaaatatcaaaacatgaactaacagttaacgcgcataatttcataacgttataattttatcacaccatggggcaagaaataaagctaagtatcaaaatgtcatcgaaatcatataatcataaaattctacctcataatactgttgaaccaaaataaagcaaaattaacattagtatcaataaattaaatttctagctgaatttcttgttagttccatttagctacacatgatcttcattgcataagaaagtttataatgcaactttatggcatcaaataatggcttaaacggattaaaatgcatttatgtaaaggaaaaatcactaattcggcccgataataagggaaaagtaatttggcccgaagaccagtcacgacccagaggccagagctagcctgtgattgggcggcccttgaggcaagcatagcccattaaccaatcatggcccgtcagtgtagccgtccgattctgatggacggccacgatctctgatgggtggctgatgcggcgtatgagagtcatggtgttatggttacggataaggcggttgtagataaggcatacc

SEQ ID NO: 98421 - DNA, 706 bp, Oryza sativa
agagagagagcgactgtttgtgaaagggcaatagtgacatttttcctacttgggcccacatgtcagagctgccaaatggttaaacccaaacagaatagcgacggaatggtgtggaggacgcgataaagttcgacaatagcatagagagagactcaaactttttagtggcatagaggcaagggtcatcttttttaatagcacacaggtaaaaaccttaagattctctagcctcaacatgaatgtatctaagggtgtaaatggctaacccatgaaatccacttgtaggttaaaataagttaaaataaacggacttgtaggttaaaataagttaaaataaacgggtttgcggctgatccacttatacccctaaatgcatctagccagtggcaatttcgtttgcttcacaatttttgattttgttccaagcaagagtatgatcggaatgaagtgtcaacattttgtgtattcaaactgaatttatcaaggacgaaaaatgagccgcaaaaaattcatactaaaattacaccgcaaaagttaccaagtaatcagagtccaattccaatctgctgagtgctgaacgcaattcatttgaaaccgcatctaattctccaaaacccaaaatttttcagtagttgacacttgaacagtttgcacaatccatatccaagcctgcatcacgtgatcaccatttttctccatctcatac

SEQ ID NO: 98422 - DNA, 802 bp, Oryza sativa
ctcttgctttctcatacatatgcaattgattgtgtactgccttgatctataccttttcataagaaaggtttggttcagttttgggggaatttttttggctgagatttgttcatgttgcaagagtatttggctatttgctgcttcgagtgatggttatggacatggattagttgggaattggggcttgtttctgaaggttgttcatatattttggggagggttgtggattgaccctgctaggatgaaactttgttctaacccaagaattttgacatttggggattttttttttctagagcagatcactaaggaatcagaacatgaggcttagaatttttgtttttaaggaattagacttcgaaaattgagtagcatgttcagaagctagggatttcagattataaaaggttggggtttaattagcgaagaagtttcaggttgtgatgctatgctgcggtgttgattgggtaacagtgacggattgatagccatggacatgaaaatgagttgggaacttgggttttatgttggtgatagtaactgtttgaagattatataaagggtcaaatatcttcggtgtatcttgttgattccagttttccaaggtttgttgacaatgaagattattcgggagggcgttgtcagaatccatttcagtttcagctctctggagttgaccaagggattttgattccaaatttccagggcgatagcaaaatgctgacttcaaatttatgtgtcaataacatttccagtcagttttgagaagtacaatttgtgttattcaggtgtttctgaaaac

SEQ ID NO: 98423 - DNA, 624 bp, Oryza sativa
aggtccggaacttcctgtcttccaggtccggaagttccggtcttgtgaaaaagattttcctaagtgtagtccggaagttccggtcttctaggtgacgtaacggctagatgacgtcacctagccgtcatacatatacagcttgattccagctcgttccttagccattccactttcatttttcaaacctagagcaattgctagcctctcccaagtgtttcttgtcttctccactcaatctagagcctaattcttgtgagaaagagagattgagagggagagaagaagatttggagatgtgtgaagactaggatcttgggtaagcacttggaatatctcgtgggctgtcatctcggtgcttattactcttcgagatgatctcctagacggttaggtgtcgcccgcgagaatccgttgcatattgtggatgtcccgggtaagtttgtgaaggatttcctctcctccgaaagggaacgaggtaagttagtgaagttcttgtactgagattttagaggctttccaagtagagcaacccacacttgtggtggatttctagaagtaggttgagtttgatcttggtggtcactcaattctagaaatttgcctaggggtgtttggggttgaagg

SEQ ID NO: 98424 - DNA, 1196 bp, Oryza sativa
gcggcgtggcgtggcggcggcggcattgcgcgcgcggcggcgaaggcggcggcggcgtggcgacggcggcggcggcgtggcgttggcatgcggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagatctggcggtggcagctctcaccccagagatgcggcggcagcggaggaggcggaggcggcggcgaggacgacgagctcaagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccccggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattacattggtacagactctaattaagatatgtatgtacatactgcatgatttaaaattaataaaaattgtactcatcatatgtacttagcgtaggaattatattaaattaaatgctaaaaactctaattaacatatgtaaatgccacatgcatgatttaaacattttagaattcgaatagtcatatataagtagcatatgaaagatagtaaattaaattgtgaaaaactctaatatatgaatgatagttttaaaaatatattacatttaatacttttaaaaattctccagtcaattataattagcatatgaatgatagtaaattaaatgttaaaactgtaattaacatatgaaattgccacttgcgtgatttaaaacttttaaaaatcctctagtca

SEQ ID NO: 98425 - DNA, 743 bp, Oryza sativa
atattataaaagtaatttgctgattttttatcaaaatataatcatgtgagatcttgttgtaaagatttaattgttacgaacacaacggtgtaatcggatgtaaatcggatgagtaatttaagagaaacttttatttgaagcatacatgataggaatatttgttctacttgcttgatcaattaataccatagtaaagcaagattcttcaagacatatctggacaacggctgattggatgatagggtcgctcattatgactaaatcgagagcgatctcgatttatattttacgttcggaaaaacattgtgcttcggaaaaacaaagaaatcaatgtagcctccatccgacttaggcagaggcgaagccaggatttatggttaggggagtgtgggcaggacgaagaagtcattagtcagagtaagcaataccgatgacaaaacaagacatcatgtgttctaccataaaaaaccttgaatttagctctttagttgtatcattgcatgtttgacagtttgagacttgaggcaccatactagatagcgagacgcaatgggaggacggagagacatgtgaagtcgaagcaatgaagacgaggagttgatttgtgttgtctctccgtctctttcttattaattaattatctatatcatgtttaatgataatggactaattaacaaactaatgcgctagttagtagggatggcaacggggcggggcggggccgtgttgggctggaacgcccc

SEQ ID NO: 98426 - DNA, 561 bp, Oryza sativa
tatcgacattaatatgatgcagaaagaaattaggaaaaaataaaatttaaaaatagccaaaaacggtgcggtcggaaacagtacccttaaacggaaacggcgcccggtcgatcggtattctgtgaccgttttcacccctatatgcaacatacaaaaaacacaaattgacttgttctgggtcagtagtgtcccggagattccacaaatttaggacaacgtgcctggtaaatgtacaaatgtaatacagtcagtttctttttaagaagtcaaacgtcaaatatattcccaagaaggattagttatggtattgtgaaacagggttggaggctgtctgctactctgctgtgtgtgaatgtttcacaaattaatgttgcaacaagtaggcatcgcatcaataattaacaattacatgaagaagttttcataacaagaattagacctacagagaaccaattgttactagccacaacaccaacaactgagctttgcaaacctttccttgtcaattctgcaaaggctgagcaaataacttgcgaacaagtgtggaactgtagaagggaa

SEQ ID NO: 98427 - DNA, 601 bp, Oryza sativa
atagtaccgatcctcttttccggtccacacacctaactcctccctctatctctttttttcctctctaacttcttatctctttccttatctctaactcccctccgctccttccttttcccttcaccacaatatctctttttttcctctctaacttcttatctctttccttatctctaactcccctccgctccttcctttttcccttcaccacagtgcaggcggccggcgcggaggtggccggcgcggcagcgcggggggccgcgcggcggcggcggtgggcggccggcgcggcggcgcgggaggccgcgcggaggaggcggctgcggtgggcggccgctcggcggcgaccggcgcggcgctggccggccggcgcggaggggaggaggggaggtggcagtggctgccggccggattttttttctttttttttgagatgtgaatctgtgatgtatttttgtgtgagatgtgaatctgtgatgaattttttagaaccctgtgatgtaatttttttaagagtttgtgatgtatttggagatgatttgtttgaggatttggagatgttatgtaatatgtgatgatttggatatgggaggggacggtg

SEQ ID NO: 98428 - DNA, 740 bp, Oryza sativa
atacaattttaaaatagttgaaattcagaattaaaaataaggaatattaaaagaagagtccgtataaaaacctaatacgagattaaataaaattggaaataaaaataaaaataaaatccgaaattagcaaaaaaaaaataaaagaagagctcaagtaggaatacaatttaaaattagctgaaatttagaattaaaaacaagcaatattgaaagaagaatccatataataacccgatacgagattaattaaaattcagaataaaaaaataaaataatatccaaaattagataaagtaaaagagatttcaaataggaatacaattttgaaacaactgaaattgaaaataaaaaataaaaatattaaaagaacataatacgatattaattaaaattttttaaaaaaatctgaaattagaaaaaagaaaaataagattccaataaggaatacaatttataaataactaaaatttgtgataaaaataaagactattgaaataaaagaccatctaaaatacatgacgagataaattaagtaacatgcatataaaggagtagagtggtggcggttgatatgacataaaaaaattgttaatgaaacaccaaatagaatcctaatgacgactaaaaggaggggcgacagggaggccgtaaagcaaacgatcaaggcgattgctgggacttctagaaagtaaaaaaataaaccccattgataatcatattcgatttttaaaatctcaaga

SEQ ID NO: 98429 - DNA, 644 bp, Oryza sativa
agtcaatatggccagtttttttcccagtatctcctaaactttacatgcatgctagcaataagttgtggtaatcaataggaattagaacgaacatgctcccaaattaacctggaagcaaagtcaaggagtttgcatttcttaatgttcttttacaaggtctaaaccggaaagcattagcttaactgaagcatttggggcactagttagactagttcttacctaattggtgggtatgtatttaatcaattaatctaaccaaaaccactaacatgagaccaagtcttacattgcatgaaaatgtgccatttggcagaatttgagagaatgattacaaacaatgaaaatacagactactaaacatcaacttttcatcaacgccgctcaacttgtgttaatgtattgtcaggacatttgacaacttacccatgagccaagtctttctacttcactggatgaagcagtcggtctctgctagttcaatgttggatacctttcaatttgccgagcatcttttctacagacataaggattaatgaaaactgtgacaggagccgttccaatgagtatttagtactatatctgtacgaactacgaaaaccagttctttggacttctagagcttactggaacaatagttcgaagag

SEQ ID NO: 98430 - DNA, 1260 bp, Oryza sativa
taaatgttgaaaagtgtactcagttactttagttcaagttttcaattagatttaacttttcttcacttgtgataaaattggggtttataatcaatagaatttaggttaaaaaaatttatacttttttggattttatattatttacttattattgcaaacaaagcactcaaagatacggcataatacaaaagataatttcaaaatttcaaaaatttactaataatcattatcaagtattttattttgttattttgagtttattctattatttagacaaagaggagggctttgagcctttgacacaatagggctaaggctgaggtcttttcagtaacttaaatggcaacttccttatttttcattaccatatttcccaaactgccaaacaacacattatgtacatttttttcctatataaaagtttctcgaaaaaattaaataaatttattttctagtttataattaatcacttgctaatgacacgtctcattttgcgtgctggatataaactcaaccaaaacgctgagtcgaacggcactgtcatttatttttttttagttttaattatcattaaatttgatcgtgcttaaatttggaggtaatagttagcaagttgtaaatttgcgtataatttagcaaataaccaacatatatatattcattaaaggcgtggtatagtagttctaactaaagatatgttatcaacaaatatcatttgcatcgcaagagttgttgaaagttgaccagcatattgaggccctctttgtttaagcttaggcttattgacttagacttttaagtcagcttattgacttatatgatttataagccaatggatttaatgttctaagtttagtggtggagtcatacatctacctcatataagccaaaaaaaacttctttaacctagcttttggcttaatagtgttaaagtgacttatggcttcaaaaaagtcaaacgaaaaaattgcttgtttgtttagacttagacatttccgcttataagttggcttataagcataaacaaagagggcctcagcactccggttattatatcacatttccaggttttaaagattgggtgaaattgacctgatcgcagcgcgagcagctagcgcaaattgttggactcatgacccatccatgcatgattattcagtcagtcagtcagtaggttcccagaattttctccctgcaaacagggacaaaaagcctctccaaatcgattgctgtcaaaattcagagatcgaattcagacag

SEQ ID NO: 98431 - DNA, 746 bp, Oryza sativa
ccccctataacttttattttcgtatttcttcatccgataaagtgttagtaacattgctaacaaaattgacatatctgtgttatagtttataaaacaaaatgagagatatgtgaattttgtaaacaatgttactatcactttgttggataaagaaatgaccaaaataaaagttatacaattttgttgtgatgaccttttcaattgaaatcatttaatatttgaaattgttgtctgaagttatcatattttcaaattcaaattcagactgttcaataaattttatatagagaaattaccaaaataaaagttgtaagtcttgataagttatacaactttgttgttgatgacttttctatttgaaatcatttagtatatgaaagttataaaagttatatcttttataactttcatattttcaaattcaaatacaaatagtttaaaaaatgttatatagaaaaatgaccaaaataaaagttatacgtcttgatgagttatacaactttgttattgacaattttcacatttgaaaccatttactacccgaaaatttatttgaatttcttatattttaaaattcaaattttatatagttcaatcaaacccgaatggagaaatgacctaaataaaattggtagatctcaatgagttctacaactttgtttttgacagttttttatatgagttcatttcgtatcataaaattcaattcaaaatttatttttgcctaaatgtctgatttgactcct

SEQ ID NO: 98432 - DNA, 745 bp, Oryza sativa
caaagtccgtccctcctccatttcataggatatccttgggaatatttcctccaaattctgggaaatccttttcctccatttataaaaccatttgaacttcggaaatttgtatcttgcaaaccgtaactccgattgggtccattcaacttccaggatttctctaaaatcgacatctatcaaatggcactactgaattgaggtgttttgtactttatttgtaggattttggatgtttatctcttattgaccgcataggtgatatttttgatatttaacgaacgtggatttctcaaagatattggattctaaaagcaaggcaaatcactacacatccctccttgagcatgttgaacctatctttataaatgtggtgattaaaaataaaattgcatgctatttataaactgcgtacctaaacttgaatgtaacccacccttgatattgttacatttatatatttgtatatccttgttgcatgagtctattatttatacgcggtcaattattgacattgctagcattgcattgtacagacaattatagataccatgtttattatatggatatggatgtgagatcactcgatgcgagtgattaatggtttatggctagagacatgagcgccacccgcgacacaaaaaccttttgcgaaaactaaaacttaataaaacaaaacaattttgactggagtggcatggatagaatatgggtggatctatgagcggctagtaaaaacaccctggtc

SEQ ID NO: 98433 - DNA, 624 bp, Oryza sativa
tgggttttctagcttatggcttatagcttatggcttagtttatttttttagattctacaactatagtttcttagaatctggaataaacactgtattagttgggagagtttctaattcggagagaacctgcaaacaggaccatactgttgctcttgaatcagtaatgatagtacaagcggataatgatcggggtttagagaaaatgaatgaacgagcttttgggcattggcagtgccacggcaaccaccgccgcactcccatcaccgtaccctcatccactgatcgttctaaatgccgcatcatgatgattgcacgccccaaacccaaatcgcacgggctgcacggctgcaacgcaaccaccacaaaaagccccccctgctccggtgggcatccgcatatcagcatctgcttctgcgacgtgcggggggtggtgtgcgcgagtggtgcgccgcacgttcgttcgttcgtgccgccgcctgccaacctgcagcccagcaacgcagaaacggacgtggcatattttcctccgcgaccgcgagcacatggacatggccacggcgacgaggcatccacgcatcacgtacgcacctgtgcaccctgtcactgatctatctactcgcaaac

SEQ ID NO: 98434 - DNA, 684 bp, Oryza sativa
ctccggccgcgacgctgccgacgcgtgcttctctgtctcgtctgcgccacaaacttgaagctgctctcaaccatcagcacctactagacggtcaccgccctcaacttcgcctacatcgtccgtgagttctgcgttagagacaaggtgattgattccgtggcctctccttttccgtgttgtggaatctcttcttgcttttggtttgcccggtgattaaatttatatctgtttgtgcaagtgctgctgctgctacgattaaatttgtcatcaaatatgtgcaagtgctgctactacagattctttttctgtttgtacgtatgcatcatgtgaatcgttgatttcgatcccgatggaattttcatagtgtttagttgtgctccaacagatctgaaattaaaaaaaaatgacaaaaaaacatgatattttcaatatgacttgtgcttgactaattaaggcaatggtactggtacattactcttagtgcatgaaaaagtaaagagtctcagttactaataagaataaattggacgactgaaagaaaaatggaaaaaagaacacaagtttcataacacaaataaactctagttttgttgttggtgaccaccatatttctgccaaatgtgctccatcaaaactgactttagacgtcgatgggttgttcgatcgcgaatattcatgtctgcg

SEQ ID NO: 98435 - DNA, 640 bp, Oryza sativa
atctggataaaaagcatgtccgaatttattgtactatgaagtgtcttctccggtactaaattggtatattatgggacagaggaagtgatatataaaccgtatgtcatcaactcatcatgttatttgtgtagcattagaaacatgtcaactctggcgctagcaattccatctcgcattgttaagatatttaaggcttagtttagtttagcaactttggtgagcaacttcctcgttctctcttcaaacggttaaacggcacgtttcataaaaaaaatgtatataaaaggtttttctaaaaaaatagaataaactcattcttcaagtttgtaatagctaattaatcaatgatcttccatgttttcggcactatggaaaatcttacccgagttgctaaaacgaactaaccctaagtatgacagcctagttattttcctttctagggtttataaacctcttagggccaggccaatgtttatggtaaaatgcataacaggagtgggcccatctacaggtagcaatagttaaggaaatctctacaatgatactgctttgttgatggaaaaaggtgggtccgctggccccacgggagaaaaaggatcagatcactcttaccatttgttgttcgcgcgagtgaaaaaaa

SEQ ID NO: 98436 - DNA, 681 bp, Oryza sativa
agcttttgatcaggttggcaaataaatacccaatagaaaaaagctctcataccctccctgataatgcccgtgtactataagagcaagcaccatcggtagcatatgttaccccataattgccaaagaaaaagaattaagtcccacataatagtacctgacagctatgcaattaatgtaacacttgctgatggatcaccagagttttcttggtggacccaaggttgcgtattagaaacaagtgtaccattagacatagacatcacttaaccaggccaatgatagcaagaaaaagaagttatagaaaattcaaatttgatcagcctgaatttttttttcgttttttccattctacttagataatgcaggcgtagggctggaaaacatggtttttcaccagtgaaatcaggatctatgtgggcaatggggaaagcaagccttacaaatcctaaaaagcagagtagcagagggttacgtaacctgtatgtatattcaaaggttaaaaaatattcagaaatataattgttgttgacaaacacaggatagcattagcggtacctattcttgattaaattcttaaagttacccaaagttgttgtattcatgaatttgggatttgtagtatgcaacgtatgagtttcttcattgctactttggggttaccggcatgcaacatactattat

SEQ ID NO: 98437 - DNA, 554 bp, Oryza sativa
  unsure (1)..(554): unsure at all n locations
gttattccctagttatatttctatatgcactatatactcctcttttaatattcctattttttaattccgaatttcagttatttcctaattgtatttctatatgaattctagtctcctcttctaatatcccttattttttattccgaattcaagctatttctaaattatatttctatatggtttctgcctttcttttttctccgattaatgtgagaatttctatgccatgagagcgaatgtgnaggctcctttttctattcctttaataatataactagctgggtggcccgcgcaattgcgcggctagcacccaaacaaaattatatatattttttatgattttactaaaaatttattaaatagctatctcattgtcttaagagtttgaaagaccaaaccttatcatccccatgtttctaattatatagttttctaaagtcacaccagatactaccccttatgttatctccttctttatttgcttgctcgatctaccactatttctattcattctccttagaaacttcaaacattggatcttataggttttagag

SEQ ID NO: 98438 - DNA, 576 bp, Oryza sativa
tccacaggatggaagattcccccgagggggctcgcacgcccgcgtacgtacgttcgcgcgtgcggatcccgagacgcgacgaatgggtcgagattgtgcccggcgcatcgcacggcgcgggaggtgggggctcctcgaggcgggcgcgcgcgtcaaacagaacaagaggcgccggcatctcgtgcccgcgtggcctcttcctccctccgcctcccgccgcaccactacttgccccccatatccatccataataaaagtacgcacctcgcgtccgcggccgcgcggctatatatcagtaccgcgcctacgcactcctctcctctctctcctgtgtgctagcggaggcggagcactacacggttaattctgcggttgctgctgctacctgcgaccttctagcaggtgcgtttcctcctcgctttgcctatatatatatccacttacatttctcggcttgatccatggattagtctgtcgatctcttccatgccatcgatctcgctggttaagattgcgctctagtgcttagcttgttgcagagccttgactttctttttcttgctaagaactgaataa

SEQ ID NO: 98439 - DNA, 559 bp, Oryza sativa
atagatatagatagatagatatctataatagatagatagatagagagagagagagagagatttgagctcggcattgacaattttaatgtggagaacatccaggacgagaatagtcacgtgcaaggcattgtcaacaaattagatgaaagtctgaaaccatgttactttgttgaaatgttaccgacaagagatacttgattaatcgattttcttttggccaagttccgagagaatatggttgtgcagcatatgaaatttggttcgccatatgtacaatatattgaatattgaatattgaatgctgcatcaagacacgggatgaatcatcacgattcttgagttacattgcatcaatatttttctgaaatgttcaacatctggtcctattttccccatataacagctggtaacgcacatcacgtatgaccattctggtatatatcatatatgtgggtcacttgatttttttttatttcaatactagagtgccaatcttctttatgtggtctgaatgtgccatgaagaaaagtatgtcatgcatatctcattgaaaaaagat

SEQ ID NO: 98440 - DNA, 587 bp, Oryza sativa
caaaggacaacctgtgctatccatcacttgaggcatgcctggaaaagtgcaagtacgatgaataggcacgcagccgactcagaggctaagtgctccgatgtgtgattgaattggacacaatatttactaataatcatatatccggtatatttgggaataacatatgtatatgttccaacagatatgcattttctaaatccatattgaagcatatgagatgcgtggtgcttatgtttaggagttgttttcataatcaacaaaatataattccatattttcaatgctagaataaatattgggccaaaagaaaaccaagaatctcatttcataaatttcgttatcgcacataaggacccaataaattgagtctatgaaaaagagttgagcatgctagtgggcgtagttgctatagcgacactagacgtgcatggttgcgcttcccatgcaggttttggttttgcttcacgtggcatctttagcctcccgttcaaagatctctacatatcagaacttcagttttcctgaaactttcatctcaaaatcacaaaactttctctttcaacatatgaaaacattcatctgaaaat

SEQ ID NO: 98441 - DNA, 661 bp, Oryza sativa
aagtcattgttgaatcgccatgcatgcttgcatcgatggtgtggcttgccacgtatggtgttagtactaagctttgttattatctgcaccttttcggaactgtatgtgcttctgagatcaagacgacgttataagatcaaggctcagaccccagttgagtgtgggctggtgagtggacctgtagcatcgctaggatcgctgtattccggtgctgtcgcttcttattggtgtgaggactaagagcctattctgtaagtatagcacgcttaatctatgtttgaggaagtgtattacgttgtcgttttgtgtaccacgtctggtcgtggacagggattttatacacaaaataatgtggaaatatgggttaaatttctgggcgtgacagcttgtcagattcaaggccatacatgtatggtcgtccattagcttcaatgatttgatggattatgtgagagtcatgtatcttgagcggaacctctgccaaggaccacatatcaaaggaagcaattaatatgtccattatctctaggtgttcaaaagacccaagcatgtgaaactcattgcatagtgtccaccaagtaatacgcggttttagactattgcctcacacgtcaagagagtgggtacaagatgggcaacggagcatcctgggctgcaggaa

SEQ ID NO: 98442 - DNA, 565 bp, Oryza sativa
atttgagccggtcgtgggctttttttgtgcgatttttttatttgtgcggtttttttaatcttcttgtttcgttttctttttctctagattcaatgtccgattggattttgtatcggtatttgaatttgtgcaacatccgctttatgtggtaccggcgccacacgtatttgaatttgtgcaacatccgccttatgtggtactggcgctgtggcgcgacacgagtgggaacggggagggagttggacaggaaaataacacggaaaaatcgcaaaaaaaaaagatcgcgaggagggaatcggacaacgtacgaaaattttttggcaaaaacatcttaaacttttataataggtaaagataaagataagctactccatgtattatatactccatccttttaggttataagatgactgtttcaaatttgactaagtttgtaatttaactaagtttatagacaaatataataatatttataatactaaattagtttcatcaaatcaataattgaatatattttcataataaatttgtcttaggttaaaaacgttactactttttctacaaa

SEQ ID NO: 98443 - DNA, 658 bp, Oryza sativa
aattaacttatcaactttccaatctttaatttagtcagttaaggctctgtttgaatctcctgaagataaaaataaaaataaagattaaatgttttacgtaaaagataataacttatgattaactgagttttaattattataaatatgaaaaatagattaatctgatattttagaacaactttcatataaaaaattttcgcataaaacgtaccatttagcagtttgaaaagcgtgccacgaaaatccaaaacttaatgttcactttgttgggttctcgaacagcgcttacacccacaaaataataaagtaaatttcatccataatcccatcatccaacagcgctttaaaacaaattatgccataattatttgcgagacaaacaatatttagatattccaatcatcaaacttccagaatcatcacaacaaacacaatcatcaaacttccaaaatcacatttccttcacagtcatcaaacctcctttgggtgttcctctagaagtaacagaagtatcaaacaaactagatgcgcaggtatcaaaagtgctcctccagaagtaccaaagagtaagtactacaaaatggggctacaaaatccggagtcactctcttttgccctgctgaggagcccatccctgtgactgcgaacctctcactcg

SEQ ID NO: 98444 - DNA, 590 bp, Oryza sativa
tcctgcagccctgatttgatttgtcatcaaatgttctttaagcataacataagtatttttgtatttgtcatcaaaagctggatttgttgcaagtcagtgagcggctccgtcgtccggcttgccaatgccagaaattttgtctggtaggcagccaccgaggaggcctgatatagccgcttcagttcgcccagggcattgcgatggattggcggcccaaattgggcatggcacaattccttgaaggcgtaccaatctgggggtccgtgatgctgctcgtagtgaaaataccattcctgagcgtcaccggtgagatggtacgtggccagccatacacgatcaccatccggtgtcttctgtcctcggaagaattgttcacaatgattgaaccaattgaggggatcgtctttgccgtcatatttgggaaattccagtttatagaagcgaggaacgcccgtgccagaactgttgtcctggggcgcatgagaccgtctcgtgaacagcggtggaggaggcggaggcggcggcgggggcggcggtggtggtggtggtgggggagagccagatgatggtggtggtggtggtggtggtgg

SEQ ID NO: 98445 - DNA, 717 bp, Oryza sativa
attacatctatataattgagcgaaaatatgttttatttatattagacataactttttaattatagggcatttggcatttcaccatagggccccaaatttctagagacggccctaaaaaatagtaccactgcacctttcactctctaaaaataataccgctcatgaacagatcatgcttttgaagttttccaacctaccaatttcatgtgttgccttggccaaagagcccacctacttcctaacacctaaacttcaaataaaattttctcttaaattactaatctgatatacaatcagattgtatcattatgttcattgcaacttaatttttataacaagatctcacataattatattttaatggaagaagaatatgtgtagtaaattacttttgtgtatctataaattacttttagattggattagattacttcttagacattctcataatattgtgaatatgttacttttattgttgtttttagttagttctataatttatgttgattcaatttaatttctagatagacacatgtttttaccaccacaactgatttactttaaattttaataccatgataacttacttttattttgtgttaagttacttttataatttgtgtgaattattttcaggctttattgaatttactttcataaatatctaagaagtaatttattcaaatctaaaagtaattataagtagttatatttaga

SEQ ID NO: 98446 - DNA, 667 bp, Oryza sativa
attcctgcagcccatgcctcgtccaagctttttgttgtcacgctgccaaagaggacaaggatttggccctgcttctcttcttcttccttcccttcttgcgggaagaacactactactattaccattaccattaccggattatttggcaaaccatggaccaacttggctttttcaaggtggaactggctgaacccagttaacccacccctggaaaagggcaggccctttatttgaccaaatgaagatgggaacctaataattggacaagtttttcaagggcaattttaagggaggaaaacacaattaggtttggaggggaaataacttttgacattggtgggaaaagaaggggtgggttggtctggggcctaaataaggattaccaaattttggcaatgccaaattttggcaaggtttggcatgactaattttggtaagtcaaaattggggttggattgaagcccaaataacctaagttcactattgaaatggcatattttcttaagcatgcccaaatttggattcaaaccaaatagacactaaacactgttgaaattggacaaatattggtaagtctaatttattcctcaaaccaaaccaccccgagatgggttgggtaggtgaacttgtgaacagtttggcctgcatctgcattggtaggggccta

SEQ ID NO: 98447 - DNA, 2590 bp, Oryza sativa
atcggtaaagagccaattaacttggctttgagcatgtgtagtttcacgtgcggcaaaacaaaggtaaatttaataagtataagtgggagacaacttattatagtttagctaatcaattgatcctaacataccactaccagatcgattaattcattctagtgatctactctttctccatcaaaaaaaatcaacctagtattagatgtgatatattatagtactatgtacagtccatatttatattattaagatatgttaaatttaaaagtatgttagttttttatagaatggagggagtatagttcagtgggagggtagatagaatatctaaatatataccatccactacgtactcattattgcaggtgccgagcttgccctatcattttcagctagtgtggcatgcataattccgaccataaatatcacgttctaattcgtcattatattcgatgacaaaaaaaaaacaacaattacttgcgtgtatataccaccaatgaactgtgtgcttgcgatctaggagatggcataaatgaataatgcctgacgtgtgtatgatctaaaaagggtttaggatatttctttgacctacgtctcaagtcacaagagagatcacacatgcacattcttttggcataattccaatctttcgttcacacaagtacgtacggtcagaaacacaaacgttgactcacccactaatatttcagctgcgttaattaattatctgcagcacactctacaggatatgcatatgcataatgcatgcactacatcttttcttgaagattaggatgcatcggcatcttagcttaattgtttgtactcgtcatgttcttgtctatctctcttcgttttcacatgtgtcaattttctttgcagggtgttcacaacgcatccactaattgttatgtgattgaggtgttgaaatgactgaccacactattctcgatcagatatgatgcaaactttaatctagcgagggaaatatataatgaacaagttgttggatacgtacccccccccaagcgattagttaaatcatcatgcaacattttacaatttttccaagatatactggaaacaatacaactctataacaattcaaaaaatgtctggcaaatatcaaagaataactgtcttaatttgggagttccgcactaaaccaacttacctgaatgatggttcctcaatgggttgggttgctagactcgatcgatcgattaactgcaccttgtaaagttttcttctttttctttcctcccttttcaagcctctgtatccttttgatatattctataacttctctctgccttttatacgttaattagaaaaataattgtactttacaatgggtaaaatgtattggctttcactttacactactttaagctaggatgtattgaaatatgttacattcaataataccagcatgtgtcatcaatcctatagaaatctcttgaaatttcataaaatctaaatgaaacttcataaaaacgtggtctaaattcaagaatgttcataaagttccagtcatattttacaagatttctcatagattatacgaagcaacatggtacaaagcatatactaacttaacgctgatgcaaagtgaaagtgtgtgcttaacctatgtaacgtgaaagactgtgttaattttaaccaatacaaagtactctatttttcacccatccaacacacataccaatacaaaagccaaaaaaatgccattcactttattatatcttaatgcaattaccctccactttatctattcttaatatatttgtcaccactttcataaactccaatgtaacgattgcataaaaaataaagttattttaggacgaggccgtgcaacttactcttaaaaaatgattgaggagtcccgcttgttcaaattgaaaattgtctatgtatgatgtggtattatcatagacggttttgagccatctgcaatctaataaactaaatgatgcatcgcactttgctgcaggatatagttagatattagataaatgatgaaatgatttatattgaaatattatgaaaatgatatcagaatgatgatttagcacgtgtatgtttagttttagaatgaaataaattctagatataattactatatgcttgcatgttgagctttgtgtgtttaatggtttgatgtgacatgcttacatgtaggttttaggagtgctaataaaaactatgcttacatgggtctagatcccctggagttgagtataactctaccgggtggagttggccaaatctggagttggccaaatctgtgccatccattgtttcctacagctgagatcattcctcatcaatttcacctaataaattaactccttaaattaatggttatgacttccgaggaaacttaatttttttccatgcatttcctctataatagcgatttgattaaattctcacaaaaaaataatagaccagtgttttgttattgcccaaacaactgatatagtccatcaactctaaagcttcaaggagtgcataccaacatatatagtgctttcacatataatgagccatatcaatattaatgtgtgtgatttgggctgcagga

SEQ ID NO: 98448 - DNA, 660 bp, Oryza sativa
ctgcagcccctgatcaatatggaattttctgttttccaaaatacgtaaatcaaaagagaacggagggagtagaactttagtgcatgacctaaaaagagtaaattacattggcggtacacaaacttgttaggtgggtgcaatctagagcataaacttataaaatgtttgtgttggtgcatgaacttgtctggtgcgtgtaaaccaagaccaaaaggacacaacaagactaatctcatttatttaagtgctgattaggatgcgatgtaaacatgcatgtgatatatatatgttcaataaaaggtaaaataaggcatgattgttgtcaaagaaagacataaaaaacctgagtaatgatgcaagggtggaaacaaaaagaaggttaatgtaagaaccgagtttataaatatagcatatctcatgcccatctcatatgtgcatatcacgtcctaatctacatccaacctggtaaaattagccatgctacgttattttggtcttggttcacaaccactagacaagtccgtacaccaaaacgagtattttaaaagtttatgcacttgattgcacttacctgacaagttcgtgtaccgtcaatgcatttactcaactaaaaaagtctaaacattttggtggttaagagctactaattgagagggcata

SEQ ID NO: 98449 - DNA, 575 bp, Oryza sativa
ccaacagtttggtgtgtacggatcaccgaacataccctaaacaaagaacacaaacaatatatgcaattcaatcggtagtacatgaaaatggtttgcatcaacaattatcatttaagagaacatggtgatgaactcaaattaatgttatttagaattttagattaatggagtttcatagggcaatcaactgccacaaaatgggaagggtttacataatactatagctcatttcacttctaccgatactgttacagtatatggtccttgaggagttgagtgcagtgagatctttttttttttgtttactctaccaaaggcccaaaatttgaaagaagaaaatgttaccacatatatatactgctccctccattccagaataagttaatctagtactcaatccattccaaaatataagcatttttagcatagtgacaagtcaaacattttaaactttgaccattaatagcaaaagaaaaaagatcaatcatgtaaaattgatgttactagatttattattaaacaaacaattataatatgcaactctttttatttaaaacattttacttttatagata

SEQ ID NO: 98450 - DNA, 628 bp, Oryza sativa
cggtggtttggaaggcggttttggctaatgtggcgcttacgtggctggcttgactaggtctttgtcccacgtggcattgacgtggcgcttacgtggcaattctatcccagaaaaataataaaaactgtgggcccacatgtcaattaccccaaaaataataattttaaaatggtggggcccacgtgggccccacatgtcagcctcactcctcccttcatccctctctcttctctctttgttcttcctcatcctcactcccctctctctcttcttcttcccggggagtgccggagcggacggggcgggtgggcggtggagcaggcgagcgaggcgggctgtccgagctccggcggtgggcaacggcgccagcgacgggagcctcgaccgggggagaggaggcgccgcggtagctggagccggggtggtcggcgcggcggcgggtgaggtggtggtaggcgcggcggcggagagaagctgctgctgcatctccagcatgatgcagactctgctttccggattgcttgctattggaagaattgaggagtcgatcgactactattggaagagttgagctagataacttatcactgacagttaagctatagctattttttttctccatatctga

SEQ ID NO: 98451 - DNA, 712 bp, Oryza sativa
ttacaaatgcatgcatgctgtagtaataagatgtctttgctttaatttggtttctctaatttcgatcttcttctaattaattaagtaatagttcctgatatgcatgattaatataattaattcagcacatatatacattcattctcgattaattgatacagtagtgcagcaactatgagtgagtatcagcacagtgggttcacatattaaagttgtgggctgaacgaaaaggacgacgtacttttagttagttgtatgcgtgtgttgtaaaagcgtatctactccaatatttttcataattacaatcacggtacttcgattctgaacatgaatatgccaacgaagcaaattaagcaactcagggaatgaaatgcgttgattaattttctggatttgattaacattgtatactttgattttctatgatttcatttcggtgagccacatacgcatgcaacaaaaatgtgtccaatcatgttaataactattggttgcagtaagtatagctaggacgactgctataattaaaggaatgctagtatgtatatataacatgatatcacataatctaattaaatagaaattgacttaggtagtcgtatctttctcaagttatgatgcaaactccaatggtttttggctgttacaatggcggtgaatgatgttttaagctagaaatatcccccaaattactcctttcagcactagagta

SEQ ID NO: 98452 - DNA, 699 bp, Oryza sativa
attgggtaggttgatccctgtgcatggcacctgctcaatttgatctgggagggatcgactttcatcaatattttgagttcattctagttttccatccctgtgctttgcttttgacgcgatagagtggagatggattctaatagctcgagtggatgtccatccgtttattgcatgtcaactacttaattacgaaaaattttcaaaaaaattgacaacatagattaatatgtagtatatcactctacaaacatgtaagttcaaattcagcttctacaagttgtaacaaaaataacaaatttaattgtaaatatacatatagtaatttgagttttgtttattatttttgttacaatttgtagaagttaaattttaacttgcatgtttgtgtattaatatattacatattgatctatcttgttcttctttttttcaatttttttcataccatttaaatgacatgcaataaatgggtagacgttcactcgagctgttaaacagtttcccgcgataaagttaattaaatgcatgaacaagttatatactgggagccggtggtctggttagatgtggtagcgctatgaacgaagcatataatagtcggcagggttaggtcggggtgagaggtcgactcgttaagataggaggtggtagatccagcagtacgtggctctaaagatgggaaggcaatgcactgtgggg

SEQ ID NO: 98453 - DNA, 637 bp, Oryza sativa
ctgctatcgtagttcctgcagcccactgctaaaaaagtctccagcttgaaggagaatttctcgcgtgttggtaagccattggcaaagcccaggaggagagcatgccgctttggtgatgatgacgaggaagaacaacggacacctcctcataaatcttctgttaaatccatccccatgcgtggagtccccacagagaagttccaatcacagacaggggttcgtgggatttcttcatcccaaattggcaatgcttctgcaatgaaatttggtgtggcaagagaagagaaacctaaaagcattgggaggtcacctgtggagcatgagccagattatacttcaccaaatcaagacaaaatgcatggtagactacagataatggggaaaaggtcaaccacaagctcggttgacacttctgctagtctgggtaacaaaactaacctggcagatcgcagatcctctgggcaattaagaatggcagcatcctctgaagtgaagaaaacacaaggaagttcttctaaactattgcaccagacaccggggaacttgcactctcaaaaccctgatgactcggaaaagaatgcactgttgtctaaatcggaaaacagtaaggctaagactaaatctggcacacagataa

SEQ ID NO: 98454 - DNA, 673 bp, Oryza sativa
tgccggtaaagatcctgtcaaataattttgctgtaaattcctgaaagcacaacaattaaaaagcaaaaaataagatatttgaacttgtatctgcagaatctcttattggcaggaaggaagcatcatccattacataagcctttcattgcaatagcaattggaagtagcatgttaaatgttaccaaaatgatatgaggcacaaatgcactgaagtgaacggtaccaatagtggggccttgttgaagttggactacatattattataactactgaaggcaacatatatatgtacttaaaaaaaggcataaaaaagggaagtaaattctgatgaggaattgaacctcctgaaaaccaacatctcaaccaaaatactccctccatctacttttgatagtcatattttatcttggcacacagaccaaggataagtaattatacttatcatccatttaaacatgctactagtaattattttatcgtttgcctggtaactaacaattattattcaaaattagatgggattaattaaattaatatttactgcagaatatttttcaaaagtttgacagtgattgatagtgatacatattaatgtgctttatcatcaacacatacaagttagctagataggtgagattctccagttctgcaagtatcggaccgacaacatcca

SEQ ID NO: 98455 - DNA, 544 bp, Oryza sativa
actggttgactgatcctgagcatctctcatctcaaccatgatgatgacgatcacctgtgacctgatgagcttcttcctccttgactcctggttggttcactttgttgaacaacagaatgaccagaagcagcagcaggaggaggaagaaagcaaaccggacactggagacctcacatcaccgagcagctgtttgggttctcgtcgctgaagtagttgtagggatcggcatgcgggtggggctgcatcgggtagtgcatcgggtacggcatcggcggccggccgtacccgtaccccatcgccgggtaccccgccggagcagcgccgccgccgtggccatggtgaccgtggtggtggccatggccgtggtggccgtggccgttcatcatcatctgctgctgctgctgctgcatcatggccatgtactgctgctgggccatggggttgccggccgccgccgcggcctgcagcatctctgggccggacggcatgccgccgccaccgccgccgccgccgccctggtagaacgccggcgttggcatgccct

SEQ ID NO: 98456 - DNA, 664 bp, Oryza sativa
tgtgatagtagaaatgccggcatgtttgcaatggaaaaagatacaattgcgtatgtaaatcgggacatgtttatatgtgtttttaagtgagaccgtcataaattttaatatcgattcgtcagttccaataaacatattgtcatgggcggatcacccaaaaaattcttagcctaacacataaatatacgtatgtgaaaagaaacttttgaaaaaacgaagaaaaaaggctcgtttttaatatattatgatgcatatttgatccatttatacttttagctttgttatatataagttggatcacccatataaaagttcgagatacgtcattggtattgttaaatctattattaattagtcattttcatttttaagggagtattgtttccagtttataaattaattacatttgaggtcaaatagtagtatttttttacctcaacaaattgatagagaaatgagaaaaataaaaggaagagaggtctggtagggaaaaaaaataaagaaagaaagcagagcacgagaacagataagtcataagtccccattttcactttctccttcactttccccaaatccatccgctctcatctcgtgtcctttactcctgtctagctgtctcccccgattcaactccccacgcggccacctaaaacatgggggatcc

SEQ ID NO: 98457 - DNA, 591 bp, Oryza sativa
ataacctaaccctgtaaagcatgaatcatgtgccaagaacagctaggttactgtttagttggtacgttacataattgcattgcacttgtataaatcttagagacttttagcaactccagaaaattggacagatttatcagaactaattgtcggtactatcgtcaaaatcaacgggatatgacataatatgctgtcatgccataataatcccgcctaactgcttacaaactactccagtagtattgaagtgcacactcgatagcacttgattcgagcattcggggttcattcggcaaggtgcaaactgcaaaatgatttgaatttgagatgaatttggcgtcctcaagagactgaatctagtttaaacccaaaccggacattttacaaccaaaggcgcctaattttccgaatcccataaaaaagcacatatatgctacgattccgcacggggattcaaaacaacagcctgccgaaccaaccgatccaactcaccacaccaaacacaagacagacacgcccccagggtgtagggagtgcgagagaaagcgggagactcactcaccggaggtagaatcggcggcgggtaccggg

SEQ ID NO: 98458 - DNA, 520 bp, Oryza sativa
tgcatcgtattcctgcagccccgcttaatcctaaatatatgcatggtttgtttggttgaagaagagtgaagagacatgataggtttatccaatccatcacctcatccctcaaaagtcaaaactagtgacagccagcccacaagaaatggtactagcaagcaagcaggcagccagcagccagctcagccagctagcttagctagtccgcgatatctgcaagagtgtcatccgtacgtgcaataatatagcttcgcgcccacagttctaatcactgcatgtctgcatgcaaacctttagaacagtagtagtcaaaaacaagtttgcaaacaattagaacaaggattttgaaacctgttcgcctgcagttaacatactgcaactctgcaagcacattgatcaatcgatcaatccctccttccccatccaatcctccctctatataaactccaaccattcgatcccaatcaaacacaagctaaagccatcctcctctactgaaatctctagctactactactgc

SEQ ID NO: 98459 - DNA, 932 bp, Oryza sativa
attcctgcagcccggcgtatgtggggaggagcacgtggccttatgaaaataatccaacaattctaggtctcggtgtagattgtacaataaaaaagagtacactataaattcaattgatatttttttatggaaaaagtacgaatgactcccccccccgaactatgaggtcgaccgattttcatatttactgtccataccctagattgtactaccttcaatctggggcccacactcttgaccaccctatccaccttataggatgaaatggaattaactacatttagtatggaccaactgtatagatttataagattagcgccggccccatcttgtcattgacgctaacctatatccccaatcgcagagctgtaacaggccagcacctaagcccctccattgcaccatggtgccagaaacatcgagctgttgatggccctacttccaagtctacaatgtgtgccacacggtccgcccctatgtgccttgccatcacttccaaccattggctctaacaacacagccctctggctttcactagcatcttcatccctaattcgttcatgccttcgtccacatcctccacgaacgaaacataaggaggtgattaatattcattatttgcaagttaaaaaaagaagaagacaagagatgggacttcatagctgctttttgagaggtctgcatacgctacgcaagcgaaacaaccgggactatccaaatcacatatatttatagcaattgtataaaagtccctcggcgaaaaagtcaaccaacgatctccatgctgcaccgtcagtccatgcctgttatctaaccccaggcgatataaatagatgtcatccacatcctccataaacgaaacatgatgatgtgattaatttttattatataagttaacaaaaaaagtaaagaagatatgtgaatgcattgct

SEQ ID NO: 98460 - DNA, 660 bp, Oryza sativa
ttagcaacaaactaattaaatatatatattttttaacaactttataaaaaaatgacatggttgaaaatggcatcaaagtgaacagacgctaaaatttagttcgattaattgaaatagggaggctaagcagtacttgacttgtcttgtccaagtagctcgcgaatttgcggagctctgataagcaacgagaggagtaagtgagattcgatatatatgtatacatatatatacatatatatgtatatatatatatacatacatatatatgtatatgtatatgtatgtatatatatatatatatatatatatatgtatatgtatgtatgtatgtatgtatatatatgtatgtatgtatatatatatgtatgtatgtatgtatgtatgtatgtatgtatgtatgtatgtatgtatgtatgtatgaaaataatccacgtgcagcgagcaaccagctgcaagcaggcgcgcgcatacgtacttaaatatcaacctttataaagttggtccttaacttttagctctcattaaactaagaaaatcgctgtcaccagttactatggatggtagcttgagtttcaagcacacatttgagatgctgtcccatgagacatgacatgtgaaatgtttgcatgtggatcaccctagctaggataaatgagtttt

SEQ ID NO: 98461 - DNA, 1680 bp, Oryza sativa
aggatggagacagatatcctcaccgtcctcccagcccacctccacactcttcctctactcctcgccgaggagagaggaggcatatctaggcaagcagcaaaggagaggggcgatggcaagcggagtggcaggggcgaagcaaatatggactgccagatccatgacaacagagatgagtcagcgatagcaacaagggaaggggtgcatggtgaagagcggcagtaaaggaggcggacctaggcggcgagagatgatcagattaatttgggctaccagattcatggctcggcagtggcctggtgacaacggttctgggataagggcggtggtacgaagaggaggggcgtaaggtggagggcggcagtggaatgtgagtcgaggtggtgacgacaaccgctcctagatctagtacagtggctccacaacgacgaccatgactagggatgcgacaacgatctcgacctcaatcatgacctgttggcttctagtgacgacgatcgcgatcgctaccagctacgacgtaggcggcaagcgctattttttcccctgaaaaattatcttcatatgtgggtgtcatagtgactcgcttgcaaaaatcaatgatttttacattcatttggttagatacgggccgtccgtatggaaaaattatttcctagtggagtatatatgattaatagatatatgttagctttatcagtgatgggtagtacgctttctctgtcatgaaatgattaagaccacaaagatcttctcctgcttgccaatcttataaaatatatgtaatgctttacgtggcccattaagtagcaactttaataagtacgtaatcatggttacccaatatttgatgtttagattaatgtctgaacacgtatgaacaaaacgggtacacgcacacactcgagttctttcggccgtcggcaaaatgtccctttgcaaaaccgcccagattatactactactatagtcctagaccatacagatgatttggaaggaaatccactaaagtgagcaccaatcaacatatttttgcatttatcggtctagcttctctcgtgttagaaaaaaaaaaaaaaccaacgtcacgactgctgggtgcgcatcaaaattaaactttggatctaaaataaaagctattaccgataagtcatccgtaatggtctcaagacgataccaataaaaggtgaccatcacatttttttggtttatagtacgttaccatgtatcacggatgacttatcttcaggctttgatttgacttctttgttgggttaaaattattagtgatggtcttttatatcggcctgagacaaatcactgttatcggtgaccaattatccataacgcggcctgtcggcgatgcagatgaaggttcccgtccgacacagatattttttttccacactagtgtctagttctgtctcgagttagcacttcatggccgaggtgccttgcctctctaggttggattcatcatcatcttcttcttattttttcaagaatggcaacaaaagtgtgtatcatgctagctaggccaatcaactttggacgtatacacgcgactgcattggcagtggcactttcattcgtttgtttttctcttgtgtgctttggcggcgttgagaggtgtgttgctttggcttctttgcgttgggggcttttctctctctctctctc

SEQ ID NO: 98462 - DNA, 990 bp, Oryza sativa
gattcggtgacattcccacgtgacattctcggtgacattgagttactgacaggtgggtctaggcacagacccacctactcgctagtgactgccaagtgctaactacttttgtttaggatcagagcaacatgaaatcttcatttctttgtcgatgtaaacgtagcaggtttaatctttcgatgacatggaaaagataatacaaaaatgaaaagaaaacgaaatgctgacagctttgacttttgatagtgttacttcatttatactccataaactaaaacagaaaaaagggttgctgtaaagtactctacgtctgttttttaataaatgacaccgatagtttttttttttccttgaactaaaaccaacaatatttattcaattagttatttaattagagcgaaaaaaataccagtacattcgtcatcaaaacactttacacatgtctagtatgtttaatctatttgcacaaatattcctagaaaaaacatggatagtaaacaaatttaaaaagtcaactcaatcatatattaagaatcggaggttgtaattggtaagaaaggtaatgggatgactggagtattcaagattcaaaatgcaaactgtattccttccgtaaaagctaagcacgaatttgagaggttgatttctcatttgaattcatgcgtaacacagtagcatgtggtctgcacacgattcacaccaattgatggcttgatgttacagtaccttccaagtctttttctccccttatactagcaggttagcaggttttccttccaacagtaaacgataattgttgttacatgtactactccaacagtaaacgatattcgatattttggagtactatttactctctgctccaatgaataaatcaggacatcaggtgcgcctcttatatactcctatataaaagaaagctcagcagagagaattagtatagcaactcatcagtaatcattggctcattgcaggagcaagaaccatctt

SEQ ID NO: 98463 - DNA, 643 bp, Oryza sativa
aaaaatttctttcaattaaaattgcacgacattgctaaaccctaaaattgctgcaattttatttcactttactgtgattttcttgttatatatggttttactttatttttatgtatttggtttttttcatgtacttctgtaaaattttattaattataagtttgtttcatgtcatttgtaaatttttacatgttagaataatttattgttcaatcatttgggaatttatgagaaccataagattattagtatcatccaaggatgagaaatgtaactgtatttttgaaaaatccagacgcctgaaatgtccactccctgaaggaaaatgtaagcaaatttgaaatcactacttaagagcttttgcacgtagttttgtaaagttttattaattataagtttgtttcgtgtcatttgtaaatttttatatgttagaataatttatttttcaatcatttggggatttatgagaaccataagattattagtaccatccaaggatgagaaatgtaactgtatcttttgaaaaatccagacacctgaaatgtacactccctgaagaaaaatgtaagcaaatttgaaatcactactaataagcagcttttggaaagtccaaaaatatagtggaccgtagagactcccctct

SEQ ID NO: 98464 - DNA, 873 bp, Oryza sativa
tggtttggattttagatgtgattaagtagcctcaactggtttggtgaactgtgtataatggagatggggtgggttggatttggattggatttctgcccattagcaggctgtgacaagtcgattgactggacgaggaatagtaaccctgcacattgtgaagttcagatgatgttgcgagggtccattttcagcttataggtttatgttagcagaccagaccatgtcgcactgaattgccatttggcttacaaaaagtgggcaatgattaattatctattagtaatgtgttaaccaggatagaatctcattatggtgttggctttatatctttggtcgaaaaaaaaggggatataatctcatatttttctttttcataccatattgagttttgcaagggttttgtgcaccgaggattagtttagattaccagaaatcaaattaatgagaggataatttagaactccatagaattcatctgaaaatcatgcaaatttcatgtaaaacttgtgttccaaattgaccttgagccccgctcacacacgccctgccgtgcacgtcgtgatacctgtttttacctgtcaaaccattcactttcctgtcatttcggcctatatcggcctctatggtttccaaattccaagtctcctgccataaccaaatagcccccgattggccaatcatttagtgatcgtctatgttggttgacttgactcggtacaaggtaagctggaaacacatgaacagtagtgcaaggtaggagcacgaaacacccagcctcgcggttgcggtctccggcgagtctagtattcgggagtctagttttggggtgaattcaattgaggttgctacagtttaatttgtttattttatcaa

SEQ ID NO: 98465 - DNA, 522 bp, Oryza sativa
tttgtcgatttttgggccatatgatttgcgtggagatttgtgctaactaatacgatggataaaagagacaagtctgtgcgtagcgggggatcgattccaagagcactagttttccctgttaaacgtacaccacagagcaattaagccaagtgggttcaagacaaaataaagtttatattgaagttacagtgttagaaaactaaaattacaatgtaattatactatagttacatgtatgtaaatatggtgcaattatagtgtaacaataatataattaaaattacagtgcaattatactataattacatatgtaactatggtgtaattataatgtaacaacaatgtaattaaaattacagtgcaattataccataattacatatgtaactatggtgtaattatagtgtaacaacaatgtaattaaaattacagtgtaactataccataattacatttgtaactatggtgtaattatagtgtaacaacaatgtaactttagtagatggattggtaatatctttg

SEQ ID NO: 98466 - DNA, 775 bp, Oryza sativa
atcccgtaaatcaggaaccatgcaagtattagatcatagatcgttaccactcgacgtgctgcgcagcagaagaagacgctgagaagtcgaaggaactctcgcgaagtagcgcgcgtcgatgtagaggaagtagtcgatcgcaccggctcgaccttctcctcgtgcgttctcctcaccgtacttccacgccgatcagcaccgcaaaccagcggcgcctctaccggtatccacacgcatagggacggaacgccacgcgtagatgtgctagcatgcacgcgcggctagggttttgctcgggaagggaagtgacggctagggtttctcacgtgatgcaatgcctccgccggtcacacccctcacgaatatataggatccatcactcgggcctctaaggcccgtaggactcctattcggatccctatccgaattaagctcatattgggtctctatccaatccccttattccggcccattaagcttgcgaccctgtaggttcatatatactcggttgtaacctaaaaactcattttcggtccacgcgtcaacagcggcccctagcagaacgtattgacccaccgggtatacataaagatcatatcggctgaacctctagtgtatacttgtatgaacccctttgcctcacgatatcgattgagctcaaggctaaatatgtgacattctctaatagctcaatcattcactcgaacttgttgatagattatataacttgtgattgactcctcaatcacctttggcatggccatgcacttccata

SEQ ID NO: 98467 - DNA, 514 bp, Oryza sativa
agctacaaaatcttcccatagattcaaggtccggccataacaaaaagtaaagtggatatagtgtacgtatcatccagcccagattttcttccttaaaaaaagagagaaaaaaattagtccgttctactgcaacctttgcaacgacaaagtcaggtcgtcagatcgagtaactaattaatcatgcaaatatccactgatctaaaacttcgccatcagttgatcccttcacggtttcgactagcctgcgtccgcccacaaatatagcgaaggaatcacacattgttttttttttttgatgcgtcacacattgttaatttggactttaaatgacatgacatgacatggttacaaaactaacacacgttcatgcgtgcatattacttacagaataatccaagttggcatcaatgggttaatattctgcaactcctgcattagaatatgatagtgtattagtgtgcggcgacgtttatgccctggctcgcaattaccttcaaactgatcacaattatat

SEQ ID NO: 98468 - DNA, 630 bp, Oryza sativa
accgcaccatcatcaatgtcacgtgccaacttctactttttagtacactatgttagtgtatatttggattaggtaactcttgtttctatatcagtatgacagtgttgaaatatacaaccatcagattgacagagttttgatcaaccatgcgtgccatcatgcctaaagttgtttgagcaatggttttctgtttcttttctcatcatttcgggcatgctcctgttggatgctcttgttggtcctcttgaaggagtcatgagctgactgattaaccatgcgtgcagtcatgcctaaagttgtttgagcaatggtttttctgtttcttttctcatcatttcgggcatgatcctgttagatgcttttgttggtcctcttgaaggagccatgagctgacctactttcccgcttgccacatacagatggcaactttgatgatgagtactttaagggaacagaagaatcaaatcagtttcgtcgggaatatgagatgcgcaaaatgaaacaggtaatatattaattccccgaacacgcttttcttccttttcatttttggctactgctggaagtgggatttcttatgtaaggtgacctgtgtatggaattgaaattctgcaggatgaaggtttggat

SEQ ID NO: 98469 - DNA, 551 bp, Oryza sativa
gttattttttttaacggaaaacaacacgagtgccttttcattgaattgaacatgagaaaatataaccccaagggacaaagggaaaaagagaagcactatagatgtacactatacagaatgcgggattaactcacgcaaccgtttggcccctgctaaagtccaaaggctaacctcctctttgattctcgttagcagaaaactcgttgccacctctttatgatcaaagatccgccgatttctctctttcagatttcccagacgactaataggatgagcgatcgaagcccccttcttgggacactaggagtgtttgcgaggctctcccactattgtttgacagactgggtttcctcccattcagtcggctccagctgttgatagcccacccatgcagagacaaggtgccaaatcatcttggtatatctacaagtggcaacgaggtgcagtgccgtcttagcctcgcggcagtaaaaagagcaacaaccgttattttgccaccccctaatcgcaagcgacctgatgtccagactctattctggatgataagccaa

SEQ ID NO: 98470 - DNA, 724 bp, Oryza sativa
  unsure (1)..(724): unsure at all n locations
cgtggggnnngggaatgtatacgactactatagggcgaatttggctcggtacccacaagcacaagttccatttcccatcttgctctctccaagttaatagtagtagccttttttgtagtcaaaatttaaaatctgaaactttgattttaggattttttttttcttatcatagtctatttatcaaccataatttgttagccgctaattatacatgtataagttaatgttttacatatgaattattttcagttgcttcgtttatttatctttacacggctgaggcttatcacccgtagctcaaccaattagtgccgttaaaatttcgcaacaggatgtgaaattatattatttttttaaaaaaaaagattataagataaaggtaagattgtacagtcacactagcttgcctagtgttgagacatttgttagggccttagggcatgtttgcttcgtgccctgaaaaatttgtctaactcaagcacaactctcaggcgtccgattttgtgcgcccgcgactggatcgacctgcctgagcgaaagcccccggaccagggcagaaacccaataagcccttaaccctttgcagtgctttctttgcacaatatggaatgtgtaaccagcagtgaaaggaattttgcattggacatccctgttattttgggttgttaagacacaacaatgaaattaaaagtggtcccatttcatactgtccaattagattgac

SEQ ID NO: 98471 - DNA, 530 bp, Oryza sativa
cgcggccagttgatatccgattactataggccgaattcgagctcggtacccatgcagaatccgctctaactcgtgctttgagctccctgtctcatatatgatgttgttcaccataggtcatttcttaacacaagttttttttttatcaatggacatggagtgatattttttaaaccaactccgtgcaaatttaactgcatttaactacctctaatttaaatcgcatgaaatttagaaactaaatatattacttaggtgaaaaattaaagccgtccattttttgaacttatcaaattcaaggtggaatcatgtattacattaggttcatctctcaatttaaagcatgtttgggaagaaacatatttcacaaattgcacagttaagggcctagctagcagcagggctccttcagaacatatacaaaaatttcaggatttttacacgaattacttcaattttcataaaaggaatctctaaaatttctccattccaaaggaagcctaatattgcgcggaatatatgacgaatct

SEQ ID NO: 98472 - DNA, 709 bp, Oryza sativa
cgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaactactatcttcttttctagttgggcttggttgctgaacaagcttcacaaagcgaggttgagtccgcgccgaagaggcgcgaagatgacatcctcacaaaggcgctcggaaccaaagaacatcctagccgaactcggggaattggtagcgatgtgccctagaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatatacccccagtcacaacacctgctgtgcaaccaactcctcgtgtacaacacgacgcgagtccgtcacagctgatgaactactgt

SEQ ID NO: 98473 - DNA, 720 bp, Oryza sativa
tagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactttatgatttaaaatgtgaacatgtgacttgatttgaaattgataaaatgtgttgagttgtgtgagtgtgatgatatattatgacttgttgtcaaggatgacaacaagagattgattatgatggaattatgatgaacttaatgttaaaacttaaaacttgttttgttaattgaagcatcaactcttttacaaaagaattgcgaaacaaaacttgctttatgctgaaaatgatctacatattgccttcctttgaatatatgccttacatgtagtatggtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtaaacccctagtcggtgtgcctgtgattgggtagtcaagcttccgctgctctctaataagtctatttggccggttggcctatgttgatgaactactgtacca

SEQ ID NO: 98474 - DNA, 679 bp, Oryza sativa
atagctatatggagggtagaccatgaagggaccatgataacgtaagactcttgccttggatacatctagagactgcttgtgtggctttgttcaaagccattataatggcgtggttcacacacttactttgttgggctaagatccaaagtgtgctaacttgtgtatatatatatatatataccaattgtgtatcgagatacatgtgacaccttatatcaatgcagtgtccctactagtagatatagcagccaacattctatatacatgtgcttgctgagcaagcaaacatctatgcccctttgtttatgaacaactgaactgaactgcagtctgaacatatatgctactatgcctaaaatgctgtaacattgaagaattgaatcaaagccgtgcttactgctcaagctctacataggtcatcaagcttggtgtttcttacaccgaggtgaatattaataacacgttgacgcactttaacatccgcggtgtacgtgacggacaccttggggacacatgatcatgacattttctgctttatgacccaaaaatctgcgaattcacgcaaagctagaacctactggtgatgggaccagactgtgtgtaacgttaatcctctctactaaatatgggggtggttatttgactgaacaggtccgggaactttatttccaattgagga

SEQ ID NO: 98475 - DNA, 895 bp, Oryza sativa
  unsure (1)..(895): unsure at all n locations
acaccactcctctggtctatcgatatgttgttgctttngcacagttttcgcattctaaactatgcgtatggtatagaataggtaagtgatgttantcnnnncnnnnnnnnnaggttgaagccagctangaaagcnattatatagtttccactcttgaatacccaagcttgcatacctgaaggtanactttagaggatcnnatgaactatatgttcccatttccttctgagtctgttcaagttcaccattgttatcacataaaacctatcaaagaaattatcaaccatctgaaaatactcaacaagcaacaacaaaattattgagaccattaaaaagggcaacatggaaatttagctaactcagaaaatctcacattttatgatcaaagttgcagaaaaccacatatattatgatgtgtggcacacaaccacatgtattatggtctaaatatttcataaaaccccacatttattgaaatcttgattaaggccccgtttgatcatccgtttggcagatagatttttgacgcaaaacgagaaatctcattagcacatgattaattaagtattaagtattataaatttcaaaaatgaatttatttgcttttttaaacaacttatgtataaaaacttttttaaaaaacgcaccatttaacggtttgaaaagcgtgctaacggaaaacgagaaagttgaagtttgaagttgaaaaatagaactaggcctaattttgcatatcttgaacaattcttttgaattagtaaaaattttaattatcaaccttagtcaagaacttaaaaattaaaattttcatgtacacactatgatttagaattgaagtaatctgtgctcaaaatgcataagggtaggggtttgtcaaactttagaactgttatac

SEQ ID NO: 98476 - DNA, 572 bp, Oryza sativa
cgggtggtctattcagtttggaataaggtgaggtacggattagaagtacggatgatgaatatatagatgtggtacaagtagcccagcaaagttttcgtttttttattagtggaacagtcgattcgtttagtgctaagaatacacgaaagaatttagttactgtcatgactttcttttataaatagagaatatttataaccgatagaaaatatattaatctcttatacagctggctaaaaaagatctaagttttactaagcctgttagcgaattgataatgtctacaactgctcaaatcgattaccaaattattgaatacctttttaaaacaaaaaaaaaactccacctccctaatcgtccaaacaaggtagcattcaattaagcaacctcacatatgatgtacaaatccgttttttccggcttttcgctaacgcggttgatttagaattcacatcgcccttgcttctatacttaaccatttccgttcgtccattttgttagatgcacaggttgctggcaactacaccgctggcaacatcgagagcactgtaaacagatcaggggttatgatt

SEQ ID NO: 98477 - DNA, 528 bp, Oryza sativa
gttcggtggagctcgttagtttagtcgatcgtgctgctcaccctagagcttttcccccttttgtttaatggagaaaaactcataagcatactgtttctgttgttagcttagctgtctattgggatttcttttggagagtttagatgcagcaacaagtagagtgctaggataggctattatttatcatttgtttatctgtggctgtgatcaatatggagcatcttcaccactacctgactgtaaataagtaattgatagtgttgactaattggaaacgtcactatcaattgatagtattgtcgatttctatgtatgttctccccttcaatctgaattaaacttaggctggcccgggtgaaaaagataatgctgaccaatctgtagaccctttgaccactgtgttttcatcaatacatatacaaatacttagatctcggcactactataaatgtatggcgcgaaatgaatcttacaatgtgttttttctttcacaaaacaaagcggctgaaattattgtcggtcaaattt

SEQ ID NO: 98478 - DNA, 670 bp, Oryza sativa
actagtggatcccctttttatggacgtcgcaggaatctcttgaagcaaatgccgcagcaatcgatggtgaaagccttcaccagtgggcagtggcaacaacactgcatgaccccatcgtcactaccaaacccttcagcacctgttatgtgttcaaggtgacggtgagatgccattgttgtgaattgactgctgctgtttacttacaggaatgatgaggaaatcctccagttagttagccacgactagtaccacactaccaccaatggttgccatgtagtgcatagtgctgatcattagatcggcggtgggggagatcgcgtgcgggcgggcgatgccggcgctggcgtcgccacgggcgggcgacgcgatccgtgcccgccgtccgccgccatcgtcccgctccccgtcccgacggagctccgcctccagtacctcgccatgggcatctcgccgccgtcgccgacttgctcccctgctcccgcgtcgtctccgccgccgccgcgtcgcctgtcgccagccgtcgggccttctctcctctcccttcttgccccggcgacctcctcacgacccactggccggcctggtagaggagaaaagcgagagacagagagaaagaggaggaagtgaaaggagggaaggagagagagggtggtacgtggcatactgacag

SEQ ID NO: 98479 - DNA, 772 bp, Oryza sativa
acctgcacaggcacctgagccatgctatggaattcatatatcttctgcattagaggggtgctaaggcacaggatgagtattactgcgtattagggatactgtaaaccgtccgatcgagaacggaaggatcaagtcatgcgctacagtattttcgaccctatagttatagaaagcatcactgttcatggcattaattcactgcccttcacacgaacagactgtaaacgatccggatccatatgctatggcggcttggcctgagccgtccaatgggataaggtggatttcggttggactgtcattaccttaggactccggtctgtgcgtgcagtagtgttggggggcaatatatataaaagagtaaagtccatcaccggtccatatgcgtatcactcgatcgcacacatattcatgttttgtgcatgttgaatgaagggtccgtcgaaattaggttgtaaatgatctgcatcaatcaagctggacagaactttacaattagagaggatcctcatgtaacatgtgcattttcacttaatatggctatgtctagaacttcaaacgcgacaagtaaaagaacacggtaaaggtaacaggaaacattggtatgcgtgtgcttagtccttatagacaaaggcgccatgcattgtgcatttggtccccctgtgggggaaaaggatcttttgataccttataccccctataggagaatggtttgaagatcattcttgaaactttatagaattgggaatgaatgtaaagcattatttttatt

SEQ ID NO: 98480 - DNA, 556 bp, Oryza sativa
cgattcacactgtgatcatcgctctggtcatataactcatacagagtatggatgaaactgaaacgtgattgaaagaaaaaaaacagtcactttagaacaagtggtaatctaagttttaatcattgagttgtgaggtgatggggtcttcagttactagctagtatacaagtagtaactagttatggtaattggaggctagcaaaagaggacttggtgcctatgacatacttcaacaagtggtgagatcttcttgatttcatggttgaataattatccttgagaccttgacaagatggcctgcttgatgtttttttttgttaggaggggccaggttgatggtagtcttcctttctcaataatgggatcaaatgtgtaattagtgtttaacaggactctgataagcttttggaggatgtcaagtctcaaatgagtttgaaaaaaagattcatgtgattaagaatactaacaagccgtcttacattcattattgcctcggcctgcttttctctgaacctgatgcagccatgcagctacaacgcgtgaatgctgtcaccgt

SEQ ID NO: 98481 - DNA, 718 bp, Oryza sativa
ctcttgtaagtcgtaactcaagaaagaatcgatgaggaaattcttacaaaaagcacaatagcccaggaaaattcagcaggtacaaaaaaaaaatctaggcctaagggccatgatgaatgaagattaaaagaacagtcctaaaaaaaggtactaacctatttgcaaataagaaacaatttgtttgtttggtaacataccttgcccatgatgcttggctgtcggctcagtccaacccactcatatgtttaccgtcaaagtaacggactgtgtgcatccccgcccatatacctgaataagaatattagcatttcagccaaaatatttagatgaagctgaacacataaaacactccatagcctactgctaagagtgaggcttatatggcagatttgttcttcctccattcacatttacttgtcacttttgaccctaacgtgcatatgcaggtactctttcaataactggttactgaaatagaaagattgctttcaacccatgaactgatagaagaagataaattatattacttcataaacagtaagtgtttaatgtcagcagtatgcatgtgcatcaggtctaagttttcttcttaaaactctcagatacatcacatcgctattcattttctatattatcatgttcagttgataagagttagatccaaacaaactgtataaaatatgcaaacccaaaaacactatattattttaatctgcct

SEQ ID NO: 98482 - DNA, 599 bp, Oryza sativa
gggtcgcgggttgagtacccaatgattgcgcgtattatattgggcgcttccccaatcctcgtgtaggctgtggctgtggctgccttttccttcgccggtgcgccgtcgattaatccgacgttgatcgatacattccatttccccatattcccaccactatcactttgcttgtaggagaaggaatggagcaaattaaggtttctttttccaaggcaaaaaagaaaagcgatcgagacgagcttgtgcatgccagcgtgttacgtgcccatgacgtatgtcgtcgagcgtggtggacactggacaggagcatgcagcaagcagcccatgcacgctacgctgacacgaccaattttgttcaaaaccgatcggaattcggcgccggttaatttgaaattgagctcgagaatgttcacgttctcgattaggctgacacgcaatgaggccgtgatgataaagttggtgggctgggcggagccgatcttgggcgtggcagacaagtatgatgagccctttcgatggctagattttgccgatcatgagaagcacattttatctgctccgttctgctttcgacgttgtatcctgtctggtttacacaa

SEQ ID NO: 98483 - DNA, 717 bp, Oryza sativa
tttctgccgagcatttaatcatagtcttgtctctttttccactgagagaagaattatatgggatactaactaggaacttagtatcaaattaagaaagaagtaaaatatttctgctgagcatttaatcataggcaaaatggtgagcaccgagagcagggctcgaacgcaggtcacatggatataaggcaagatctttgccattgagctatgtgccagttctcaaggaaccacttgtttcatttatcatcttttgattcatgaccaaattagtcgatgggttgatgaaagactaatatttctcgtagaaggcaccttgctagttgcttggccacagcttgcagaagtgcgccgagacagaagttgatgctctttgttttgttagcttctcctttgccttagttagggatcagttcaagttgcaaaattaattgtcacggagttctctagtattggtattatgttggatatgttctttgttcctcatggcagtatgttatgatatcgaatctagcctaccagtttatagattgatcttgttagtgtctgttgtcaggatgtttggtgctaccccttttcaatatgcgataatagactagtagtgtagctgacacactttacgcaaatgtcacagacaaatttatgcccatcaattgaatgcgcagtaaaacaacgaattgggaatttttttaagaagaaagacccaagtttctcagattg

SEQ ID NO: 98484 - DNA, 550 bp, Oryza sativa
cgtcgggctgggcctgggtccaggcgtcgcccggcccccacagcaccagcaggtgcacgcccagcacggcggccgcaatcaggccaatgtttcgggggcgcatgcgacctcagtccagggcgcgctggcggcgcatggtcaggcccagcaccgccaggctgatcaccgcccccaggccgccgagcaccggaaacacgggaatgccgaacaggtgcacctgcgaggccagcagcgttgggccgatgcccaggatgaaggcgccggcgaccacggccagggacaggcgcgtggcggcgcgctccagggcggtggacaggcggtgcaggtggcgcacctccatgtccacgcccaggcgcccctgcttgaggcggtacatcagcaggcgcagggtcttgggcacatcggccgccatctcgtacatctgccggctggccgcgcgctgctcgcgcagcaggcgccgcggggtgtagcgggcgcgcatctgctcgcgcaccaggggcgcggcggtgcggatcacgtcgaagtccgggtccagctgcagcagcacgcg

SEQ ID NO: 98485 - DNA, 569 bp, Oryza sativa
gtgtgcaatctcgaagcaacgagtctgtgatgtcacctctgaccacgactgctttgagatgtggacatgcactgtttcttctgtacttggaatggcataggagatctctcagcttttcttttagctttcgtgatttctccattctttccgctgtgcacgcctgtgtgttttatatgttcaaattaagcagaaaactgtgacatgatgtttttgctattgtgcttaggtggtgtttggatccagtgacttaactttagtacttatatttagatactaatttagagtattaaatatatactacttccaaaactaattacataaatgaaagctaatttacgagataaattttttaagcataattaatctataattagagaatgtttactgtagcatcctaattatggattaattaggctcaatagattcgtctcgcaaattagttcagaattatggatgggttttattaatagtctacgtttaatatatataattagtgtccaaacattcgatgtgatagagattaagtttaagttttatcccatctaaacagggtgctagtttgagatgaa

SEQ ID NO: 98486 - DNA, 919 bp, Oryza sativa
tcgcccgccgccggccatgcgctgtccattgtcgcgccgcctgctgccgccgtgctggacgccgcccgacgagaggagggagcagagagatggggagagccggagagaggaggaagaagatattggattcggtcaacgacatgtggggcccacgtgggcccaccatatttattttgtgtagctgacatgtgggacccaccatttttaaaatattttttggggctgacatgtgggcccatgatttttattattttaccgagatataattgccacgtcagcgccacaccagcgccacgtgggatggagaccgagtcaaaatggccaaaaatggccaagtaggcgtcacgtcagccaaaaccgctattaaaaccgccgagggatctcgtttgactgatttttgtaagttggggatgggtcgtatacggttttgcggttcaaggatgaaaattagactggcgacaaataaagggaactcaagtgaacttattccaacgttgaaattgctcagtcattgggccgtcatgagcagtgggaaacgtcatcctgcacatgcggcctgcactaccagcccactagttgttgggccatttgaggctttgaacgcagtgtgctcggagaaggaaagctgattagctgagcctttggtattattcaggcccactcgtgtacattgccttcattgttacaagaacaacttcattgttaccaagaacaacttcgaacccgagcagggaggtcagttttctgctatctgttaactagttctatctggtatgcatctgatatatgctaatgatgctatgcaggtaaactgtaactcggatgttctccttcttttgataacaggtaactgtataacagaatgcttgaaacctgatgttcagtaaaccgtcatccagcagctaatcgaactgccgtc

SEQ ID NO: 98487 - DNA, 677 bp, Oryza sativa
aaccaacgcagcgtcagaatcgcctcatgcttcagatggtttatttatagcgataaccggataaggtagcggcgcaggcgggcgaaacaccgaacctttttcacttctccagacaaagagaccatggtgtgagacttcgaatgctggtgccacacagcttagacttgtttatgagaacttaaaattctaagaatctgagatttagagaagctaggctttttcaaaatatggtttctagtttactttttaaattctacagccatagatttttagaatctactaggtaataatatggactgtttatggactgtttagggaaactgaagcttttgtgagaagctgcagttgctaggaactaaacagacactcgattcaaagaccaccggcacaagtagatacaccaaatacacaggatatactaatgtagcatctgatttcagacaccacaatacatcagctgttacactgcatcagacattcagaactatctcatttcgcaagccaaatcatgaaaattgaggctgaacaagcatcccgcttacggatcataccatttaacttgcagaagtgcgcaaaaggattccggttagttacagtaatctagaccacaaacacaggacccatgactaataatgggttctcttggcctattgtttccggatcatacctattgtcac

SEQ ID NO: 98488 - DNA, 655 bp, Oryza sativa
aaaaacaaattattattgttggttctaatttggtaagcctccaaggcttttaaattctggcattatcgaattttatattttgttgttacaatgatgatcagttaatctattgcttatctttatctgggcatcacagaagtaattcctgttataactctagaactaccatgcatagttgttactcaatcaaatcattaacatacgttgccgcgtgttatttagccatgtgctttagctctagcaacacttttgattcttctttatgagtttatttgttattaaaagaggaacgcttgaaccttataggtaagtagatttgttaatttatacaattatgtccctaccatgtacaatattttcttttcgagttcttgtgtagaacctttggttggttctttgctgatgaataacaagaattcagcatttattgagtttttacttacatttcatgtcaacttttcatcatttccaatggccagggaatgctttctgcttcagttttgtccatcatacctctgatacgcccatatcagtggcagagtctactcataccggtacgttgacgttgtgactttggatgaatcaaatttgagcagagctaagcaatgtatttgctctgatattctacattatttgtttccaggtcttgccaaac

SEQ ID NO: 98489 - DNA, 575 bp, Oryza sativa
aagtaattcgtaattcaaatgctaacatctgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttgcctgaaattgaagatgatgtgactgaaaagttacgtgtgtatacacaggtggaggtggatgtgatggaaaatgattgaagtttggatgcaaa

SEQ ID NO: 98490 - DNA, 612 bp, Oryza sativa
ctccttttgtcaaaaaaaaaaaaaagcagtagtgtgtttctttgtccaacgaagtttaaccatctatcttatttaatttttttttattaatacttttatttttattatagataaaacatactttatgcgtgactttttttaaaaaaaaaatcatattttttatataagacagacggtctaatgttagacacaaaatctcataattacacttaaaaataggacggagggagtatatttttgtactctcataataaatcaacctaagattgaatgtgacacaatctaatacaataaatttggatatgcatgatcagatttaatttattatattaggttatgtacaattcaattcaatgttaattagtttaattatgaacggagtatattgcaagtacaccacgggggcaaaagcggaatctcgaatgtaaagtggtagcacaaactctgatctgattcggccaacaccaccatagcacaaaaaccagcagaagtagcagcaaagcttgtatagctcagcacgagctcgttctcgcacgcagttgcagcagctatagcggtacccggggccccatgcgcagtagtgatcacatgacagcgcagcgagatcaagcg

SEQ ID NO: 98491 - DNA, 563 bp, Oryza sativa
caattcagtgatagcttcctcatacttgccaatgatgtaaaacaaaagacaaaatactccctatgtttttaaatgactgatagtggacactattcccttttgaatttagccactcgtcgttttactaaatatttacaaggactaaaaggaataatatgttattgaattgtattatattctaaacataaaacatgaaacttttattcaattactctaaccatttcagagtaattactagtcaatattcaaatagtaaagctaaagttatcagttatttaaagatggaggaaggcaccgaaacccgtcatgctgtaagcgggatggagtaatctatgtgcgagcaaagctcgtaataagcttgtcgtttgcttgcacccactccaattaagcaagcagagtctctgtagtatatttgcggctgccggtgagtgccgcggcacagcaacggtggaaaagcacatggcaacatggcgatcgatcgattgattcgacgaccggccagccagccttgccttggctttggccttagccttgcactgcactgtctctcctcccaccggccg

SEQ ID NO: 98492 - DNA, 529 bp, Oryza sativa
accatgctcaacaccacaaatatgttccacattacaaccccccaaaggttggacctttctatttttccgggctctttttctagaaattactgggaggaaatcaccatcgctactagcattactgcatgattgcatttcttgtgtaccactgctagcatcagcactgtttctgaaacaggagaatttatcatgatttgctttgtttagccaaccttcactgccaccacatttagaacccctgagatctgtcacttttgactgaacacacggagggcactcatttttgtcaatcaacaagttctcggtatcatcactgaagttccaactgctatctgtgtaatggccatccaaagaggaatcagtaagagtggaagtggaggcactgtccaaacatctggagttattgctgttagattgctcacagcattcaaaataagaagcatgcctagacaattctatctcatcactacaagatgtacttgatatcagagttatgaaagaaccatcgttaccagtttcactatcaggt

SEQ ID NO: 98493 - DNA, 571 bp, Oryza sativa
tatcatcccgttcgaaaacgagattccgttatatagcagcccccgcttgaaaactaacccctcttaggacaaaaacacattgtttgaacatattttaagtcacaatatttttaacatatgaattgcatgtatgaaaaatcatatattttgatttgttggatatttagttatcttttatgaaaaaaaagcttcaattgaagactatatcgatgttgaaacgatattttttccaccaaaagtgagtactatttaggtgtccttggaagtaaatttagaggttttatttttttaagataaaggaaactttcttgatggatgtaaacaattataataaagtgatacaattaatctaagatcactcttggcaccagcatagtaggttgtccacaacctataattattttttagaaagaagaacgacatgataacaaatatcatgccatagtgagctacaaccacaagctttatactctatacacgcatcacttagaaaaccttaaaacaacacctccaaaataaaaattgcattggtcttgccatgatccgatcaacaaaacccaaatcataggtt

SEQ ID NO: 98494 - DNA, 692 bp, Oryza sativa
taaacttccaactttttcatcacatcgttccaatttcaacaaaaattccaatctcggtgtgaactaaatacagccctacccgtgttcaaactatgtaaagacctgtttagttcgtaaataaaaaaaatttcaccctgtcacatctaatgtttgacatatgtatagagtattaagtatagaaaaaaaactaattacacagattgtgtgtaaattacgagacaaatattttaagcctaattgctccatgatttgataatgtggtgctacagtaaagatttgctaatgacggattaattaggcttaataaattcatctcgcagtttacagacggaatctgtaaattgttctgttattagtctacgtttaatactttgaatgtgtgtttgtatatccgatctgactctttgaaacttttcgtctcgtgaactaaacggggcctaaaagtttttagggaagaaaagtccgctctttgtaccaagaactgttacttttgaaaaagtctgttttttttttcttttgaataagagggtagaaggacagtctcctttcattaacaaagaagaaggtttagttttgtgcaagtgttaaggggtgttacataggggactattctcacaacaacattagctctttaagcttttttttttttttttgccctcactaggcaccaagctctggcctcctcttttgtt

SEQ ID NO: 98495 - DNA, 699 bp, Oryza sativa
cacgagcaagcagcgcgatccagcttcctagaatcctgttctaccgcaccaaccatcacctacgcaataattccagcgcaagaaaaaacttcaaaaaatttaccaccgcgtgagcgtcaacgagctcacgaatcccagtttgctcccggagacgcgcaaaactcggctcgacaaacgggctcagccacgcaaaaggatcacatcacaattgcaatcgcaatcgcgcggaaatcaccttgaggagcgccgggtcgaagacgacgtgggcgcggttctggagcagggacacggcgacgcgccgcacgccgcggcgggccgagacggcgccctcgacggcgctcgtgcacgccgagcacgtcattccggtgacccgcacgtgcgcctcctcctcctcccccgccgccgccgcggcggcgccgccccccatctcctcgtcgtacgagtccagcagccggacgtcctccatctcgtcccctcccccacccgccgccgccggccggccgccgccggcgaccgccgagagctgcaggtgggccatgcctgtcagagagagagagagtagccgcgcgaggtgggaatatttggtggaagagagagaggagacgaaacgatggagaatggggcgaggcggattatataaacggagagggaaaaaaaagttaaagcgcagggggcaaagtggaattattttgcattttt

SEQ ID NO: 98496 - DNA, 688 bp, Oryza sativa
tttgtcatgctgctctgtccgaggaaagctgcaccatgcgatgctcctcctcctcctgtaggcggaaatgtattatggttttctagttgtcgttttggattttgttatggtctctactaaggttacctttttgtcttctttttggaatagtatgcaatattactatgccataatactaatcttagtagcaaactttttcttcaaactttcaacttctcaatcacaccaaaatttttctacacgtaaacttccaaattttatgtcacatcgttccaatttcaaccaaaccaattttcatatgaactaaacacagccaacataaagcaataaaaatctaggcccagtgagcttacattatataacttttggctgagtttatttctaaactttttctttaaacttctaactttttcatcacatcaaaactttcctacacacataaactttcaactttttcatcacatcttttcaatttcaactaaacttctaattttggtgtcaacacacactgtttgattcaattttggcagcagtggagcggattccttgtacggatatcaaataccagtatgaagataacggcgaccagagtgacggattgacgagacaacacattgcatggtgtttgaactggatcatcttcgcttcacacttagggccagtttagttctcaaaaattttccccttc

SEQ ID NO: 98497 - DNA, 700 bp, Oryza sativa
tgggataagttgagctaaaccaacatgccctttacaaagtccaaaacattaggttagcgacatttttgtttcgctctgacagtgaagctttgttcttacgctgctgtcgctgtgtttgcggatgcaggcactccactccactgctaaaaccaacgcccattctgccaaaatgtaacccccatcataaatttcataaacccatcgcaaaatgcacccaaatcatatcgaaattcaaaatgcaatcgaagcaaaaaaaaaaaatcaaacaaattcagagcgaccgcgcgaggagagaaggagacgagcggtttcgccgcgggaatccgcgtgccggtggccaggttccggagcacgtgttccgcgcggctaatcacggagtagtatgttacgactttaatcgggtgattagcgccttactaatcctatcttactataaagttatcccccaccaactccttaaacttaacatgcatgcaaagatgccacatcatcatccactaatccattaattaacaagatgccacatcatcatctactaacaatcatcacatttaaacatcatacaaacatgctatatctttatagtttttataatttaagagcttttcaaatataaacatgttaaattatcatccaatataattcacataatgtttcaatgtatatttttattatgttttatgatatatcctatatattt

SEQ ID NO: 98498 - DNA, 690 bp, Oryza sativa
tcctcttgtgcatatgaatgcgtatgtattgctgcagcatatatacagcctcgtacgctacgagtagttcgtactagtatagagatgcagatcgatcgatgcatgcttgtacgtataaacttaataaaggtgaagtgacttggaagatttaattttggacgcgatttgaaagagagagagcgaaaaaaaattgaagtttggccagtagatcgatcgagctagctatactccgtaattataagtacgacgtactccgtacagacgacgcgcacggtagatatcgctagatcgagaagcaagatggtgcgcactatactactactctgtgtaccgctaccacagctttgtgccaaccctgctcttgttaaacgattggggacttccagataatacacaaatggtactgttatatcatgtttataattatataattagttgagtttgacaaaagctttcattgtattaaaaaaggagtaattacatatgttgatggtatataaacttggtgtaataacttagtttccgaacttataataggctagcttgttatgatacacaaacttatctagtgtgtgtaatccaggttcaaaacaacatattataactgattatgttgagttattaggacacccacgatgtgagaacatgggtggggtattctgatatcaaaatataccttcgagcaagttt

SEQ ID NO: 98499 - DNA, 503 bp, Oryza sativa
acatgaggtgggccccccaccaccaaaaaaaaaaaaaaaaaaaaaaaaactgaagaaagaagagaggagaggaaagagagggaaaaggaaagaagaagagaacctcgcggggtggcatcagcccacgcaggccctcagcattcagtgtcattgagcatgtaggctgtgcaccacctgtgctacccatgagacgatcccaggtgcctgtggaacgcagagcaagaacaccactccctccctctccacctgcatttccatcttgatcatatggaggagaaagtcttagtttaaagctagcctgtctttgacactttcctactccctgtcaatctccattttaaacaatgaaaggcccggtctcaggccataactttggcaggtaacagtgtaaggttagaatttaatgatgccatgtaagtttcatatatatgtatgtttagggttgccatctatgtaagacaactgaagattgttttttacttacactggtcataacaactttt

SEQ ID NO: 98500 - DNA, 502 bp, Oryza sativa
atttgccacgtataccaacaatacaaaagaggtagtgacagctggtcttctgtaaccctctacgtagacaagcctgaaatccaggagggtcaaaaggccaagatcaaagaggagatagcgaccaaaaatgaccagcctcatttttcaagcagactaacgtcacctcgtttagacatcgctcgattagtcgattgcgatgtgcagagagacgtttcattaaaaagacgccttcaaatctcacactttgctaggaatatctctccctataatttacaaatacgacaggtagtccaatactaccccctaccggtttcattgacaaccacgataaaccgataaaaacacgatggaacttagacaaattttatcaaaaaattgaacatttgtttggataattttgaaatatggatcaacttcacaacacatcaacaccaataaacccgagaaccgagcggttatcgtcgcattttggaactcttgtccctctctcagcatgtacatg

SEQ ID NO: 98501 - DNA, 634 bp, Oryza sativa
tgtcctaatgcagccttgaacgacgccgaacgtagatgagacaattgcgtgggccaacggaacattggactaacccattcgccggagatcgaacaccgatgcagcctcgcgtcaggtgccaagtcccgccggacgataaaataaagtagaaaaggtaaaaggtggcgatgcgccgaattgtattgatcgtgaggatatattacatagaccccgggtgtacatatttatacccatgggttgatacaagtccttgtcagacaagaaagaaactaacctaaagataaaaggaaaatataaagtccttatcggacactaaacacactttcttaaagataaaaggaagctaacaaactattcctaattaatagataaactgtcatgccgcatcctctttaaactcggtcacttaggaataagcttcctttagtagattgatttccttaaccgaatatagcaggaatccgactattggcgacttgataactcccatcgactgattccgagatgctacagccgataatgattctaagccgatgacgtctttgccaattaccaaatttcactattaacaggaatataacaaaggtgattttcaccatataagaggttgttatattcttttcccaaatagtgt

SEQ ID NO: 98502 - DNA, 663 bp, Oryza sativa
attcaggggcctgaacctgtataaaaatccctgtctccatctcttttacctcagtctcgtgtatatcctagcaccaacgatccccatactgtccaaataccgtagtcgtgacatcaaacgtcgacaagattagctatagatgatttggagccatcaatgggctatactattaaacttgctctcaaaaggcgagcagcctaggaggtagtgccgagccaaggagagggagcggagcggccaggcaaggaatcgtcgggggaggaggttgaggaatcgctgggcaggggagacggcgcggctgaaacgggccttgcggcgcacgcgcacgcgtcgggaggtctgtgaagagggtgggcgaaaggtggcgggatggcagcgagaagtggtgcaagaggagggccaccccgtgcatgcgcgtgggcatgcggcgcggccgagacgtgcgcctgtgttcggcgtgcagtgtgacgcgttggctcagagaaaacgatcgatgctttggcttggagtagtgacagggagaaaaacaatctaatgggcttttggcacatggatatgggtctctccgggatggctctatcgtttcgctccgtgtcgcttcagcgttggtacgataggcaacatggatgaccatccagagctgctcatgatgaacgactgtac

SEQ ID NO: 98503 - DNA, 665 bp, Oryza sativa
atactttgccacaactaatgttagataagttgtgacaaccataaaatgtgatgaataaattgctagtcattaagtatggtgaaattggtaaggaagttaagctaaccaaacacatacatataggggtgaaaacagtaacggaaattaccggccgactagcgttcgttttcgactttctaccggccgagcgatatggaaatggtagtcgaccaaaacaaaaatggaaatggcaaaacatatggaaataaaaacggaaatggttttgctgttatatcgatcgtttccgtatctaccgtattcttgtggaaattaccatttcttataatatggtaattaccgtattctaaatatgtcgatatttatagagcatgtctatacttggcccacagcttacagattgactgactcttcaatcaaatctctaacttttatgcatggctaaaataaagttaatttataatttatatagtataagcttgaatttatgtatacatataacatacttatgtaaagttaaatatatgtttttatagtttaatgtttccatatttgttactggtttccgatctgcaccgacatgtttccgtccgtattattccgtttccggttttctgatatttccgatatcgttttcgtttccgagaatatgtgatgaacgacttgca

SEQ ID NO: 98504 - DNA, 765 bp, Oryza sativa
tttttttccaaacttccaactttccatcacatcaaacttttcatacacataatttttcagttacatcgtctccaattttaaccaaattctaaactttggaccaatctaaatacagccaattatacggtacataattatatttaagatttgttcactttgttgtcaaccaaatttttgtacgacaataaactgaacatgatttcaccattacaactttaccgaactccatctatttacaaaactacaccaaatttaaattttgatagggaatcaaaccagacaacaacacatttgcatcttttatattggcaacatttggcattatcaatctttggttttaccaataaataataataataagtttctttttttggaaatgatacaagaaggtataccgttcggacataatgataacattgatgtatcacctgatatctagtaagtattgtttgatacctcatttgaacggtatgatacctccgaggtgtcgcctaataccttagtatcagcctgatactgatactggtaagtatcggctgatactaaggtattaggcgatatctcagatatatcatcccgtctgaacgggatgccgtcccgtcacattcactttttttttttttgcaacgaaatggatatgtccttagagcctggcccattgaaataaatagtgatagggtttattttggcaatgaaatggatatgccatcggagcctggcccattggctgaaatgatcacatcattcacatcgattcttagaaaa

SEQ ID NO: 98505 - DNA, 602 bp, Oryza sativa
tgtggcttatgtggtagtgggcggtggtttttcttccatttgctttagctattacagatgtcatgtaagtgtcatagtatggtccgatccttgtaccagtaaaccggcttagatggaaacaccgatatgagaaggccaattatctagcatgtctttgtcctgaacctacagtttctgtatgggacaaatacacgttaacggatgaatcacgcacaatgatgcaaagtcaaaacaaccggagcaacatcgtcagaaatctgatcacagaaagaggctaaggccctctttatttagactttagactgattggcctagacttttaagtcagcttattggcttatatgatttataagccagtggatttaatgtcctaagtttaatggtagagttatacatctatctcatataagccaaaaaaaaagcttctccaacctagtttttggcttaatagtgttagagtggcttatggtttaaaaaagccaaatgaaaaagctgcttgtttgttttggcttagacttttcgacttataagttggcttataagcctaaacaaagagggcataagctggctaacttgctattaaaattttcatacgttcttaa

SEQ ID NO: 98506 - DNA, 615 bp, Oryza sativa
  unsure (1)..(615): unsure at all n locations
gccatgccatgccatccatagaacatcgatcgatcgatctacaaacgatggtagcagcagtaccaccgcgcaaagctataaagagataaaaactcgcatgcaaacgatgcatgcatgactgctgcactaccggccggccggcatgcagtaannnnnnnnnnnnnnnnnnnngagcagcagcatgaacagggagggagagagcaatattgcaagcaagcaagcaagcaagcagaatgcgatcgagcacgtcgccgtccccaggaggaccacctgcggtctctcatgttgtaaagaagccaacctcccataaagaacccccggctacagccaatcccagaggcagcagaggggagggagagagcgacggatagacggagtcacactacccatctccccccacttgatgcccactgatagctacagatgcatgaaagctggacagggcaaaaaaaaaaatcatcagagagaccgtgtttagttcgtgtgctaaacttttttaaagtatacggacatatatttgaagtattaaacgtagactaataataaaataaattacaaattccgtatgtaaactgcgagataaatttattaagcctaattaatccatcattagca

SEQ ID NO: 98507 - DNA, 563 bp, Oryza sativa
ccaaagaaactagagaaaagcttaggtcaccagttgctggagctggttccacgtacaggaacctaaccgaacacactacagttacacactggtactagtacgcagtactccattttgaataacgactcgcgacgatcacgtcgaaattccaaacacattaattcacggtagttcgcggccacatgcgagcacgagcaagcgcaaaaaccaattaattagcaagcgcgcccgcccagtactactgctcatatgttcttcccttaataagcaaagcatcccccaccctatccaacgtgctggacgcctggactgctggtgggtcgggtgaatttacggcgtctcacacgcaaatcccacgtactccacggctcgcaccggcatctcacgcgagagccacaagcccaacatctcgcgggacacgcgagagcgatcaggcgctcgcggtggtggcgcaatccgcgcatctgtagcgaaacgagccggccggtgaacctaacatttgcatggatggatggatggatttgctgcggcgcgcgggttgatgtgaggggtgtcccctacca

SEQ ID NO: 98508 - DNA, 509 bp, Oryza sativa
caagcgttatcaatggatcatgtcttcatcaaataaggttgaaactcacccaatttcatgaaagtaatacatttgaatggtgcttaacaagtaaaagagggagtgccagtattacatgcattattgggtctcagtttctaacagcttttgaaaatggaacagtcaacatgttctcatttctgtgaacaaaatatagtatggaagagacagacatatatgttaagactaaaagaagaatgaaacattaaaagatcttctaaattttataaactggcaaaatatatcatgatggagtggtaaaaaaaatgtgacatgccaaagatttatagtgcaggtaaggatactaccgatctatgcagcagacaaccttttttagatgcattagatgttagaaacttagaatcatggtattacattgtgcaaattgccaaaacaacatgcatcgggtagcacatcaggaataaataaatcaacatatactagaaaaaagaactttagacatccagaat

SEQ ID NO: 98509 - DNA, 529 bp, Oryza sativa
  unsure (1)..(529): unsure at all n locations
agacctataaacggacaaaactacatgatcatcaaatacagcaacccccattcttttgcagttgaggatttctagcatccgatgatatcagtaagcttgtatcacgaaataatagtaaagctaacaattgctattttccaaggtatttcacaagaaaaaaacagtttctaaagatgttaccaaggattcataatcatatataaaagattgcttagcatggaaattggaaacactgctacttgcttgtgttttgtcctagatctttcttgtatttgcacggggatctataggtgacacaatcttaatacagcatgcgcaccacataaaggcatctgaagtttgcttccagaggatgcttctactgactacaaatgtagtaagcagcctcaagaacacaagcaatttgagtttgttaggaattcttggaagagcattaaaatctactcatatggatgnatatgtatatatatatatatatatatatatatatatatatatatatatatatatatatatatatatacacaca

SEQ ID NO: 98510 - DNA, 741 bp, Oryza sativa
gattatctgaatgtacttcagtgtttacaaagcgatgccaaaggagagccattgtctacagagcaactaagttttgttcatcgtgttttggaagcatttgttgattgttatcctgataaccaagcacctgatatgatggtgaattcattgttgattcccgattcatttggtgttttgacacctgccagaaatcttgtctacaatgatgcaccctggatgaatgctgatcctacttcaaagagctttgtgcatcttagtattggtaatgatctagctaataggcttggggttcgatctcttcgtggatcatcattactggatgacgagctaatgacggatttgccatgcatggaatatgctaaaataagtgagttgctggctttatatggtgagagtgactttcttttgtttgaccttatagagctagctgatcattgcaatgcgaagaaagtgcaccttatctatgataaacgagatcatccaaagcagtctttgctgcagcagagtttaggtatgatagaaattttctccctagtcagctattttactgatatttttcttttccaatcataattgtgcaagtattttgtttgtcttgttctattttctgtttatgtttatataagtaacatatttttattttccaaaaaaaaaatctaggtgacttccagggttcttcattgacagtcgtctttgaaggaacgataatgagcagagaagaagtttgcagcgggctgcagg

SEQ ID NO: 98511 - DNA, 590 bp, Oryza sativa
tttgtgtttaatgtggggtgtttttgttgttttatattgttgattaattcttacggaacatggtatgaatttggttctagatagtactaaaatgcttgataggcagtggaaaacgcccgacaggtccactaatgtagcatcattttgaggatctggtacttatttttgtttcagtgtgttggtgttgtttggcattagattgacaacatggataaggcattattatgtcattagaatataaatgatcgcttctgttctccttgtatcatatcatgctaaaataagtgatttgagcttgttcaccttgcttgccctttatatgatagtaatagtgtttacctttttttttttaatcattttggatgctagcctgctcaatcatatttctacaacagctagttcaggggaaaataagtttatgcctcgcctttttgttcagcttttaattgatggtgttgttttactgcttttgtgacataccatatgttttgatctgtccttaaaccactcggtacttgtaaccctgagcaacttagacccatgtagatgtaattttttctttctgacatcatagaacatgccatgagttc

SEQ ID NO: 98512 - DNA, 693 bp, Oryza sativa
gctgaaaataatgtgctgtcatctatcatcacagagctcaaaggagtcccgtttccgacatcgacaaaatgtctaacaaggctgggatctaccgaactttggatagcaagtgaggagcagcagctattgatgcgcccattcttgcatcactttatccatcatcaatgtttacaaaagcccttcttggagctattgctcaccactcaagttattcatagacctctaaagctaagaagtttttctcctcacttgttgtcaggccatttgaagcacatatttgatgaacgttgggtgcaccttgcagtagagaagaagtctccatggattccttgggataataatgctaattcatcaactgctggaccaagtcctgaatggattaggctcttctggaaaatatttagttcaatgagtggtgacctttcacttttatctgactggcccttaattccagcatatctagacagacctgttctctgccgtgtgaaagaatgccatctaatatttgtaccaccagcagatgattcaaatcctgatagtggagatagtgcagctagagtagttgacacgtctgcccacccacgagatgagactggagaagctgaactgaacagcatacttgatactgcatttcagtcaatgaactcagcatttccatggttacctgctctgatttacaagttgaatatacca

SEQ ID NO: 98513 - DNA, 630 bp, Oryza sativa
tagctgtaactaatattctcggtagccatccagcttgttctcaatttctatttgatggtgaaaggaattattaggatattgtgtatagttgctatgctgtcgaaatacctaatgtttgttttctgttcgtgactattgcaccaatataataaataataaatcatggtgctgtagtttttacaatacaacaacaaacataacatcactatgaaaattgcaaatgaatattgtgatcgcccgaaaagttttcaactgatcaaacaagcttcaaaacacaatacaatgacgtgattttttatcttatagtcccgtgtatgttttattcagtacaaaatagatgcttggctctttcaagttttttttgttcttatactcatcgtattcaataattaattgcacgtggttatttttggaggtcagataacaatataagttatgtacgttatccctcattatatgttctggaacaatataaaagaaaataaaggttgagataaatattatgaagatcttacatatattgatcgtttctaatataagaattttacaagatttttatgagattcattcttatttttattataaaaagaaggcatgatctgtaaaggtttttgtcatgctttgttaatg

SEQ ID NO: 98514 - DNA, 588 bp, Oryza sativa
cacccctgagtcattacattcagagtctcagagacttgataatgcagtagtgtcctggtatgcgggaaggagacatgcagtgtagtactgaaatcagtgatacacaagctcacccacgtacgtccgcacgcacggccccaggaaaaacggggcacaagctagcagctgcataacgtggccagtatacaacgtccagtacagcagtagcatggactagtacagtagtagtactgtactgcaacaatctgactatttttttttggaactgaaatcatctgactgcgtcctccttttcatttcctttttctttaagccagaaagatctctgactgcctcttcgacaagaatgcaatgacgctattttctttgtgtgtttatttagctggtcaagtcgccgtcacacaaatgtaaaatactccctccgtccaaaaaaaaaaacaaaccctgattttcgtgtgtaatgtttgaccgtccgtcttatttaaaaaattataaaaaaattaaaaagataagtcacgtataaagtattaatcatgttttatcatctaacaataataaaaataccaaatataaaaaaatttcatataa

SEQ ID NO: 98515 - DNA, 569 bp, Oryza sativa
gactatatccccaattagctaatcatggatataaagaacttgattatagaaggaggtagtactgcctgctgactactggaagggggagagtagagggactgagggagaggagagccggactgccagagaagcagtggcgcagtgctcaccggagggggagggccgccggatgtgggatgccggccgggcggcgggtgccggcggccgaggtagggcgcgcgcgccgatgcgcgtcgaggaggcaggaggcggtgcgaccgcgatggcgcgagttgggactcgggaaggcgggcaggccggccgccggcgcgaggggcagagctccgctgcactgtcacggcgctgtcgggactcgggaaggcgagcaggccggccgccggcgcgaggggcagtgcaccgtcgcggcgccgtcaggactcgggaagggggccggctggccgccgcgcgaggggcagagcgccgttgcgccgtcgcggcctcacgggacacgggagcggtggcggcggcatcaggcgtcggagcgacggcgcatgcgcgtgtgactgggagtccgggaggaggctagtagg

SEQ ID NO: 98516 - DNA, 610 bp, Oryza sativa
tttgcaagcatccaaaagacctttttgttttctacaagttgagcaagaaaacacctcatcttgtttaacaatttcttccatgtgtttaacacgctctaaagcatctttcaacttcaactcattcaaaacacactttgaacaatcttgagaaatcaaaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagaagactccaactttttagatttttcaatctcaaattccatttttttgcaattaacagaattgacatatcgcaaagcattaatttcagaaaataaaacttcacaagattgacaattatcatctttaggaatcaaagattttaatctagcaatttcagcattaagaatctcaatcgtacgatccttctcatcaagcacaatagaacatgtttgaagtttcttagcaaatttgtaagcatcatattctaattgatcataactaagcttttcttcattatcatcatcagattcatcaacatcagaact

SEQ ID NO: 98517 - DNA, 599 bp, Oryza sativa
ttaaatagagaggggggcaccacgatgtaaccatgacgactacaatgtagcgtagacacgcagggagaggatggcggcgtggccatggactcgtagcggctaggtgctatgttggttggggaggagcgcccataatcagagccccggggatgtaggcttcggctgaacctcgttaacaaatatcgtgtgttcctgtgtcgtcatctggcatgtcttgggcgatcaacgactgaaacgatcgggaaggttagtcgtcgttccactatatcgactaacttttacaacaagctcggcacacaccgctggctcggtctcctccagaccgatagctctatgaactatgaaagccgccccagggctctctttctccctcctagcttccactccttcaccatccctagagctcgccgatcgcttccaccactccgctctcgtccaccgcgtggctcgcccgaggtgccggtgcgttcctggcgactggggcgaggtcgtcttcccttaccccgaccttaattggttcgcgccgaggtcggaagattacttccgctctgctggcatttcttcactacgcgcccttcgtctcggtagtctccccatcc

SEQ ID NO: 98518 - DNA, 537 bp, Oryza sativa
ccaaaaagttattaaaaatatgatccatctcaacaacagaaaattcaaacatttttttaggaatacatcttgtggaatcaattttcaagttttgccataacataagaaatcttacttcagcatcttatcaaggtggttgttgagcttcattctatgtgaccaccactttacatggtttgcttgtccatcattcagagtgagggttgcactagagagggaaataaagttctcctcaagtatctttctaaaagtaggagccacgtagtctattatagtgtagccccaagggcactgccaattcttatctgggctctcattagattgtccagttctttggtacaggaatcttcatgttgggtttctgccaagcaacagccatgtgagaaaaaaaaaacacaaaagaaatactaagagtaagctatgcaattttaatatggaatcaacaaacctttagaaatagcatccactggcaaaagcaatgtaataggtttgtttgttgaatcaaacctcgaaagcatcatcccagcaggaaaataa

SEQ ID NO: 98519 - DNA, 651 bp, Oryza sativa
catacaataattataagatatctttattcatacaaaaatcataaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataagggtgggactttagtcccggttggtagcaccaaccggggctaaagatcaccgggatcattagtcccggttggtaataccaaccgggactaaagttaagatctttagtctcggttagtagcaccaaccggggctaaaatcaccgggatctttagtcccggttgg

SEQ ID NO: 98520 - DNA, 2005 bp, Oryza sativa
ccatacttgtggggcaccaagcggctgccgtgcgagacgccggacgcctgctggcgcacgcgcgggtcgccgccgatgctgctgccggagaggatcgacgccctctggccgtacgtgacggcggcgcggcggccaacaacggcgacgatccccggatcgacccttccgccgaggcgatagcgtcgctgccgtgccgccgcgcgctggtgtccgtggccacggaggacgtcctgcgcggccgcggccgccgatacgccgccgcgtggggtgacagtggcagccacagggcggcgacgctcgtggagtccaagggcgtggaccactgcttccacctcttgccggagttcagctccacgccgagaccggcgtgctcatggatcgcgtcgccatgttcatcgccaagggcaagacaccaccaccgaacactcggggctgtttggatggaggctaactttgccataactccatttgccataactgtggcaagccacacagccacaactatggcaaactttggctagtaaatgagagtatgacgcgtgggccaatgtgctaatgaagtgtggcttgactcaactgcggcacgcaaccaaacactagcctagaaaattgtggcacgcctaagatttggtgtggcaaactgaggccaccaaccaaacagccccacgtcaagtgcggtggtgccaagttggagagttccacgcgggccgaggagtacggcccaaactgtggttggggttcgacgtgccgggtttgggatgggcaacatgatcaggcttcctagtaacgcccagaagtatccaggaaactattctaatccctcgaggggatgttttctcgtttgctcaaaaaccatctaaacagttatgaaaaattctggaaaaaattgacaacattcatacaacacatatatacaacttcacaaaatcttaagtccaaactcgactcacacgtcgagatataaaaaagacagattcagtgtatgaatagtagtgtactgtttatatctaaatttgtcttttttatttctcgatgtgtagatcgaatttgaacatgaattttggtggactagtaggtatcattatactctatattgtcaatttttttcagaatttttcacaactatttgcatcgaatttggaagaaaaaggtatacgaggggtatccactcgagggattagaatccactcgttaaggggacatcccatcgttatttgcatgtcatctaaatagttataaaaaaatttgaaaaaaaattgagaacatagattaatatgaaatatatcactacacaaacatgcatgactaaattcaacttctataagttgcaacaaaaacaacaaattaagctgaacataattatcgtacattcgcagcgatatttgttatttttgttacaatttgtagaagttgaatttaaacttacatatttgtggagtgatatatttcatatcaatctatattgctaatttttttaaatttttttatgtctatttaggtggcatgcacgaaacgagagacatcccctcgaggaatgaaattactttcccgtttgttggaagataatagaactatttgtaacgcaagtgtatatacagatactgagaggacaacctattccatttgttgttggcaaaaatatgcatgatctgcatatagtacgtccttcttctccttaaacctttgtcgtaggtttctaaaattgaaaccgatatacttcttccgttttccgttttaggttataagacgttttaaatttagtcaaagtcaaactgttttaagtttgactaagtttgtagaaaaatatagtaacatttttaacccaagaaaaatttattatgaaaatatattcaattattaatttgatgaaactaattagtagtattataaatgggtgatgacagttggagcatcgactataaaccgtcggttcacggcacacgttgtccttggcaatggccgaacctatgttggcacttccctctattctggcaataacacggct

SEQ ID NO: 98521 - DNA, 888 bp, Oryza sativa
atactgcaaggtatacaaattatatgatttatatgctcagcccttataaattttcacacctacttcctccgtttcacaatgtaagtcattctaacatttctcatattcatatttatattgatggtaatgaatctagacatatatagcatttcccatattcatattgatattaatgaatctagatagatatatatatctagattcattaccatcaatatgaatatgagaaatgttagaatgacttatgtttatctatctagatttattaacatcgatatgaatgtgggaaatgctagaatgacttacattgtgaaacggagggagtattacacaattagatacataaaatataattaaataatattttaagtaatagtcaactaaaattaaatatttaaatgctacttagacaaagtgcctcctaatcttcgcgggctatattattcctagttatacgagaatattttcacatgatgataatcaacggcaaggttatctaactaactcatcaactctatttagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatgtgtgtgtgtgtgtgtgtgtgtgtgtgtgtgtggaggatgattaaaggcgacgttacctagctaactaaattatctgtacatgatttgcgacaagattacagtagatcgatcctacgcatttggcaacctgctgcttatacgtaagcagtagctagctattgttaaaaaaaaattgggga

SEQ ID NO: 98522 - DNA, 1164 bp, Oryza sativa
agttccccgatttgactacaggaagtatgggaggatgtagtgtacacacaagggctgtcagaaaagtcaacttctccaattaaacaacacctattcttggatcaccgtaccggtcgatccagatcaacctaacgatccaatgctaatatgagggtcgttggtcaatggccaaagttaattattccaggacacaagtgaacaggcagagcagttagaaacagaaaatgatgaaacgcaatacacctggcctgtctttaacctaaccgttaggactatatcacattaataagtgaataaattacgatttacctgctcaaccatcacatgaactgatgaacaaatttccttggatttactagtacagtatcaaattagcaatgacttatccagacatgagatgcatgatgagatattagtaggatatgtgggtggtggacagagtagagtttcctccgcttttgccttttcgggaaaagcgaagcagcagctagcgatttgttggtttgcagcaagctaatctctgtaggttagagcaaggctaataatacagccgacctgctggctataaggttctttatagtcttctctcagcctacctatataatagttagctcttcacaattaatacagggcccacttgtctctctcatagagtttcttggttcttgtgtccaagccggctataagtttatagcccgcttctcctctctctcctctcttctttcctccaacttagcatttagccggcttataacctactattatacttgatcttattagagcacccgcaatggtaaagtaaggtcctatctataaaacatgtacatctcagcaatagactagaataatagtaaaccatctcaatagtatgtctacatgggtatctatagctctctaatacattgtctcgtttttctctatagactatctccaggttagtagatagctttgctctctctcttcatttaatctcttctaagtaggaaaatatgctgacatggatctcttatagagagcctatagataaccattgtgggtgcccttagcggagcagcaggtgttctagatgcttcctgcctcgtcggccatgatgcccatgcagcatgcaccgatctactaccaatcaccatggcgaaatggcgagtgacctcacatcacccaggg

SEQ ID NO: 98523 - DNA, 1101 bp, Oryza sativa
ttataacccacatgcaatatcttaatttgctattggctaggaaatattggggatggtgcatgtattgagtttgttgatatagtaaatatagtatggagagttattacttttcttggtcttggtgtacctataaaatatgtagatcaatttgaaatggagggagtagtatacaacattgtttccggaaaagttttaaccagatttattggaatacattacatctgacagatctagatataagtttgtaattagatttgtagtactattagagcaggtataatagcaggctataagccaactataaacatattttaaaaagataaaggaaaaaagagaagagcagcgggctatagatctgtagccagctgcagcacgaactccaagatgtaatgtgtgtatgacagatgggaccagatattaatagtatagtaagcaactattgtatgtatgggctattatattagctatagatagtttggagttagtggtgggttatactattaaacttgctcttaaacattatattcggtactaattaatgttttatggggcgtatattttttctttttttttcttgtacgacggaggagccagggatgagaggagggggcggggcccaccacggcacggcgtgttccaagctgtttttacgcaggtagtagagtacgtactattagtacgtaacgagtacagctagaacgctttgtttttcttgctgttgtagttgtacgcaacttttggcttgataatatttgttattttggataaaaatacggtctctaaaaataactttaaatattattttctattataatatatataacagtgttaacaaacataagatttaatatgttttgttaaagtactttttaaaactaatctatatatatagtcactatatttgaaagattaatatttttaaaataatttataataaagattttaaagtttaaacttattcttatctaaaacgataaatattatcgatacgagggagtagtatattatggttatatcagtagtacataccagcagtagtataattgtagcagtagttgtagtagtagtagcatacgatattttttttctctctcccggccc

SEQ ID NO: 98524 - DNA, 3022 bp, Oryza sativa
tcctgcagcccacttttccttagcctcaattcgtttgtcgttgtatgactgatgctggttgttaatttgaagttggtgcggagcagcgtcaacatgggatattattcgagtctcttcacaattttgtaatggtgatcgttcaagctgctaacgcaatgtaactactcagtgccgtgatctatccagttaatataacctaattgcgtagtattttacctgggattataatagtaaattaagtatgacatctcttgtgtgtcctctcgtttctgtgaaggaactttccattgcctgattaaaacctggaccattctgctttttgtctaattaatcgccacttgttgcgatgctcgtcaccgccggtgactcttgcaaaaggcattcgttgtagtactcgtaccagtgatactagagtacttaacaaagaaagcaacataataattaattaaagaaagaagttgattttcagaaggcgtggaaagcagcaggcagcacaggattcttcgagacagcatcgtccaaagccgatctgatgggagtctcacgtatgcctttcttttttttttcttccttctctttccttcttttttttttttgggtcatagcgagggcgattgcagcagaaaccaacctgttaaaagtgttaagcaaggcgcaagccagtagtaataagcagttgaaacgtttttttgctgcttcaaatggtgccaatgcgcaagcgaccatggtggatgaacctgaggcttgatcgatttgatgtgttttccctaatggcgacactggctaggcgacgccggtttgtgcatgacagctgcgtgcgacggataaggtcgtcgtacgcacctggtcgccgccggggacagccgacagcgacggcgcaacacgcgcgcgcgcggccggcgcacgagccgtgcctcgccgcacggcacggcgcggccaccgcgggagacgcacacagacacaggcatatccacttacttacacagatggatcgagcagtcgcgactcgcgagtgcttggtcgttaagcatttcgatcgacggtgacacgttcgtcacagcgacgacgcccgtgtcgcgggccggccggccacaatgataacgataacgatagccgcttcccggctggccgctggtcgccgtcgacgcgcgctagctgtttcggcacgcagccgtttttggtgcgcgcgagcggaatccgctgcttctacggtacgtcgcggcgtgcgcggcctcctctcctctcccatcaattgacgtcgccgttgcagacttgcagtcgagttgcacaatccatcgcgttttttttttattttttgaactttttaaatttttattttaaaaataaacactttgaaaatatattttcaaaatctgaacattttagctacaccagcaaaacaacatggtcacgctggtttggctgacgtggcaatattatttggtcatgccaacctcgctggcgtgacataattatttgtcgtagcaggataaaactgtcacgtccactgtgtatggcgtatcagtattattttatcacgtcatgttggctggtgtgaccaaaaggttaatattctataaataagttttggtatggtctatttttaaaaataaaaataaaaaagttcaaaaaaaaatcatccttcgccggccggcggggcccccgggtccatgcgtctgttgcattgcacctgccagtcactggcatgttggaatttatgtagcctcgacctcactctgtagctgctgctgctgcgactgctagtgtgacgagtgacgacacatcttacaagcaattgttgctgcatgccaatgcttccaatttgaaagtactggccgcgcatgttctctctccagtgataaactgttgatcatatcttcagattagataattacagataatctgagacgacgaacacgagctacagtaacaacatagctttcctactgttgttgtggctatctctgcctccctggcatgctacacgccagtacacctcctactgcagattagcagactactagtatcactggaggatggagccaacttgggggaagtgacattcacatggtggattgggttagaaatatgatggccatatttcaataaagtgagttaaattacaaggtcattagtttcttgtaaactctgccacactatgatttgcttcacgcaaactctagtaatgctgttcaattatctagtagtagatgctagctagtaataaagttggggatagatcggtgaaagaatgattagcttgggcaaaggcaaaccccacatgaaaatgccaatgcaaatgtgcggtttggggcaaggaatcacatcgatcgatcacacatgatgattgcaaagcagagcggggcacaccacacctcattgtgctgtgccgtttccatccacccaaagagtccaatccccatgtcactaaaccacactaaccttgaaatttcttcacgtctaattcaagccgaccacacacactttgatccttgtaattatatcatcatatatgcagaatcagattcgatcgtggaattaagaacaggctgagagacacgagtttgtcaaacgtctgaattttctatgaaatatcaaatcctgaagggcccgactgaatactcccagttgcaagactttgactgtactgttactaaaggcatataaaatagtaccagaattcaggtaaagttcacataaactttcgttgcattccctcgatttttttggcatgatcaatgactttgactgtactgttactaaaggcatataaaatagtaccagtattcaggtaaagttcacagaaactttcattgcattccctcgattttttttggcatgatcaatcgtctgtcagcacaaaccactcagccgtgcttatcaccagactttgaaaccaagcaaccactttgtatgccgatcactgtcactgaagattttcttcactagaacagtacttttctgaataaattaggtcgtttcaatcgacagctagctccaagcgaaaaacctacacatcaca

SEQ ID NO: 98525 - DNA, 639 bp, Oryza sativa
cacttgcaggtcaatgtcataacatgcttatatgttgctatcttatgaaaatgttctcttattttcttttctgaaacaaagcagagtgttgggagaggcaatggtgaggacacactggcacactggccaacttcatcaggaataatgacggtggaagatgcctttctacggatcttgcaatacttggataaaatatggggaacaatatcttcttcaggtagtgcaaatgcaccaaaattatgttacctccctgtatatgccctacatttgttgccactgggtaacaatagcttatggtattatcattttctctttccttgggtttaagtactagcagcgattttttttttcactggaaaacacttgatttacttacgcttcattgcatggccatatttgagtacaatcatgcaaagcatccctgtaagatttaggataagggttgaactgactagattcatatgaagggtcaaatatgtactccctccgtcccaaaaacatcattttttgcctttatttggcccacaaaggcttcatcattgagacaatcaatgcattggagtttgagaaagtgggggacaaatgcattgaaatttgaaaagtggaggacattctagtcatttgattttgtattgggac

SEQ ID NO: 98526 - DNA, 615 bp, Oryza sativa
actaactttgctgcttgacatctattctttcctctcaggaaccaccaaggagatgtcaatatagagaatggatagacactagaagggttctaactccacctagccatgttgtgcagcttgaactaccagagcaatacagggttactaaagcgcggtttgagagaggagagggatcctcacgtaggggttagctattatcggacaacttggcatattgaaatttctactgtcatgcttccttgtcccattactgcatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactgatacgtcgaataaggtacaaaataatacctcacttaacatatgaaattgcgaaacaaccaacttcaatacatttttataacaatattaacaagttttaccaataaatacttctttatttattattaacataacatagaaaaatcttttggccggacttttt

SEQ ID NO: 98527 - DNA, 509 bp, Oryza sativa
tggggaagtggaaaatcgttgctacatttacagaccaactatcgtttgcatgaatgagcaaattatagtctcacctgacagctggcagaaaagtatagattgcaacactgacaatgaaagtggcctctactcactactttaaatgcttgtgccagttattcgctgccagtagagaacactttcattgccaagttgtaggtaataagattataatttgatcattcgtgcaaacaatagttggctgtccataaatgtagcaatgatcttccacttcccaaattggcacatgtgcgtgcgtgcatgcgtgtatgagcatgtgtacagaatcattaaaagtaataaatcttaccaatcctccatgctcttcctttggagtacctttagcacaatcttcagcaggggaagaacactcacgctcagcgcctgcttcagccatcttttttattccattctgcaaaagggttgttactccagttgcacagacagctgtgttatccctcataatcttg

SEQ ID NO: 98528 - DNA, 1206 bp, Oryza sativa
attcctgcagcccagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgta

SEQ ID NO: 98529 - DNA, 629 bp, Oryza sativa
tatattttggaaactcatgctagcaggggtgtgtttagttcctgaaaaaaaataaaagttcaaagaaagttgagagtttagaaaaaaagtttgaagtttatatgtgtagaaaagtttttttttgatgtgatatgatgtgatggaaaattgggaataggaaggaaactaaacatggcagttttattccacaccatgaaacagagtaccaatgcaattagttgcgctgaactatcgttcaaagcacaagcataacatgcactggatgatctctcgcgctttgctgcagaatatatacgttagatattgacgaaacgatgaaatgatttgaactgaaatattatgaaaatgattgaaggatgatggtttaccatgtatatatttagttctataatgaaataattgtacatataattactatatgtttatatgttataagtcttgcgtgtttaatgagtagaatctatatatatatatatatagatttattatatgaatgtggggaatgctagaaagtcttataaattgccacagaggtagtatatttcgatgttaagttttaggcgattaataggtattagttttatagaaagaaggattattgggatgagccaaatacgacaatggttctc

SEQ ID NO: 98530 - DNA, 691 bp, Oryza sativa
aattcctgcagccctgtgacttctagtttattttctttttaataattttttagtttattttttaagtccgtagttactccatccatccctaaatataatggattaatgataatctgaaatgttcgtgtgagctaaaacttctgagagaagcggcagcatcataagcctcccaaataaaaccttagattagattaatgttctttagagcttacttttcttgccgtttatattaggttgttaaccaaccagtaggactagctaacttatatgggcatttaactattttttttgtcacttttagattgaacgtttaatcatttgtcacctatatggcaacgacatgtaagttcaagtgttaaataattatttgtcacgtctaaaattagcaaatagttaaatatcttgacttatcttgttactctagaatcttagatgcacttaattatcttactactatcagcctagtatctctctctatgtaaaactcggtaatttcaagttggaataattttgtggttcttaattttcttgatgcaccttaattttttttaataaataaataaattatgaatagcaacaaacataagagaacattattaagcccttctcaccaacttaggagttgggagacaaaatgagccaaaaatgaagcagttgtttcatagagtaaaaaaaatgcattcgttatttt

SEQ ID NO: 98531 - DNA, 649 bp, Oryza sativa
tagcttaggggtttgtttgtgaaagcttcggctctagctgcatcacttttggaactgaagctagtctaatcaaacaattttagctctataaaaaagaaatagccgagttgactagagtaacctaaaaaaataaattagatgtgtgagtggagttcgggccgctatatagaactcatctccttagtgatcgctccctgtttttttagccacttcaccatatcattactgtgaattatttgccccatgcctctaaaacaaatttttcttcatatggcattgcttaaaccactttctttaagttatttaatttatgtttattttcaaaaagtatttaatttatcactacgattaattaattagatgatctgataaataatctatttcaaacacataaaactgctgatatgaggtaaccattatttgaagtagagttcatccatcaaatttaattttaaatcttgatgtctataattacacgcatatgtgagattgtgctctcatcagcagagcatgtcttaagagagtgcgcttgcgagtgtgtacgtgagacggatggggtatgtaatcggggaaagaaaattcttaacctgatcaattgttgtatttcgatacgataaaccatcaccatcccaagcatgcaatgcctgca

SEQ ID NO: 98532 - DNA, 600 bp, Oryza sativa
aaaacttgcgcaagttgccgatcttttactccgagaaagagctagaatattctgcgctttttcacaattcagaatagaaaatatatgatgaataaggaattaaggatacgatcacatccaaaacgaatcgcgagatggaactgtagtgcagcgaaagcgccgtatcgaattcagtcggctctttggaagagctaatggctacactctaatgcaacccacaaagagaacataaaaagtgataaaagtgcagctttaataatggggattcaaacaacatgatatattttggggacctttttcgtgacatcacctggcttgtttagatctttcttcagtggatctttcatgtgttgatatatccttgtgtcaaagtaagaaaatgagatgcacgaataaggtcagagcacaagtgcaattctgggtagttaaatttgggaattgtaaaccagccaacccatggctggaaatggaacacgaccggccaaatcgagtagatgacaatctactcttgtccagagatattcttgtgctgccccccttgttcggcggattcaccgctgattcctgtggcagggcgccgtgaaagccacagcgcagcac

SEQ ID NO: 98533 - DNA, 990 bp, Oryza sativa
atatccaataccaccaagctaggaattaattatgagtcatgtaactaatgatgccgagattagtggtagtggccggcaatatgcatccatgaaaccgcttttgtttgtgtggtgtgcaactgtgcatgtatagaagctactagagagacgtgcagttgcgtgctataatgctgcctactacactacgaattagtgtgtgctcacgatcgatctccctagctatatgacgaccagggaccatgcgactgcgagcacacgaacatttgctacgcgtgttgtgtggttgccgatgaacaggcaggcaggccaaagctacaggctactgaaaaacacagagactaatcagatatccctcacctaattcttgaccggccagggcacacgaccagttcaacaaaactgccgtgtaattaggccaaagcgcagtgtgcacaccagcagatatataatactactatcggcagcacatagtactacaagtcgatttgccgtatgccgtcgccggagccgcattacgtgtggcggcgtgtgtcgacgtgcggccgtaccagctgcgggacgtggtcgtgtacacgtgcacgctgcaccctgcaggcctgcaccctgctgtgcgtgcccttcacatgcatgctcgtctctcggtctcgttcccgtacacgtcgcgatgtgaaagagagggggaaaaatgcgtatcgatacgtgaccgtgttgccgtttcttctttcttttttttttccgtgtgtgtcgtttcgttcttgtttgttcgggtcgcggcgcgggagacgagctaacccaacggtgatgatgtcagctgacgtggcgccccggagcggtccagctcagcaccagacaaaagccggagcggcggcgtcccgaggccggcctacgtggcaggaggacgtgggggcccaccgtcgccgcgcggttcgcatccaacggttctttttttgaccgtttgagctttgcgacgccgcatgatgccccccccct

SEQ ID NO: 98534 - DNA, 1540 bp, Oryza sativa
aagaagattcagaaaggcttgtctcgtggcatgcagcgccggtaacttttccaactctacagctttgaagtgtttattcatgctctttttttttttttgctggtatattactctctacttaattctgaaaagaagaagaaaagaagagaagcgacgcatggctaaaaatttcttatatttacttaaaaaatctggaaaataagtcttcctttaagtcacttgtcactaattagaaaaaaaaaggaaaaaagaagagaagcatatcaatgttgtctatcatctattaaagaagtaatatatattatgctaacttcatgtctgaaggaatagtgatattttatattctgcatgacaaattgtcaatgttgcttacatgagatcatttcgggtacgaccggtattgtttactcctcttacgtaagttgatcttctacctaacaaagcagtcaaaaatctgcgtcagttgctgagaaagtcctcgccttccatatccgtttcccaaccagtggatcagtgttgcttgccactgccattaaaataaccccaaaattcagaaaatttgctcaaagctaagctaccgcatgataaccctcagagacttcacacatctgttattctgtttctccttttcaggtaagaaaaaaaaaacggcaccaaaggaaaagacctcctcgagatattataactaagaagaagcacctaaaacgggcagagatattttgtttctctttttcaggttctgacttcactttgcactgtcagtttaccaaattagcgaatctgctgtgtgttgggattcttgatcattctgagtgccacacactataaccgtacaagacctggcaaagtcctgaaatagttttgttgagatggacactgaatttctgaacaaaagtttcagtcacctaagcaagcagtagcagtaaccatgttcagagattcagaggtggctgcaacagttggcctaataaataaaaaagctaaattagtcatcaaggggcgcaatatttcgagggtgagtcaactaacatcgatgacaatgcaagaaaacgagcctccaagatttctccagattgccttgaagctgatcaagattggttgggtaatttgcacgaactcagtactttttttagataactgcacgaacttagtactggatacatgacagattaacaggtgttttttccctaatgaaagagagattcagattgctgtctgaatctgaaatctgaacagcaaggatacggaaactctgaaagagactactcatccaacttgatgtaagtacttgatactaatcttggtaagggctggaagaattgcctgaagattggcacatgtacgttttcctctttgaaattgtcgccgggttatcgtcgtagaacgctgtattctatccattttgacgaagacgtgaagaaaaacggtgtctgtaattttgtcccaattgaaagaatacagtggcgttgatgttgtacttgaacaataataatggctgcatattttgtgtagcttgtgtagtcaggttcaggtaactatt

SEQ ID NO: 98535 - DNA, 1631 bp, Oryza sativa
gatccgcccctgttcacatgctaatttgtcagccagattttctgccagcctgaaaattagagtttatgtcaattatcctggagttctatatatgcttggtcaccaggacagatgcaactccgtaataagaaacattgaagttatataaaccgaaaacagtatcaacgcttcaatcattgtatcaacagtacatttaaaagccaacttctatgatgcaaatttcatagaatggcaaggttaatcaactgtgtctattagccagcatccgaaattctggggtgccatccaaactgccagtaggtgttaaggctgtgtttagttcacaccaaaattgaaagtttggttgaaattggaacgatgtgatggaaaaattggaagtttgtgtgtgtaggaaagttttgatgtgatggaaaagtttaaagtttgaaggattattttggaactaaacacggcgtaaagcattaaatttgttgctaacatgcacaagataagctttcggttcaagaaaaagcgaaaaatcatgcaataaaattttggatggagggtcttctgatattttgaaaagattcccatggtgatttgttagcaagattttccgccagcctgaaaagtagatagtttatgttaattatcatagagttctatatacatggtcattaggacagatacaattccgtagtaaggtacattgaagttattatcatataaaccgaaaacagtcttaactgcatgcttcattgtatcaacgctacatttaaaagccaaccttgtatgatgcaaatttcacagaatggcaagatcaatcaactgtgtgccatccaaactgagagtaggtgttaaaaccattaaatttgttgctaacatgcacaggataaacctcggtggcaacatctagctgcatatcaaactatttgctgagatcatgtatgtacgtatacaagagaaaaacaagcgaacatgaggtcatatcagaaaaagtaaggaaagtaatttaaccagcactacagaaaagaatatcaaaatcaaccatagggaaaatgaaaaataaactattaataatgcctagataaagttagaaagaagcaacagatgaatgataaagagacattccaagatcagagcatttatataattggctatgattgcatgcatgttattgcagtacggagtgcaatgccatcaagaacaagtactcgagatagcagacatcacgagaataccttttaaacaattgttttattagcatcaacttcacctttagccttcaaatactcttggatgcctgcaaaggtctgctatgcaaatttagtacttcctaagttcctatctatctatatctatatactggtatactggagtataaaggcactagtggtggtagtggctactttgcaccactactttttgcattttttagcacacgatattttctggtattatgcaatagtctaatatttgtttgaatcaagtgggtaccatatatctatactactataaaaagaattaggggtggctacttttgcacttttacacattagcccctgacatttgttgatattatgcaatagtctaatgtttgttggaacaaggttctagccccatgccaaatgtgtccaaaaaagaagagcaaa

SEQ ID NO: 98536 - DNA, 676 bp, Oryza sativa
cagatggatgactactaagttcattatgaacaacacatcgtttgctcagaacagcgcagtgaggaacaaatctgactgctctttcaactgcaaagcatgcaacatcttcgcaatagatcagaaagtgtaatattgttaagagatcaatcttctaaacagttatggaaaaagtctaaaacaattaataacatagattaatatgtgatgtatcattccacgaatattcgatcatgatcaaatttaacttttataagttctagaagaaaaacaaatatgaccgtaaaagtacgttttactatttagtttgttttttacaactcgtagaaatcgaattctaacttgcattttgtagggtggtatataacatattttttttcattttattaaaatattactatttaagtgatataaaaatacgacgagacattctctcaaaaatgaaaatacatactatgtctagctacttgtacatgcataccatatagtttccatggcccttgataaggaagtgagaagtagcgattgaacctgctcttaaaaactaggaaaattaggggccctatttattcatatgactatgagtagataaaagttttactttgaccaaaggtgaatagatatcacaattgaactcttcatccatcatcccctgaaaaaattgaatggtctatcaacc

SEQ ID NO: 98537 - DNA, 525 bp, Oryza sativa
ggtgttgctcatctccaaccaaacaagaggttttaatttacagcccacaggtataatacataggtaaccaagttgggtttcattgtttcacacgtcttctacctggtcaatgcaaagaactgttctttctcctggtttcaaaactctccaagtacgccacctaggcttattaagtatgtgacattatactttaaccattaatattatttataatatatatataaacgactacaaaattagtatcatataaaaatattttaaatacgaacataatggtgctgacattaaacacatgtattttttttactttaattattaaccaaaattcctgatatcttatattttagaatgtacagacactcataacgcacgcacactcacttctatgaacataacacacgcacgcacataaaccctatctctataagcatcttctcaacgtcgttactaccgaggctcttctaaactaggctacatgtactttcgctctaaactttaattttattctcgtttaatttcgtggcc

SEQ ID NO: 98538 - DNA, 2231 bp, Oryza sativa
gtcgcggtcgtgctgaccgcatttctaccccctctcccgccgcccccactccgccgtcagccacctctctccccctctcccgctgtccccactccgccgtcggacacctctctctcctctgccagtgcgcctgctcgagagaatcaggagagaagaggagaaaaagaaaagaaaggataaatgtggggatcactccattttctctcacttacatgtaggcccacatatttatttatttatttatttatttatttatttatttatttatttattactgactaggatgccacgtcagtgaaaccagacggttatactgcctcgggacttttatttgaacggttttacatagtttagaggtacacatttttatattgcggttaggggatctcaaacaaactcagtgtaaagttgagggacggccggtgaacttattcctttcacacttaaacacatcatggtgatggtggcattctactgctagcatccttatttttttactccattcgtctattagtatattacccgttgattttttatacacgtttgaccactcattttatttaaaagttttataaaaatgaataagatataaatcatgcttaaagtatgtttagtgataaaaaaactcctaataaaataaatgataattacgtaatttttaatgagaaattttggcaaagatgattgatgggataagtagtaaacaaattaccttacgtgtatggacaaatagagggctaaaatcgcggctccatagtttgctctttagttatcaccctcaaccaaaatttaaattttaaagtttattttgatgctttttcacaatcgtttatttttccagtattagcttttaaatcgctaaaaacatatatatataattttttatctataactcttttcactaataaacgttcatttataataaactgtagacatagaaatgatgaaactgctttgtacttatggacagcgggagagaaacggcagcaagctagcagcgtgccgcaaagatacacacaggttagtagacctaaaaactacagtatcaatcaagaaattaatggaaactcaatttcaaattttaagttcgaattcaatttattctgatcggtctgcttcggttgctagtcgattattctggtcgttttctcaacaacaacgaatggtgttggtgggagtaggcagacgtgacggcgaggctgagtgagagtggagagcgacaagagtggcacatgaaaaatgttccttgatgcaaagaaggcaaggagcaggtggctgactacttgtcaaaaaaaaaaaaaaagaaactagaaatgttagcatctctgcttctgcacacaagcagcttgtcaaaattttctcacttatattatcaaaatgtttgtcctactaagaaagctataccatcagctaatctagctaaagatgtatatccatgtactatatatgcatgcaaaggcaacgggtaagaaagagagagtgacttaaggccttgtttgtttcagcttatgagaattataatctagattattaagccagattgctataagctagattataataagctgatataaaataagctgtgagttgtttgtttgtctggattattggaggcatggattattgggtttgaaaggctaaagtctataatgccctcagctatctgttcggttgatggcataggtgggtaatttttctcaggtatgtaggggtagtgggtttttagccactcaataatctgaaaaaagctcttttagagcagtttattagattataataatatgctataataatctacttgtttgtttcagcttactcctaataaggtagattataataatgctaagctgaatcaaatagggccaatctcaaggtgatcctagcagatgaaaaatttatatatttatactacctgttttctattctacgatacagttaaattctttaattcgtttatttatttatgttgtttttaaaatatttatgcatgacaaatatactgtaggatcgtaaagggcctttcccatcccaaaagctagccattgaggtgaggggctcccccacttatatcttaggttatttgcccttccacaactaatgtgagactattcaacatatactagatgtactacttacttgaagtactttttaatgatagatcttgtcgtatttttttttaatttgactttactaagtaaataaatattagtgatcaaaccttttaggaaaaa

SEQ ID NO: 98539 - DNA, 571 bp, Oryza sativa
tatctatctgtatcggatgagctagcgtgcttcagtcatgcatgtacgatcgcctgtatacgctttttagataaatgtttgactatttatcttgtttaaaaattttatataaatataaaaggtactcaatatatatttaatgctgaaacatatcacaacaaaataaataataatcattacatattatcttaaataaaatgattagtcgaaaatatgtcaaaagtcatgcatgcaagttaattgggaggatcctccaattgatttattgtgcatgtatgcatgctgcatgaagaaatatctgacaacaatgcttaattattcatcaagataaggatatatatactatacattatacatactccagttaattaccgtaacatcaacaatgcttaattaatcggaataattaactatttgctaattagtcactgcaagtttcccaatatgtatgaaccactctatatatatattcagatgaaaatccaaaaacctggtcaaggttcgatggctatactaagatctatttctgtcgttgctcagttgtttgaagaatctggcagtgtcgttgtga

SEQ ID NO: 98540 - DNA, 930 bp, Oryza sativa
taatggtattagtactgataattatgatatcagtactgagatagaaatagctggacaatgtaaagaactcatctttttgatgaaggtccaagttcatgtttattctgtagctgtggtttcagaggggttcagaataagcaaaaggcatcggtacttggtttggtttcttttttcaatgtgcatctaggacaaactttgtcctcaactcctagtcattggtcctctccctcatcacaggcttgttgtaggaaatggaaaggccagagattttttttgcaggaaaaaagtacagctagtgctagtagtaatactgccaacatgtagtactcgttgctagagatttttctttaaagatactctcttccccagcatgctaaaccattcaactgacagtacaactcaccgccccaatttaatcttttgattgctccatttgggggtttcagaggcgacatgcaacagtgaaaaccctgtagaggatctgaccagggaaaagagtgtgcattgcaatgcaaaggctgcagctgttgttggatgggggcaagagattagattgattcatctcaaccaggcacatgattctactgttgagcacactgatgaaaaactgtagctgcttttgtcctctccctacccacactttccaatccaacccttatacaaacacaaccacacacacaccccaatggcaccaatgatcaaatcaagcaaagcaccactgctgctgcaaagaacaccagatagatcaaactctctctctctctggtgttgctgttagttggtagtttggtactacttggtactctgggaagaagaaagagattattatagcagaaaagcagcaccatggcatagctccaggcagcaaaaccaggtctgaaattatccctatcttttctttgcaagaaccagaatctttttatggcatgg

SEQ ID NO: 98541 - DNA, 663 bp, Oryza sativa
ttatagatataagatatattttaaagatagaatcttaaaagataagataaagttttagagataaatctactctaatagtctctatctcctgtatacgcttatatatagaggatcgatctaatagatcggagaaaataacataatacaacaattagattttctacaccaccatgatgtagtagaggtagttggacagctcccgcgcgatctccatgtgcttcctggtctctcgctgatcgacggtcgccgcactcgccgcggaggcggcggcgccggccgcctgtgcctcctcgcggaaccgcaggtccgtcgcgatgtgccatatcagtaggctctcgtcgaactccttcttctccaggctccagctcaggttgctgatccgctcctttttcatcacttggtcccccctgcaatccgtcaaaatgctgtacatgctactcgtcgtcgtcgtcgtcgacgttccggtttgggttggagtcgtagcagatgcagatggagatggagatggagatggagatggagatggagatggagctctcactcgcttccgctcacgctcacgctccctctccatcctcttgtcgtactcgctgagacggcgaaccttctcctctagctgggcgtagatgaaatccttgagcttctcgctcaccgggacatact

SEQ ID NO: 98542 - DNA, 1904 bp, Oryza sativa
ttattaaatggtgtatagataagagtgagagtgtagggtaaaatagaaaaaaacttgaatgggaagtgattaatgggaccatttgtattttattgtgataagtatgttgggacaaattcaaattctagaaatataattattacgggacataggtagtgagaaggtaagtcaaaactgatcccttagtaaaagttgagatctagcctgtcggcataaaatggaaatgggaattaatttcctcctaactaacccttactcctacataggtactagaaagcattaattttctctctcgatttctcatccacatctcaccaaaactcgcatgtcctcaaaacaaacaaacccgtaaatagccttatcgtctcttcaaactttcaatcccatttaacatacgagtactgctatacatctaaccctattgttcgacccctgtccaaccctgccgtatctaccaatcaatttactccatacgagccaactgctctccatctgggctagagcaaagagtaggtaagtactggtcggatgcaaattgtacacgccaatcatatgtgtagtgatttccttaacacacctccctccccacctatcccaccccaaaccaaatgtgtatggtaattgctaaggtatgtatatagtggcgatgtcatcatgttataaccttgtatacatgatctacttttccatatgcataatatagttgatatctatacttatacactaattgtacttcgataaagctcccacattaagtagagagattttgctgttgattaggcgcattatgtcatcataggcgtagattgtatagagatcatattagataaagcatactctctccatcctagaatataatgattttcaggggtgaacacaggtattgagaaagtaggtagatttaaataggagaatgttatgattagatgaaaatgggaggtacgtggggaaattgaatagtgacgggttgtgattggttggaaaaagaatgctggtgaagaagtagttatattttttgataaatttgaaggctaaaattgttatattttgagacgaacggagtataatataaggcccacatgcattttaagattcaacttctaaactatttcactaacaattagtataatatgaattagattttatttactaaaaataatattatttgattgcatatttgaatttactttcatatggttataattttattgctataaatcttatggtatatgagaaattataaccaatgattattttttagtttgtttaattttagttttgggggtatttgtaatttaaaaaatgaatttgcacccgtcttggtctcttaatttatcaattaattaatttaatttcaaaatttgaagttgatgattaaagaattgtaactgacgcactgtccggttctggctgaataaaatagggatatattccttgaaaaaacaattacgggacagatagatgggagagttgcttctctgatctcatcaagaccttctcgctaaagaaaacgtgcgggaggaagaggagttgaccaatttgaatagttccacgtgatagatcgagaggatgcagttgatgactgctcctgttttattttagtacagtaagtatctccgtctaaaaaaggactctaagttaggactaggactctgcatggataaaatacttctacctcgtgattcatgcatactcccttcatactcataaaaaaggaagtcgttttggacagcgacacggtctacaaaacataactttaacttcttatttctataaaaatatttattaaaaaatgatatatgtatactttgaaagtaactttcaagacaaatctattcgtataatttttacattttcaaactcaacaacttgagagttatttatgatttatattcccaaggttt

SEQ ID NO: 98543 - DNA, 656 bp, Oryza sativa
tgctgcgccggtgtaagtagacaatcaccggagtgttgttgtagatgttatcagcttacatccgggagcgcaaatggctcggcggatcagtagtgttttttttgtctatatgtgtagtttctcacacatcaaagggagtagggatggtaaatgaaacttacctagagtttcttaaggttaggcgaaagatgattgtactgttggaaaggcagttctgtagtaaaatgattcttctcagaggccattcttaagatctccatgatgaaatcaaaagttgaagatgtcaggtctgtgttttttgagtcgtatgcatttgctttttgcaaatgttatgtcgggttattcttcaggtattggaatactgcgtaatttccataggacaaacggtttttgccaacatgagtgctaatttttaacaaaaaaaaaaataaaagttactactgcaaaaaaatacagaacacaaagcccttccctaacctatgctaattggttttttttcgtccacatttaatgctcctgctttatgtatgtgtccaaatatttgatgtgatgtttttttgccaaaatttttttaatctaaacacggcctatatatgagtcgttttgaccttttgagtaattgttccagttgtttacagtacattgtcatctccttt

SEQ ID NO: 98544 - DNA, 1894 bp, Oryza sativa
cccccttgtatcatgactaggacgctccatttagattagattagtagcactactcctactgacactgataggtttactgattaatcatgttatggtagttggctagttgcctggggtcttcttctcctcccctgatgggctcatggtgtcaccattcaattaaccacaagtactgggcaaatgatcatggaaacaatcatgaacacaacacaacaacacaacagaacagaaggtactcgtttcttccattgaatattctttccaccagccagcggctgagatagcacgccggctgctgccgagattaacaaattcaggcaggaggaaccaacgaatctgaatgatccatcagtccacatactttggaggtgacgttttttgtcacaatcgcgtagccaccatggcgctcaatatttttcagataccatcaatcctgagaatattttttctgccataattaggcctttggtcttctgcaacccatgtcctaatgacttccttgccaaatcatcataacagtataccacagggttagcagcacatagaaagcagttagtcccaaatatcacccccacagcaacctcctaaaccttataaacaagtcaagcggtcaagccttttgtgaaaacatgatgtacagattcacagttagtacagtttctagtggaagtcaaattgcacaactttttttctgaataccaccaaattgtacagcattcataattgttattccaatggtactccattgacccaggtatctgtacatttgacacccattaaaccttttccagaagtatgaatatcattgatttcagcttaggtcagtttgtattagcaggtagtatttccttttcttgataggtcagcttaggtcagtttaagatgcacttgatattgcagtgacaaggggtatgcggttttaattcgaggtttcgtgtttaatctctaacacgctcataatttttttaaaaaaaatatttggagggacgtttctcactcaaatctcgtttatttttcatgatttgctggcagattccttaccccgatgacagatgccaaatccattatttactatataatctccagggaagcagatttgaggccgattgactaagtggtattatttcttaattaacttcaatcatgttcttaccacacgctaaatctagccttaaaatagccaggtctcttcaaggccctctaggaatcctaaacaagaaaatttatactataaaggagcatttattaggctagactgtatcagcactaacctgccaccaatggctaacagctagcttatcatccactaataaagtttattgattattttctcttcataggcttattacaaggcaattcgtaatgtcctatgatgaaaaggaattccatgataactagaaagcaatgacccaattcagggaagttttcccttgatgattgtaacggtggcaaaactttttttattttagaattggcacagtgaacatcagagaatgagagtggagctaggtgaagtgctctcacaaaaataaattagagatgtggagttgggtatgagttagagatgtgaactgccatggtgttcgactaattgcgtgaccgaagcagaggggatgtgcggaccgctcacgccgaagcgagtgggggcattgcagatttccaaaagtaaatttcataaagctacagttaatttaaccagactattgtaaaactataaatttaaattggtatatcacaagctacatatttaatacataatttatcacgaaactatagatttaagataaagtggtataaaactacatatttagtaacaaaattatcataaaactatagcatttatatattaaaaataacattatgctaggagttaaaacctaatataaagtagttt

SEQ ID NO: 98545 - DNA, 546 bp, Oryza sativa
tatgggaccataagccagttctcaactaaagtgagtagagataatactctgtctcgagactactgaacagctgatgtaatgaaggcaaagcaaaatgcgaaaatcacggaccctattacagactacgtcacctcattgacctgtcttggactgctctaaatggtaaccaactacatgatggcatgcctttcacactgatgtgtgttacggaggattaacgagagaaaaagatctcacgactgccgactatatttacgcattcattagtggtctgaaaaggactctactacgccgatagtgctagctggctaatcctagagagagacacacttctttaaaaaaaaaagctgctggtgcactcaagacctatgtgtagatacacgggaacagagaactggcttttaagatacttatccgatttataagccgatcacaccgtggcgcacattgcaagtaagtatttacgacaagatctcacataattatattctagatgaaaaatgagcccatactttgatgatgagacaaaatatacttgtggatttc

SEQ ID NO: 98546 - DNA, 759 bp, Oryza sativa
ccgtacgcccgtacgttcttcgcgtctacgcgagggcgttcgaatcaaacacgcgcgaagggggagacggcgactcgtgactcgtgaggccaccagtctatctgctcggctctcggatcctacgcaatttgcacacggcaatccatgagctttttcttggcaaaggcagcagcgctgcgtgccatgattcctgctgctttttttcacagagaacttcccggttcggctcctgcgcaaggcaccacggttgattgattcacctgcccttgtatttacgacgttttagtaattgctactactgctagcttgggtttgtttgatcaaggggttcatcattccgtccaggaaacgctctgcaccaaccttcaataattcagatttgagagggatcatctagtgtacaagcagcagcagcagcaacggtccaagttagcctcatgtatccaatctgccaggctgcaagatttgaaaggtttcgcctgcgttgcttgacttgtgcacgcattgctcattttcttaggttgttttcagctttattttcttcatcttatgatcactcttggaaaaaagaaccattttctgactacatgtcttacagtgaattagaagcatgtgtaaatgcctacttcggcttaatttcttgggaccaaaaggtgaaaaggagcatatcagcataatcatatacgaaatgaatgcatatttttttttaacgaaccggtgcagtgaatgaataatgcataatgtttgctgcattcagca

SEQ ID NO: 98547 - DNA, 763 bp, Oryza sativa
tgttgttttcaaatccaaaagatgtgtctattcaatttataatcggggaagtaacatatttcctttgtcccaaatgataaagtgtattagtttttacaagacattcaatattgtacttcgaccattattttttccttttttttgagcgaaccattattttttcttcataatgtatcatcaacaactatgagattaacatcccattaaggtattttcaaatacaaatctaatggtattatatatgtcattaaacaaatatattgctaacttaattattaatcgaagttaaaaatattgatttatctaatgtatgcattgtcttatattttggacataggagtagttaactgataaccttgacttagactttttcatacactttaaatacataatgatatttgagctagaagtatcgctggagtatcaacgaagtatccttaaagcatcagaaattaatttatttttaaaaaagcatggaaatcatcattcaatacaaatccgagtatccaatacatatctgttatggatacgccaaattttaaagaggtatccgtgtttcctacttctttgcatcagccatgacataggaaattaattgatcaatactattgtggtttaggagtagaatggaaaagaaagcgccgtagtgtgtgagagctccgacaagtagtaaaaaccaaggcagccggccatggaaaggatcgcctggcattgtagtttttcgcttgtcgcagccgttcaaagcgcatgcaagtgtgcaacc

SEQ ID NO: 98548 - DNA, 2739 bp, Oryza sativa
tggcgcacatccagcggccgcgcccaggcacgtggcggcgaccgggcgacggccggtgaccgtgtgccgatctgcggccgtttttttgtaccggtttcgattaattaatcttgacctcgaccggtcagttcgatccgtcgcggcgagcggttgctgtcgatcagctgaagccatgagcgatcgagcgcgaggttaatgggagttgttgattttgccgatctgccgctgttgccgacaggttgatgcgctgactacgacgatctcagcgagcatatctattccccccgccgctgcgtacacaggattcacgacggccggccggtgagatatcttgcgtgggtcatggagcaaattcgatcccaatcggctcgtggccgtgaaccatggacgtacgcattactcgatcaatcgatcggaaagatgcggatatgtctagatctgcagcgagcgttttcgttaatcagtgagctttgctagtgccacttttgttcatcgtacgtgaatgaaatccgaatcagcgagccggcagctttattcttggaccgaaccgatcaatgctgtgctatataaaacgacaggttaactttacttatctactttttcaggttcaactattagcttttcacgttaattaaccactgtaaacctttctgcttcgcgtgtgatcctgtacgtgtcctgtacgcgtgaagtgtgtaccgagttcagtctaatttatcagaggagatttcaacgtcgtcagttcaaaggcgagatatataggatatggtcggcctgtcctctgttggtgctttcgcgaggaaaaaactacagtatgtgtcgtgaaaacgacatggaagagaaagcggctagctatagataggggaattcatggatgagattacagtttctggatgagatttcgtatctggtggtcctggagcatgcatggtttgctgctgactgaatctacagatctgcatatccttaatttatgtgttcggtaatgttaacggaaacgataatgctctggaaaaccgtctctgttttgtaaaccaaacctctgccttctaactagtagtagttgctaatttctttgcctcaatagcttctcttctagtagaattttgttctggtgcacccaaaaatagttagtcgatcagttttggttgacttaatgaatgcaaagttgaaactttgttaggtcataaacaaatcagtacaaagtacgtactactacaaacaaacaagatcatcaattattgatcattcacaaatcccactagctgtacgatcagcggcgacagatatatcataatatataccatgtgatgcttctaggaatgcccggtccatggaaggaccataataacatacatatgtgttaacgaccaaatttaataagatataaaccggatttggtattgaaatcaaaatggattcgacaaagagctagattcgaagatatgaaacaggtttcttgtcttttattcttgttgattgcaggattaaatcaactggcacgctcacgaaactaaaagcaaaattttggacttgcacaaaagttaagcaaatcttccagaccagtatatgtttttcgcatcaataataatatgctacgatccaacggcgcagagaacgccgatctacgatggaccactggaccaacgacaccaacccactgcatgcggcctccagatcgatcataattctgcaacggtttcggaacaacaacaacaaatacctagactagatcgatcttactcctttgccgatcgagctagctaggcgagagggacgcacacactggccactgtttccgcgtattcttggccggtggcgcactgctgcatggaagacactgccacatgcaggaaaccgatgcgccccgacacaaacggttgcgcacatagccgcgagaaaactatgattcggccgctcggccggtctgaagtgctgcggctacgagctcttcttgcaagctatttaccgttgcaggtgtacgtacatataccacagaaaagcctatcactaccgagccattgctataccacagaaaagcctattactaccgactcattactgctggctcagtgtgattgtgtgaaccggcacgtgttctgtgacaggcagtgttacgtacggagcaacagatcgagtacgcatggtacgacgaggaagccagccaagccgatggccatgcatggacgtgacgaggaggatcaaagagtactgggatgcaggaaacgcagattgttgagaggcaaaggcacggcaagtacgatctgtgcgtgcagtcgtccacactgccattggtgagcggtcaacttaattggccgttttaattgcaaggtcggttgtgccgtacgccggcaaggacgtactgtgtgtacgtgtgtgtcctgctttgttctcgtgagaatttgatgcatgagaacgaaacgtaactgaagatagatgacactgtgatgaggtacgggaaacgtactgcattgaacaggggggtagaatagaaggaaatgtgtacagtacagtacaagcctacggtcgaatgaaacgcgcatgcacgtacgggctgcgagtccaacaaaagctcggagcagccacgtacgtacgagctagcatgcggtaacgtacaacagcaataataaatggtactagtaatcaggtagtctcctacatcttgtactactaatttacacatgcatgtgatcatgcatgctgcagcagcagcagtggtgattgatcgatcgacgacga

SEQ ID NO: 98549 - DNA, 3692 bp, Oryza sativa
cgatcgccgcgaccgagtcgacaaagcatggtttaaaatgcatggaaagcttcgctaagaccgagaagaaacaaaaagaatacaagaaacttctgcaaagcggcaagttttctatggcaaagctactccggcagccgagtgagatccagtggcgacgtagtggcgacgtggtgggggctggccgtgtgcgcgcgaaaggctgcccccggctcgcaatattctacgcctcgcctcgtcgcggcggagggtagggatcgggaggcgaccggggaaaacgacgggagccgggcgccggggcacgggacgggacgggcgcgtgaggcagcgtacatgtggatgcatgcagattgcagatgcgtcgcgtgggcatgcacggggcatgggtggtggtggctgggctgctgctttggctactagctgcagggcatgcatgccccctctcttcttcaaaggttccttcccttgtccatttcctccactggccagtcccccccacccttcccctttcccgagaatagatccagaagctaaagcacgtactgtttatatactgtactccctatactacctaaaaaactaaaaatgccacgatactactaccatgcatgcagcgagacccgtatgtatgaccttatccgtactgtacgcgcacgtatatacgcggtgcgtacgtacatgtagctggtcagaggcgtcacgtggcgagtatggcttggctcgccgggcccggcgggagagggtggctggaccacgccgtccggccggcaagcggcaagctcgccctgcatccgcatgccccctgctgtcctgcggcgacgacgacgtagcccccgtcgctgctgcgcctgtgcgccgtggaccggggtctggtcggatctggccggcccggccggttttggggggtttcgaacggtgtcacgcgtggaccaccgtttgtgtgtgcggatagatcgatcgatcggtccatgcatcgcggcaggcactatgatgatcgctacgagtcagattaggcctgacaggaatatgttggtcgctagctagagctaccctctatcgccaagtttttatcacggtcacacgtacgtttttaccatgttaggaccgcgggtatgtgtgttcgctggccgccggcccgtccggccgatccatcgaatgcgtgggggtgagcacgtacggtttctgggcaaagtacggatcggatccggttgcgatgatgaactgaactgataatatgcttccggccgggcacaccgagttcagttggaatgttggattattttgcgtactctttagataatttgacaatgattataggaatcgcccacggaaaggcgaagatgattggagttcgcaggaatataatgctgcttcggcatataccgtgcgccccgctctaactaattgctgcggtttgcttcattgatttgatcatcactcgattttgtgcctctctgaaatggcatgctctctccgtacgggtcgctgattatgggacacgctgttcatatggatcttgcaaggcagatcaaggtgtgaaaagtcatgcatgtagtttagtggttgtaatgacctaaataacacctcaatgttatgagtttaaattttcacaatagtgatatttagtttttttagagtgaatttttgcacctactaatactagaggtattttttacctcttaataccagaggtaccggagatattgaattttgtcctagaaaatatggtaacttttggtatctcctcaagaactcaaaataaggctgagtttagttccaaactttttcttcaaactttcaacttttccatcacatcaaaactttcctacacacacaaacttccaacttttccgtcacatcgttctaatttcaaccaaacttttaattttgacgtgaactaaacacacccttaactctaagagcaaatatatacctgcatgctcccatcgtttgcatatgaatgaaaatttgaagtggatttactgagaggaaagatactactactacaagaatacagcagctttgaaactgttttcatacaaagtacaaacgcattttcaattttctctgactctctcgagtcaccaggagtactggactacgatgtacgagtagtacgcaccaaaatgctcagatagtcaggtcccatttttaccaagttaccctagtctgactggtctgcctcatacgacatatatgcacgttgaattgaatgattgaaattatgagggccaactgctcgataggggaacaaatctacccttagctagaagctgagaattacttcagctcagaatcatcaagatatgttgcagggaccaatcactacgaagaacagtcgacttccacagctccggactcacacagcatctgacacaagattccctgtggcttttcaatgcaagttttcagtgagcaattatcagccaaaactgtgactacttgtcattaaaattactggaaaaaggagctgttctttgtttagcatagatctcgagggaaatggtataccctggaatgcacaagcagggaaaaagcctggataaagtgtagccctacgcacacatgaaaagtagcaggaaggagtcttttcttctaatctgtccctgatgcagctcctgaatgcttttcctagagaaacaaaatgaaggaaataatgacaggagaattgacttgcacttattctataaaagcagtgactttttaccttgtggcatcggtactttggtcttcaagacaaaaaaaagtatatagataacgtatctccaaaatgtttaaaagatcttggggcgccaagtaaacaggaacttccccactttttttcccctttaacctgactttcaactatcagtacaaacctttattcctgcgccccaccttccacattgtattttcagcgtaaatcttgcatggaattatcaactagctttccatcatttccaaatggttgccactgagctgaacagaagttgttattgatagaggtggtgatactttccatatgataatgatataggagtattcatctgcaaccaatatggaagaagacagacaagaatacctattttgtcagaacgaatttggagtgttgagacactagtccaaagattcttgtcgcagaacagcaccaaatcagggatcctagaagcaatagctgcggacaagactttcagctctctcgttattttaggtagaaagtgcacgtctagtctacaagagaagtgatactagtagcatggttccatttactctcaaccagaaaatgaattttcttttatcagctatcttcagagtatatgctggtaacagctagcagtcaggaattcaagatatctgactgtctgatctatgtccaatgagctactccaccaatacaccatccatctatctatcttccttgccaccatccaaattagcaggtacatccaaatcatagtagttcatactcctacatgattgtccaataatacctgccactgccactgcttcattttgcgcttaatttgagcaaagctacccaggaaaatgagctgaaagtgaaactgaacggtagaagaactgaaacttgggctgtgtttatttgctgaaaaaagttgaaagtttggagaaagttcgcagtttggaaaaaaagttgagagtttatgtgtgtagaaaaattttggatgtgatgtgatggaaagtttgggaatttgagg

SEQ ID NO: 98550 - DNA, 1347 bp, Oryza sativa
ccggtcgccggcctagccgcaccggctggcctctctctacaaggaagtagacactagaagggcaagagcgacattttttgtgcccgggcccacatgtcagagctgccaaacggttgaatccacacagaatagcgacggaatggcgtggagggcgcaataaagttcgacgatggcataaagggaggctcgaactttttagtggcacagaggaagggatcatcttttttaatggcacacaggtaaaaacctctgggatgggaaggggattagaggaggtgagaagaagagatagggttagaaatgtgggcttttatttgttattgggccaatgggcctgaaatggtgggtgatgggaaggttcaatttgggcttctttttagttttgaatgggtataggtatttttttccctatatatgcctatggaatatatacttcatatatgtatttttttttccaaaaatcttgggtattcatttgaatacccatgaattgaagtgggcccgcccgtgccggtcactttactgctgagggataaaaattgacaggttattatgagttggagaatatgctatacctgttatttttgtttacgaattttactcggcattaaattgaggaactaaaggtgaacttatttccaaccccaaaaccatataagaattaaacgggccactaacacacgaagcccattacgtaccgaaaggcctctacagtggaggccggcgaccattaccagcccagtaacaccgagaaaacatcacaaaatgggcctcaaaacaaagcctagtccagtcggccgttgctcgtcagcgatgggcctccataacgaagccgagcgtttcggccgcgccattgaaggcgcaccagttgttcagacctcgcgtctcatacaggtacagtagatctgagctgctgctgctgcaatcatcgcccgtttgcagattgcaggggcggccagttcactacacgcacagtcaccgctcactgtggcgtgatgctccgactactgtgtgtttccatccatgcgcacacagcacactggtgcctgcgtcacggacgctcgctacagttggcttgggcttaggccggtggccatatctcgtgcatgtgcattctcgtcttattgcgggaattgaagttgtcatggtacttaccagcaggttataaaacgttttgactttaattcaagtcaaattaccttagatttgactaagtttaaagacaaatatagttatatttataataccaaattagtttcattaaatcaataattgaatatattttcataatgaatttatcttggttgaaaatgttattatttttttctacaaacttagtcaaactta

SEQ ID NO: 98551 - DNA, 2667 bp, Oryza sativa
  unsure (1)..(2667): unsure at all n locations
atacccaagttaaaaaccctggacccgcccctggtgaccggttttggttgacatgataagtgggatgcacgtgagccccacatgttagtggtcgacttttctctctcctctccctcttccctctcttccccatctctcacatcctcaagcgtttgagcatggtggtcgacgaggaggggcgcgacggtccgcatcggctagaggagacccgacaagacgggatccggcgatacctaggtccagcagtgaatggaggcggcgacgcgtcaacgatgatcgtgagaccatcgagcttgagcttgacagcactggcgcttgtggaagggaacgacagggcacagcgcgcgtgcctctatctgcattgctggagttgttttagtctcgatctgctcaactaggttcgtctcatgttggagtgtataaagtgaattgcccatctttccctatcagcttaggcttttaggtgcaactggctggtgcatgcaacttaatatggtatcaaagcnnnnnnnnnnnnnnnnnnnnnnnnnnnnnnnnnnnnnnaaataaaataattgtagcccactccaatattccacgcttgagacttgagggggtctcacgtgagggggagtgttggagtgtataaagtgaattgcccatctttccctatcagcttaggcttttaggtgcaactggctggtgcatgcaacttaatatctcaggccccaaaattcttgcttgcatcacctacgtctagttctatcgtgcccatcgctagtcctcgatcctctttgttggctatagcaatgatttatgtgatctgttgaagctaagtgtagcacgttgtgacacttttttccatattatcctttgatttttcaatctcaactatcgatgtgtttatctgagttttgatgagtgattagcaatttgtctgtggccgggatactgtcggcgagaatccactaccaagcacctccgctcgttgtccgccatcgacgccttactggccctacagctagcagcaagtttgcgacgtcccccttagcttccttcgcgcatagctccaccactaggccaccgccacataactcaactgagaggagagattgaagagatgttgctgatggaccgtcgcggccccctcctcgttggccaccccgctcgaacgctttagaatctgagagatggggacgagagggaagagggagagggagaagagttggcctttgaaatgtggacctcacatgggcctcactcaccacattagacaaaaccaaccactataccacaaagggaccaattttaacatgataatgtgagttgaggatatgctatacctgatatttcagtttagagatgaattttagattcgtgacaacaaactagggacttaaagtgcagttattccttttcggttttagcccactagccagccagtagtaatggaccaggccataatagaggtcaactcctgcaaagcctcaaagtgtgaattttccttttcttttagagttaccctggtcttacagtacatcacaggtaaagcctgtcactggatgcatgtggatgtgcatcgacaaaatatgcattttccttgttgtattctggcatgtggatgtacttttttttttttttgcttcaatctgtacacattttcatcacacaaatctgctggagcctggggacattggggaaaaccgcggtcagccaaacctggggtcaacaaccatcgtcatgcgggaactggccgactgacctgtagatgagctacttgtttatatgctactttactaccaaatgttaactcgtgtttttttgcccataattgaccacagaactcttgaatttctgaatgaacagcacctgttctgaagaatctgaaaatggatgccatttgactttctgcaaaaaaagtcccaaatctgcactgatccaattccgtttgcttagttgctctagtgctgaggatagtagtcaacgtactgcaactgcctacggcctaataaccagctctgtttgacggtttcctgccgcagttgccgactttgcagtgccccgtgccaaagcaccaaccgaagatttcgctttcaagctggctgcacggcgagcaagtgtgcaactcgatccactccaccgtttgtcttaaaaaacggcccgatctagaagaaaacccggcaaatccaatccgggaaaacgctatgccgcgagctatggattccgaggcctaaaccgcggcaaaaacgtgcccaagcccaactcccgcgcggcgccgaagcagaggtggcgattcccaactcttgctgcgaagtcagcgctcgcgatcgcctactcggctactcggctactcctcctcctcctctccccatctcgtgccgtgcgttggtacgcttcatgggcgcagatgcctccctcgagatcgctcgcgtgccttctgctgccgccgctgctgctgctgctcgagtccgtgcgggacgcggacgcggggcccctggccgtggagatcgtgcggcccagcttcacggcgactagctacgactacgtcgacaccggcggcgcgttcttggtgtccaggaacggctcgttcagggcggcggtgttcaaccccgggaagcagcaggccagcttctacctcgccgtgctgcacgcgccgtcggggacgcccgtctggtcggcgaaccgcga

SEQ ID NO: 98552 - DNA, 673 bp, Oryza sativa
tatagggcgaattcgagctcggtaccccttcaaaataaaccggagcgtcagaagtgccggagtctaaacgacaaacaaggtgcacaataaatacatgctaaaaagctactgaaacaacaaaagaaaccaattttaatggattcttgacatttaacgaattcactgcaatttgaatgggttaaaacggagctcagattattaagttatgaattttagaagatgctctgtgctattactattaacagaaaaaccttaatcaattgacagggatttaagcccgaaagaacataggatcaaaggatagattgattggcaagcgtgcctcacgtgataccgactcaacgagtcaattctacgtgacacaggatcacccaaatgatcaatcgaaaccggtgaaaggagccggcggctctgaacggctctaacctaaaggacgactcgggacggacgaacgaacgaaccacagggaacacctcgttcaaatgaacgagtgaacgacacaacaaccaaaccgaacctttgggacccaaaacccccctttttaaaaaaaaaaacccccccccggggggggggccccccggctaacacgattacggtaaagccccggtacggcaaacgattggccggtaggaaccttaggttgcacctacggctagacaactcgactacctat

SEQ ID NO: 98553 - DNA, 600 bp, Oryza sativa
tcttacatcctgaaacggagggagtagattataaaaatagctcaaaagaaggcatcatgtgcactctatatattatattaccacattaattgaagaaaaaagtaaatatttacaccattagattgttatgagtccagagtataacggtgtagattgattattggatattataggcatttgagtggttgacataatacaactctattctatgtaggcaaaatctggtcaagaaatgcaatagaatccaactccagttccaaagcaattaggagtagttgttaaaacagatcagtagtcagtattcatgtactgattttctctttcctttgaaaggattcactcagggatgctcagaagcatacaaattaaaaaaaaaaaggtctctgacccggttcaaacaaactggctggctagacaacatcacttccatgtacatacatggtggttctggacttccagcagccatgcacattgagagaacagagaaaggcaggctagatatttaacaaatgaaaaaaagtttctgttgacatttaatcaaattttgctaaatggcacaatcaaattccagcttcaaacatagtagtacaactaaatttt

SEQ ID NO: 98554 - DNA, 706 bp, Oryza sativa
atatagcaaacaaagtacataaatagctaggtattcttaacacaaaattttattccatcttgatcattctttcttcatcttgccaatcatatgtagttcagaatacgaggcacatcagcaatcttgactggcttcagaatataatcctttgctcctccatcgaagcacctccaataaggaaaaaaaaagaagaaaaaaggagcacatattaggatccacaagctcagatgagaatttatcaactaaagaaatcaaggtatacgttttcatacttactttctgatcctttctgggatgttatcagaggaagcaattatcaccgggagatgtaccagtctaggtgatttctaaaagtaaaaacaagtcaaattttaacatgtaaaatatttgctagaaacattgtaatatatatatgatgaaaattaacactatactccgatccatgacactattgtacgcaccttcacttccatgagtaagtcatagccggtcatctctggcatacaatagtcactaacaatcatgttcacatcatgttcctgtgtccatcagagataaaaacatgtttgttgtatgatatgtaaataaaattacctaataaacaagtagaaaacttttaatttaccgagtccaaaaatactaatgcttgcatgacactttctactgcagtcactgcatatatcaaacatggaaacacttaattaac

SEQ ID NO: 98555 - DNA, 542 bp, Oryza sativa
ttttgcgagtaattcgtgtaatatatctggaacatttcagggtcgcaatcccgcaggaatgacaagtgctggtttcatgcagataagtggagctgctggagatcgggtcgtcaccaccacagcctccacgtcgactgcggcaggtagcggcagggcttacatgcatcaccctggagctgccacagcccacttcgcctacgtcaattcccgtcccgattgccggttcttgcaaccctcggtgtccgctacgaccacgggctccatgggtctgccgacggccagcagtccaccgggaatctcacccgtggccgatgatcagacaagaactctcagatcaacaccgacctttcagttcaacggtatgagcatggagctgcaccctggccagcagcctcaacggttcgacctgagtggaacgggggcaggagcccacatacgctacccgtcgcccatgggtagcgctgcggcagccatgtacaatgctgccgccacggccccacctcctcatcctcaccagcaacatctttcttatttcaactatc

SEQ ID NO: 98556 - DNA, 718 bp, Oryza sativa
tataggcgaattcgagctcggtacccaattttaaatagtacatgcccgtcgaagtgccaagtaaattggatcccgcagaataagatgatctcacttgtgtggtgtatgccttttgtaaatacagttatacgttagaatttacatgagttctgatgccacttttttccaccctatactgcaatttcattaactgttttctgattgctgcaaacatgtagttttcattttttttcaatactttatacttttgatcaaacagcatctacgttctatatattctggagaaccccaactgaaaagttttattgctttgtcaagacagaaaatagcaactcggaacacatttatgattatgatctatcatgacatcctttgttgttccttattcatttccatgttcctaacaccactggattacatccatcaccttcatgttatttacaattttccttctctgactatgaactcatttctgtttattttcaattttaggggaataatgggctttgaataaccccccccccaaaaggtttttttttaaagggggggggggggtttttgggggccccccccatactatggatctcatggcataaagtggcaaaattccatttgtatgattggatgatacttatctttctagctgttgtttatgggctgttcaacataattgacccttcggaccgcttcgttgaagtgacatgctgacagacttgag

SEQ ID NO: 98557 - DNA, 685 bp, Oryza sativa
tgcatatctgataaaattaaccgttcgaagcgaccacgattgaaagaaggttaagcagaaattaaaaaaaaacactatttcctacctttcatttccaattacttatcgtccattctaggtttgtcgtaagttaaatattttaatatgtaaataccaatttctatatagatttaatatcataagatttatatttttatttatagattcaccactagaaatattttcttagtatataattgatatgctgttaaactacacgaattttcaaaaattaatgttcacatattttatttatgataaacctacaacaaatggtgagtaatttgaaatggagaaagtctttttcttatttattagctacctaattaaatttgtacacgaatagtttcaacttgcacggagatttttatggatataaaaaaaagtgaaattaatgagagatgattgtgattggttgaggtggaaaagtaaattgagaaattaaataagagactattgtgattagtggagataagggccgggagtatgtgaagaagtagtttttttaaatcaaaattcgaactttaatgtaacttttctattcaacttaatttgagtatatttacatttccataggataacacgcataccgatctagaattttgtcagctctcggcgaacttctgctattgcttttctcgaagga

SEQ ID NO: 98558 - DNA, 661 bp, Oryza sativa
taaaaggtgggccttttggaccaatgggccaaaccatgcccatgtacggtactattcacttgctttctttcatttagtaccataccatctatcaaaccagaaggtgaccaattaattaatttacacaagcctctttattgtattgaacatttcaatatgaacaaattaaatagtgcaactacatttatcattatagatatatcaaatattagctcattcattagactgtatttttcctcctagcttgatacaattgttgcaaggttactataattaatttgtgcaaaatgaacacctttataggtacgaaagaggacaaagacatttatcattatacattgtataatatatcacaattatcaaatatacggtcactggtgatattgtgagatatgacagctaacattcatgccagtgaattgatattatatctttgcaatatctccacgatttgagaattttgcactataaataagtgcattataggtccattttcctcaactaaaattcaaagtaactctacactgaaaccttgcaatgtcatccccccatgtgcttgttgtggatgatacccatgttgatcgacatgttatttccatggccttaatgcgccataacgtccgaggttctttgttgtgcaagtttccatgttttcttactg

SEQ ID NO: 98559 - DNA, 615 bp, Oryza sativa
aatattgctttatgaatttaatgatgttatggattgattgctaacatccatctcttgagtacttcctcagttccttatgataagatgttttgggtttgtccaaaatcaaacttattcagtttgaccaagtttttatagaaaagtgtagcaacatttgtaacccaaaacaaatatactacaaaaatatattaaatggtgaatttaataaaactcatttagattttttagaggttgctatgtttttctatatataaacttggtcagtaataaagaacttagaacaaacccaaaacgtattataatatggaattgagggagtatttgttaaaggggacatacttacaagtatgtgtgtttggtgcgtgtgcacatatacgtgtccaggcaatcataaaacaaaggaaaatttctatcgtgtcatatcatgaaaaaaaacatacaaaaggagagaacaatcccttttatagtggggagcatgggaaaattcacgatttgctacccatttcacggggctttgataaaatggcttctcccccggtgctagtgagctcctagagcctcgaacatagggagaggggagagagctctaggggaggggcataatatgtaggatcg

SEQ ID NO: 98560 - DNA, 686 bp, Oryza sativa
ccaccagtttaagtgaaaaccgaaggctaaatgttttgttttttattagaatttctagggatttctctaatttattagagccccacttggcggtttaggagcgtttgtaggaagtttcgtgtacttttagtatataataataaatagatagatagatgttgtgttttatgaaacacttatatcataaaacttgtggaaatatgccacttgtcataatacacgttgttttctacaactttggctataaaaatgcgattttctaaattttacttttaaagctacagttcggacatatttttttgtttttttatgatatgattatatcaaaggtacaatgtacatgactatcaacgctctaacacactctaacatatacatgttagagtcagtataaatacataatctaacctaatcctactaaaaacgtacccacacgtatgtaacaccagtcaacacacaaacatactcccttcaacctataattagatgggacacatcctaatacaataaatcgtgtcccattcaatgttgggttgacggagagagtacgtgttagcacaagttgacaatggcctcacaaaaccagaaaagagaaaccattcatttcatcttactttatgtttgtcataagttaaacatttgtatctttgaccattaatttttggacatcaatatagttttatatc

SEQ ID NO: 98561 - DNA, 826 bp, Oryza sativa
aaaatatttaaatcatgacaacaatcataccacagtgcacggaacaaatgaattgtctcccacactgcgaaatcaatttagacccgagaaggcttttttgtttgaaatatatatagtgttacatgcacccaaggtatcgattaataacaatgaaacaatctagccaacatatagaaaaaaatagcaggtgcatctcaccaaagatacagtaagttgtaaaatatgtagccaattttctacatactaaaaggaacaccaaaagtaactatcaagttctattgatcgttggcaaatagttatacgggcacaaagatttgtatgtaccattactttcataatcaatcaatgtaaaatgtcaactttaagccacttatccaactttttaattgaatgaacaattgtgttcatcgcactcataaacaaatgatcttcacgggcattcttttcacatgttcctcaaatatgcaccctcctatgtgacgagcttggctcagactcatgggccacctttagaaacaacttttgtaatgtttttacacaactattttagtggagtacttaacccacaagatagcattgaaacttttatagagagaactattttagtgaagcacttaatccgcaaaggtagtattgaatcaatctactcccttggctataggggaaaaaactcattttatgtcctaacgatattttattcttttttaattttttttatgcttctctacatacaagccatatttcgctttgacacatcaataaatgaatgtcaatgataattaaacaaatttactaaattccacaacttgcatgtataagcttctaa

SEQ ID NO: 98562 - DNA, 529 bp, Oryza sativa
tttcaagtttttgaactagatcgcacccacctaccaaatttatttactgtacacgcaattgactaaatagggtaaattggcttaaaccttaatatttgctaaacaacctaaaaacggattagctaaaattatgtcgacacatgctatagtcgatttttttagctacttacacagtaattacacctcacttacacccgcttacacctaacttatatatataattagcatgtaatttttgaatttacatatgtaattttaggattcacatatctaattttcatatttacattataaatacactaaaaacatataccttatttagacacttacaatataaataaaccccgactatttttggtgaaaaaataccgcgccataaatatagctacaccttaaaaaaaagcttatattgtaataaaacagatattataaataattatcatgaaacgcttaatctcctcgaagaaaacccaattccaatcatgaacccatccaatcgattccaccctttgcatgtgtacaccacacc

SEQ ID NO: 98563 - DNA, 570 bp, Oryza sativa
acatggtgacatgatgtggggttgtgtcttgtgggtacagtggtacacctctgatcagagtaaacttattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcttatgcaacagggtatgttgtatagcgttggattaatattgtttaattacttaactgttttattaaattctcaaatgtttgctaaatgctgcttttgcaaatgaaaccctactatgccatcctttgttatcctgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttg

SEQ ID NO: 98564 - DNA, 594 bp, Oryza sativa
gatgagttcgaggacgagagtgacgatgaaggtttgtcttcctttattgtgtccacagattctcattaatatccacttgtttctattagctatatgatagcataatatgattctgtgaaaatataaattaaggaagcattatttttgcagtttggtaagattagtatggtttagtttgaactgcctgaccagatgagtgatatgactcatgcacgtgacaaatgccattaattgaaaggccaattcttgaaaaatctgcaattgtgtgattcgtactcttaacagcagtgatcaaaatattgcacctttcatgcttggcacatataaatgcaactcaataggataaagctatttttttcatcatacaggactgtttcttgatattgtgattgtaaagtaaaagtgctatttaatggttctcctgcacattttggaatagtttggcccgaattatgttgttcatgctgtaactattatggtggtaattagtctgatatgtttcttacttgcattgattttgtgataggtatgatactaaccttaatcacatgcatcaaaagtttcttaaccattatacttacatactggttagga

SEQ ID NO: 98565 - DNA, 1393 bp, Oryza sativa
catggtatagtactagagctgaaaattcagaaaacaactggttcaagcataagtaagagataaaatttccaactaatgaaattcttcatgtgattgatcttgtatattcattattctcagctgaacttgtgcttgtgaataaccatccatgattagggaaccttatgcatctaagtaattgctttatgtgagatgattaagatgaaaggaatccttgcaactttcttatgactcttgggaatttgttttcaaaaatagaactattttaaaaactctatcctccagttgactttaccttatacctaccaagaccatatgcaagtacattaataatcaaacattatcatgcatatgactgcttgacattatattgagttttgtcaaatttgtgtgacttgtgttagatatctttcatactgtcatgatcaaggagtcagtatcatttccactttccaatttcacatataaaattaagctaagcttctacactagaagttggctttccacaaaaatatcattcaaataaactcctacaatgaactatgctttcttttcttgggaaagttcatggcaaaaagaaaatgagaaaaggagggaaaggcatggctatgaaaaaaaagaaaaaaaagaaagaagaagatggaaataaagcttgtcctaaaaacattgagcaaagttgaaaagaaaatatagccatgccccttccatgatcatgccaagagaaccaatttggagagaaagaataggaaaaaggagaatcatttctttattccagcattccacaacatatttccattttcaaccacaaataaagacccttgatctaggagtatgacgaatgatcttcttgagtccatatttctgactttgcaatatatatgatgcaagtatgtcaccagtttatccctaccaagctccacataacagccttagaatagggatgaattctggcatactttgccttggagaggatccaaaaagaaaatatacatctttgagagacaagagagaaaagtcaatatgaggaaaagagctagtttgcgaaaattcataaaaaccccacgagtctaacagagaagcaagaaggactggaatcaagatcattccatttatcaattactcaagatggtaagatagccactgataaaattcacaggtataggtatgggtgtgaatgatttatatgcttgattcatctcttgaagaaattcattctacactgacctttactcagggacgagcaaagtgctaagtgtggggggttttgttggcggctgttaaatgtcgattctataccgccaacgtctgcataaagttcggataataaaacatccaacatagtgataggtgcttaatctcacgtattccacaagtgttggtgtatatttgtatg

SEQ ID NO: 98566 - DNA, 596 bp, Oryza sativa
  unsure (1)..(596): unsure at all n locations
ccccagttagtgttttaattcttaaaacctgcctaacaactaaaatgtggaatggttggcctgggttggcttgggacgagctgggacccagggtcgggttgccagttcggtctgaatcatcgtaggccttgggttaaggcaggttcgtgtgggctcacggccttgattaataatattgtatagctctaggaccgtgtttacaaaatagctttgagcaactaagtgacttttaatgctgtttactgcaaaccctaaccctttatattataactcccttgtattcccttgcatttattctgcgcttgtgggtgtgtcttgttgagtacggtggttgtactcagtcttgcacaattttccccaaactcagaagaggagttcctggaagatgaaggctttggtgtctagctcgtgcctgccgtcaagcacctgtggtcgtcgccctagtcttccgctgtttgtcgtttgtcttctggtgtgctgggccttcgccgcccatgtaataaattaactatttacgcttncgctgttaaactctgaactgtgtcaacttttggtgtaccttgccttctgngacaaggaataatgcacgcacgtaa

SEQ ID NO: 98567 - DNA, 585 bp, Oryza sativa
tgtcagttatgttgatctctcatgactatgaggattttcaggagttggttgacaaagcaattcgacttgaagacaagaagaacaggatggataaccgtaaaaggaaaatgattgtattccaggaggcacaggatagtagccagaggcagcgtatcaagccactccaaattggtgaatctttttctgcaggtcaagaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccatagaataattatcggagttatggaataagatagactgcagtttacctatgcccttttctttc

SEQ ID NO: 98568 - DNA, 582 bp, Oryza sativa
tttcacaaagggattatcacgaaatgtgatagaaaatgcatcaaggaaaaggggattgatacccatgtgagtcacacaacagtggtaacccatcctatgtgatcggagatcccgtgaagtaggtaatgggtaaaaacaaactgttgggtgacaggagagtacaaaactttcttacccgttcctgtcgaagatgcagtactctcattctgtatggtagggtgacatatgtcttaatgtgctctgaggttctcttagagacgaggtactgtcctacagggtacacttggaatagcacacctatatgagttaactgtggggtcgcagttttgagacatgggaactctctaaaaactcatgaaaagacacaggggcatgaccgataaacgccccaaccagaggcttggttcctggtggcctcgtatcagtaatgacttcaaaataaacttgtctacggaaagctagcaattcaaggtctgtccattgtctagctgtagatgggtggaacttaatgttctagacagtatgatcaacccttaatgggtctactgttgaaacgctggtatacaaacaacaaatggcagt

SEQ ID NO: 98569 - DNA, 948 bp, Oryza sativa
tgggttgatttgagatgactaatttattaaaggtcattctcttagcatgttatatgcttaatttggttatggtgagagtcatagcttaggctattagactcgtgaattaccatgattaaaaatcatgtttggtggatctttttaagagttatttactcgaattcctatcaaatatgtctcttttttggacctttttgagtgttatcactcggccctttttgtattttttatccttgatatgttcaagttgagaagcagtcggctggatattttactgagtaccatgcatgcttcgctataaaaccactcggttcttgactacatgtttagtttttcaactaatcatatagtcgggggctacacctaattaggtgcatctactcgatgcaccatgttttattttcgcccttcacagtttttgattttagcactcggcaagctggagcaagttgaattgaggcactcggattactgttttttgttttgagaaggctattattgtcaactgcgaaggtctcgggggctactgtggagattatggataccccatatctacatgacaattataatttagttggatatacggtaccaaatatagatagaatatctttatgaggactcgggttagtttttaacttgtatgtcaaggaattacccgagatcttagtcggttacgattgcattttatctgtaattacatattccgttagggatatggactgtactttgtaaagcggactctttcccctatataaggagggttcgtgtgcctctcggggcacgatttcttttttccagtttatacaatcaataacacactcggcggaataatccccggacaggagtagggtattacttcttgaataagaaggcctgaacctgtataaaatcctttgtctccaaacccatccactttcctagcttgatagccaccccgttttattattg

SEQ ID NO: 98570 - DNA, 768 bp, Oryza sativa
cggtgagcacccaagcttgtggtgtgccacggaaagtttgtgaaggcttcgatttcgcctccgcaagggaagaaatcaagagtgaaaccgaggagtgcatttgtgcaacctcgtgagtaaagggttgaaatagacccggcccttgtggcccctcaacggagacgtaggatccgtagatccgaacttcgggaaacaaatcaacgtgtcccctctcttggttgctcgttcttcccatctcctatattgtgcttgagtttgtttttttacccgatctacttgcatgcttaattaatatagttagtgaccttatatcttgcttaaataccttatttgtcaccttttgattcatatacattttctttattcgagctacaagttcatagctagtgttttattccgttatccgctgaacctttcggttgagacaagaacttccaatcccataccggaagttcctatttgaaccgaaagttctcatctctctaatatgctatgaagttgtgataatttttaggaacgcctattcacccctctctaggcgacatcaaggtcctttcagtttccaaggattcagtattcatttttttctctcatagatattttttattctctttgcacaaagagcaattacaaagctatttgagaaataacaattcaataaagcatatatataaagcatttataaatcaaatcatatgctagcatcaatattgcatattttcttaattcaagtataaaaattaagtgtcatgcattatctcccttaaa

SEQ ID NO: 98571 - DNA, 616 bp, Oryza sativa
tggcaatgttttccttttagcatgttttccaaactgctaaccgactgctaagattagaagcttaatcagttgctaaacaatttggtatgtgttttctaaggatttgagtttaaggactcttgtatggatttttatttgttgatttcttaactaatgttgttggtttaacttaactagttttaaaagaggtattttactgttcttaaggttgtgcagtaccaaatggcaaatcgtgaccgttgatctagcatcatccaacggtcaaaaatcgtccgtacctcattgaagcggtatcgtgggtgagagggtacgtctgtactttcacgtgcggcatcactttctttcgtgtttcgctttcttctctctttcacgataggaaaaaaatcgccggggaagagcagtgagagaaactagccctaaatcgcagggctggggtggctagaggcaagggcaacgagagatggtggcgagagcacgggcatgaaggtcacaaatcctagatggggacattcccggtggtagcctcaatgcgactgtagtgtggtgacctccatgtgcgatggcggcgcggcgcagactgccggcactgacgacctgatgcggtttatggaacaga

SEQ ID NO: 98572 - DNA, 1641 bp, Oryza sativa
catggataatactactccctccgtgtcataagataaagatttttagacttaaacatgggtattaaaaaagcatgtagaattaaataggagaaagttgtgatcggtttagaagtagaagtaggtgagaaaattaaatggtgaagagttataattagatgagaagagaatattgatgaagaaattgttatattttgggataaaacttaaggactagaagttattatattttgggatggagggagtagattctgagcttgcacgctgcacataaagtatatatttatcagctacacgtagattaactgagcctgtagctcgttaaacaaagaacaaattttatttcattataaagaaaacgtacattaattgagacgattttctttcgccgatcccaaagcttttcgattgcaagtgccgatgaataactgaggagtcattaaagtgccgatgcatgcgctcggcctgaataactgagtcatattgttcagcttgttcttatgcgtatcgcttattagaaaaaaaaataatttatagttgaaacttttatataaatgttgcaaaataaattatgactaaagaaaaatcataaaattaattttgaaatttaaattttagcttctactaataattagcataagtgggaagacggtttgtgctaaaaggacaatacaaaatgcaccgacggcagccagagtgacgcagcacaccgctagcttgaagctagagggtggaaaaccgatcatcagcacataggcacgcatgcatatttttttttttttgtggggaaggcacgcatgcatatatgaagccacaagcgcgatcatcatcatcgcgatcatcatcataatcatcagcatatatgaatgtatatatgcaatgcagccacgaccgactacgtagctggatgctggtggatgacagttgacacacgcatgcagatatatgacacaggtggaaattaagcttgagatatgatagactaatgaacaagtaattaattaaggtggtaaagagtatggtgatggttattttaggattacaattaagtaaaagttagataatagctagctagccctgtactcggaagtcaatcgctgatgttgggctgccatagctgacaatgtttctattgctgatattattgtacattatgaccttgcgatataactaatatagttggacgtagaattttaaagacagtgaatccttatattttagggtggatagagcattatctaagtcagtcttccacgggatatatatatctccagcaccgcgcacgtgcgcacataaacgccctgcgcggtgcggcagcacgcggggaacgaagctggtgagatttgtctgcaccttaccacccccaacccaaaaaggcacgtgtgtgcagatagatttatatatagcttgcaagctagctatatgacgtggtgcgcgccacgtattacatacagtcgacaccgatcgatcgatgagtcagcttgtggctttgcttgaattgctagcttagctgatcgatcgaatgcatgcgtgggcgtggcctgcacgcgccaggtgagctgacgggatcgatctcgtcgtccacctcgcttccgcggcacacgcttggaacgcatggtttggctggttaattactgcacatct

SEQ ID NO: 98573 - DNA, 824 bp, Oryza sativa
tctttgctgtataatgtgactcgaaagaaacattctgctataacgaaggttatgaatacaatatcgcttaatatttcacaatatctcatttcggcgagcgattgtttgatctaaattgcttggttggatcctggtaaaaaattgcttgaatggaacaatttagttgaacaaccggctatggttacactatcaaaatgatgaaaaagattgttttgtatagtctcgttcaatgaaagtggtagttgttctatacattctatgtaccccacagaaatgaactataatgtgaggatttttataaggattcgggttccaaaaaaaataaaaacttttatgtgttttctctttaaaagtaattctaacaaaagaaaaattgagaggagatagctaacattgttttttttaatctgcaagagataattcaacatctgttttgtagaaaaaattaactatttcccactctaggaatgtaccactcttcaaatatcattatagatgacgtaacatacataggcttacggacctttcgtttcacttattcagggaataagcgaagagctgcttctataaccaattcatatgtttttttttcaaatactgactgttgttataagagtataagacccacagctgataataaaaagataaatgacaatgggacccacaaccaatagccagaaacatccctagctatctctagggggaaaaaaacttgaaagactaaaagaccacaaagataataagtaagggtctcatcttttcgcttatgtttattcttatcagccaaaatttaaattttcgaccttaatttggagttgattttg

SEQ ID NO: 98574 - DNA, 672 bp, Oryza sativa
cacttgctgaaccatccatttctgctagctcgattgatgagaaggttcctgagcagccgtccgtcaagaatgaagaaattcagactccggattgtgccgcaataatgttcagggatggttttgacgaagactacggcaataccctgaactactttagcaagaggaaaccacccgttcctttgtcaccttccgatcctatagaagttgggttcatgcgagaaactgtccgggagttgacatccataatgagcgacgaatggctaaaggaggcagagctttcatccgaagtaattcagataaataccgctccctgaatcattccttgccatctggaagggaacgatgtcggtattctctacagtccaactgtcggggtcaacctcgtctctgagtcttttgcattcgcttatttaagcaataaggcagtgaccccgacaaacaattcttcaagcatccgaacggaaatatcatcgaaggatttgggattgtgcaagatgtgcctgtctgctttgaagacagggaggcgatcttggatttccatgtctttgaaatccaagactttgatatcctaatcggaatgcccattgagcaactagtcatcaacacaccccgattaggtagcctcaaaataactctaggaatcaatgggtaccgagctcgaattcgccctat

SEQ ID NO: 98575 - DNA, 1883 bp, Oryza sativa
tttcagttatacttacacaaattaaaacgagtatgtgtgagtgtgagcaaataatcgatctactagatctagatcgacttgtggttgagattattaattatgcatggggcatggagtgtgcgcgtacgtagtggttgccattgagtctagctagtattatggattgtgggatcgatggcacgatccaaattagttgtctccatacttttaagcatccattagtattgtaattttgttgagattctcaggaagaaaactcaggaaattgcggcccaattcttgtgttatctctctgttatcgaaaattgctatacgtacgacattttgagtacgatcttcgtacgatcaaatgggcggctaacgtggacttatggagcatgtcagtcttgtactcgttctgatgcatgtcatcgtcatcgccagcgccacgtagggcaagaggttggcggtgatggtggttgtgatgtgttcgatgccggcgccggaagtccaaaagtacaacaccagcacgatcgcggaagtccaaaagttcaaaggttaattagacccataccactgcaactttacgaaattgaaaaaataccactactattcgtcatatcggctatatgccgctggaaatttttaaaattggaaccattccacttccgtccctttttccgtgctctctctcacaccgtctccattcggtcctcatccccctccctcgacgtctcggacctcgcccacgcgctgtcacgcccagccatcgcggcgcccaaggatgtccaagccgtagccgcacttgccgccgcggcggacttcccgagtcggacaacgccaactcgatccaggtccgcctcgctgccgctgctgtggagatcgaggaggtccgggtgagccggatcgacggcggcgagggcagcgtcgacggcgagtggacatagcaggttggacttgacgacgagggagtcgcagaagctacacctacaataaaatggctacttagctcagtggctttgcacgctcgactacgtctcactctgcttccagagaacaggttctcaattatctcgcacccccccaccccacttcacccacccaacaaagaaaaagaaaataaataaatgaaaatgaattagagtgcttacttttcaggtcatcgaccaagtcttctgtctgtccatgcctatctgtcgatgaacacgcccaaatagtttccgggacacttattggggcattttacacttattggggctttgtttttctttattttgagatacataaacgtactcattggcttttcagttgtcttttaattcattgctagctgtatttaatatttataagattttgcgtgaaaattaggtgtaattattccaaataaaaagatttctaggattcagatttattttataccacaatatataagcattactactctgattctcttagcttctatcatatcaatgtttttagagccaatcaaatgcttcagaaggacatctaagaaatttaataatcaaatattgataactgaagtgactaatggaaaatttttggcccgagtagtacttactaaagagtaaactgtgatcacggtacataaacttgcacgatggatacaaataggaacaacaacttataaatcgtttctatacaattactagtccatgcgaacttgagccaaaacaatatacgcaagcaaaattgatttaacacggtgcgccttgataacatctttgcatgctagcggtttttttttcacaaaataaaatgtttgttttaaatacaatcagtactctagtagtgtaaagcaacctacaagatattgcaatgaaattattattgctgactgctatattctgcaaaactgaaattgatctagtgtgtgtatgtctgca

SEQ ID NO: 98576 - DNA, 558 bp, Oryza sativa
cgatgttagatttaatagaattaatttcgtgttataagagttgctatatttttctttaacttgattgaacttatggaagtttaacttagaaaaaaatcaaagcatcttataatatgaaatggggggtttctcattcagagtaattgtatacaaggaacataaacatcaaaaggatattgtgttgaactgttagtgtatcaagcaactcttcctgaaagaaacatctgataagattacattgcaactggataaggccaaaaagggggacagaattatgggaaactagtcagtagtcacaacacacctaacgtttctacaccaagaagtaagttctgttgttgtttcaagctaagactgagctagtttcatgtttcaaacaacacacgagatggaaaaatttcaccacaaactgcacctacaaagttacagtacgccttgaactacactacacagatttcagcccggtcaggtgattcggtcccgagaatggagcatcttcacttcccttaaccaattacccttaaattttactggccgtgggctgcaatttcttgattt

SEQ ID NO: 98577 - DNA, 577 bp, Oryza sativa
ctttttgtccttatattttattcgcaatttttgtcatgagaaagggtctgtgcacattgtgaggattctttttttttatctacccggttttttcgtcgtcgggccgaactctagcaccaccgccacatcgatcggccttctcatgctttccctcctccaattgattgaaaaatcaattctccactactccatcatcattttccccataattttttcttttatttccgctttaatttatcagattcaatctctatatttagaagtcaccatttatatcctagagttttatggattcgctgcggttttgataaaaacggaaagaaaagatcgagtgaataagagcactcaaccaattttaggagattgagaaagattggatcgtatttgatggggagtattggttctggcatcatactacacggtcctatcttcgaggttgaacacggcagtcgactatacgagataggcctatagctctacttgtggtctaggttcaaaagaagtaagccaagtagagagaagtagcgggttgggccgagactgaataggaaggaagaaaataagtttttatccaaaa

SEQ ID NO: 98578 - DNA, 633 bp, Oryza sativa
acgttaaaactgttgcgctgttgattacattgtttctgatgccccttttgttttgcaagcaggacgatacaccattcaattatgagataaacaaaattagagggtactggacggaatacattcatcgaacataagtatatttggtcagtactgtttataatatgctggggtttttattttgtttagcactaaaacaggtgaacagagtacacctattattttgattagaccattggtttttgtagcggcaatcagcaaaaggaagaatcattatatagtcaaaggatacatgtttgttgattctagcaattcctaactgtgtgttctgtagcgtgggttaagaactaatccccactcatggacgaaagagtgatagactaacatataattatttaagtattagctaagaacttttaaaatatgaattaatgtgatttattaaagcaatccttctatataaatttttgcgtaaaagccatattgttttacagatttagaatcgcgcgcacggaaaatgaatgtgtataaggttcggaacctcaacaaacgaaatctatgcaaggggatgtataagggctttcgaataaacacattatggttcaattaaaaatgctaatagtagttatacaaagg

SEQ ID NO: 98579 - DNA, 528 bp, Oryza sativa
gcatatttaccataattctagaagccaactcgatagcatctttagctcttaagagaagagtcattgttaacatcctgccttgtccatcctacagtactcaccaaataaaacatgatcagcttttgcaacaggcaagacaaaaagttcatagtaacattacgacataatcctacaattttaaatttcagtaaaattcacggtgcttattatatatggatgaagtttgcaacaaactaatttatatttatattatactccctccataaaaaaaacccaatcctgtccaagttcaaacctaggattgggtttttttttaggacggagggagtacatttgaagttatagcacatagccacaatgtcaagagctcacacatccatctccaatgtcttatatatgatattttattttgaaagaaagttcgtagtattattattgaacttgtttatctcgattaaaacttttgattttgcactaacgcaactaacttttacgttcatattcacaagtcctaaagttgaaggttga

SEQ ID NO: 98580 - DNA, 564 bp, Oryza sativa
ccgaaccccattcacaggttcagagagattcagagcttctttgcatgtggtgccttcttctgaaaagcgaggcatcagttgcatgatgatcaatcgtcacattcgagtggagcaacggtttttttttttgacgtaagagtggagcaacggtgattgtttctttccccttgttcccctctgatacaagtagaaccaaatcacattctcaacttgttttgtttttcagttgctgatcagtcttcggtgcaaggaaatgaaagcagacaccaaaaaaaatctgagagagtagacatacgaacacaacataagcagattactgcgagtttagttggctgtcttacaatttacaggggtcggagaacaaaacccagaaccccctcgtccacagattttttccccccttttttctatgtgtgagatgtgcagacttcagatatagcaaaatcagttctaagttgggcaccgcaacgccgcattacgagtttacggcacggtatacgcactgaatgtctgaattcatcctcgtagaaccaagtgaatgagttcatgttctgaactttttct

SEQ ID NO: 98581 - DNA, 562 bp, Oryza sativa
  unsure (1)..(562): unsure at all n locations
gggtgaaaacccacttantataggcgaattcgagctcggtaccctgaatgaaagcagttgactgtagattgttgatgtaaatttctgtggatttttgaatgcttgggtaaatttctgtgaaatttttgaatggtggagtgttgaagaaggcagacggagcggagtcgctccgtccgtcattttttttaaacttggccagtattaacactggcggctagtacattgtaatctgccagcgaaaaaacaggccgtcttaagccaaccgccagcgaaaacggatctttgctggcgactagtttaagatgaccgccagcgaaaatgaattatcgctggcggtcgataactgctagcgaagatcttgatcttcactggcctttgctttgtgccggctctaaattccgctagcgaaaacccaaaatggccgtcacgaaaaatggttttcatagtagtgcccccgacccccgatttttcaaccggctcccctacgtgtgatagctttgatagcataacctcaccccatcaaggaccgttatttgcccctctgttgcataggactaacgaa

SEQ ID NO: 98582 - DNA, 560 bp, Oryza sativa
tatagggcgaattcgagctcggtacccgaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacccctatattattatctccttgtaccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatg

SEQ ID NO: 98583 - DNA, 1100 bp, Oryza sativa
actttagatgaaccatgatgatctcatctattgcatgcttaaaaccctgtatagttgtcatttttgtgcttagtttaggactttgtgggcctaggaaaaatctggtggcctgccggacccaccagggttcggccgaaccatcacggtgcccgatcggcaccaattttgaatggcagtctcccccgctcgtcctgagtccgtttagacgtgcgtttgtaggtagaacgttcggatcacagcataacacttcttcttcatcctttccctcacctttgcacactctcggcccgttcggccccccgttcggcagcgcgatatctctcccctcgccatgttacaagaacaaaaatccggggggatttccctgcgcaacagccgactacgggagagttcggcttgttaaaggctcaatgccttttccaagatgacgggaaggccgcggcggctcccgtcgagcgctacgtgggcaccctcttcaccaaggcaggggatgaggtgctccacaagtacaccacacccaccgctacaccatccactccaaagggggagcgtttccgcattcaaggagtgcgaactcccggcggtgggtatggtaagggttttgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattacatttaatgaataatttaaattaaaaaaggtttttaaaatcctcttttggctttgggccgaaagtcggcccaaaaccttctctctctccccggcccaagccggcccagtccgcccgcagcagccacgtgcgcgcgccctcggacgctgacaggtggggcccgcctgtcaggtcgtcgtctacctccggccgcccgccgcccgagccctagcgccgcgctgccgccgtctccttccaaattcgcccgcccctttaatttttccggtgaaatcaataga

SEQ ID NO: 98584 - DNA, 659 bp, Oryza sativa
taaagaagtatttattggtaaaacttgttaatattgttataaaaatgtattgaaattggttgtttcgcaatttcatatattaagtaaggtattattttgtaacttattcgatgtattagtactcagagaattgatataggcctatcgcagtctcggtcgtagaaacattatatggacttaaacaaggagaattatgtaacatgaagaaatagtagtataatttgaacatgatacaactatttccattgcggttacatagatgatattagatttgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccatgtattgctctggtagttcaagctgcacaacacggctaggtggagttagaactcttctagtgtctatccattctctgtattgacatctccttggtcgttcctgggaggaaagaatagatgtgaagcgagcaaagttagtaaatgttgtgagaaaataaggattcatgtaatcaaaatattcttaccatgaaatcgtcgacaagaatatttggacaaacaaagaacct

SEQ ID NO: 98585 - DNA, 618 bp, Oryza sativa
tagatggggatgagatgagagatgaaaatgataaaaaaataatacatatgcagattaattgcagtttaagaataaaatgaaaaattcatagttttagatcaagttattgaaaaaactatcacgcaagaggtagtgagaaaaaaatgctcaatggaatcacaacaaaggcagctataaattaaaggtcaccaacattagtgtagtttttttctttgcgaaaatcaagcctatgtaagattccgtactgtctgcaatggctataaaaaacagagaacagaacatcaacaaagaattagctgaaacatcaattttattgttaccaataagtctaaattatcctaatggactgtatgggtgagagggtttttctttagagttagttcaaatttgaatccaaatccccctatccaaaacaggactaaagaatgagttgatgataaagcatcatagttctttactgctaactcttttttttgttgacctttctgacctatcatggtcttcaagattacttagagtgggtatatatcaaggtataatcatgaaaagtactttgacaacaaattaagtgatacaaatctcatacaacaaatctaaataactttaaacatgtctgta

SEQ ID NO: 98586 - DNA, 630 bp, Oryza sativa
ccttgtttaaaaaaaatttctaaatgaaagtgacttaaaaaaatcatattaatctattttttaaatttattttagttaatacttaattaatcatgcactagcgctgctttgttttgcgtgctagggagtgaggggctttgccacccttgaaactttgcgctcctctattttatcactatttcgttatcattcattccacttttggtagtcaacgtcatttgaacatacgatttagccctcagtctgaaacaagttattagaaattccaaaaaaatacgaaatttagttttcagtactttaagttttgaaaggttgtataaaaattgatggtagaaaaaaattgggttagttagaacggttttagtgcaactttaaacaaaattttcaaaggaaaaatatttctgtgtatacacatataaaatgttttacgtgtaacttggaccttcaactttatattacgtagtagaataaatttatgaaatctagtgagtcaatgatattatgatactattttcctgtttttaaactaagcattttttaaaaaattgatgatcaaagttggtttgagaaacgtcaaaagtttctctctgtgtctctcgctcttactttctactccccccgtccctaaat

SEQ ID NO: 98587 - DNA, 521 bp, Oryza sativa
aaaagcccaagctgtcatctgtgcccctagctaatggcagagccctcaaacctcgatgcagacttcggttttgttaccaatcaaccttagtacttgactatgtcgctctgcatgccatatctctgacacgaatcaccaaaagttggctgcagtcataaaactgctgacttctatattgcagatcatgcaagcccgactacatattcaggtttaatctctataatatgttatgtaagagtacgatctcctgattttattctaaatcacatctagggccataggaactacatatgcttgtatcacatatcatacctaatatcagaatataaattactgttcacacatcttgattcttgaatcactatttgttatgtaaatgttatgacagttgaccaaacaaactagctttactcccacgccacagtccaaataagctttttttttttagcctaagctaagcaagttagacaaaagaaccaaatgtacccgtagcatcgatacgcagttccctgtcgtaaaca

SEQ ID NO: 98588 - DNA, 578 bp, Oryza sativa
aatttcataagtgctgcccgaaaattcctgcacttttgcccggaacctcctggcaggtttccagtcaaacttgtacgggctagatgacgtcaccttgctgttatatatatgatttcgtccccaggtcaccttttggccattccactcctgttcattcatgttctagggttttctagccactcccaagcttcctttgcttcctccactcaaattagagcctatcttgtgagattgagagattagatgagagtgtaggagtgttttggagatggcttgaagattaggtttgactgagcactttggataccttatgggctgtcacttgggcttatttctcttggagatcttttcctagatggttaggtgtcgcccgtgagcttccaaagatcttgtggatgtcccgggaaagtttgtgaaggttttcctcacctccgcaaggaaacgaggtaagtgagtaaagattcttgtgctgagttttcaaatctttgtgtgaatcttctgatattctgcgatcttcatcttgttcctctatgtgcttaaacttctcttgctaggacctgtttttcatctcagcttta

SEQ ID NO: 98589 - DNA, 537 bp, Oryza sativa
gtccatgtgaaatcatggaaatatcgttattggtaatctgtgatgatccagacaaacacatttgccaccaccacaaattgcctggaaagagcaaggccacatgtatgtacatgatattgtccatctttttcttcctttgagccaagagaataacacatacatagctgtttttgaagtctttttcaaaggaagaaaatggtttgcatgtatatattgatgtgccatattgcatatccccaagcacaatgcaacattgcacgattgcgatgagcactacctcccagccgtggctcctccaaaaaaaataataattgtttctaattggggaaagagagaatttttttttgacaagacatggttctactgatcaaagggtgataggtgtggttttaaacattaattgtggttatctcctcaagtctaggtagggaattaattaaggatgcgctcacataaatattaattcatgtagatacatggaaaagtgcgacatatatatttacgactgatcataataatgaaaatgatcgggctgca

SEQ ID NO: 98590 - DNA, 656 bp, Oryza sativa
cccaccggtggtggtagggctttcagtcgtgctctacgagatgtccgatggcctgagagattccatagtactctacgctgccggagcagacgacaacgcattggcaaaattatttgccagcggcgttgaagggatctgcccgttcgtggtttgttcacctcccgccctacttgatttcttcatgggcagatttgtggcagcagttcgtcgccagcttctcttctcttcatttatgagtgcttctcctgcatacatgttagtagcatagcatatagtggaagtaattattttatttaggaattatgcattgcaagcatagctagtcttcatatattggataatattgatggtcgaaactggttatcatgagatctaagtacttcgttttgtatacaaaagttcatgattctgctaggattacataaattcatgctagtagactcaagattttatttccatggcgagtttgaagtttgggcatcatgtttcgcgtcgctgcttagttcacacaggtttatactagcagattcaggatttattcccaatggtgagagtatggtctacttcttctgaatcgagggtgttacatcatagccatagagatggtttggcgcacaatgattgtatctatgtgagaccctttggatatggacaat

SEQ ID NO: 98591 - DNA, 681 bp, Oryza sativa
ttcctgcagccccattcacttctacatatctatttattattatttaataaaagtccattaaacttcctacaaacactcttatgctgccacgtggcacttctacaaacgctctaaagtcgccacatggcactatttaatctcaccgttgattttcacttaaattggtggacccgttattttacaccattagattagatctattattaaaaaataatgacttcctcaggtacacgtatgagttggtacgttacaaatgccactgctttctttccgtacatacaaacattgtacatgattgaaaacaaaactttcctaatcttcactggaaaaaaaacatatacatgtacataaaaaaagacagaataagcatacattcataaaaatcaacggtatttaaaatatgattttctacaatataaaggtaaaatatattacttcacaaatatatatatttagttaagttaagatctataataaatatccaatcaatgttcttttaaaccatcttctacatgcctgcacgaatgcgcgggctacctttctagttttcttaataaccatatccaactctaaaacttcttatattgtggaacggatgaagtatatcagcaggatttatgcattttctgtgcagtgccttcggtgtgctatgcagtttacttttcacttgctaaactccaa

SEQ ID NO: 98592 - DNA, 685 bp, Oryza sativa
ctactgagctcgcgaatcgtccacactcccgcggcaaaacaacgatgaggtttgattggccgcagttcgtccgttgtcccatgcggctacggaatcatcgtaatcgtcgtgcgtgagcgattcatccacgtgatgctatttcttgcttgctccgactttagtgttgccatggagaggcaacccgaagtggcaattaaggatggctaggcaaaacggagtggtacgcgggtttgggtggcacggctccaagcatgtgcgaagtgttcgatcgggtgccatgagtagctgggtagactggcatgatggtgaaggtgatcgatgcaaaaggaggacaaaaaagagcttgcggtggcttttatagccctagcgcagggggggagtggtgatggcttctagttctaggcgaagggaagaggtggggtggtacaactgtacaagggagtgaggatggtgggtggtgcgacgtggatgagccccgctctcatgcgaacgcacaatgtcgcactgcaccaggcatggccaaggctacaaggtggtgtgcgggcatgtggcagcggtagggccacgatgctatgcgaaactgtggttgacgcgcgtgggcgtagtggaaaaaactggaccggaccggcgattcaactggaaccagagcttggcacggttcggtcgaatagaaagcccggacatg

SEQ ID NO: 98593 - DNA, 769 bp, Oryza sativa
  unsure (1)..(769): unsure at all n locations
agcatgtcccnatgagcttcaatctaattcctgcacccccgatagaaaaacttaaaaaataagcatagtatgccaacatctagtgatgtggcgacattttggttaaaagatcagtattccacaccatactttttatgccatataaaaaagcagccacttattccatctcgacaaggatctacatgtattcgtattgcttttaatttgttactataataataataaaataattctatcgatttgaaaccgaaagatatatgattatcaaaagtaagtgcatgcaaataagcatcatttccgagcgattcgattaatcaacatattcattatcttgggctatgaacatggcaaaacacaaaattgaatccatgagctaatgatctagcagtcaagcttataataccaggattaatcaaaaggtacgtatcaatgtttttactaaaatgcacgtgattgtcagtttatgtactactctacttatttttcaagttcttgcactaaatcgcacgcatctactaagttatcgtactgtgggtgtaatttactcttcttttaaaaaaaactctgaaatggctatttatttttcgaaatctttttaaaatacatatattaaaaaaaattcacgtgatcttcaaatcctccacacaaggaaaaccaccaaacgttgggcccatgaccgcaaaaatttgcttgggaaagggaaatgggcccggcccgtgctgctgatgacgtgggctttcattggagctgaaccgctccgaggccccta

SEQ ID NO: 98594 - DNA, 769 bp, Oryza sativa
  unsure (1)..(769): unsure at all n locations
aggaggttcncnaatagaactgctatcgaattcctgcagccccgatctcgatccggatggggacgggagaacaaatggcagcggtggttgcgggatggcgtgaggagagagaaacaccaaatctagcgtttctctctccgggaatagcgcatgcgccatctatggaggcccatatggcgtatccgttggagcggattttctccccccatacccatttcctggatggaagatgggatgccggaactgctgggatgctctaaaggccaaagtcaatgtgctaaccatttttttcgttttgcctccattaattccggtgtcccactgatcggttttcaacacgcttgtctgcaagccccagccacagttctgttccctttcacgcccttttctcagcaaacacatactacaggcgtacagccgcacaccctgagaaatatatgctccaacaagtcctcctcaatatacaaatgaacctgatgacattatttggaggggatcgatcagccaaatggggaataatactctgcaagacgtacaaatacaacatgcgatttcaaggcacaatcaagttacaacaaattcaatgttctctggcaatctgaagcccaaccgaaacatgtcagactcgttgggtggctcctgactcatcaggcgtacaaggtcaatcaattcctatgcttgcttcgtttcagaaattcttgcatcttacatccctcggtcatggtctgtgcttaaaatcagaccgatttgcttttggaaaaagaatgtg

SEQ ID NO: 98595 - DNA, 688 bp, Oryza sativa
  unsure (1)..(688): unsure at all n locations
catccctgaaaagggacgggtggctttctccactaaacaaagacagcctacaactccagaaggaactgagtggatctatcaagtctgaaagngaggcgaattatcacttaatccacaccgtttgcacccttaattagttgtcctaattgagttgaattgaccatctagctagatagtgacaattggtaccaagtaccaacatgctttggatccatctcctttgacacaaggagagaaggtatacagattagtcaatagtcagctttctctttaatttgttttgtggccaccatgataattgaacagcttagctgtgacacttctccacaagaaatgctgtagtttttcaactagctagtttgctgcatatgtgcaattaacttgcaaaatacttcctccgtccaaaaaaaactcaatttctagagtttgaattatatcccagaaaaaaccaacttctaccatcctacctaccctaagcacgtaaaacgagaagttttatcccttcaacactttttacctacctatcacttttgctactttttctattgattaagggcattttagtcattcttcatctccactaactccacctcgggatgctagaaatggatttttgtgagacggagggagtattgctttgagatgtgtaggatcgaattataataactaagccaaccagaaagggggt

SEQ ID NO: 98596 - DNA, 730 bp, Oryza sativa
catcaaggtcatgatatcttcacactatgaacaaaacaaaaatgtaactttccacagtttgtagtattgttggtcattgttgcttcaaaacttgcagtcttctttgactatgttctatcagaagatctggcataaatctgttgaggcgaccagtccgtatcaaaatagcatggcgtaatgtcatgcttcctgtacagagtatagaaatgctatgcaatggactataatgatccacaacaccagtactttcctaattttccaatttttttggtagatcgctctctctgtctctggggagacttgctgttgctggtaccctgagagctactggaactactagaaaggcttcgtttcacatgacttgggaaacaggaagttgtaggactgtgctgtggatgctcctcacttgagtgttcgtctactttatcatttttcactgacttttgcggtgaatctccagctatggtggcatggttatcgagattgttaacaaaccctgcacgcacagagatgccaacttcagtataaatcctactaacaaattattgtataaacaagataaataaaataagttaatgagctgaaaagtaatcatcaactctctagacaagagtaacttacatgttactcgtatgcgaaacaatactgttgaacaagcatgctaatcaagaacttcaccagtagcaataagaaacaaacaaataaacattgcatatcagggctgcaggaa

SEQ ID NO: 98597 - DNA, 554 bp, Oryza sativa
atgtgaaagcctccaacaattaaaatgtgcaaagttaaaagtcaaataaggcttagaggatttttgtatatttcctaaaaacctaaaatgtgtaaataaattttagtggaattttcagagcacaaataataattattaagaaataaacaaagttgaaaaagttttataaaaagaaaaaccctaaaagtcccccttccctcccttgggccagcccggcccatctctcctcccaccccccctctctctctcctctccccgcggcccactcagcctctccctgcgcgcgctgctgacgggcgggcccgcccgccaccctcgctgacgggtggggcccacccgtcatccccgacctcccgccgctcccgccgcctcgcccgtgccctagcgccgccgccgccgcaaatcctgccgcctcccgtgggccccgcatgcgataaagcggggggaaatattgcccgcgagcccctttcccttttcccacattttttccctctctctctcgagttcaaatgggcagatttgccccccgctaatctcgccggcgacattgatgg

SEQ ID NO: 98598 - DNA, 936 bp, Oryza sativa
ctgttttttaactatataaacccttatggtggttctgagacatggtggataatactcactgggtatgcacctagcacccatatttcattcacacattggatggcattatggatagggaaacttacagtgatggtatgttgtacctagcattttaaatatgcatatggaaaaacttttggagagcgatgtcattgaatttacaaattgtttgcatgcagtttcggaagcaagctaagtatgaagatgtgccgccgcctgcagcaattgatcttttcaaggagcgccattgcagtagcaagactggtttttactaatgcacgttgtttgttttgctatggtcagtgccatgtacatgagcttgttgtggtcactgagtagtcggtgaacctgtttccatgtatgttaactgggtttgtatttttatattggatattaattgggcctgtgtaatattggatgttaattgggcctatataacctttgtgatatatgggctattatttggtataatgctttggtatatatgggatgttagtcttgagtcagttcctggaggtatctcgatccacagtatagagaaattaaaatattactaaaaaataaaaaaaaaggtggtatagcactttgtatcttcatgaggatcacaaacgaaattttactgaaaacaaggtggtacggcattccatgaaggtcacaaaagatatctcaagataaacagcagttcaaaacacactccaaaacataaaataagttgacatgttgctgaatgaatacacagaaattctttagtcaaaatcctcctcctcctcttctcgtagggagtccaaatgttggtacgacctgcaacgtaatcatcagttctagggtgcataagtccacaaccatagcaaatgccaaactccttgcgacaaaggaagatggggcagaacacgtgca

SEQ ID NO: 98599 - DNA, 701 bp, Oryza sativa
aggaagggaatatggtttgggatgtttttttattagaaaatatatcaataatgatgtaaaataatgtgttcatatttaagtggaagccaatggatggatgtttctataatttagaatgtcatacaacgatttagaaatgtttataagaggtttaatagactttaacgcctatttatgagattattttccataaagataattttaattttaattatgatagggataaaaaacagaaaggaacagggagcctacaaattgatacgtgcgtggtacacggatatggggacatgggaggttttggtattctaagatagatctaacgaagtccaccgatttaaatgaatatcgatggttagatttctctattttattaggatgccatgtgacggtttggaagtgtttgtaggaaatttaatagattttatttagaatttaatagattttatttagaatataatagatagatagatagtactacgtacatatggatttttgctttattttatatggtagaaaattatattttatattttttcttccgatgatacgttgtactaattttttttttgcctttatctcattttgacactggcaatttttttattccggcgaatcgaacggaagcttttcttttttttctgaatcatacgtactggtatttttttgtttcgtcgacggtacgtattctcacttttatacag

SEQ ID NO: 98600 - DNA, 679 bp, Oryza sativa
agtaccaatcaaggtattcatatcagccattcattggtattggcaagaaaacatgatatacaaggaaatgactggcttgatgtttgaacagtttcaatctataggcacagttcatgattccatataataagaataagttgaatactccataagacaggcaagacccacttcagttagaaaaagagggcgatgagtgaaattgcaaaacaaaaaggaatgaaataaaaaagtgtgagataagttttgcactcttcatgctaacaatataacttggtaattttattagtgaggtctgaaaataaaatatgtagggagttgcatcgttacagggtactgtacaaagaaatggtcacgatggttaatctgactaccactatatgaggaaatgagaaattaatttgaatggaaagcaatattgcacaaagtttttaataattagtcataaaaaatctgttttcaatatagacgaagaaacaagaaattaatttgaatgggaaggaatatttcacaaagcctttaataattagtaacaaaaagctgttttctaatatagacagaacacctacaggtagcaataggagatgtgatgattgggcacagaaaaatgatctatgacttacaccggttcatgttctggatgatttcattgtgatgggtgcagccagcttcaagataagac

SEQ ID NO: 98601 - DNA, 685 bp, Oryza sativa
ttcgcttgtacccagggtgaatcgcgccaattcttgctgcacggttggattggagatagacggtggtattccctctcacaattcaaaccattcacccccgagccggccgttttcaccctcaccgccgccgcgcgtcgcgcccggattggcgccaacacgtcgccagccgattccaacagcggtcaagtcaatccttcgccggtaagtattcaaacgtgacctcccgccactcaaattgatcttggccgccctctcacagcctctgccgccctagccatatccaaagctcgagctcatccatggcgatgacggtgtccgagctcatccgctcctcctagccctataaataggaccccaatcccttccctgtccatcatcgatcatcaacaaccatagccccacaaccccgaagctctgcttcaccaatccattccatcaaccaccatcgcccgtcggtcgaacaccttgtgcgcgatcgactccacaccccttcatccatcctccgcgctaattaccccttagaacacctataacctaccatgttctagcatactaagccctaatcgaagcatcgcgccgagtttaccacactgcaccaagccgagcaccgccgcccccgcgctgctatgttcttcgccgccgcgaagtttttccggccgtaatccatcgtttcaaccaatctcgg

SEQ ID NO: 98602 - DNA, 959 bp, Oryza sativa
ccacgtgatgattctgaactgattgataaattctcgtgccggattggtcgattgcccgtgcattttactaattttttttacaaaaggtaagtaggagtattccctattatattaataaagaaggcaagactactttataaccaccctttcttaaaagggaaaattgaaaccatgccattataattttacaaaatttgatatatgctgttattgactcatgtgggtcctacatgtcattgagataccgatggcatatctcaaactttgcaaaattataatggcatggtttcaaattacccttcttagaaaaggtctcccagatgatgatttgctaagcattagtaagtcaattagcagactagtccatattcaaagggcacatcaagtcatggaggcttgcgtacgtgcactcggtgtggacaatggtcaagtaatattcggtagaccagatacttgagttcagataattaacaaccagtattccatgatctggtaataaatttcgtttatttacatgaccaaatgtatccctgatcggaatttcaagaggggctagaatctggtaggaaatttcaccttggagaaagatttgacaggaaggtgaaaaggtcatattgggagtactagttaggtacaccgtacaggccaaagagaggcattattattgggcgtagtttaatattattggattatgcatacacatctttgaaactatattactggtggagattttagatttatagagtctagatgttgaattaatgtaacagatgcacattcaatatatcctgatttgttttatggtcttgcaatgtcaagcgatgatgcatgcttcccatgaatggatgacgtacgtttatgggaaatggttttacacaccaattatgtcagactatttttggtggcaaaaggtttaataagggtcatagtgatggcatttgaatccatgtattttatcg

SEQ ID NO: 98603 - DNA, 1912 bp, Oryza sativa
ggataattagagtagattgaaagggttctaatacttgaaccaaatttaaataaaaatcaaatagatttttaaaccaaacaaatttaatcaaaagccagcatgatgcattcaaattttagtttaaaatttgaggatgttacaaaatagtattgtaaaatttagtggttgcatgttcagtttgaaagttcgaggtattacattgattttcaatcaaagtttacggaagtatttggatttttttttcctaagaaaatctcataaactgtgtttgtttcagccgagccaggctgtgtaaggcccataacgcttacggcccaccctaactgaccagtgtagccctcccttttcctcgcgtcccgtgttccctcgccgcgccgccgtcgccgtcgccttcctccatcccgcccgcgaccagcgttgccgccaccggtgagcacccatacctgtccgcgcatcccccgttcacgccattcaactcctcctctagatctggaagcattttctctttgcaggtttaatcttattagtactaataacagtttgctcagactgccatgagcaatccaatccacatctctatatgctctttctttctggaatggagactcgaacctgtctgctgctgatttgtttacttcgtggtggagtgctgagctgttatatgcatttgggttttgtgctgaattttcaggggctcttgtcgtggccaaggaagcagcgagtcgggaatggcatcgcctgatgcatgtgtggaggacaaagttcatcgcatcttcttggatttcatgaccaagtaataatttcgatcctgcacttttccaaccattgaggtcctgatataacttttgcagtagatctgatgtgttgtgtggtgttgaaactaatatcagtagcagtgaaaacaactgaattaataacttttgcaaatctttgcttgcacatatttaattcttatatgaaaacctagggttccaattcttatgcaaacctagggttttctttgaataattttcctgggtgaatattttccaatttatggtgtgaattaatgcgtactaattttataagagtctaggaggtattgttttatggttatgttcgttcgttttcttacactggcagacaccttcattaagttgtttatttcttgtggctgtctaatttatggaaaatacacgggcgaatttgttgctgcttttagggttgcacggtatgacgagctagttgatgcaggtaaaaaggttcttctcaagtttcatcaagaggtaggtgagttcatttctttttccctgaaaaaaaatatgttagccagcgtaattttctcttctctattttttggatctaaatttttgaaggtttcacctgattgtccatcgtatgattcatgtccaagtcttctaaaattctatagcataattacttataccctattgattccccatgttcctgaccactattgatagtttagggctaggtcctgatctgttgaaacttcaggtcctagaataagccagggctttcagttttacgatgaagataagaaaaatgtaaaaattcccataataagcctgtcttagatgggccaagttttatactagctttcttgctttggtaaatttgaagtaaactatatttattttgctacattattttatttcaacatttattggtgtaatctcgtattttatttcagttctacctagctgtgctgctatttgttggaccgcggatgttgtatttaacagagtaaatttctgttgtaaacttgtatgccatgcaattgtgtactgaaattatcattttctggcaaatgattactcttcaaatctcaatcctgcccatggattcctgcttcatgtttattctacttattagcatactcacgttattacatcgattcgggccgcaggaa

SEQ ID NO: 98604 - DNA, 1650 bp, Oryza sativa
ttggttttcattgtgtagcacatatgtttgtgagctggctcgatggaattcataataatttgaaattacatgttctgttaggagcagctgctacttgttagtcgctttggctatgcaggaataatgtggtttttgattaaaaaaaagtcatatcttcccctttgcaggttatatattctcttatccattggctttgtatatgggctatcctacaaaagcctggttcgcggaaaatggtagttgcggcatgtcaacatttagagaatgtggtcaaggagttttttacctagggatatgggtggcgatctagtcttagaattggtggtccttaaaactatgtgcttttggaggagatggccaaggagttgttcatgagtggcaatttagtcgttagattgatggtcctcaatactccatgtcattcttttttcctttcgagtgtggttttgtatgttcggttgtgtgcatcttagttatgcagaggccggaagtgttctcaggataattgtatcaccttgatgtaattgactgagttcaataaaagcttccattatcttaaaagaaaatcgcctgagctcggcgatgacgctagttctgccattgatcacctggccgaggaaggtagtccgagggatcaacgccacgcctgcgctacccattataactgaaaagtcggactcttgagcgtccacaatatttgagtgaataaacactaaggatgtccatagcagcaacttgcaaaacacaggctttttggctagtttaaccaaatgcacttgagtgtccaagcacctaatagcaatatataccaatgacaataacatcaagggagaggaagtacacaatatatcatgcattcatactcttgcaagccataatatggttcaaaatggtaattaaaacaaaggcctgcactactatatatcgaacataaaagtcaaacacaagcttagcatgtacagaagttaaactgcataacaaaagcagttgtaacgattcattccacttatatataaaatggaaaaggtgaatcatagttaccaccagaagatactgtgcatagacaaattcactaaaccaaaaaccatcgccaattaatgtagtccattaatttccatgctaatccagttcttccataattatgcctactaacataagatgccacaagcaaattacaggaggcctctcatgtgcatgacagaagagatagattgcttttaccaagtaaactgaatgataattttaccatgacacaacaaattgcaatacaagaaaccaatccaatcacttaacagcccaaatgagaaaattgcatgccagatggacaccttgttgatctgatcacaatatagaacacacaagaaatctagaacgctcaagactcgttgaaatgcgtatgtgctgccaacttcccggtcgcactagtgctgctctcctacatgaaaaaaagaacacaaaatataaaaatatcagaaaaaagaaggccacggtatccttcagcagagccagcttagaacgaaagaggttccacactttgtatccaaccttgatttcattattgttgtgtgcatacacaaacagcattgcgttgcacactgcaatatactccctccgtttcaaaatatttgacaccgttgactttttagtatg

SEQ ID NO: 98605 - DNA, 887 bp, Oryza sativa
  unsure (1)..(887): unsure at all n locations
tttatatcatttgatttattgttaaataaactttcatgtacacatataattttacatatttcacaaattttattgataagacgaacggttaaacatgtgctaaaaagtcaacggtgtcaaatattttgaaacggagggagcaggaacaatattgtcaacagaccaggaggggattgcaattctagcagtagatggatccgccggggaccacgctccttgcctagatcttggtgcagagcagaatacctcctctgacctctccctccactccttccgcgtcctgcatgaagcaaagcatctggtatgattgaatcttggacaagacgataatggcgaatcgtatggttcttatatgctttaccttatgtaagattgaatcgacctcagggtgtcagactcgctgcagtgcttgaagaaatcgctgccgcatggatgcacgagagggaggggagacggagatgatgcaccggtagcaaggtggtcgcggtggattgcgaccgtcgcctacatctgccgctgccgctgcagatgtcgaggtgaacgacggcgtgcgacggcgctagggctgaggggggtgccgttgcgtggaaggcctcgcgggcgaggtggcgcagggaatccccaggtggaaatcggcggcggagcgatcggagtgaggggtcgccggcgtcgcgatggctgggcatcggcgttgtcgcgggatgcggacggcgtgaggaggcgtggcagcgtcgatccggagggcgcatggccgggtacggcnngtgatttgcgggagtgcgggtgtagcgtggatgcggcggcgttaggggggggggggggtcgtggatcgatgcggcggcgcgacgtggatcggagatgctgtggatggaggttgaggcgaagaa

SEQ ID NO: 98606 - DNA, 577 bp, Oryza sativa
catttctgttgctggagtttgctcgctggaatcgtaagcatccctacgccatcatcctctttaatcacttcagatcagcaagctagcacaggctatatttgccatcaacttcctctttcctttcggcaaattggtctgatttttttctcaaaaataggaccaccatttcagttcgtacatgtatgtatttcaatgtgtaagcatgctgcatatgcatacataattgtaattacattagttttccagtttggctatctcgcatttttttcaaccagttctacccatatcaattccttctttataccatgcatccccattcgttttcacacatgattttagatacttggttactgacttagttaattttcttttggttgtcccaaatcacagatcatttttcattactgcagttgaaggatgtaggaaacaatatcatctagaccagttggttgatttgtcacctacatattcagatctaatatgtatttcaattatgatctttacctggtgaagttatcttaattagtttatatacggtaatatgattccagaaactccatatcaagaatgagggcca

SEQ ID NO: 98607 - DNA, 2170 bp, Oryza sativa
atctgggagagcaggcagaccggtgtagccgggacatccgccgcgcgaggaccgtcgtgctgcaaaggatcatccaccatcctaactgacccttggggagcagagttcaagattgcgaggtattgctcattgttgtgatgcaattcatgttgttaaattgtgatagatgtacatatgaggtgcactttgctgaaattttggagcaagtgaaattgatattgactattactctattagtatttggttcgattttggtgctatggtgaaactcaatttgaatgaaattactacaaatatatcgaatcttttgagtgcctaggccatttcgggattcatggtaatcgaggtatgtagttagcagttatactagtgactgccgaaatttccgaagcattagtgcatttgaaccaatctaaaaggtatggtttgcttggataacaacaaaaaagaaggaaccatgatggttgttgtccatgataggttagtttcgatcttgctggaagtttggcagactggtacgtggtatcggtacaatatgctttcttccgtgcacactcatgcatagtgtctatgtttttgagaatatttgtgaaatcacatcaatttgcttttgccttttggcaagccttttttccgatcgctaacacagttgtggatatcatctaacatagtaataacatgaggatgtgccacattcttccagaatatgtctttttcataaatctagcaaatggcaatgggatgtctgagaggtattatcattacagttagggagaatcaagtgacttaagttgctgatagcagccacaaactgaatcctttgtcagatacagagattccatgcaacagattatgatgctttgtgagttgataacttgcagcatcttcttgcaagtgccaactgaataatgaaatttatgagttactttctttctttttttaaagtactgcattcaaataaaaggggcatacttgtcaattgcttttccttgtctgatatgtcatctgcagcttgtttgagatgatgaatgcatttcatgatatatgccgcaaggacattaagttcaagacatcccattattacttgaatgtatgttcaactaattattgaaatcatcatttgtttggtgatctgttactctggaacagggagattgtgggccttggttgcagcagtactttctttttttttcaactacatttttaatcagaatcaaaatacttggtagcaggattaaatactattaaaaagtcttcacatgattcaaacaagtttctttgattgaaagttgtattattggttaaagtcaggcaacgaaaatcgatatacaaaattctcagtttgtctgttgcatttctaaattcaatatatggtcatgtaaatgtttccttaaaagtaagatatgctgagctcttacaatgcattccatggtgtttgcagcagtagatttagattaaaagttggttcacatgacaaaagtaaaaggattcatagttcacatagtaaggaaattcagctatgtgtgtgacaaattttgaggccactaatcaggagtttagtttctgctatctactatttattaccttgacctaatatgtttactatatgaactatatgaagccttctactcaattatcagatgactaaatgcaagtgtcactgggagcacatagttcactttcttaaatgagaagcgaccagaattcacctgatatgatgaaaatacaacggcacaactgatggcatgattgatgtaacaattaagtttgaccccagcctcctaagtttaattttacctgattaaaagagcagtccatcatatactttcacagctccgactgtgctttgcagtttcttagctcaagttatcaggtttacatagctgttgcttgaccagatacactttctgatgcaaaggttggagtacgttttcatgtttctagtttatatccggctggtgcatcttatattcgaatgccacggatgcttctttgtaaatgttgtcaagagatcctgaaaatatgaaaacaggagggcacaggtagttcgattcatgtgggtcggctctgatcgtttaagctacggtatggttgataaaagccgtgaaaagataaacggggcaaataaaacttttatgtgtgttattaggagggaatctaatacttagaa

SEQ ID NO: 98608 - DNA, 2229 bp, Oryza sativa
ccagattcaccgtgattagtctcatcttaataaatggatgtgttgaactgatttagttcaggtggtttggttgggcctgtttcaacgtggttaaacgttgggctgtgatgttacattgattaagctatatctactttttactatgttcaactggtgattttaaaatgcttgcttttatgcaaatatcctatagcctttcctttgcttttaccttgcatcatgccttcctattggtatgacttattgagtacggtgggtggtactcagtcttgctttatttttcccccaaccctcagaagcagagaattattcagatcgagattattttgaggattaggcttattccggatattgaggatgcctgtggttatggaggatgctacgctatcaagaagatcttagtttagattattcgataatttatttccgctgtatatgtaagaatcatttattattttttgtaagacgtggatctgtgtatcaatttatcgtttgtgtactcaggctggtcttggacaaagaatttaacacacattctgcttgagattcgggttagcgaatttctaggcgtgatagggtttcagccaacgagttatctgaatgttacgtcggcttacaaggattatatacaagttggttttagccgattgcaataatggtttcactgattatctaatcatgtggatttaatgacatcggaacaccaaccaaccgatatatgcttaaccttcggatcaagcaattattctatcatatcattattgattgattggtttttattggattatattattattttataacattatcatcaaccaattgtctttttatcattatttacttaagtgttagaatctacattggatatatagctgattgctcaaaactctatcgacatcagctagcattgctatatcagcttattgcctgatcggctcttatttgtacatattgtcagttgcagaatcagattgacccgcacgtccacatctcatcaatattttggacctgcactggagtaagcagatcaaccaggccgttgtgttcgtcgacttagtccgtgccaacacaaatctggtaccatcggccgagcacggattttgcgtcaatagtttttgaagatttggggtacagcaataaagtgtgtgttctactaaattcaaccaagttgagttttccatttttagacctagtatcaatttcatcaacgatcaatgagcagtacggggcctaaactcgtcacaaatgtcaaggatacatcattgctatagatatttccagtgtaaaacgttatcggtcaaaaatgatagtggaagtcttgtacttcccgatttcgtacgaatttgaggcaaacatatgtgttgactaatataatggaatggacttccattgtcgaggaagttaccacgtaaatttgttcttgcttttctacacttttttttttgaacattcttttctacacttgaagtttcgactatttcatacctgtggacaatgacaatttcccacggtagacatatttgatgacataatccaaagtaactatataagctagtgatctgccaaagaaaatactcactccgtcctaaaatataagtattttttagacttcgagatgctactttgaccaataaagttaagatgttttaaataaaaagagttgcatattatgataatttgtttaataataaatctaataacaccaattttacttgattgatatttttcatttattttactattatagttaaaattagaatgtttgacttgacaatattataaaaatgcttatattttgggacatatggagtaataaatacgtttaaaaaaatccatcatgttcctccaattagtttaataaagcattgatattccttttttatctaatgcacaaattgtgtaagaggtttgatagcactgtttactttgtggattaccaggtgaaattggaaaaagttcatgcttttcaagtgaaccatcagattacatcgcgtcgcaaaatatcgtcagacagctgttggaaaaagtctacgtaaggaggcaactgtcggtataactaataaggtagtattacttattttgctgaaaattaaggtctgaaagtttgcatagtcaacctcttccatcttaattcaacaagatctccgtaactaagtccgtacacacaaactagcatgttcaacaggaatgcattgactattcgaccaagaatatggcaccatccaacaa

SEQ ID NO: 98609 - DNA, 788 bp, Oryza sativa
aaattctggccaaggtcgagttgaattttgatgaacatgtttagaggatcatataaaaaaatgtaaagaaaactacagatacctataaatattatacgagtatttttcaagtggtatcacatttgagggaagtgaaatcctcaacgaagataatttgatgaagcacaccgataattgtaagaaaagaattaaatggaaggaaaacatttagcatctctttctttatcaccgttaatgtgtgcctacaactaatgataaactaggctgagttacttttctcttttctcattttttatggacacgcttcgtaaactattaaagtatgttttataaaaaaaaactttatataaagatgtttgtaaaaagtaaaataaatttatttttaagtaaatgatagttaagatttaactaatcactcgctaatgactttactcactttttgcatagcctcttgctgtcaaaatctctactgaattacacgagtttgttagctgcattttgctcttttggttttctactcatattttagttgtgttcgaaacaaaaaattctcccatttttaccatgatggctgccaatgctgtaaaatggtaaaaatgggatggaaattttctgaccgttcaagtacaatttcctcaaaaatgatataataataatatgtttattggctgttgctattttaaaagtatagtttttaactcctatgagtgtcacattgaaattaacactaaattagttaaattcatgaattttctaaccgtttgcatagaatctatctattatatact

SEQ ID NO: 98610 - DNA, 600 bp, Oryza sativa
ccttcctgtagaaaacttttgaaaagaacgtatcgtttagtagtttgaaaagcgtgcatatgaaaaaaagaggaaaatgagttgaaaaaaaaagggaataagtggacttattcctgtgtacgccttaaatcgccatgtgcatgtgtatagcagggttgtatggcgtccaaaaaaacacgcacacggatagttttgttcggtttggcataacaatttatagcatgttgactgttgacctcatcctgtcagtcgctcggttcatcatttcaactgcttgtgcatcacccaaataattcgactggctaaggtttatcagaaaatgtgtgttcgtctattttttctggtagaagatttacttcggaaatagttgtggtccaaatactgtccaaactcttttccaaacgagtgagaagagaaatggtggccaaatggaagatgatcacgtacaccaaaaaatagtaatcttatagatatatcatcaactagtagtgcacaagctcccacgttaattaaaaattttgatcaatttattgtctacatgcccaattaattaatgtttgaattctaatacatgcatggaagataaaattagaaccagat

SEQ ID NO: 98611 - DNA, 615 bp, Oryza sativa
ttgccctttcagcaagcaaatatgagatctttgcagctataattaatcaagaactgttctctgtaaaaataaataggagtccacttttggaccagtcactgcattagaatgtaaacaattctttcgctttcacaagtttacataaggttcggcatgagtaagatcacatttttctcgagacataagaagtggtaggagtccatctttcaaaaagaattggtgatccgttatcatctattcttttcgatttggacctatcctctcctccctgccaaactctgaactgaccaaaaaggtttggatctttttgcattggtttgaggcaagaagaagaagaggttggagtgcgaattccaccattaacgcaatagtgatgatctaggggaggcttccctggtctgcattacattctgaaagcaaaagctcattgagtcggcacttcctgtgctgtgatgcgagaatgtgagttcacatgcttttgtccttggacccacatggcctgccttggctgttccattcggtcatatgcccaaaaagctctcgttaaatcccctacctgctgcactttgccatccatcgatttgattttatatgatgcaacttggtgttatccca

SEQ ID NO: 98612 - DNA, 549 bp, Oryza sativa
tccttggaggaaaataaaaaataggcttgtagtgatattagtttttcttctcaggtgtgcgggtgtctaggctagttatgatctaaatgaaaagaagcgcatagcagtaaaagttttatttgatctgtgatatttgtattactgcttgaataaagggcaaagtattgtagttgaagttgatagcaacatctgttattataaaattaagcttgctcgtatattctataccagggctccccggaatcttgcatgttggtgagaaaaatttaagtatgttatatcttctcttcatttgtttgtgattttcttcatacatcacttctcaccggccccatatgatttggttgttttgttgatcttttcttatgagcagaggattcctgctcctaacctaaccccacaacaataatttgagaagtctctccgctgaaccacaatgcatggctaactgttaaagcatgatgaacacaacttgccaatgctttgtcctcgagcacctcggacagcaaatgaatgctcactgtggagattacgatgctgctctcattt

SEQ ID NO: 98613 - DNA, 616 bp, Oryza sativa
catgcacaggcataagttgagttgtagagagaactccataatcgcacattgggaatgttgttattgacctaatatcaaaatagcaatttgtataaaaaaaacttattttctattcaaaacttcattcagtggccattatttaaaaatgtttttctttttaggatagattacataaaaatcgataaattcatagtttgcaaggaattacctaggcgacgactagtacataatcccgtgggcgcatttcttttttagatagattacataaaaatcgataaattgatagtttgtaaggaatcgcctaggcgacgactagtacataatcccatagacgcatttcacgactaaagtattctgtgggccatatacggcccaattatgaggaagttaggccttacggttttataaatcgacgcgtgcatgatgaactttcatgaaaacgcttcgtgtaagacattcgaccgtgttcggccccaccatcatttacccatctcttatgggatcatctgtacatttgtcgacaaattttctcctaaaaatttcgcatccaattatagtacaatcgtgatgtgattatattgtaacttgtatataactcttaacaatctcttcgtaa

SEQ ID NO: 98614 - DNA, 528 bp, Oryza sativa
tcactccaagaagggaataaatgacaggaaaaaaaaactcagtaagatctaatttgcatgcctttttacagcctggcaaacttctagtcctgtgttgaagcctatgttagataataagttggcataaaccgaattttcatcatggcacctagttctgcacggaaggaaaaaaaaagctcatccaactgtagctcaacagcaaaacaaacctttccagactcatgaaaccaattcgttaccagcataaatccagattatcagtcaatatatttgtcgctccctataaaatataaacctctggaccactgttcttttcaatacatagtgtggccagctcagtatatatgaaagaaaaaaaaatcaggcgtgtgataaatgtatagcaaaaacaaattaaaaaccggggcaattttggtaacagagtcagataactgatactatgactgcatcacaatccttaacaaattcgactcaaaactaagcaattgcatagacaattaggattttccgaacaattaccgtcgttct

SEQ ID NO: 98615 - DNA, 696 bp, Oryza sativa
ttcctgcagccccttcaagttcaatatggaatggccagccagccgttagtggaagatatggcagttgttcctcatattgtgagtgtgtcccatacttcaagcacaagtgcacaagttatgtgaagaaaagcttagtcagtcagtttgcattttacagtgacagagagggcctgaattggagagtttctcaaagcctcatacgtagtgtaaatcgagtaaaggctaaacagtttggcattggcagtatcaggaaacgttaccgagagagaacacacggaggtgcagtagtttaacacaagacatggacaccagctatcacaagaggcgagacgattccggcagaaatgtccagaatccctcgtattctgcttggtgaaataaacaaagcatatatttttgctttttccttgtgatagatcgaggatgcagaccgcagatgcacccgttcgagacactacaaaacaacacgtccaatgcactagagtgtagagggtccagagaaggtcttatatagcattaatctacactgtcaagttgcttccatggtaaataacatactaatagtaaggtttgcttctccattctccaatgtttgagtacatccactgatccacccatttcccccaagaaaacaactcccctgcactgcaccactcgcattgcatgttggtcttctgaaacactcagatgtgggat

SEQ ID NO: 98616 - DNA, 511 bp, Oryza sativa
atccacgtagtactccgcctcagctgatactccgtttctttcgcccgtttttccacgtaccactcgcacgcaccaacatcatggctctgttgaagagagtatccacgatatatggaagagcgggtgctctgaagtcggaaagctacgcggaatggcagatggtcagatacagataggcattgatcgcaatggccaggaagcaaacgacgacgcaaatcatgcagcgcgtcaagtgaagatccaatcgcccttggctgtttctgcccccgcatgcagcgatgcaaacggagtgtgccatgctgcagtacacgggattacaggaaacattttttttgctcctttggttcagaaaaaaagggaagaataagaacatttaccccaactgtccagtggtgcccacgggtggctggtagcgatgggtcgcagcccggccggccttaccgaaaaggagaaaagaccgtacgacaatgggctttgtggtccagctcgttgggctcggcacggatggccc

SEQ ID NO: 98617 - DNA, 591 bp, Oryza sativa
aaaaaaaaaagaaggaacaggtgagttctagagtcctagcctggtctttcgaccattccacttatcagagaggcaacgtgcatgcttaccaggactccgctcgccgcagttaattagctagcttcgttttggccttttgggaagtaacaatcaatcgctgggttcgttttgtcgaaggttagatgctagctaggtttagatagtagtgcgcatgcatcagtgtatcggatcatgacactaatgagatccgcagccaaattaattcgtctaatctaatatgtttggcccccataaagatccactaataagaaaagttccccctttaaccataaaatcagtatgccggtgacagatcgtgtgtataggctgggcacttttctgcaggcagagatcggacaaggccagctcaaaaccttatctcctaattaaatccgactgtcacagtcccgaattaaagcactaatacagaatgagatgttaactaaggcgttaagcatgcagcttgttgtagacttgtagtgctcatctaatccctggataaacaacacaaaagcacccgtgcaaaaaaacggcagttcttacagcttgatt

SEQ ID NO: 98618 - DNA, 604 bp, Oryza sativa
cctcatgagatcaagatagcctaaaaaagggaggaagttcacagggcttgagggcaagttttatagtggaggtggatgtcacatctaatttagatcatgtcatcttctcattacttaagaggcaacacataaaacatatcacatctaatacacaaaccccaatattaatctactctcacatcatcttgtacttttcttggatattgtgtagaggttgccccttgcatgaggagtggctcattctctctctcctaactcctctcctccacctcatcatctaatcttatatggtaaatttagaagcaatgtgtagagactcgtagtacttgccctcaggggttgccttctagacctttttaccttgtctgaaaaaagggcctctagggagtcagctatgaaggaaagcatgcgatgttcatagccaaattaatgctaggatgttgattttcatatgctttctccgaaaaagaaaaaaagggacagcaataggtggtactaaagttgttttcaccttggaatgaatggacatggtgatgaccagattcgattctctttttcggagatacacatacaccactagtagaagagactgtcatagcacctt

SEQ ID NO: 98619 - DNA, 615 bp, Oryza sativa
tcctctatctgctaatcttggctctcgcaaaactatcatctcttcaggcttcagcaaaagaatttagaagacacatgtatacagattatatattcgagaatcgtgaattttatagtacgtgaactgttcgctgcataggagctcctatagtactgtagctgttttactgatccattgcagacaagcgtgggtgagcagtagttctagttcgtcactggagctagctagctgctagtctgcagtaaaaaaaatgtctaccggttgctgtgcgtgcacacatgtctgaacatctgatgagcagttcaatactggtgcattgtagacatcgagaacaacagcctctgtaggttttgtgtaaaaaaaatgcaggttcgaaataatctgttactgttgcagtacatgttctggaatcactacagtgatgaaaaaaaagatgcatttgtctcttccaccgcatgatcaacctcagtatagctgattgtttatgtggatttttcggggatcaccccgtgccaaggtataaaaaacagacggaaatcactcggttttcgtatagaaattgaggtttcgggccagctcaagatcacaaactgttcagtaaaccgatcaagttcc

SEQ ID NO: 98620 - DNA, 779 bp, Oryza sativa
tgtcgccagaattattaatgagtataaagtacgtgtcgagcaattaggtcgcacttaactacacgctttaattaattatttgcactgttttatagacttcgacaagacagagaaaacagggtcctaaaatctttaccctacatgttgcaggctcgacaaatactgattcgtacctttcaaagcttctgaaactgatacgccatatgcccatatatattcctggtctggccccacataccatgctgtgcaagtgcacgtctacgagccacatgcacccacgtggcaaggttgggcccacctctcagtccttggttgagctgattctgataccgtgggcccttttcctactgcagctcgacacctgtacccttcttgagtggcaagttgagactgaccctgagcagttcaccatcacacctcatgtcatcaggcagaaaacaaatagttaggcgagctaagcatctcaacaagttagcttaagcagttttgacaaaatcagagggaaattcggattgataacatgatcagagtcactgatgttgtagtatctcttgatctgcaactcatttatttccccagatagtgtgtgttctccatttgttcagacaaaacaatggacagaaaaccagcacaacctggacaggtgacctctagtgcctggatccagtgttcctgagctaaggtccagtttttcagtttttctcagaaacttctgcatattggtgatgcttgggcaaacttattccctgccataggattatgaaattgacaaattgtag

SEQ ID NO: 98621 - DNA, 747 bp, Oryza sativa
aagacggaaaggatgctctggatgaactcaagattaaggcattgatgcggtacaagattaacatgtacttagtagtgatagactgatgagtaggtacttttttttaatgtaaatttaataactcttagtatctagatactatgagatactaaatttaatactaaattttggttcctcataatatcttcccaagaattgtaaaattactctagactgctagcctcacatagtagcaggctgcaagaaataggccacaccgaacgggacttcacggttgtactgcatctgtgactgtgacgatggcgaggcttaatttcgtggatctcgaaccttcttaatcttgttttctcgcatgacaaacaaacgaaaacaggtggagctactgaatcattagccttttgttaccaaaacagaaaaaaaaaactgaatcattagcctttttctatggtggcgagacacgtacggccggcccgtgcgacgtgccaagggctaaactgtggccgtgacgcggtgcacggtagaaaaaaaaattgcaccgtagtaggagtaacaattatcaccaaacaatattagcaagtacgctttgcgaatgcctttgttggtatgatcacgacgtcgcgacgttgataacatagagtaaggggccatgacgtatttcgatttgacataaacgacaatacaaaattgttttcaacttttttagtgaaacagacagctgattccaccctttaattgggtgtcattttc

SEQ ID NO: 98622 - DNA, 754 bp, Oryza sativa
atccttcatcgtgctactaaaagcacacttatgtgtacgaaattgtgaccaccagattttaaaatccttgtagtcaagtggatcgagtcatcgtctatccatgattaagaacactccccaccattgtacctctagtgatttcaagtagataattccactccgcccgggtagaataagcagggcatgaaatatgtacgtagtacgattgagcaagaacatcaaaagcgtcaaattcactaagacggaaataccaaggtccacagggaatttggactagcagatggtggcaccatttgaagacatttgtggagtagtcaagcactgccggactaaactatgtgctagtgttctccatcatattttgaaaagaagagcaaattaaagaacaagagaaagtacatactctaggcaatgcagaaagtcttggaaagcccctcaaaaaaaaaagaaaaaagaagaagaaagtcttggaaagagactagctagctatagacagctaagttaaggggtctgatcgggaccattggtaatatccttttttctgtacccatgccccgttggttttgaccaagtctaccacgcaaattgctacatgttgaggtagtcaattggtccgtcatgtgtgccaaatactctctagatgaattgttacagtgcggcacaatgctcaataatgtaggaaacggatattgtggctggatgaggggatcttacactctgatgatcactgatatcactcatagggctgcaggaa

SEQ ID NO: 98623 - DNA, 531 bp, Oryza sativa
tcatatatattagataatattgttataatatatggctaattaagaatggtactattattgatactaaaataaagtgtattattattgtgggtgaggatactataaaagttgccatacaaaatgttgtatgcacgtgctatatatgtatacgttttatagcattgtcactgtgcagttttgtcaaaaattgccagtattagttactagtttctcagctgacaaagagatggacaaactgatcaactagctagtagtagcagattttactttctggactcgtatatactccctccattttaaaatgtttgacaccgttaactttttaacacatgtttaaccgttcgttttattaaaaagtttgtgaaatatgtaaaactatatgtgtacattaaaatatatttaacaataaatcaaatatataaaaataataaataattacttaaattttttgaataagacgaatggtcaaatacatacttaaaaagtcaacggtgtcaaatattttaaaacggagggagtagaagaaaacaa

SEQ ID NO: 98624 - DNA, 664 bp, Oryza sativa
aatacgtactgttacctatctcttattttgaaaatatgcagcattacctatcttgcttctgggtacaaagatggggactcacgaaccaccatacgactttgagacctgacagcctgcataccgcattgtcggaacacaaaagcgtttaaaggttaggctaattggctgttgtcacgtcgtacccggtcagaatagtatgtgccaccatttactagccaaaaaaccaaaagaattagagcttgaattccacaagcaaaatgggttaatttatggactaaaaggccttgtctacatattgccaatagcgacgtcaacagtctagcatttctttcgctatgattatgccggcttagcgcattttcaggcagtcgacggttcacacccaaatgtccatcaccatcgttgtgcctaatcaaccctaatcaaatacatcaagtcatgtacagacaacccacaagtttggttaatactcctacccctacaccagcaaagctagtgaggaaaaaacaaggaacttcaatttattctctctttggataaaaatattggccactcattaaccatggtagctgacgaggtacatctccccgtgtcacacactttgtcacatggccacaagttcttcaaaccctcaaaatatgtagagtttataactgaataatgc

SEQ ID NO: 98625 - DNA, 611 bp, Oryza sativa
ctcattcagagagaaattcatggatgtatgagtactgcgtatgcgtggtttgttaaccgttctcgcaaagatcgtttatgaacgactgccaaaaagcagaagaaccagtttcactgcatccagtgtcaaatactggagtacacggagtattactcgtactgcaccccacaagctgcagatcagaacctccttcctctactacagtaggagtatgctgtacacaattactcctactctacacacacatcatatactactgtacatgtaagcctgacaaaaggcgctgcagctgcaagccgcagccacacacatcgggcattcactacgttctctctcggaggcctcagtgattagtcagtgaagggctttaacattgagacatcacatccgactatcgagagcagggagaatgcagtagtaacaatggaaatggggagcttaattaactccagcaaacaagtgactgtgacacccctgcagcagagaaagagactgaagaagagacggctgatggccagtgctcgtccagtgcagagtgaatggttcatgtctctcaacctccagtgcagtgtaactacggccctaagcagatccaattcaatggtgtaact

SEQ ID NO: 98626 - DNA, 569 bp, Oryza sativa
agagtgagacttgagagatagctcgaggagttggagtacgcccaatgagccatgcacacaacgggccagggatacgtacttgctgccaggcctcctagtgttaccgtgtcagcaccggatattttcactttacccttcggtggaggtaaacagccaagatggccccggtccaccgcaaatatctttcacaccgtccgtcactctagccagccagcgagcatcagtttggcagaaatcactgatcaggtgtctagctgtcgcgctgaccaaaagaaaatgcaaagtttacagaagaagtccacggtaagtgttgtggtcatggcaaatgttcagcggaaaaactgccacgctggcatcgttagttgtcagttgtcacagccaaatggtcatatgttcctggcgttaatttatccttacgattttgttcaattaatcccatctaatatttttttcatgggaaatggccaaacaaggcctaagtaaattttgaaaaactatggttgtttagttcaaactatcactaatcactttgctacaattttaattgggtatttcacaaaattataaca

SEQ ID NO: 98627 - DNA, 724 bp, Oryza sativa
atccacttatactttaaatgcaattttctcttaaaatactcatccgatatacgatccgattgcaccgttgtgttcgtaacaattaattctttataacaagatcttacatgattatattttgatgaaaaattataaattacttttatcatatatctaaattacttcttagacatataaaaataaattcaataaagcctaaaagtaatttacatatattatagaagtaacttataataaaaagaaagtaactctaatgaatgccttttttcattggacgtgaagtcatatttttatccctacaacgaatttacttctaatgtcgtgacaaagttacttctgttttgtttttaagttacttttataatatatgtgcattacttttagactttattgaatttacttttatatgtctaagaagtaatttagttaaatctaaaagtaacttatatacatgataaaagtaacttatatatataataaaagtaatttataaatataaatatttttttatcataatataatcatgtaagatcttgttatgaaaatttaattgtaacaaacacaatggcgtaattggattgtagatcggataaataatttgagagaaaactttgtttgaagaggaaaaatacatgcatgtctattaaaaaaatgcatgcatgtagtacgagtacgatgtagtagactccacgtcttctccatatttaggcgtcgctggttaagg

SEQ ID NO: 98628 - DNA, 640 bp, Oryza sativa
tcgtgtcaagcaacagagcgcggcgacgcctggtcggcccgtgcacgcgcgcgtcgcgcgtcgcgagatctctggcacggaccgacggacggtgacagaaactccgcccgtacgcgtaccacccagtaccgttacatcagcatgcggcaagaaccgatctgtcgcgcccaggtgatcgaaacgtgaggctggccaccggccggtcgtcggccaagaccaacccaccgcgggaacatcagcttcgccgtgaatggaactactcgtggaagtgacggatcgagcccttctggtcgcgtcacatcggggctatacccgtcgccaaatgggaagactcgtcacgtttcaagtagctctgccccatgccatgtgtcccaacagttgcacagcgcaacgcggagcaacgcatatcagcgtacggggttaagtactgaacggtaactgcgtgtactcctacataccacgaggtccaccatcctggacgggtggagtagtagtaacaccgaataaacaaggattctccatcggttaacacaagtaaagtacgccccatgttatccattctcacgatttcatggtaagttaaattatttacacgatgacgggcaaattttatttttcatcgtaagggggaaattaaata

SEQ ID NO: 98629 - DNA, 554 bp, Oryza sativa
cccgttgaaaaaacacgttagctgggttgaagctgtgacgatggtagcaccatgaggtaggcgtggaatgctgttacgagctcctttccacgcgtcagtcttgttgtggcgatggtagccacattggacaggctaatgtgaggagagaggatccatttttctctctcaccctctccctctataacccacccacaaggatggatctatagcactccttaagttaatatgctactttgatggccaaccatctgctaagcatcaacacaatggcaacttaaaagggattacctagcatctactgttgaatttaacagatacttaatcaatctttaaatttcttttccactacctatatctacaacctcctcccccccccccatataaattccctcaccaaacaatacccacttctctaatctacaaaacttttacccctatacctttaaaatactactacttatctatatccaaccttccaagatcctatccccgttttttccactttccaaccttaccatattaaacacactggaaccattactaccttaccaaaa

SEQ ID NO: 98630 - DNA, 581 bp, Oryza sativa
ctctgcctgttaagagctgtcattagaaagaacaaactgaattttagtacacctacacaggaaatgtaatccaaatccaaatggatgttaaaatctcaaatgctacacggtaatttagtactgttataagagccaccggcaaacatcacaggtatgtcacccccaatttcattatatgacttcagcaccaacccagacagactatcggacggatgccctaatgctgtcaatcaacctaaaaatgcgggaagcacatatcggcgatcaaagtacacgttgaacgattggattgcgacgaaatgtccccatttggattctgaaaaataaaagtagtggcgaattcctacttgatgttaacagagactacgttctgacagatcatcagttgcctacactcaataggaaacactaaatcgcacaaattccacccagtcgcagtggaatcgaaatctgacgacaagcagatctcttcgggggggagaaggaccatacctgatcaggaactggacgaagacgggcagcgaaccgcagacgaacccatctgaaccgatcaggcacgacctcgcggacagcaaatggac

SEQ ID NO: 98631 - DNA, 701 bp, Oryza sativa
ctttgatacaccaattaattaaccatctttttttgacagcggccgtatagtaacatactggagtaagcatgttactagtaatttctaaattttgactctaaacgcaggtaccacaaacacgcgctggacactcttaagttgaatctcttttgttcggagtaattcttaaaagacaagagatcatgatatcttgagatcgtttaactgttgaccagctaactattgattgcattagagcaggtacaatagcaggttataagctagctataaacatattttaaagagataaatgaagagagagaaaagtagcgggctacaaatctgtagccagatgcagcacggacttcaagacgtaatgtgtgtatgatagatagaaccaggtattaatactatagtaaacaactattgtataaattggctattatattggctatagatgatttagagctagtagttggttatactattaaacttgctcttatatgcacctggtacatatacctggcctagcatgcatcatgatttattttttatttttaaaaagcatttctgcacggtgcacagtgccatgtcacgcgtgcatgcatgtcagaacttctcggctgctagttacaatagctgtaccatcaattatagatcagttttgccactttgccctaaattaaaacagccatcggtgcagacgtaattgggctgcagga

SEQ ID NO: 98632 - DNA, 626 bp, Oryza sativa
aagtaccgtgagctgccggcgccggcgccgcccccggcagggtccatcccggccatggccgtgtcatctggccgctcccaccacttcccggccgccagcttcccggttgatcggtgcccctcctcctctacaactcgctcctcaccatcaccaccacaacctgccaagacaaagcgagattaagccccttgtaaagaatctcgaagtaatttgcatggcacagtagtgcagcccaaacccaaacagcgaagcaaagcaaagcaaccaaagcgaaatgggagatcttttcatcaacagcaaagctttggcctttgacttgtccacacatctagcagctagctctagctagcatagctaagctacccagcaatgatgaagctctcaaaacgatcgatcgctgtagctagcatgttttccttacctccgccgcacgcttctcctcctccacgcaccgctcgacacgtcgacaccccggcggcgcgcggcagaaacctccctccgacgaacctgcccagccgatcgatcgcccaagaaaaacctccccggagcagcaagcgaaacgatcgttattccaacaaagagaaagtaaggaggcacgcggtgtaggatgggggtgaaacgggcgg

SEQ ID NO: 98633 - DNA, 544 bp, Oryza sativa
ccgccagggccgcgccatagccgtccgggcagcggcggccgtggtagaggatcagggggcgcacgtcatcttgcagcgaaggacgcaccagcagttgcagggggaggatggtatttttcatgtgggtccgattgtcgccgcagcgcgcggccggcgcacagcccggccccagttccaccgccaccgtgcccgggcctcggccggtgtgcccccggcctatgcctgacacaacagctcaggacataccctgggcggtatggacaggccgtgatcaatgcaagtttggaatgattcaatttcgccaattcatgcctgaaaccgcggcatattgtgcacaaaacccttttccatcaaccacttgaacattccacggcgtcaacaaagcaccgacaagccatggttgattacattccaggtctgcagacagcctgcgggcgaccccacataatgcttgcatcactgtttcagtgactggctttgagccccaacgccagccaccaagtctgatgaacaacgtcaacgacatcgccccctatctgggaca

SEQ ID NO: 98634 - DNA, 651 bp, Oryza sativa
cattcgcttgctacgatccatttcccaactgtattaagggctaatcactatgcaaaactgttgtattaagggctcaaagccgcgtactaagttatcaattttttttttcatacttcctttttaagctctaataaatgtcatcggcgagcgtctaaaaaataccataccattgtactccctctgtcccctaatataaggtattttaacatcttgcttgtattatttgatcattcgtcttattcaaaaaaaattaaaattattatttattttatttgtgacttactttattatcctttattatccaaagtattttaaatataactttttattttatatttgtataatttttttaataaaacgtgtggttaaatgttaaaagaaaaagtgaatatctcttctattagggtatggaggtatccatctttcctaaagaaatgtcatcgccgtcggttttccattaatagccaatcgtgtttactgtcggtcaacacggtcaaaatccgccgtaacaaaggggagctagatgcatctgaagaatgccgtaaacgctgagatcgactgcatcctctccatgtctggccgaacgcgagtttgccgattgctttgcagctggtgatctagcggccgattcctcgcacgttgcatcgacat

SEQ ID NO: 98635 - DNA, 528 bp, Oryza sativa
acgtgtaatccttttgcgcgtttgaaaaaaaaatcttgtagcaaaattttccattcctaaacggatcacatgtattcgacccgttttgacgcccccgcttgcgcacaaaaacaagccggacccggagcggaaaccgagcgagggctctctccgtccagtctcccacccccgacctctcgtgtccgctgcgaagaaaaggttgagcacacacctcacctcacctcctcccccgatccccctcgcctccttcccctttcccccctcacctctatggttttatccgccgcaccaatccgccccctaacgattcgaccagatcggcgcgagtaagtccccgctccatcccgatctggatccgccgcccccccccccccccgacctctgcgtggttttcccccagaatcgaatccctctccgtggcccgtgttttggttggggtagatccgacggttctcactgcggcggattttttcccttttgttttgtttttggtcgaattcctggtgcctgtttgttcgatccatttgt

SEQ ID NO: 98636 - DNA, 632 bp, Oryza sativa
tcgcttatgatccagatgggctgaatctacttaaccggttggaccgtgagcccatatttagttggcatgggctatatgtttcttcttggtcatcgggcagtaacgtgtgccacgtcataaaaacgccatgtttttttttaaaaaaaaggagtagatttgtaaaggacgtaactatacagctagtgttagctaaaccagctaccactccatctaagaggcaccatccacctatacttcaaatacaattttctcttaaactactcatccgatctacgatcgattacaccgttgtgttcgtaacaattaaatctttacaacaagatctcacatgattatattttgatgaaaaatcacaaattacttttatgatatgtctaaattacttttagatttcactaagttactttttagatatataaaagtaaattcagtaaaacctaaaagtaatttacatatattatagaagtaacttagacaaaacgaaggtaactttaacatgtcatttgaagtaaatccgttgtagagataaaaacatgactctatctataaattaaaataatcaacacaaattatggaattaactaaaataataataaaagtaatcacctcagagcattatgaatgtataggaa

SEQ ID NO: 98637 - DNA, 604 bp, Oryza sativa
taaattgttttaataatatatagttagatataatattaggcggagtaaataattggtttcttcctagaactaactgagatacgtgtgatcgattcccgcgggtcatctcaattctcagccactaatcaacgcctaagatggtgtttggattcagggacttaactttagtctctatatttagacactaatttagagtattaaatatagactacttacaaaactaattacataaataaaagctaatacgcgagataaattttttaagcctaattaatccataattagagaatgtttaatgtagcatcacataggctaatcatggattaattaggctcaatagattcgcctcgcgaattagtctaagattatggataggttttattaatagtctatatttaatatttataattagtgttcaaacatccgatgtgatagggacttaaaatttttaacaccatctaaatagggtctaaagcttttctagattgtgatcaacgcctaaatctccctcgtcagtaaaccaaatattacgatcacacgtgcacacgtacccgaggcccagagcagagtttaattatgatcgatcaatcacaacacaggtata

SEQ ID NO: 98638 - DNA, 559 bp, Oryza sativa
attcgcgcgtaccattctgccagaactgactaggctaaccgagcagtagcactgatgccccttcggggaccttatgtgatcatgtccttcgtaccttccggggctggcccatgaaaaaaattttgttaaaatgaaaaagaaggccaaaaccgtgtggcccgataaaggaatgggttaactgttaactgaccgcgcggatcgatctgactttttaaggtttgggttaagggcctgtttgtttctcatcgtataagattattataatacaaagtatttacccagattaataaactgaattatattaagctatgagtttgtttcaatggattatagtaggattaaggcagtgactctttacccacccatataatatgaaaaatatatgtttagaacagattaccatttatactaatctggcttacagatcacaataatctatcataataatttacctatttatttttattattactaataatctagattataataatctctaagcgaaaacaaatagagcggtaatatggtttggtctgtgatcatgaccgatgttggagat

SEQ ID NO: 98639 - DNA, 1058 bp, Oryza sativa
gtgccctagcacttaattgatcttttccgtagcttaatttttacagtgctgctcctgcttagctgaacatgcatcaacagacagaaagacagacagatctcactctacacatctctagacaacatcaacctaaatttcactccatgcttggtaatctaattaactgttggtctctctccactatgatactgacagtaaccagtgattagcagtaagtaagggcgtgttttgttctttgccaaactcaaccataccaaaattttgtcaatagcaaaggtttagccactgccaaaaaattgataaggttgatcatttgatttctaatttcttgccaaaatttttgaaatgtgtgtgctttacttggttttggttgctaaatttttggcaaagcctgttttggcaacaaagcaaatggaaccatcattcattgtcattacctttttttttttgacatggttgaattggacaatgaaccagaatccaaattctaaaattgaattttccatttgctcttcagcttatccgccacagccaaaatttaaatttcaaaacttaattttagatttgattctgatgtttcttgctcaacgtagtttatttatattactgcctttttaagtcgctaatagttgtttcggtttataatcggctataggcaagtttggggagtttctagcagatgcggtttcttccagaatcaaaagctgcctaaaatagttcggttttttattcatattccgagaagctagacttacataatttcaaaaaataaactacaagtcaggagttatgctttcttcttcagatttctaaagccggctacctatcacccgcttcttaaaatcgtaaagttcaccaaacagaatccatggtagcctgaagaatgaaaagagagtgaagagaggatgatgatgctacaggcaatgcttggataattggactccctttggcattttatagcattagcgttgggaggagtggtgaggtagcaccaccatgtgtcgtgctcgctgctgatgctgataccagggttcgccataccgccgttatccgcgcgg

SEQ ID NO: 98640 - DNA, 686 bp, Oryza sativa
cacatgactaattatctatagattactaacttcgtactaaaatataataaattttctataaatttggatagatgcttgtccatattcatagctggaaatgattacattttgggatcgagagaacattattgaaaaatatatttactcgactttttaaacaacttaaattctatatagattttttttttcataaacacaccatttaacagtttaaaaagcatatgctaatgaaaaacaattaagttaaagtttagagttgaagaaagaacatgattttatactttgggatggaatgagtaataatctttctaagcaatcacattaaattaaacaaacttgcttatatatgttgcttttcaaatatagccacttaaagttttgagtattgatttgacttgtacttagcaaaagaatgaaaaataagttcctgttgatctttaaattcccgtgtttttattgtgaaacctgtaaataaggaattttttcccacttttcctgtatgctaatccttcattccgatgagcgaatagtttcaatttctatagtaatttaaatactccattttcctctaaaaatccttcaatccgaaggagcctttgcgacctattaactccactgtaacaagggatgaagggaatatgattgagaaaagttctacagatttgctttctgtaccccttccaaga

SEQ ID NO: 98641 - DNA, 917 bp, Oryza sativa
aagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaatttttttttgtcgatagattatttctgtgaatattaaaaaaaatctaaaaacgaaaaaaattcatatccatcatgacccattaattgtgttgttatggttggtactagttaccattcttgttcttttctttcctgcatcaattagattagtactccaaagaggctcctttttttttctcctcccttgtgcctgccatgttcttgcactgcactactgcaccagcacctacaattccaacagtgtctccatagccatcatttagtttgacaacaatgagaccaaacaccttacagttaactaattagtgaatatgtacaacactcctgtaccaattaaagttggtagattacaaataaattgttaaacaatttgacatgaaacatttgtactccctctattccaaaaataactaacctagaacgggaggtaacataatctagtacaatgaacctgaattgtaacattttatccagatttactgtactagtttgtattacatcccctcgtatgtaggcattaaagcggctacaacatctctctcaagtcatgtcaatgctagtaccattctccggtgtttatgtggctttggtccttctctgctccatggtactactacactccattgcaagcaaacacatttgtaaaagcgacaagacatgagagtatgtctagtactgagaagagcatgcatgattgtcccaactatggaagaaagaggggcaacaaaatactgcaattttttttttt

SEQ ID NO: 98642 - DNA, 1037 bp, Oryza sativa
attcctgcagccccaaaaacattttaacagagagtggaagtagcatacaaagacccagaattacgtaattgtttttttttgtccggatgcgacggatcaggttataaaaggctatgagatactggcctaccctccccacgcaaagtacatgcagctataataatttgtacatgagagcttaccataggctgtccaccataagctgcataaaggcttccgtaatatggatcaatatttgcgtaagcaatttggccctgctgaaaaaaaatgcagaattagacaataaacattacaaatggaatttggcgttatgcatgaactgtgatcaggaaatccaagcaaagaagcaactcatggtgcaaccaccaacgctctctttggttaaggttagtaacaaagaaatttggctatctgtggtcgtgtggagacttgtgttatggactggtgaacatttgttgacaacgtatcaaggaaacgtggcatagcagtataaatgggatatggtataactgtcatggaagtcatgtgcacctgtttgacaatcaaggtgtgatgcatggttttcataagagggtcacctcaaaaggaagtaaattggtcctccactatgcaagagtttttctctctgtatatctgttagttttagtatgaagaggtggttatcagcccaagaatccaaatccaaattcaaacttgaatctccatagtgattctacaagcctgccatgtttctcccatatttcactatgatcagttggctaaatatccttagactagggctcaaactgaaagaacagaagttatactacttgctcataactaaaaaagggaaaaaatacatgtaatgtaccattgcatgggccatatcgtgatgggcatagggtgtcgcataatctgttgaaggtgttgctaccattgtatggctatctgtactagtaactgaggcttcttgctggtcctcaggttcaccttgcctttgctgtttttgccgctcatcagcttcatggttgcctacataggaaagaaaacaaaaatga

SEQ ID NO: 98643 - DNA, 707 bp, Oryza sativa
  unsure (1)..(707): unsure at all n locations
gaatagagggagtacaaatgtttcatgtcaaattgtttaacaatttatttgtaatctaccaactttaattggtacaggagtgttgtacatattcactaattagttaactgtaaggtgtttggtctcattgttgtcaaactaaatgatggctatggagacactgttggaattgtaggtgctggtgcagtagtgcagtgcaagaacatggcaggcacaagggaggagaaaaaaaaaggagcctctttggagtactaatctaattgatgcaggaaagaaaagaacaagaatggtaactagtaccaaccataacaacacaattaatgggtcatgatggatatgaatttttttcgtttttagattttttttaatattcacagaaataatctatcgacaaaaaaaaattgcagaaatagcccctgccgccctaatggtgggcggcaagctgacgtggcagacggtgggtcgaccgcgccgtctgccgccgtcggccaaaattgcgattaggcccttgccgcccgtacagagggcggcaaggggctaattgcaattttggccgcccataaagagcttgtggccgtacttttttnatntgggttccttgccncccaatgaaaaaagtacggccaaaagatttttctatgttatgttaataataaataaagaagtatttattggtaaaacttgtgaatattgttataaaaatgtat

SEQ ID NO: 98644 - DNA, 596 bp, Oryza sativa
gaatcccaatttgattctttagctgcatacgactgtgcatcaaaccagttttggcatggtagccctcggctatagcattatagccatcagaattcatttggctaccattgtagtggcctgctcttacttgctctatgcacaatgctaacaaaatactattataactatcagtccagttagctcggtcagaagtgctcaccggagggccgccgaagctgcctaattcctccacctcatcgtcccatgcaccttcttcgtcaaggtcgacgtaatcgccgatgggtgcttcctgggtgccgacactcctcgacgcacaccaaccgcggcccccacgtccgcggtcgcggccacggttggttgccatggcgcgttgccgacggcgacccgttgcccctgatgaggagctacctcacccaaggccgccgccgacaatgcccgacgacgacccaccatttccaccgtgtccagcacggccacctgccgcgccgaagttgagctggcgggcgcgcggtgcaccacgagatggctcggcaccccctcgaccagccctcactcccagagagcgtggtgcacggatgggagggagaccggagcct

SEQ ID NO: 98645 - DNA, 542 bp, Oryza sativa
tgagtagcctatatagactactccctccgtttcaggttaccgtttcaggttataagacgttttgactttggccacagttgaactgtttcaagtttgactaagcttgtagataaaataataacattttcaaaccaagacaaatttattatgaaaatatattcaattattgatttaatgaaactaatttgatattataaatattattatatttgtctataaacttagtcaaatttaaagtagtttgactttgaccaaagttaaagcgttttataacctgaaactgaaactgagggagtagtgaataggttaaaattagtgcacttgacttttagagatgtactagcatagttgtgtatttgcgaacgtcttctgtgttaaaaaaaaatcgaacagagtaaagccgtaaaatatatccgaacatataaagtcgacaaatcacgctggagaaattcaaatcttgtcatttttaaagaagaacaatccaagtctcactcgtatagagcagactagcaatatagtcagccgctcctatgacgtaacga

SEQ ID NO: 98646 - DNA, 607 bp, Oryza sativa
cgtacactaatagggaactctgacgatcgtactaattcgtaaagacacctaatgatcgtgtcatttcattgagcagctggttactgctgtacgactactaccatggaatgattagagtcatttcattgagccgttggtgtctgtggatctgcgatttgtcctactgacgatgatttaaccctctccagccgaatcttgcactgtttcctacagtaagttgagcctgcctgcacgggcactacagtctactgctcctacagtgcaggggaatctgaagaaaaatttaattggccgcactactcctcagacggcttttcacttcttgcagttacagatgaattttggatctaaacttcagtcttttcatcacatcaatctgtcatacacacataactttttaaccacatcatctttaattttaattaaaatctaaactttacgctaaaataaacacagcctatagaggccaacctctctctcttctcccccatcactgcacgcgtctgcgagaagcaagaagcagaagctactcctactactgatccgtagctggaggagtagatggtgatgtcatggccatggccgcgtgcctgcatgcatcgaggaa

SEQ ID NO: 98647 - DNA, 650 bp, Oryza sativa
ataaatttattttgagacggtggcagtactcgctccattccatattataagttgttttgggctttctatccctcgtgtggattaactataaatttagacacatatatgaagcacacacataaattaaattcatgcatgaatccattaaaaatccaaaacgtcttgtagtgtgaaacaaataaaaaaaagcattgaatactaaaacgataaatatgaccaaaattatactcccttcgacttattttaagtgcggttgtggaggttttatgtccaacgtttaactgccgtcccgtcttatttgaaaaaattaaaaagataagttatacataaaatactattaatgttttattatctaataataatattattattattaatcataaaaaaaatcaaataaggcggatcgtcaaacgttggatatagaaacccacaactacacttagaatgaacggggagtataatttacttatattataatgatataaatatatttagtaatagtgaattatgggccattttgacggtttcaagtcatgaacagtagtagtgacgttaggcaggagagggtgaggtgtgcaagaagccgggagagacagacacctcggcagccacacacgcggatgcgcccgggcccaccactcccaacgcgt

SEQ ID NO: 98648 - DNA, 2150 bp, Oryza sativa
tactatgcacctaagttgtatccatatgcttagatataagttgataaaattgaacacggcatattgtcaagttggtatacccacagggtaatttattctcattaaaaatttagcaatttaaaatgtcatataattgaacattttaatgttctcctttgtttggactggaaaaagtcaatttcctccctcttacattgctcgcctgtaaaatagataattagggccacagctcccaatgcaatggaataaatatagggcctatgtggtaggcaaaagttgaaccgatcaatagtgaactgaggctccgttttgacacgggatctcaagacctgatgtagatgaaaacactgtaaatgagatgaacagattgtttttatctgatttgacaagatggatttagtactagcttgttagtagggagatgagaaataaactcttactacttgttagtatttttttcctcttgttacaatgacataatttttatgaaatagataatcctgtagagattttggagaaaacttagcaagagattaaagctcttagaaaatttcctttgaggctatctctgttatccgatttttgtgtttttcctacggtccaatcaaacgatcatttctatgtttttcttgtgttttgaaatcatctgttttacacttctattcctgttagaatccagtcttttcctattcctacgtttttttttcattcttactattcaagggccccaagtatttatagttggtgagaaactgcaacagtagctgatgatttcataattttgtttgtctgattagattgagcccacctgtcgggattgtgctaatgttgtttaggcagcaagtacctcctactgtagtactccatccgtcccataatttaagagattttgaagggatttgatcctttacatccctccaaaataccttgggtgtgtttattaatgggaaatgggggtgggattgggattgagaaatgaatgaagggttgggattaaatggaagaggaaaaatgaatgggtaggatttaaagatgtcttttggtgcgtgggaattcatttccctatcccattagctaaaaaccgcccttatattttgggacggagggagtataatactacacttacaggagattttatatattgagtggattatgttagaacatgcccaattgataaaaaaaagttatctctaaaattttgtttttggaatttctaatttaattttaaggtgtaaataatttttatctccaacaaatatcttaaattaactcccaataataaaaagtggatacacccctaactatcgtacggtaacaaaaatcgctccacccattccatccccgcgtgtgatctctctcaacatgtctccctattcttttggcgtgtggaaattgggagcgagagtgtctcccgatttgcacagagcaagaaagaagaaagaaggagaaggggattccaattttcagatacatctctaaacatagtgttggagcaagtttttgacaaaagaaacctcaatttgaattgggtttcatttgttgatcattctcttacgagaatatagctaagtaggtggtgaccactactagacaatcgatttttcatgacgtttggaaaatatttttcatggcggccatgtgggaaaaccgccagcgcagaaaatcgtgggggtgggggtcaagggccgccagcggaaacacatcttcgctagcggtctacttaagaaggccgccagcgaagattggatatcttctctggcggctctcttaagctcatgccagtgaaggtattgtatctttgctggcggtaaggggatgcggcccgccagcgaagatgtaggtgtcttcgctagcggccctcttaacttaatgccagcgaagataccatatcttcgctggcggtgtggtgacgtggaccacaagcgaagatacctacatcttcgctggcggggtccttaaccctccgccacctcaaatcattttcaatggcggttcaaacgaaccgacatatgacgaccgccagggaaaatgcgctgaactatatgaaccaactacagtaacctcgagcaccattagaagcacgattttctctctcttaagaacacatacataggggggaaggttttgatcttgaatcttttgaaagattt

SEQ ID NO: 98649 - DNA, 886 bp, Oryza sativa
gaaaaaagaagtttgtttccaacctcaaactatcacgaagttcgatttttaacttgcaactactccaagaccgtctaaaacttgacatagcatttcagtcaatcctaattagtgacctccctatgttttaaaaaaaatcgttagcatgcatgctattttaagtgcagccaggaaaaagaaaaggccaggtcagcatttgagcaaacaccatggcggtttcagggaaaaggggtctttttcaaccattttgaaggttcgacagtgaaagttgaagttttagtggtgcaggttattaaaaatccagcccatgccgtatgcagaattctgtaaaatggagaccttctccaattcctattcttttgtaatacctggaggctcagatgaaatgcttctccaatctatactttatatttagttggtacccactaataattattagaagctaaaactcaacatgcaaatatatcatatcaccacccactagcaattactattctaaacccttttaaatcccatacaaatatgacacattatataatattatataaagatgaacaaacaaatatatcaaattatctttctcacactatttttacaatatttaacatatactcatttataaatcctgcatcaaaacgcgagggatcacctggtattctagagtttcagaccatttggaacgcctctggttcgtccttatgcaccacccaatgtctgcattgggagcctcctcatttcagttctttgaaaaactgaagcttgaaacatatactcaagaagcaagcaagcacacactgtaatgtcatcagctccaaaatgagacacaaaggaatttaaatggaaacacgagaatacataatattacaatttagattgaacccacgta

SEQ ID NO: 98650 - DNA, 2289 bp, Oryza sativa
tgatctcaacccctactacttatgaaactaaaagcagcatatgtcgcatatatgcaaatgagttacgtgagaagcaaactcactaagcgcatgaaccccaagctcttctatgcgcatgaattgcatagaagcagtgaactaagtcatgtggaagtcttatagatctgtccactaactcattattgacatcttctcttgaataggtgtgtccgagaaattggaataatgagacttagaggaatgcaaaattcagggggagaatttcgctaactcattctagaatcttgatatagaaattcaagtacccagaatcaatctagaaagattgaacgaagaattgggtgaattgtactctttttcccttggataagttttcccagcagtttcttatcaaggtttttaatgaggcaattcatgcgacgttgcaagcgtatgctatttactccttctctaaatttttcccactgggtttttgtgaagttttgatgaggcataggcatcacgcagtgagagccaaagggggagtgttaggaaaccgccggcccatgaaagcccggcccggttatccactaattgggcccatcactaaatatggaaagtactcatggctatgcctatatatagaggggaggaggtgctattgtattggacaagtgaatgaatgaaggaaaagagtcctacccctacatctctatgtctccaattcttgtagacattatgggaccctcttagactacttcgtgtagtaggagggttgcgtaatatgaacttgtgacgaaattgtaagaccaacgcgtgatagggatgacgcggccaccggcctcgcagggcagtgacacggttgccaggttgcgaggatctcgtggtcggcaaacgacatggcctcgacctcgctggttagccattaatcatcctgattagtgattaattaattactaatggtgttaattaaaaaataaccataattaattcatttctaatgatgctaattactctattaatcgtgcgagttctctagttagaaaatacatttgttgtaatgatcatgacaacgcaacttttgaaaaatagagagaatccattttatgccactaactttgttacaagtctatgatttgccgctgactttgtcatgttatacaatatgtcatcgacttttgcttaacttctacgatttaccatcgctgtccggttagcttccgttagcactgtaaattttgtccaaatgaccaaaatacccctaggacaaaaacttccaaaatttggataaaaaaatccaaaatatcatattataaacataagattgtaaacatccaaaatttggccaaaaacttaaaatatgatatttcataatttttatcaaaatttgccctaaattcctgaagcatctcatatgaggactcttcaaagagtagaaagacgcaatagtgagtctttcccgtctacgaatgtaagaaataagctcaaatgatgcaatgacgaaacatctacaaaattgtagcattgtagtttaggccacatttcgaaggggagaattgaacgattaagagatcttgttgttactattatagcaggatgatctctatgtgatacgtattaattaagaaatcatattgaactctacctttgtacatggttcttatagtccgtacctttctttatttaaaccagcaaaagagcccgtgcgttgcaacggaaagaaaaaaaagataaaattgaattaaaacatattaaattctaattaaatggaacacaaattttctgaactatttgagtattttttaagtaggtaggtataattccattccattatcttaaaaaaaaggcaggtatataattaaattaatttatgagtaaagtaagtgtgagaaataaaatgttatggttggatttattttttttattaaattttctatattaattacactctttgaaattttgttagaatttacatagcttaattgctaattttgataattagaaacatcatttcagcatttatttaaatggaaatcaaaataaaaatcattttatctctatgggccattttcagcccattttcttcttcagcccgcaagcgaccaaagttcaattattatccccatactcctctcacttttagcctgcaagcgaccaaagtttaattgttatccccatactcctctcacttgctgaactgccggcccacgtgtggctcaagtggtgcggcccatcgctcgatcgatttgagccgttcattttgatagacggctcagatctgttccaaattgatgaaaaccctaaccctaa

SEQ ID NO: 98651 - DNA, 555 bp, Oryza sativa
aatatctaggtctgtccccattctagaagctgggtcgtactcgttcgtttgacataagtatttggtaaacttatatctactgagacagtactagccacccggaaatcaaccaaatcttacgtactgtcccaatctaaattcattatatttttatgcagtctaactaggcagggctgagcaaaagttagcatatctggtttgctatatgtttaggttatgcattcaaaatcatgaatggctaatgcatagaatagaaatatagaatatagggtaattatgttcaaggggaggaataataacttgccttgctccaacgcaaataaatccgagataggcaacctgattatccgattctcgaaatatcacaggctgccatccaaaatagactctactaagaaagaggaagaaccaatttcaataaaatccataaaataacaagaaaacgataacaactaaaagggctagggtttagggtataacctatctcctttataaggtgtagggattactgggctaatatgtgtaggttctgaagggttggaggctagaggggat

SEQ ID NO: 98652 - DNA, 1277 bp, Oryza sativa
  unsure (1)..(1277): unsure at all n locations
ggctcctcatgcccataaagtaagcgnagacgtctggtgaaatcagggcaagaagggactatcatactcaaagtcacgaaaggtacctcccagaatagaagggagcctagttgagatctggcaaacagtatggaacctcagaataggcgtaccgcaccttcccatgaaggaagaaaactagctgttggagtgcacattaccgctggtacatacccacatcaagaaatattaagcaaagaagaagaagcatatgaaaatgcatctccttgtatatgcatggatattcgcatacagtctcatgcaaccaatagaagttggcaatgagatcgattatgggcaatgtctcctttagacaacaaaactcaatggcagtcaaccaggagttgaataaatgaattagaagttgaaaagaagaactcaacctgaatattaacaagcattgaagatagaatcaatgaatgcatttcaggagtttggatcggacacttgcataatagtacatgaagaagtactaggtcccgaaccaacatagaaagaataaaccagaaaagaatcgaagaagcaaactcgttcgtgtgaatttgagtttaattttgaaatatttggctgaacccaaatcatgctcacgcttgcagctaaaagcatgcgacagatggaagtctagtacatcagtccaaccgcacttagaaatgttcatggtgcatagctttggttagtcaattatcgccaaaatgggacggaattcccaaacacaagtgtgttatagcagcacacaaatacttggctaattgaactaaaccgaactaaacatcgttgaactgttcagagcctcggcatggttttgagggatggttacccgcgacagcaattgcgacttggaaactatctcaacccctactacttatgaaactaaaagcagcatatgtcgcatatatgcaaatgagttacgtgagaagcaaactcactaagcgcatgaaccccaagctcttctatgcgcatgaattgcatagaagcagtgaactaagtcatgtggaagtcttatagatctgtccactaactcattattgacatcttctcatgaataggtgtgtccgagaaattggaataatgagacttaggggaatgcaaaattcagggggagaatttcgctaactcattctagaatcttgatatagaaattcaagtacccagaatcaatctagaaagattgaacgaagaaatgggtgaattgtactctttttcccttggataagttttcccagcagtttcttatcaag

SEQ ID NO: 98653 - DNA, 724 bp, Oryza sativa
tccattaaataaatgctgaaataatgtttctattatcaaaatttgcaatttagctatgtaatttctacaaaattttcaaagagtgtatttattatagaaaatttattaaaaaaataaatccaacgcataacatttatttctcccactcacttaactcataaataaatttaattatatacctgccttttttttaagataatggaatggaattatacctacctacttaaaaaatactcaaatagttcaaaaaatttgtgttccatttaattagaatttaatatgttttaattcaattttatcttttttttctttccgttgcaacgcacgggctcttttgctggtttaaataaagaaaggtacggactataagaaccatgtacaaaggtagagttcaatatgatttcttaattaatacgtatcacatagagatcatcctgctataatagtaacaacaagatctcttaatcgttcaattcccccttcaaaatgtggcctaaactacaatgctacaattttgtagatgtttcgtcattgcatcatttgagcttatttcttacattcgtagacgggaaagactcactattgcgtctttctactctttgaagagtcctcatatgagatgcttcaggaatttagggcaaattttgataaaaattatgaaatatcatattttaagtttttggccaaattttgaatgtttacaatcttatgtttataatatgat

SEQ ID NO: 98654 - DNA, 1196 bp, Oryza sativa
atacattcgaccccctttgattcaaaggggcccatataagaaaaaaatcatatcccctttaaatcaaaggattttatataggaatttataggattaggatcctatagaaaattttcctatgtggctatttgattcaaaagagtaaaactttacaaatcctatgaaatttttatgagaatgggtcattgcatatagattttggagaaaacatacggatatgaagctttcctatgaaaaatttcctctgagtctatctctttcatccgattcctgtgttttttctgcgatccaatcaaacggacattcatgtgtttttcctatgttttacacttgcattcctgtttgaatcctatgtttttcctattcctccgttttttcaatcctgcgattcaaagtggtcctaatcaaaggaatgaatcctatggaatcctatgaaattcctatggaatgtctctttctttgtaagttttgaagaaaatttaacatgaggtagaatctcatggaaagaatcttttgagtctttatctctactcaaatttctaagtttttttctgcgacccaatcaaacggtcatccctatatttttcttatgttttggatttctctgtttcacacttgtattcatatcagaattctatggttttcatattcctcctttttttattcctgtgattcaaaggtgcccttactataaacctggactgaggtttgacttgattcatagcactgagatatatcatatccgatactaagttagtttttatgggacagatggagcaaatatatagctcggcattcacgagatagatagcgacgacatccttcggggacacttatcaccgacaataggcataacatccttgaacatggatgaccagttctacacgtgtcttcattatattgggggagcttgaaggcttccactaaacaaataagcaacttcacctcaaaagaggctacaggcgtattcagtcattttaaaccataatattgtttgataaaattgataaatgttaacatttagtttgttattaaatatttgtcatgcctagagaattgataacatcatagttagcctatcctattaaaacttggtaatgttacgaacttaccaaaattttggcaatcccaaattttggaaatgctgaaaatagctataaagggaacaagtcctacatttcccaacatgtcacgtt

SEQ ID NO: 98655 - DNA, 615 bp, Oryza sativa
caattcgtgcgcgtctctcatgaaccgctaaaaagggagaaaaaaaaagatcagccaacatagtactactacccaagtagaataaacttttcatttttctcaacaaaaagataagtcattttgtgcggagaaattatgtgcgagtagtaaaagatacggcgcgatttgtgcatgaacacgggttatactgtcgtggaggccacacggcctgactcttcacatggccacgtccacatcctctgctcgtgatggccagtcgtcttctttctcgcaagtgttgtggtctcactctgacctgttcttcactcgtctttgattacttctgattatatttttttatttggtctaacacgaactgttagcaatagagtatacgtgatggtaggcgaattgtgttcttgtagatgatgatgattaggattccttaggctgctcgatgtgatgcgcaatcaatagtcaagagttctcgtgatatagttctctcttctcgttaatttggctttgccagttgggcttttctattgtttgtgccgaaactgatccctgaggtttacattacttaattcttttttgttgttgaaatggagtgtagcgtgctaaaaaggcagtacggag

SEQ ID NO: 98656 - DNA, 815 bp, Oryza sativa
cgacccgattgcaccctcaagcaaagtccgaatgatcaccttgatatatatgtaaaaatatgattttaatttttttccgttgactgaaattgaagacagtaacaaaaatttctcgttagtttaggatgaagtggtagataaccattgagccagtctgaatcatggtagggaataaacatggtttctctcctaaacgttacttgattacaatactctcgagtaattttttttgagagtagatgaaaaaacatcaccaagctgtcatcagcctagtcatgttcttcaaagatataactaagaaactacaagtgtaggttgatatgagaagcaagagcaaccaccactatccttctaagggacgcagctatctcagaaacgcatgaggttttcaagagctcagggaatggggatctgactgtcagattaatagcaggtatgtcaacataaatcagctttaaaactgaactttaccgaatttgtaaattagatgtaaactcattttgcttgaatttctaaaaagtatctttttcctatgtatcattgcttcattttcatatgcagtgatgagcccaaggaaaacgccaaaaaggtaatttcttatttgaagctaaaatttcttatttcaattgcagaatcgtttgaatatttcttttaccgagattccaggccctcttctcacataaaaaatccaattcctgtctaccactgaatttgataggtctggcattcaagtgtagcacttatgacaatcctttatatttcagggtatactgcataaaaaaatattgaaaaatatatactaagctatacctggg

SEQ ID NO: 98657 - DNA, 711 bp, Oryza sativa
tggatccccccgggttgtcaggcagaccggcagaacgagaacgtgcgggaacgggggcacgccgcgccacgccacgcgacgggtcgagaggccgaggacgacgacgggttccaacttccaattcccagctagaacgagagcttgcttagccgacccgagacggcgatgcggcttgccgatggtttggtttaccgctttgccccggttcttcgctttcccgttttccaccccctcccctcctctttcggtcgagcatatctcctccccgcggggtgggctacttggctacttgcccgggtcccgtgtcctaaaaacacaacatatcttacggggaaaaagaccgttccacccacacgtctccacacgcttagggcctcaccttttcgtttatacttatacttaaaatttaaatttttaatattaaatttaaaactgattttaagtctttttattaaaatttatctttcatcttttatttttagatcgttaagaatacatatataaaaattttatttataaattatttttcgtttgtaaatatgtcatttcgtttattcatgaaataagcggaacgatagctccactgtactactcatccagtacacggtcacaggagccagtgagccacggctacccatctggatccagctcctccactcccagcgccgaactgtggccggcagcgagccatgagtggcggcatgtcacgtt

SEQ ID NO: 98658 - DNA, 726 bp, Oryza sativa
tcatccctgacgggcttttagctatgcccgaaagagataactcatccgtgacgggctatagagtcaagcctgttagagattagtcatccgtgacgggcttttagaatacacccgatagagataagtcatccgaaccgggactagtttgactcaacacgtagggtcaaacctatcggtgacgagctctggctaaatgcccgatggagatgactacttatccgtgacgggcttagtggtgtgcccgattgagattagttatccatgacgggttcctaactatggtggtttgactggtcatactcatctatgacgggcttggttgtcagcccgattgagatagcatccatccgtgacgggctttagcccgattgagatattttctcacatcagtgacctgtgcccactgacgggggccttacccgatagtgatgaggctttcagcccgttagagataagcgatcccgttctagtgaggttggatttccttacgtttccctcgtttgaacttacaaatgtacaacccaactcgtatgcaatatataaacttgaaatacaaaagttgtctcgttcagttttttgttccatttataatttgctgtctttgtgagttcacacatatatgtttatacttaaacattgttatccttttatgcttataatacttggggtttccgttagcccgtagtaccaaatgcctagtggcactactacaaaaaaagctcatag

SEQ ID NO: 98659 - DNA, 673 bp, Oryza sativa
cgctgcgatgtttttggcagcacaccaacttgatgtgtcgtccattttggagtttcacgtgtgtgttgaattcgaccaggagagctgatttaatacaacttggaagagatcgagctttccgcggttcaagttgcgccgatatgttagcgttggagaaggatgcatagaatgcatacaaaatcttgtaaaatcgagaaacttggaggaatggatgctatttttttcaattgagaatgttccattggaatcaaatccatgtctaatttcctgcaaaacacactaccaattttcatccaagtgcacaaactgggatcgctggggtagaaaatgtttaagcagactatccgtatccctgtctccatggctgtatgcttgagctttggaagccctactaaacccatgatgcatccacatggaaaaaccagcccttatatatctgaataagaatcatgtctgaactctgacgagaggatcgatgatgaaaaaagaagtacataagtaaccacgtacgcgaaaatttaattcatgattcagccatgtctctgtggaaggcaacaactagctagctagctgcactctcagtccaagggcttgggcccaaccacctccatcgtcgcacaaataatccatggctgcctgacacagtgagcccagggccctagcacaaaggggg

SEQ ID NO: 98660 - DNA, 993 bp, Oryza sativa
  unsure (1)..(993): unsure at all n locations
caaaattcnccatgcattttgtattctgtgatggtttgaaaccctcggaactacatttaatctgcggccaatctatcaattcttcaagttgaactaatttcaaaccctaaacctaattaagttccttattatcaaagaattacagaatacaaatgcatggagaattttggtgtctaggtcggttctgtccatggactacactgaccaatccaccaaaattccccatgcattttgtattctgtgatggtttgataacctcggaactacattaaatctgtggccaatctatcaattcttccatttgaactaaatttcaaaccctaaacctaattaagttccttaattatcaaagaatgatagaatacaaaatgcatggagaattttggtgtctaggtcggttccgtccatggactacactgaccaatccaccaaaattccctatgcattttgtattctgtaatggtttgataacctcggaactacattaaatctgtggccaatctatcaattcatccatttgaactaaatttcaaaccctaaaccatatatatagccatacatcatttcattgcaaaaccatatatatagccatacatcactggatttcagaatttaaatcacacttgcagcaatgtgaatttatatggaaaaaagagcacgattatatatatgcagttttagtgcatcagtcaaacaaaacagctaataaaatatatacaaattcatccatccatcattgtcacgcattataatacattaaaattcatcgatacgtccaacatgatatacatatataatgaattagcatataacacttttccctacaccttcatttctcatgtatggcttcggtgattcaccaattgattcttcgacgcgtaatatcttgtttcgaaaatctgtgaatagtgtcatgttctcgtattgattgtatgcctcgacatcttcgacatcatcaacttccaaaatcctttgttttcccgaaataactat

SEQ ID NO: 98661 - DNA, 693 bp, Oryza sativa
gctcacgtcaaggattcaacacgcgaacgaaagaattaatgtttccattttcaaaacttgcacgaacgacgacgaaaccatatgcttgtatatacagctgaaacgcagtagctagtggcgtctggactttaatttgatcaaccgaaagaccaagactagtagtactattacgcacgagagagaactaacacaacacattatattaattaatccaatcgtatatatgcaacggccggttcgtcgtcgtctccgttgggtttatttgatttcaattcgtccgagaccgatcgatcgagccgctcccacggtacgtggtccggtcggtcgtccggtccaggttgagttttcactcctggtctggtccgtacgtgcgtgcgcatgtacgcgtttggtatgtcgcttttgaacactgtactagtgctatatatatatcctgcacgtgcctgatatatacatgggtcgcgcgcattaatgaacccgacgacacgcgcgcgcatcatctgtgacgtacgtgttcgtgtgaatagctcgctgttcgtggccaaggcgccaacaaccacacgtacgtcgacgtcggtcggcttaattcccaccagcagccgatcgtgcagtgcagagacgtacagcgcagtgtgacagtcgtagctagtagagaaggagaagaaaactggaaacggccgagcgagcgaggcg

SEQ ID NO: 98662 - DNA, 594 bp, Oryza sativa
gtcaccagtgttcacatacatgacctgctatgatcattcacacgtaattaacttttaaaaaatgaaatgaaaaaggatgtgtttgtatgttaaaataacgaatagttctcttttacgaaaaggttgcattaccaaaacatataaatatcatgtggagcccagcttgtcggttacaattaactaaaaggaaaaatataagccgctacagatcagagcatacaatcatacacatctgacccatatgggtaagatttggataaaatgtatgggccatttaatgtagacctgctatgtgccttaacaatttaatcctatctggatgaatgcagggcagaggaagctgtaatagggaaatcaagaaagcaatttagggaagaagaagccattcaatttcagctggtctgtttcatgtccatgtgaaggttcattacaatttcagcccattaatcaagcgcattactctggtaaaacataccatgcccactcatataatgtttgctctcagcattacatacactagcagttcgcctcctatcacgctgccagtgaggctgtgagttttagccacaagttccattgtgctttgagttctta

SEQ ID NO: 98663 - DNA, 566 bp, Oryza sativa
aatttaaaattagctgaaattcgaaattaaaaataagcaatattgaaagaagaatctatataaaaacccaatacgagattaattaaaacttagaataaaaaaataatatccaaaattagaaaaattaaaagagagttcaaatagggatacaattttgaaacaactgaaattgaaaataaaaaataaaaacactaaaagaacacaatatggtactaacttatttttttaaaaaaaatctgaaattacaaaaagaaaataagatttgaattaggaatacaatttataaataactaaatttttttataaaaataaaatttattgaaagaaaagaccatctaaaacactgacgagataaattaacatgcctgtaaaggagtagagtggtggcggttgatacgacatataaaaattgttaataaaacatcaaatagaatcctaatgacgattaaatttttgataaaaataaaatttattgaaagaaaagaccatctaaaacactgacgaaataaataaagtaacatgcctataaaggagtagaggaagagtggggaaaaggtaggggaggg

SEQ ID NO: 98664 - DNA, 570 bp, Oryza sativa
ctgctcacaacgagccacaagagaaggacgctcacgaggtagtaggaggctgagaggatgtggaggggatgtcctgaggcacagaacaacgcttgggtaagcgcaggggagagagatgtatgtggctcctcacatacaaactgaatctgagagacgtgctcaatcatccgcatcaggtgaggagcatatggaagccccctcctgtactgaagagatgccatgaccgcatcttgaggcggactctgactcccaaggatggtgatgcaaacaacatcaaccattactcccgctccgtactcctcaggttcaatcctccctgtcgtcccttttcatgtatttcaatttgtttgggaggaaatccgcatggcatctcttcagtacaggagggggcttccatatgctcctcacctgatgcggatgattgagctcgtctctcagattcagtttgtatgtgaggagccccatacatctctctccctgcgcttacctttgcgttgttctgtgcctcaggacttcccctccacatccttttcgcctcctactacctcgtgagcgtctctctcttttgcc

SEQ ID NO: 98665 - DNA, 569 bp, Oryza sativa
acatactatgaaggtgtaagaatttatatatcttgaagatatacttattgatggtatttggcaatcttattaattcacctaatgccaaaatatagaccggtttatgtcactctaagtggtttaagctaattgttgaagattagtgaaacaatcaaattggtaatgattgataaatccactaagagaaagttgcataatatttaacctcttgtattgagctaattattttatacataccgcatatgtgtatcgttgcaatttattttcccatagtcctccgtaaggataaaactttgtttgtattgcacatttgaataagtggttatacatattgctcctatacgttgatttatttctcatgttcatagtagaacttacgaaataagtaaacgaaagattaaacattttggtaattttattatcattgttttacacattaataaaaatgtggttatgacattggaacatagaagtttcaacggatgtcttattgagggggagcatatatgctaaacattgattatcatagttaagacttggaagtcttatatttgatttaccaagaatta

SEQ ID NO: 98666 - DNA, 1607 bp, Oryza sativa
gaaatatcctaaaaattttgagaaaagagaaaaacatccatgcctcaatttttacctaaatcaattatccaatattttaaccatcaaatctattaaaaataaaaacaaatccctatttcccatccatccgcaaaaccaagtgcacggcccccgcacttactacagacacacatctgaactttccttctcacttttttttctactgtacttaaaaagcttatctaatgctaagtgtttgtatttattaatgatttgcaagcacacagatacaattgtaacttttacctaagaatattcgaggtatcgtatccacagggaacgtgtgtatataatctcaaaacaacattctgaaggataacaaccaaatgataagctaagggatagagaagactcctataggttaattatcttaatttaagttcaagataaaactctatcaatttgtttcggacaccaacttacccttggtctgctaaaagactccggcctcccactctatgatgtatctgaacgtggaggattacaaaggacggacagggttgtcaccacctgccgcctatctctacaatccgtagagcacacaacaaacaaatgtaacctccagtatatataccacatctatgctattaattactaccctaatcttgacgtcacgcttatagagtattaaagtactctacctagatagagcgatgaacccgcaatgagcagaatatatcttatttaaaaaaataaataccaaaggaaatcacgaatacttacttatataaaagaagcatcaattgaggtacaagatccgaaagagtttcgacatctccagaactcccctggagagaactccaccatttggggcactccttttggagcttccccacagtcttttcctactctactagaccaatatgcctaaggccctgtttcttttagtttgggattattataatctagattattgagttagattactataagctagattgttataatctgtagtagaataagaagttagttgtttctttccagattattagagcctagattattgggtttgcaagtctaaagagggcgtggggtggcatggtgggtaatttttcacccaataatctagaaaaagctcacctaaatgagcttatcagattataataagctgggctccagattataataagctacttcaataagttgtttgtttctttcagcttactcctaataatctggattataataatcccaagctgaaagaaacagggcctaagtatgaaagtgacttgtactacactttgttatgcgttgagagtgagagcttctccttttatagccatcttatgtgggctctatgtgagcttctcctttattgtccgcgcataggggtggaaatgagccgagcgaaagcggcttggcttgcagtggctcacaacaagctaggcttggcttggcttagctcagttagggaaacaagctaaaacttgagctcggctcgactcgtttcctggctcgagccagctcgagctggcttgcaagccttcctgttgaaacacctcttcatatatattctgtaattattaaaaaaaaccaagaacaaatcatcacacatgtaaaatttaaat

SEQ ID NO: 98667 - DNA, 636 bp, Oryza sativa
atgtaatgggtgcctaacctaggccaggctaatcctatctgttagtttggccagctttagattcaaaattttttcttcaaacttctaacttctccgtcagatcaaatacttggacacatgcatggagcattaaatgtgaacgaaaaaaaaacccaattgcacaatttgcatgtaaatcgcgagacgcatcttttgagcctaattacaccataatttaacaatgtgatgctatagtaaacatttgctaaataacggattaattaggcttaataaattcgtctcgcacattacaggcgaaatttgtattttgttttgttattagtctacgtttaatactttaaatgtgtgtccctatacttaaaaaaattttagcacacgaactaaacacatcctttatctgttgactataaaccattttgtgccttttgggtgtgcattggtccatgacacatggatgaccatagtgagattagtactgctgaaattgtgttcatctaagggggaaagagggaaagaggttgttgatcacagtgagaggatggggagtctaactgtctacgctctagtacttccttcgcatgataagttaatatagtacggaatataatatatcccagtactataaatctggacata

SEQ ID NO: 98668 - DNA, 624 bp, Oryza sativa
ccacctcccccacccccctccctcccgcgtccctgggccacagatcgagcgcatgcatgcgcggaagccggaaagcgaagcgccccgcggtgaaaagaaaacagaaacgcgcgtgatagccgccgcccacatcccctcctctactcttcacgcgcacgcgctcagcgatcggcgaccgggcgatggcgaattggcgaaaagccaaaaatcaaaactgcatcgcgtgtcgccggcggccggtgccaacgtaattcactccatggccatcaccagctgcttggcgccgacgcaatctccctggttgctgctgccagctgctcagcgaagacgcaatctactgcgtcgctgctgctcggcatctcataagcctccatcgcatggcttcccctcggaaggttagtaatcagcacaccaatacaccatctccgaggccaattattaatttagttactgctgtctaatctctcgatatcaaaacataaacatatgtaggtcatctcgacgcatggcgtcgcgggcattagcgcttaattgtttgttttgtagtagtatgttaagggccccaacatttagtttcgcactggggccctgaaaactcaggaccggccctgcgcgcatggagag

SEQ ID NO: 98669 - DNA, 683 bp, Oryza sativa
agaatccacagaatacggaataaatatttccttcttggcgaatagttccatgtatattttgaagataaaattaaaaattgaggaaatagatatattaaattgtcaattaaacaatgaagcttaattaataagggtcagtttgttttttttgggggaggggtagaagagattaggagttatatggagggctaggcatatagcagttttggtgggatagagattgagagaacttcctacttttcaatatctggagggaactgctcctttacgttgcctaaacaatacttagccctctcttttctaagcaaaacttaatctctatctaaagtctgtgtcgattcccaccatctttacaaataaaagattaaaaaatcaaattcccaaacatcaccatcaattctctcgtctaaactcttaatattcttactcgtcttgccaaacttagtgctattatagatgattagtatatatttcccctctttcgtatcatatgtccctttggtttgccctaaagcgaacctttttaatttttttatcaaaattataaaataataaggcaacattttaaaacaaaaataaatatattacaaaatatgatcgatagtggattttatgaaactaatttggtgttggaaatgttgttatatttttttataaactttgtaaggttttatgcccatagc

SEQ ID NO: 98670 - DNA, 578 bp, Oryza sativa
agcacatgtgtgggagtcagcagttttcacggtttcagtggtccttgtgatggatgatgaatctgcagccaggcacgcgctgctgtaccgggagggaggagcatggcttcccatgacgagaccttgggaccatgccaagccctagctatcttgcaacattattagtatattatacttcatgggatcaaaaaaataaaatgctagtggtaactactacctaatgtttcatactttcagtttcatagggttcagtatttcaacctttttttcaagacttcagtcttcagcttatgctagcaatgaactactactattataagtgttttttttagaagctattataagtgttttgagaggatgggaaaggagagaaatacggtaaaacaagaggcttgttcactttgctataattttcaaccttaccaagttttggaaaagttaccaaaaaagtgggtacatttaggtgttgcccaattttagtaactacatatgaaatcttgtcaaaatttagtaaccctggcaaaattttgacaaccttacccaaaatttgacaatgccaaaaattgataaggttaaaa

SEQ ID NO: 98671 - DNA, 613 bp, Oryza sativa
actattatcacagcagaaatgcatcaatttctgctagcacactgaaattatgcgccaaaatttctttttctgttagtcctattttctcctgatcacagtaggtcatttcacagcaccttgtgacatcttaatatggagttagttaatatttgtagttgtgaattatgtagatattaatacatactataccccttcaagtctcctgttaagctttgcctaatctgtcttaagttccccctttctccgctttcactgatccgctcttacatcttgattaacatgtattgcatttagcaataccctctcaaactaacatgtaaaaggagtatcacctaacaacacctcatagcataagcccctacccatttaaaccacatcgtgttttctttgcacccattcttaatcgatagttctttcttttccccgaggtggtaaaagaagcgtgtttgcacccttcttaatcagtagctctctctttccctgaggtggtgaaatatacgctcctgcattggtgaacctcaaatagaggtacttcatgtagaagaatcaatgagaaagtattttctcatttgcaagtatgtcataaaaaacagtttgattaatgataaaaata

SEQ ID NO: 98672 - DNA, 726 bp, Oryza sativa
caaaaaccgtgaacaaaatattggtagggtatattttgggattccatccaaaacaaccatacttgtacgagaaaaagggtttctagctaagtatatcaagactacttttttatatatttttttacttttaagtaagaaagaacgcatatataaaattatacccataaattatttttgttgctaataagcgttaccaagtataattagttataagcgaaatggttggtcctatgttgccttgttgttttgttttttgatttcttgtcgtgttgtatgtgacacttgtaattgtcttgattttactatatgacatttaaattttgtgtaattggcttggggatgcggtaagatcgtgtcactgttgagagacttgtgtaactggctacactaaactggagatattattttatcatttccaagtaaaagcttggagagataaattaaaaataacaagattgcccttggttgccaggcacatctcacgcaactagatctgatgaaggcaatggctcctcagctgttgacgatgaggagggttaagagtcagttgttcatgtcagcgatgtagaactaaattcagttgttaaatgtgggcaaccaattacagattttttttcctctttaatgacacgattgcggtgtccttcggataattatacatattttgaaaatgcccaaaggaaattttcatttatcaaatagtgaaagtttaaacatttgagatta

SEQ ID NO: 98673 - DNA, 620 bp, Oryza sativa
agagaaaatacagaattgtcatttgtttatatatatgcatccttcaatttgaactatgtacgcgtacgcgaccgatcgacgtgcttgctatataacacggtaatgtactgtcgcactaaggatgtgtttagttccacgccaaaattaaaagtttgaaaaaattgaaacgatgtgacggaaaagttagaagtttgtatgtgtaggaaagttcgatgtgacggaaaagttagaagtttgaaggcaaaagttgaaatctaaactgtgactaattaatacgctaatatatgcatatcacatcttatactacaagctaagcagctagtagctatcctaaactaattaagtactccatctgttcaaaattatttattgttttattttttaatttaaacatttttatattgaccattaatttttaaaattttctataatttaacaatatatataccaatgatgtattatgaaagtatttcttactataatgaatccaaaatataacactcataattttaaactttatgaatgtctaaatttgattatcagagatatgaaagttttatataggataaattaagctaaaatgataagtaatataaaatggagagagtatagttaaaata

SEQ ID NO: 98674 - DNA, 1009 bp, Oryza sativa
gacatatatattttgtgtggatgatacgcatatcagcatatggcatgagaacaaacaagtagcgtagcacacagcggatggatagctgcctgcaacgcgtcactttaatcttttgtaggacgcatccatatacatgatccacatagctagatcgcttggttgctgacaaagattggaaccatccatccatggatggatcatacatatatcctggacatacaacactgatgaattgatgatactgatacacacggagtacagatcgattcagttcattgcaaacgcggcatctacttattaatggtagaatatgatatctaacgcttaccaatattctgtaatccatatccaacaccactctgcctgtctccatacaattttttttttactaatgcaagcataattggttggtacacgaaagtttagcacaacgtgttgagaaatttatctctcggcatgaaaactgggagaaaatcacgctatggccatttccaccggttgcccatgcgactttatttctctattcacgtgcattgatcaatagcgctaatttctttttttacatccccaatatccataacgaaatattaatagaggatgccggtgttgtgttatgctgacgaataaccccaatccttagagagcgatggaacatatccaaagggtggttccagatcaatgcaggtggcactccgaaggacgacgccatactgcagttgatcgccggtgacccatttgggatcaagccagtggcctcgcatacaacactgcttgcagccttgctatgactgcctcgcatacgtcgacgaacattagagcggtacaagggacaacgtccccctattttccctctggttgaataaaaaacaggcgcaaatatgtcaaacaaatggccagttagtccgttacccctaatatttaacatcggggtaatctttaggcttattatgtttagaagattagaaaatctacacaacatactttgtcttttttcgaacacaatattttg

SEQ ID NO: 98675 - DNA, 711 bp, Oryza sativa
taatcggttttacacatatcagtcaaaactttgcagctaaacatatattttgcagctttttagtacgtaaccgcaagatatccgacaaacaatccaactgggagtttgaaaacgataaagcaagccagtaacgcagatgattacgagacatttactgcttttctgcccaacacaaacaaaattgatgatgcaaccacggggctcagtagagagatctcacggtatggccagttacaggtccgtcgtcttcgagctctttgaggacgtagaaactggccagctgcaagtattaacattaccgtgattacaagtaatatacctaccctgagtttccagttagcaacaggcatgctcagttttatcccaactggctcggtcccgccgatccattccgcgcgaccgcggcgatcccgcggctccgttccgcgcgatcgagcggacgtcggctcggtcccggacgtgcgctgccaccgcgccggaccggctcggttccgtactctcggtctacgtgaccgagccggtcccgcgtcaccgttccgcgcaaccgctgcagctctcggtcccgccccaccacgccgtgcatttgtttcgctcccacgttcccaacgcacgggagaggtgtatttgcgcaaatcctcctaatcctttatatataaacataaattatgagaaaaaatggttatttttaattttttttcttcacttatgtat

SEQ ID NO: 98676 - DNA, 502 bp, Oryza sativa
aaattgccacggaaattaatgacacaaaaacaaagctagaccccaaggttgtggaggttgttgagtcatctcctcctgagattaaggtaataatttttcaggtgtttcataggttgcttgaggacatccttgctcaagaaataataatttgcatgcttatctgtaaaaatattgcaggctttgttgaaggacaaaaaaacagccagcaaaatcaagaagaacggtcctgcagtcactaagttccttgaggaattggctaacattggtaagaattggctaagttctaattggcttgtatttgattgcatggggtattgactacaataatcacaatatgtaacttgccccctttttttatattttcgttcaaaaatgcatttttaatgaaaataaagaacctttatcacttatttccaaaatgaatcgtaacataaaaaatgagttatttttttaaaaaataatttaggtgtcatttatgaatcacctttttttccccttaaaa

SEQ ID NO: 98677 - DNA, 649 bp, Oryza sativa
aaaaatcgcatagtatggttgtgtttgcacttgcacatcttttttttatctttggattttgtaggaaatgatttgatagcttctctaaaaatagaaggcaaatcctatgttgtaaatgagactaaatgctaaaaaggatacgtgtgtgattctattctcttgatttagggtaataccttttcggggagaattgaattgttcgtaggaatagaacggtagtactattttttttccatgaaaagaaatgcaagtgctttgtgtattgaagatccttggagtacaaccttggaatttggtgagaacgaaacactattgttcttaggcttcgttcgttcctgggcgatttgggggattgagagaaaaagcatctcgttttccgcgcgcacgcttcccaaactactaaacggtgtgttttttgcaaaaattttctatagaaaagttgctttaaaaaattatattaatccatttttgaagtttaaaatagttaatactcaattaatcatgcgctaatggctcacctcgttttgcgtatcttcccaatcccctctccctcaaacacagccttagagcatcactaagagcaggtacaatagcagactataagtcagttataaacatattttaaggagataaataaggagagagaaga

SEQ ID NO: 98678 - DNA, 552 bp, Oryza sativa
tactacggtttggtatgctattattgactaaaaattgggcaacaaaactttcgatttttcgatttgtctttgcggaggagaaaaattctaatggccgcacgatgtacttgcgtacgttttttttacacatatattttatacactctatagctatacaatatgggaagggcctacgtgtcggacacccgatgctttggggaaaaatcgggcgctgacgtcatccgatttacgtgcaaaaactattttaaactgatttttctcaaaaattacttatccaaatcatgatccgattgcaccattaaattcgttataattaaatcttcaaaacaagatcacacatggatatattccgacgaaattttttttagcttattattgaattatttttaaatgttgcacgatgttccaccgggtatatcggaattgttttactaagtagatcggaaatgtttcactcgtttaaatcgggtgttgtttcaccttatataaaaacaatgtttcagcaaatagcgaaacaatgtttcagttcactgtaacatttgatccatacat

SEQ ID NO: 98679 - DNA, 638 bp, Oryza sativa
agctactagcacacactatccacgtactccagtacagaagtactacgctctaattaaatactactattagttaaactccctgatgaggccaggtagcacggagagcagtgctagctagcccagagagagttaagaaggcccatctttggagggggttggcatcctacactctagctagcccacagtccgctgccggctgccggccagcgcgcgcgtgcaagtctgcaagcaaagagttttcagatgcagatcgaagcaccgcaagaaaatttaattttatccccaccaaactactgccaccaagggtgatgaatcgcatctcgcaccaacaagtccgccgtccgcgcgtcgtcaaatcacaccctgcagcgccgcctgcgatatgagctgccgcgacggcgcggcggctgccgccccgtcgtcgtcgtcgtccgcccgcgcgtgctggctatccagccaccgccgcagtagtgggaccgcgcgtgctgggtcggggaagcccgcgcaggcctgtcacgccgccacgatcccacgagccacccacaacgtaacacgagccgatcgagtcccgcgttttcactcggcctacatgggctgacactgcggcctgcttcggctttgggcatcccgcggcccat

SEQ ID NO: 98680 - DNA, 505 bp, Oryza sativa
aggggtaagatcactggcaaaggcatttgtccctgttcccatgagttgatctaagtgagggggttgattaactgaacaactatctctgaggggggtgacacaaaaagtcaaaaacagctggaatgattgcattctaaggcctctaggggtgcttatacctagttttctcactcttactaaactagctcgatttgatcgcttgctttgccagccagcaactgcagcatccacaagaccctgacaacatagtatttttggtcttcaacaggtaaaggaaacccagaatatacaccctacaagtgattatcaacatcgttatcatcagagcattgatgttctgaatcatttctaccaatttggtagcgggtggcattaatatgtatatcctccgatgaactttggcatcgtgacaaaatttattattttataattttcttagcacgcaggtaataagccgaacgatggtttaaagtttggttcagatgctataccccctttaaaccta

SEQ ID NO: 98681 - DNA, 598 bp, Oryza sativa
cttaaaatcaatctcaaaattaagtttgaaaatttaaaatttggctttttctttggccgattaggccagcgcgggtcgttcgtaccgacgtgtctcattgcaccatcattgcgcgtgtgcgcgcacctacatgcatgtgtgcgtgtctccgaggcaagtaaagtgtcaaagtcaaggatatgattgtaagtacccgatcgttactatagggttactggagtatatacaataagtgttcaatctctaacatgcttatagtttcttcttaaaaaatatttgatgtgatgtatctccctccaaatcttgttttttttattatggtagtaattcataataagtttagttttagccccctgtttattctaaaataaatttatttacgtaattattttatcaaaatttgtgaaggtagaggataaatatattgggagtatataaagaaagaaataattgaactgttatttgataaaatatgtatattttagttttttgttttgtattggtatgcaaggaatgagtcaaaaaatgaatttattttgataggaggacatactaggcatgggatgtacatcttagaaatataaatgcccaatcgtgt

SEQ ID NO: 98682 - DNA, 621 bp, Oryza sativa
aatagtgcgagcatccatatggcattcttttattcaaatactgacaagaatgactgtgggttcatgcaagatgccatctcttgaaaaagtttgaagcacacaaagcaagtacttcaacttattttccttgtgaaaagctgcatatccatccaataataattagattaagataatccccttttcaatatgcaattgttgcagaatagcatgtaccccatgaagcatatgaatattccactaggaggaactgttcttaccaaatctatcattggcacaatttacggtctatcaggattcaggtataactacttaaattaaaaacgaagtttttgttccctttacatgtgtggagtgaacagcatcaccggtctattctccaggaccactcaccctttcatcacccaactctcaaattgcagcagatgtgttcaagaaaacgaacatcgtccagaatagtctaccaaattaatgagccagtgtacgtgcattttctttttctttcatttctttttttagtttttgatttggacaaagatcttatccatacaatcgaggactcactcatgacaagcagcaagtctattaccattagatattatcaacccccagttaaccactgat

SEQ ID NO: 98683 - DNA, 568 bp, Oryza sativa
gcgaatattccctcccccctcgccttcctctccacgccaaagccggcaaccgcgccgcctccgccgcgcccaacagctcagacgctaccggagtccggcgactcgacgcgacgcggcgcgacgctcctccgccccggcgatgctgcggcgcgggctcctcgtcgtcaatcgcctccgcaatgtccacctccagcgtctcccccggcatcgcacgcactgctcgagcggtcccgcctcggcgccgtcgacctcgacgacgtcctcgtcggcgccgctccccgtggccgcgcctcccccgccccaccacctcgcgccccgcggcggcggcggcggcggggggccccgacgccgcctgaccccgctcctcgccctatccacgctctccctcgtcacggccgcggggacgatctaccacatctccgcgtgggacctggaggggacggtggagaggtccagggcgtccgcggcacgcgtggtggagcggatgcagcacacctgcgcggcggggaaggtgctgtgcaggtcgctcatgtccgtgctgtcgtccgccaaccacgaagtgaggtcc

SEQ ID NO: 98684 - DNA, 598 bp, Oryza sativa
atatcgaggtagaatgaatatcgcctgggatttgggtgtttgctagtcgtcattagaattggatagtatgacgactaggttaggtgtctagccgatattgatagacaatacaatggctagagggataagaagattgtgaagctttagcggggtggaagtgttactccgataaccgtgagtggccacggaacggctaggatcacacagagcccgagagctaactgtgcggtgtgctatggaggtcgatggaatagtgaagctccgaccactatacgcatcgaggcgtggggtgccaggagcagcacttcgaccttaggtttggttttgccgggctttacaaccgacggtccgacgtcggggtcggtagaccgcacgaacgttcccatgaaaggcgtaaagttccaaccggcggctttttagtggctaaagggtattttgggttaaaaagaaatatttgaaaaggcaaacataaattcaaacggcatttgaataaattaagaaaattcaaataaatattacaatagcaaatttagtgccaaaaggtaggatttgaatttatataaatttaggtccaagtttcattggaatcggatcttga

SEQ ID NO: 98685 - DNA, 516 bp, Oryza sativa
gggcggacctagggggtgtgccgggttggcaccggcatacccaatttttttggaaaaaaatactaggatgtagtatgaaatcaaatgacataaaaatggaatcctctcagaaaatagaatataacaatgatcacggtttagaaatcaaatcaggggaagaggaaaggaatagatgaagagaaacagtgggggggggggcagctagatatatagattaggacatgggattgattgttctgaattttattgatttttcatgaattatgggccatatttgaatagaattttgaaaaagccgaccaaaatctgtcgaaatttttccatcaaaattaggtgttttctttttaaaaaaatatatggtggagtgatcgctagaatgaacacacccggtacaatttttctgggtccgccactatcgacgtatgacacgcgacagcaggagcacgaattttaagttatatatataagcctattaagtggcacgtacggacgtaggtaacagctgccaattatatt

SEQ ID NO: 98686 - DNA, 856 bp, Oryza sativa
  unsure (1)..(856): unsure at all n locations
ttgattatgtaataggtaattcgagatgggaatnnngccttggattatgggtatcctaanctaacatttggttntcgaactnnncanncnnnnnnnnnnnnnnnnaatttttttgatggcttttaagnaacnncagcnngnnagccngcagggcgacncaagaggaacccccgcgcacggagaacaaaaccgcannannagccgnggannanaacgacccaaggcgagcnnngnccgcaacncggcgggcancgcnaanncgccgcaacccgcaaggaacaaggcgcccgngaaccngctcccttnggaagcatagggaaccaacggcacncccncngggncgaanaacaaggcannnaaannngngcnaaancaaacgccggccaaaagaaccaaaaagngaaaaaggggataagcatngncagcaagaaacaaacttacttaaaaaatgttattcaattataggtttataattgatgagataatttggtactatagatattctacttttttttctacaaatatagttgatatttaacataggacaaacctgaaataacttgtaatataaaatggagtagcaaactgacgtacagttggcctcccgaagattagcagatatgtgttagattaatatatggagtatagatttgttctgtttgtgttaggaggaaacaggggagggttttgggcttactctcaccgacaattcgatcacgagatagatgcattaatagatgtaggaagatctgtctatgttccttatccttgcttctcctgctaattaatttgctgataaggggcttaaacctgtacatagccatggcccggaaccatgcttggcacgggagggacg

SEQ ID NO: 98687 - DNA, 792 bp, Oryza sativa
aatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctttgattcaaaaaaaattcataaaaattttagaggatttcatccctgtagaaatttttcctatatagccatttgaatcaaatgagtgaaatcttttggaatcctataaaattcctatagaatgtctaatgccacgtaaatttttgaggaaatctaacacgaagttctacctcatggaaatcgcccttgaagttttatctctcctctaattccctgcgttttttctgccggcccaatcaaacccggcaatacctggggtttttcttatggtttggaatcatttattttaactcttaacatccattatcaaatttttgggtttttcttataataccatttcttcaacattgcgatttaaaggggccttagcctttaagaccatttttttattaatttgaggtataagatccgccgatgatttttacagaacaccgttattttggaaaagaaattaggttttaggatt

SEQ ID NO: 98688 - DNA, 530 bp, Oryza sativa
caacgtataataatgcacacaagggtattatgatcatttggactcaaatctgtaatcctctcaaatgtttatgttatgcctgcaactaggtttagtaccataatttttattgtacagtgtgcgttgttgcttgattactacacaagattaatataactgtctttttcgtcaataagttagagatagccagacttttgtctagctgagctcttggtatttgtattactgaagtgcatgggtttccatccatcatcctgagcatcttctatgtttcaactttaatgatttgttctattttcttttcatgtacaaaaacttgacaaatgtttctcccccatgtatcaggatgcccactcatcgccaatagatcgtccagccctgtggaaaatgctaacctcagtcatcaggatgtgaagccaattagaagtgacatttctttgatgggaaaggagtttaatggaaccctagggaaacatattggcacttcctgttcttgtagcagtgaaaataccattcatccttacggtgac

SEQ ID NO: 98689 - DNA, 751 bp, Oryza sativa
cgcgctgaaggtacatgagatatcgtggcccaataaacttacttagcttcccgcccacacgcgcattggatttggatcctctgactttacatgggtaaagttagagagctagagtgctgttgctacagtgaaacactacgtattactgtttctgatgtagcacagacacattttactgttagggtgtgtttagttagggaaaaggaaatttttgggtgtcacatcggacgtttgaccggatatcggaaagggttttcagacacgaatgaaaaaactaatttcagaactcgcctggaaaccgcgagacgaatcttttgagactaattaagtcgtcattagcacatgtagattactgtatcacttatggctaatcacggactaattaggcttaaaacattcatatcgcgattttccccataactatgcaattagtttttctttttatctatatttaatgcttcatgtatgtgtccaaagatttgatgtgatgtttttggaaaaaaaaaattatgaactaaacgggcccttattctctgtcttttccatccaaggtcagaggagctggatccacgcgcattgtgctccaaatctgatggtgggtagacaaactcgttacgtgtttgcatgccgttcttgctacgacgatctaatcttgtgaaaaattcaacagtgttatattttcgagaaaaaaatggtgaacaatattttcaattttttttcattagcaataatttcagtcgtcaaggcacgc

SEQ ID NO: 98690 - DNA, 718 bp, Oryza sativa
aatgatttagcatacttgttaatataaatgggcacagaaagcattagaggtaatgattaaaatatacaatcaaatgagtgcttcaatattaaacacttcgaataatcaatgaaattccaaaacacaaggcaatcatgtgagcaacaaatgaacaatagaagctttcaaaacaaaatgaacaatggataaaaaaggcaagtaatttgtgtggatgcagacagccaacattctgcttgttagcttctctttggggagtgaatattgatggcttccaacaaacatggaattgttacagtggcagaatccatagggatgtaatcatcagcacttacttccatttcttttgtttcgataaagcatatattttggaccttttggcttcttctgttgtttcaattgtttatcatttcagatttccatgtccgaagatataggctgtgttcggcactgttcccaaaagaacagtgctcacggaaaacggagcgatccattagcgcgtgattaattaagtattagcttttttttcaaaaatggattaatttgattttttttaaagcaactttcatatagaaactttttgcaaaaaacgcaccgtttagcagtttgaaaagcgtgcgcacggaaaacaagggagatgggttgggaagaaggggtgccgaacacagccatagtcagttgtacttattcggtaacgggtaccgagctgaattcgcctata

SEQ ID NO: 98691 - DNA, 635 bp, Oryza sativa
tttgaaaaattctagtaggctggtccatcatttgcctgacccacagtgattaggttatttgcatacatcagagaatgaagaattgtacctcctgtcgtcgttatccctttaatataacctgattgcctgcatctaaaagagactcagaaagttcattaattacgagaacaaataaataagaagataaaggacatctttgtcatatctttatcgtgttctctcctctactttatcatgcgttatctccgtctaaaatatattcatgtgttctctctgtcttaacatatactcctagatgctttgtggttcgaggcagccgtaatatctcaattccgttatactagtacttcaattccacacgttgagacggagagaacatgggaaattctaggaagcgtcatttgagaccttacagcaggggacagcgagtacagcgagaaaattgatattttaccatggtcaaaaactggatttcgctggaatgccactttcaaaagtggtttcgttaaaaaaccaccctcaaacaggagcaacatattacaatgtcatttcatccatttcttctcaaattaatgattttttaatgtttttttattgctgagtgaccaaaatagcattggatcctatctcatctc

SEQ ID NO: 98692 - DNA, 700 bp, Oryza sativa
tgagattttaacatgattttagtgagattaggtatatgccgttagttttcgtctcttagagtatgtgttaggggacgttcgtagggggtgtgagtgtagtgttgcatgtgtagtggtgtaatatataatgactcattagtgtacaattaattacttcatccgtcctaaaataagtacaattctctaaatttgaattagaggcgtgcacttatttcgaaacgaatgaagtaaatattagttcaaaatattttaaaatatatattaatatgttttttacactaatttatatgtaaaaagtttatataaaaatatattattattcgataatttgaaaaatatgcccatgaaaagtttggaaaagtgaagttagtaaaagagaagttgggaaaggagcagtactacaattctacaaatgtacaattcaacagaatttttttgagaattaatattatttttatggaaaatcgcaaaagtagtggtcaaccggagaaaatcgcgaaagtaggtccctgtcgaacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggagggctgtcaaactgcccctgttcgacaggatatccgtcgaactg

SEQ ID NO: 98693 - DNA, 514 bp, Oryza sativa
acttggtgccccgaggcttagggaagatgggatgatccgatggatgatggcgtttgtttgaagcaagttagaatgtgacgtgttttacgcgggagtgcaaccgcacccagtcgccagccgcgcaggtatgtccgtatgtccagaaaatttctggtttttgcgagcagtgttattcttctgggacggatgttaaagcagttcaaccaattttggactccggtcaaaagctattttctgtgtgggaagataccattgtgggccaccagtttaagaggatggtctgttttgacatttttcacatggtaaaagtccattatacatccctcaactatagcctttgtctcatacccgtcccttaatcataaaaccagatacctccaactttctaaacctgtttgttttacctctttgagtagtttttataccggttttatcctaagtaacacccacattattaaataccaacgggataccgtagtctaggttttttgagagggctgctacaaaacgggat

SEQ ID NO: 98694 - DNA, 624 bp, Oryza sativa
agaaaaaaaacccatcgttccaccaggatcacagcaaacgcccattagcaatttttgagaaaatgctaccaaatactaatgttaaattatactccctccctctctaaatttgacgccgttgacttttttaaatatatatgaccgtttgttttattaaaaaatctaaatttgacgccgttgacttttttaaatatatatgaccgtttgtcttattaaaaaatttaagtaattattaattctttttctatcatttgattcattgataaatatatttttatgtatacgtatagttttacatatttcataaaagtttttgaataagacgaatggtcaaacatatttaaaaaagttaacggcgtcaaacatttagggaaggaaggagtacaatgcattgattagttggtaaaacctaaaaggcgcgctaattgagtggtatattctcaaaattattgtcttgtgagataatatatagaagactattttaatcttattattgttatacgaaattcactgtaagaattcgcttgaatatatatttttctgaaaaaatcatgagctgcaattaggagttcgatcatctcaagttagcatatgaggtttttttaagaaatttcttatataact

SEQ ID NO: 98695 - DNA, 537 bp, Oryza sativa
ggaatatttttgagggaaaaaaaaggttaatgaatagtatattttcaaagttagttcttaaccttcctgtgtttctaattttatagtttttaaaaatcgtacctattgctacccttactcctatcgctcccttcgttatttgctcgatctaccattgtttttatttatttttatggaacctttaaaaattaaatcttatagtttttaaggtttattatctcattagtttttatttttataatttttataagtcccgtcaaacaacgatacctttgtatactcctctaatgataatacaataatagtgtattgcgagtagagagtatagagaccactgtaaaaggttcccagtgcataaggccaataaccattcacattttagagcttgccacagtaatagtccgccattttcagaagctttctcaccagcgctctggccaaccaattgtcacgcagaaagctgatgaccgcattgctgctctcctgcatgaagccaaccacgtaggctgtcccgatgagctcggcgctcctccaccg

SEQ ID NO: 98696 - DNA, 552 bp, Oryza sativa
gtgccgagctctaccccggcccctactctttttcccctatccgcctacgaaacgccgccgccacgttcaccatctctctccgtcaccattgccgcctccagccgcgccgcatcgcctctctggtccacctcgcgctgcgccgtcgccttccccagcaccgcagccatcgtgcgcagctcggcatccactccatctccctccttcacccccgaagcactgctcccaccgtgaacccgagacgccactgccatttgccacctccagctgccgcttgccgccactccgagacatccccggccgtcgcaccttcctccatcagcttcgcagcgacgaggggaggtccggcgttcgcttctcgtcgtcgggaacccaccggagctccgtcctcctcgcgcgccggtaagctccacctctcacctcctcctccggccggcgattcacaccgtctcgggccacttgtccccatcctaacctctctaccaccctccctaggtcgtcccgcgcctcgggcatcctttccgcaccactggtcgttgcccgaggccgcccccg

SEQ ID NO: 98697 - DNA, 531 bp, Oryza sativa
aataacactgaaaaatggaccatcatcagccaacgaacggttgctcgctttctggaagaagcaaaagcacagacggccaaaaatatcacgtaccacgccaaaatattccgaggatttttcataaaagaaaacgagaaacaaatggtaggagcctgcgttaagggtaaagaaggtgagctaccaagaccaaatctgtacgaacatcacaaggaaaaaagatgaacgacatgacaccaatcacaccatggaactcctgaagttgttgcacgagtggaaggcttcgggtgtgagcttgatttgaagtgttctttacagcgaactacaaacagagtaagagaaaacagggtgaccggcagtaaggaatgcacacgctttactcctaactttggatgcgatttggcgctattggattcaaacagcccgttctcgccgtgttggatgcgattcgcatgggctggcccgagcgcaacgccaccgttgtagttgcgtctatatcctgaaatctaaggctacattaaacatagaaatgtt

SEQ ID NO: 98698 - DNA, 634 bp, Oryza sativa
gtgcttatattttgggacagagggagtatcaaacaacaaaaactttttcagcatcctgaccagcatcaaatgttccactatgaaatataagctctttcacacctctgttcatgaaacatttggatatatgcagcagtacttatggaaacgtgtcatgtcagcaagaaattgaaggggaatgaatccttgaaaagcagtatcacatacattatagcaccaattttgtatctcccatggtggcaccaagctaacaccatagagtagtgtacgtctgtcatgtaatgttggagtatcttattgcataaacaaagcatgccatatttatggatagccgtatctttttagtatttgtgctcgcattcagttcagttgacctgaaattatatccaactgaaacaaattccaagtcgattacaagtaatccagtatgaaatctagcacagtgtgaatcatctcaagaacacgatgtatctcaagctgacaggttataattatgatctgtgcccaatgtgctagtttagaccgaatcatagtaatgtactgaattacttaaattgtgctagttatgaaatgataattacttaaaagatgttgattttagatagaactgcaagttttattatgtattcaccat

SEQ ID NO: 98699 - DNA, 685 bp, Oryza sativa
gttagaagacatgatacctaagtaagatcatgtgtaatatctcacatgtatcaaacttaatgatacttttttgaggagaaccatgtgatgctatagaggtatcacatgatcctacaagataacaagagtaccatgtgatcctacaagagtaccatgtgatcctcaagagtatcacatgatcctaatagagtatcatctttgaaaaccacaagaatcatgtgctacttgtgtgaaaaatttcagcaatcacataagacgccggattgcagaggaaattggctgacgacgtgtgcgccgatggaatcagccgagaaaacaagcatggaggcgcgcgattccgcggatgaatcttcgggatgcggaggagctcgcgccggcgaggaatcacgcacggaggcgcttgattcctaggaggattcatcgggttgtggaggagctcgcgccgacgaggaatcgcgcacggaggtgcgcgattctgaggaggattcgttgggttgcggaggagctcgcgccggcgaggacgcgcgattccgaggctgattcgtcgggatgcggaggagctcacgccggtgaggaatcgcgcttcgtcgggttgcggaggagctcgcgccggcgaggaattgcacacgggcgcgcgattccggaggaggattcgtcgggatgattcaggcggggcggtgagcac

SEQ ID NO: 98700 - DNA, 811 bp, Oryza sativa
cccctagcatatgaagctatttgctgtcacgatgtccaagaagcaggatagctaacaagagaacatgctattttatttcaaattaatcaagctgaacaaaaacaccaaagcttcaaattcatggaaatcctaactgtttcacccacccccttacgtgtaagcattgaatggacagctactgcgttaggccatcaatggtcatcatcatactaactcgttatggtatgatatttttccattaacaggtcaccgtttttgcattattaattaaaaacagaaagattcctgagttagttagaagaggtttggggtatggaagaacagctctaacctcatattaaactctcactaagtcactagcacatatatgtgtggataaacaatctcagcacaagaatcagtgattttctctgatctcgcctaaggatcaccacagatagggacagcctaatgtgggcattttaacaacaaagttcaactctacacagcctacgccctacggataaacacttcgttgcattttcatcagtcaggttcctggacattgtccacatgcactgtcaccttcatgttcttttcctattgatgtttttatcctcttatgtttaaatcttttgctacactacatagctgggaaaagaaactttgtgaacgtcgtcctcataacttgatcatgttccttgtacaggaaattgcgaagaggttgcccaggccaacggcgtcttgataattagcttcggtgtttgttgaagtggaacacatacaagctggtaatgtgcatgtaacatctctgtcagggcaaaaactgctg

SEQ ID NO: 98701 - DNA, 599 bp, Oryza sativa
ccctctcaaaaaacctagactacggtatcccgttggtatttaataatgtgggtgttacttaggataaaaccggtataaaaactactcaaagaggtaaaacaaacaggtttagaaagttggaggtatctggttttatgattaagggacgggtatgagacaaaggctatagttgagggatgtataatggacttttaccatgtgaaaaatgtcaaaacagaccatcctcttaaactggtggcccacaatggtatcttcccacacagaaaatagcttttgaccggagtccaaaattggttgaactgctttaacatccgtcccagaagaataacactgctcgcaaaaaccagaaattttctggacatacggacatacctgcgcggctggcgactgggtgcggttgcactcccgcgtaaaacacgtcacattctaacttgcttcaaacaaacgccatcatccatcggatcatcccatcttccctaagcctcggggcaccaagtagcgttcggtacagacccccatcctctcccactagctcatcgcctacgaatccccgtccgattcctgtacgcttcttgcaggcttgcagctctcaacctcct

SEQ ID NO: 98702 - DNA, 515 bp, Oryza sativa
aattcgagctcggtaccctatggatattggaattagtattagtggcgctaagttatggtgacattttggttcgttcataaataaattgtgaaaaatatatatgctcttacgtgagaaaaatataatgctaaccgcatatcctgctattagctgattcagtggtagtaggtgatctaacttgatgacgatattcagagactactagggcctgtgcatctggtgtagtggtatggtattataggtgtgtttagtccctgaaaaaagttgaaagtttaggaaaagttgggagtttggaaaaaatttaaaagtttatgtgtaggaaagtttttgatgtgatatgatgtgatggaaaattagaagtgtggggtagttggggtgaattaaacacggccatagtacccttccacgataccgagtcaggttctattttccggatgcacattttttttcaatgcaactaagtactatcttagcccgcattttcgtttttgcatgtgctatctctgcccacattt

SEQ ID NO: 98703 - DNA, 507 bp, Oryza sativa
tgtcatggtctcaactggagaaaactatccgtgggtctgcgtctgtagtgggcctttgaagtcaacccccgcacaatcaacgataccatttgcccacatcagttgggccaattagtggtctagggggccatcaaccagaccggctatgtttcatagagggattgcagaatttcgtaacatatgctctttagagtaaatatatttttacttatcatacatatttttttatagcatatagatgatttaagccgattcaaataatcattgcgaacatgattaacccctaaaattacgatgtaaatttaacaacaagaacgaagcaaaatcctatcctagttttctaactgaatagatgtgaatgagaagatgatcaacaaaataggagacctcactttatacctttgccatgataaatagtgtggtcgggtgggagtggattgtgaggacggacaatgacatcctcctggcttggttggttagtgatgggttccctaaacccttaaacgg

SEQ ID NO: 98704 - DNA, 657 bp, Oryza sativa
tattaatagtatagtaagaaactattgtatgaattggctatagatgaattggaactagtagtgggctatactattaaacttgctctaaccaaggcagcttatagataatttgtagttagcctgttgtatgagttggcttcttaagttagctctatcttaacatgataaaattttggagcttaccgcttgctgcactattgaccttgcagggatgagacattcattggagaggtaatgtcctatccctaactagattggatttttggaacggaataagttggtacttgtaggctcaatgctagaggatagtggctgtgttcgtttcccccaattaggaactagtgccctacgtacggaaaacggagcaatccattagcgcgtgattaattaagtaactttcgtatagattttttttttacaaaaaaacacaccgtttagcagttggaaaagcgtgcgcgcgaaagggattgggttgggaaccctaaggccgtgtttacttcttgggtgtaaaatttttgaagtatacgtacacacatttgaagtattaaacgtagactaataactaaacaagattatgcctgtaaattacgaaacgaatttattaaacctaattaatccgtcattagcaaatgtttattgtagcacctcattgtcaaa

SEQ ID NO: 98705 - DNA, 756 bp, Oryza sativa
cctggtttgatttggaatgactacgaaattaagtctttctttggctgtgcctttgtggggtctgatcttggttgtgccttccagggcgtaatatagtgttcatatgtgaaagggcatgtagcttagtgattgcagtgacctgagtagcaccccaaggtcctgagttcaaatctgcataggagtgaatttcagattgtgttatttgagggctaagttccttgtttgataggctaagttcctaatttaaaaaggttgcatatatccggttggatgtagaggccgggtaaaaaatctctaaaaaaatattgattcgatagaagctggaaaatgacatttaagtgcgggagactgacaattttgtcctataaatataacctcattgaggcaaaggacatttaatttctttttgtttctatatttatacttaaatccttaaagtgtgttcgcgtgtgtgttggtgataggaaattaagaatgtcaacttgcaatatctgaataataatggatattttgcctaatgcagtgggcattgaactggttcattcgtaaactagtcctatcagatctgtttggatcaatttggtatattgtatgtgctatttcagtctgatgtggtccacaggccaacaccaagacaactcgtcaagatgtaaaaacttgctctaaaagatgtgatttctggtctgtagccaactgttctagactcaaaaggtgtgcaggcatttctagtgtgtcttcaaactgcaacttatgaca

SEQ ID NO: 98706 - DNA, 534 bp, Oryza sativa
cacacattctcccttgctgcattaattgtattccgatgaaatccatgttcatgtggttatatgatgatcaatttgggaaattttgaatttcattatatgatgatcaatttgggaaggagggagtaatgtgcaagaactttaccatatgatggtttagtatacactgagcactctgcatacctagcatatctactatagcaagcctttattgcatggtcatttgttcattcttagttggttaatgtttgaggctgtttttaaatgccacatacttatgcatattgcaacagtatctcaattgtgtctgtgatgactttgctgaatgctgatgtatgcaggcactgaatgctagttcaagagctcttttgatgcagaaattagaccgtagcggcgttaccaccaggtatatatatgtgagcttaatgggttaaactatctttttggtgccctcgtggccatgtcaatctaactacatcagtcatattcaatcttacatataacctttgtcccataaatactccctctgttttttaa

SEQ ID NO: 98707 - DNA, 753 bp, Oryza sativa
atttatttgatagaaatataccgttatctcgtataaccgttggttgaaaataatatgggcatgacggcacggacggcgcgagatcgcgctgtgtcacgcagtgacggtgcaagaccgctcgatctcgcattaccagcgagcgagaccgaacaggttggccgcttcaaattaattaattatcctgattagcaatttattaattaattgctaattaaaataattaatcactaattattattagttagtcattaattgggtaattaatcacaaattaaattggagccgttcgacatggacgtcggtctcgctatttccatatgcgagacagctcggtctcgcaatgtcaccgcacgacactatctgtgtcgtcacacccacgtcatttttcacttaatggttctgcgagatcgatagtatatttgtgtaaaaaaattgcatcccgaatatttctgagagaaaaaacaaatgaatagtacattttcaaatttaattcggggagataaggtttggtttctcaaaatcttaagacaacgagatatctaattaataaactttatgtaaaattattttaaaaatagataattttgtatagatgctagccacacaattgtgtgggtcacgcatctagattttttaaaaaatgcattatttagtagtttggaaaagtgcgcacgaaaaaacagaaaacttttctcttttttttgctattgccgaacctagtgcctcttatactccctttgtcccaacgtataa

SEQ ID NO: 98708 - DNA, 633 bp, Oryza sativa
ctcaatcctacgtactccctccgggttaataatatttatcgttttagacaagaacacggtctccaaaaaataactttgaccattattttctattataatatatataaaagtgttaacaaatatatgattttattaaaatactttttaagactaatctatacatgtaatcaccatatttgaaagataatgattttaaaaatgattcataatcaaagattttaaagttggacctcacccttatctaaaatgacaagtattatcggtccggagagagtattaattagatggcatcaccgtgttatgcatgcttttctggttccgacagtattgatggatgaagtgggagtaaatgatgtttctttacgtaggaggtaaagaggagagaatgcgagagaagatttgagaatttttagaattccaatgaatctgtgatattatttaagtacttttagggacaaatctacgcattacaaatagttttgatcggactatttgtatccgtttcatatatttgttgaatattttcaaacagtacaaaatggtaatgttatagatgtgtggtacgttcaaaatattttcaatttggtctcaacaattcaaaagcaattagttgtcaacgccgaaattatcaat

SEQ ID NO: 98709 - DNA, 541 bp, Oryza sativa
tgcgatatgtagtgcagtctcctaacctcgagttcttttgagcagtctgaacaagacagataacatatgaccgtgttccagagtgcatcggtaatttgtgaaagttttcagaaaacagagaactctatacatactaaaaacacacaaagcctgttgataataagcacgtgaccatcagtgcctgttgctagattaattctatttacatgtgtatccatcagtgcttcacactacagatcaaattggcaagtcgatcgatgccactcacggcgcctagctcggcgcacacttgcacaggcaatagattcacccatcagccatatcagtccatcgcgcagcggcaagttgggcctctttcttgcctgcctcgtaccgtcgcgagagggacaactaaccacacgagcgcgcgcgcacgagcaaaagagagcacaggagataagcacgtagtagctaccagctagcgactgccatcccattgaaaggggccgagatcgatgcgtgcagcatccaaagcatatatgcatgcatccacctgattatt

SEQ ID NO: 98710 - DNA, 548 bp, Oryza sativa
ttttgcgaggttatttatggaagttaacatgtgaaattgatatttcctcgtttcatattgtaagaccttttgttgttttctaagtcatacttttttttagctttgatctaatttatagaaaaacataacaacatcttgaaatccaaaataaatatcgtgttaaaatataattaatgttagatttaataaaactaattaatttagtgttgtagagatgttgctactcttttctaagcatgatcaaacctaagaaaatttgacttaaaaaaatacaaaaacatcatataacattaaaacattataaaaccaaaggaggatcttagttatgatatcggcttttacgtacggtcaatgaattaggggtgaaaacggatcggattcggacggatagtagtcataccatatcctataccatattttttaatcggattcggaggtgatgcggataatgtgcggatgcggagcggattatttcggatgtcggaaatggtgcggagtcggtgcggactcggctcggaaacggataaaaataatcggatgtggcatgt

SEQ ID NO: 98711 - DNA, 610 bp, Oryza sativa
ctgtatttctctgttttacccttcaatccctatcagaatcatgtgttttttctatttctctatttttttcaaccctataatttaaaagggaccctacaactggacgggtccaatatgacgtagtgaagattcgtgcttgagctaacaaattaaagcagctataaagaacagccgatgacagcgtgctcgagccaatagaagcagatataaataaataaccaatgatgacagaattttctgacatataacacctgcaccaactcactgataactcggaaaagcctaagaagctgatcggtcagatcttaattaacccccttttccttgatccaattaaggttcctcaacttgatggtttaattatactatggagtacccacccgattatatgtaacgtagcaattgatcaaccaacttttctgaaccattcagctcgagaactctgaattctttactactaacagatcatccataagctaataactaatcccaactagacccccattcacatgctttgctaaaatctagtagtattacgtatcctggtcaacatactagtccccctttattgaaagagcctatcgaaccttgacagattagcgagagatcg

SEQ ID NO: 98712 - DNA, 556 bp, Oryza sativa
ataatattaataatttgggatgtcaaaaggaaacatgagtgcactctaaagtcgagcaccagagcacggatggacgagacgcttggccgctgccctgccaactatgcatgtttataattcaccctacgctaagagaacaaattaataaattttgatttgtatgggaaaaaaaaagatatgtgagcgcaatctagagtagagcgcgggcggacgagacgctcaatggttgtccacaccaattgcgcttgtgcaattctcgttgaaatgaaaataaaatgctacatgtatttatgcgctctcgcggagagcatgttatatatagccacttttgattacatttttatgagggaggttgcacaagagtacacgatatatagattaacatgtaaatgggaacagattaaaatgaaacacaaacaaaatgattactcctaattaactaacatatatatattgcccttaattacatcccaacaaacattctagaaaatgggcataattcatagcatctgcataagaaaaacctgatgtgtaccgcaactaattagtacatttc

SEQ ID NO: 98713 - DNA, 696 bp, Oryza sativa
gactgcaatccacaacctttctgatttactactagctagctctctttccatcagtctttactctttgatctcttgtcctggcaggcagtgctgtgctgtcagatacatatgtctccatatccattttacctcagaatatgtaatgcaagtaactctgatgtaactctgcttgcaaagctttgcttcttgttgctgtaagtctgaaacttgctttgtttggactggtaaactgcatgttagacacaaaaaaacagttgtgggaacagcaagaccggttattgctttcctcctttttgtttcacttttcacagttcaggaaccttgtaagctgatatatctgagacaatgttacagatgttaatgccaagggctttacattgttttgccaatgaagttcagcagatgcactttttttttcagaactcacctaacaagttttactgtagtttccaattcagcaaatcaaattactttcctatttaatttgtgtgatatataataactgataactagttgctttattctaccgatcagatcatcagagagtaaaaacaaagcaaatctatatatacagcatagagatgatttaatgtatgatgtatatacaaccatgtgacactccacatacactgtccagtttctgtttgtcacataggatgcagagataatggctaagtactcaccagcagcagcctc

SEQ ID NO: 98714 - DNA, 1396 bp, Oryza sativa
tgaaacatcacggaatacctcctgtgaattagtgttcgaaggctaattttgggacgggcccattacacgatgggctttatttatcactggaggaaatgggcttcaccattttgggccttaatgggcctcaatcttgtgtgtattcgaccagttacatattcatattggacctcattttttgttgggtctagctatacaatcggtgacaaattttctcctaaatatttatgaaatataaatatagcgcattgtagttatattgtaacttacataactacattacaatttgtatgtaatatattatttttgcaaagcgcaggtcggacagattctcctcatctctatgtgtgctatacttttttttcttcccaacttgtacaaatcttgaagtaaatctaacggtttaaaattatacttaagttatatacaagttacattgtagttagatacaagttataatataattacattataatcatactgtatttacatctgacagaaaatttgtccacaaatatataacataatcattttttatgatccaatacattaataagcaaatatttagtagtactacggtgaaacatgcagtcacaaattaagtgagtgctatggattatggatattatggaatttaagggaatatgggtttttagtgttcatgtcaattaattatcgaggaaactcctacagtactattttggaggataaacggctaactttacgttaaaatggaagaaaattaaagagatgttaaatcggattgaatgtatatgaattaattaagatttactaccagctacttgtcctacttgacggatttacagatcaggcagacgtaaagattgatcgagcaaaaacgcataaacaacatttctttaatgcaattacctatgaatcaaaacattacacatatatctccacttgctacagatgagagattaattttgacgactaagcaaagcaacaatctgaattattttggcccgatgatcaaatcctaccgaattcaaacgcaaactgacacgaattaccaacaaaaacaaaaacacaatgcatgcaaaaaaggaaacataatttgcaactagctaggctagaccgttcgaccaacaaatcaaacgagagccattgctccggctgtcgcgacgacgagcagcatcagcaaggcaccacccctcactgatggcgccgacgacggccgcggcggcggcgccgccgtcccgttcgtccccggcgccggcgccgtgaagttcatccctccagccggagacggcgccgtgaagtttcccccagccggaggaggtggcggcggcggcggcgagcctgcaggggccggtgctggaacgggtggcgacggcgccctcgccgtgccgttcgttcccgcggccggcggcgg

SEQ ID NO: 98715 - DNA, 641 bp, Oryza sativa
catgctagcaatactttgaaggtttatttgtctctagcatagcttgtatgtattctagtcttttcataagatttagattttgcttttaagggagatgatgcatgacacttaaattctacttgaataagaaaatatgcaatgttgatgctagcatatggtttgatttataaatgctctatatatatatatgctttattgacttgttattcctcaaatagctttaattgctcattgtgaaaaagagaataaaaaatatgaaaaaaaatgaataccgaatccttggaaacagtcttgacgacaaggacgtattcgatgtgagcaaaataatgggtgccgaatccctggaaacagtcttgacgacagggacgtacccggaataaaagaaaaaaaatatgagcaaaaaggctctagaaaagaaaaagttaaaaaattctcttggttattttgtgctaaaggttatttgagaaagagtgataaatgcaataggtatatatgtttagtgtttattcttcaacctatatgcttgttaagatgttgcattataaatcgtatgaaatcatgaatttcgattgttgattcaagcttaattgtaaaatctttggttcatggttatactaaatgggtttatcttctttttattg

SEQ ID NO: 98716 - DNA, 605 bp, Oryza sativa
ggcgaagcgtgtgtttgaacgcttcggcgcggtgcggcaaggcatgtcgcgggttctgccgcgggcgccaaagtgcggcctcgactcacaggtgacaggccggacgccggacgccacggcggcgccgcggaacgctttcctctgatagtctgattacgccagtttgttgtgtttgcatgaggaagaggcagaagatgactagtagcccagtaccagctttctgaggggttgggacttggaaccgttccggcggaaaaaaaaaagagccatagattaacacatgattaattaagagcaagtttaatagtatagcttactattaactccaaatcatctatacccaatgtaatacccaattcatatcatagttttttgttatactattaatatcccatataacgtcttggagcccgtgctacaactgggtatagatttggaagccggcggttttcttttttctcccttattctttttaaaaaaaattaaaggtgaatatagcctgctattgtactggttttaagtataagtaataaaaagacttgaaaacttgattaatatgatttttaaagcaactttcatatataaacttttcacaaaacgcataa

SEQ ID NO: 98717 - DNA, 685 bp, Oryza sativa
cgtgcgtacatggaattttcctgcgccagtcttgatttctcggccaataaggtctccagttgcacacgaatctgttcaatagcatgttcttcaggcatgtattttaaatatgcagaagacatgttgtactcattacttaacagtgataagtaaaaaataactaaagtctgttgtacacaagcaatgaacctcttctaagtatgaagttagggacaatcgtgttcttgcccttactttaagttgcaattgtgattttgcccctcttttttagggtttgtgattttattttttaaatgaagcttcagtttgcccctgctttagatggcgttaggtgggtccagattttgtaagataataaaatagataaggtaaagaaaagaatgtttacaaaatatagaaagactattgtacccctgtaaaaaacacttaccagttaccaccacctaagccatccaacccattctcctctcccattccaaacaggtggatgcaagcgacggagacggaggtggcggcaccggagcaactcacgagcaggctgcgacggcgcaagtggcagcgctcaccagcgtgagcagcggctgctcggtagagagggagcaggcggcgctgctcggtcaatgcgcgagcaggtggtggctcagcgacgctgtaacaggggaaggggtgccttaacttggctcag

SEQ ID NO: 98718 - DNA, 612 bp, Oryza sativa
cttaatatgccctgagaaggtgaacatatggggatttttaatacccaattaacctaattttatactaacaagccgttcacgtggctaaaagcctagcttgattcaactggttatgactacaagttagagctgatctgaactaagcatgatataagtcgatcccagccactagttgagtttttttttttcaccactactgatggtgaagtgtcgcaggtacgtgacttattcattagacttgaaatattacctagacatgagtgcactttcaataggagtttagtggggggacaaatatgtttttagtctccgtctctttttagcatatgttaagaaacatatttatgggggggcacgtgtgcatcgttattttaatagaaagaaaagagagtgagattagaaacacgtcttttttatttgcaagctcagattaaatcacccaatgaaaattttctatgcccgcaatggcttcgtgaatataggatgatgttttttctatctttcaataatccaaaaagttttcagttcatctgaaataggagaaaagctgggtgaaactctttcacaaaacaaactacctagataggggaagttgggtttaggcaacttcat

SEQ ID NO: 98719 - DNA, 1064 bp, Oryza sativa
tatggactgaagatcaccccttcaccagttcgccaccatttgaggcccagaactccagtcacagttttctaagcattttcttcacacagagatctccttttccatttggccttcataccattctttcaaggcttttttaatcaaaggatttgtggagaaatttcataggattttaaatcctatagaaaatttttctatttaatcatttgataggaaggattggagttttccaaatcctatgaaatttctatgaacctcatcggttacccatattccctaataagccaaaaggtttattagggaataaaaattaatttataagtaaaacttttatatatttgttcataatgatttaaaagcaaatgctaaaaaggaattatgttgaaaatattttagaatcaacttcaaaatcaagttcaaaaattcaaattttaattttttttctttgacttattaggcgaaacgatgggtcattaatatgcgcacttgcaagttgcaactgcatgtatcatctggagtttattttgccgggatgtgattgaagtttcagttttttagtttgaacctcattactactcagtgcttaatactcttttcattctaggctattacaatctaatataggatataatacaattcataatactataagtattatagtgtgtgtttgattgctttattttaaaacggaggtagtactccctccgttttttaataaatgacgccgttgtcttttgaacatatatttgatcattcgtcttattaaaaaaatatgtaaatgtatagatataaatcatgcttaaagtagtttgagtgataaaataactcataacaaataaattataattacgtaaattttttgaataagacgaatggtcatatgtgtgataaaaagtcaacagcgtcatctattttaaaaacggaggtagtaccattttatcatggaccctaatctcttactactcgtttcactactagtatttgtcagtttcaggtgctttggtttgattgctacgtcgtcttaatctacacatgcgtacgacaaatgttgtgggccattttct

SEQ ID NO: 98720 - DNA, 525 bp, Oryza sativa
tgttcatcacagaataataatcaaaaacacctttgattttgcaccatctaggtctcatgctaactcaaccgactctattaccgtcaactcgcaatatcagtcaaaaccaggcataatattgttaaggtctcaagtaatccggtttcgtaaattaagaaatctgatattacggttcaaatgacgtgatctaaactcgatattactgtgaggacctgaagtgaacatttctatgtttaatgtagccttagatttcaggatatagacgcaactacaacggtggcgttgcgctcgggccagcccatgcgaatcgcatccaacacggcgagaacgggctgtttgaatccaatagcgccaaatcgcatccaaagttaggagtaaagcgtgtgcattccttactgccggtcaccctgttttctcttactctgtttgtagttcgctgtaaagaacacttcaaatcaagctcacacccgaagccttccactcgtgcaacaacttcaggagttccatggtgtgattggtgtcatg

SEQ ID NO: 98721 - DNA, 708 bp, Oryza sativa
  unsure (1)..(708): unsure at all n locations
tgcagccctttttagggcaattgaaattaatcgcttccgtttaggcgtgctgctgttcgtcgctgctgtctcgaagactatatacattgagcaattttacggttcttgagggtgtaccataaagtaccattttttctattataaatttggtatctcgtgataactagatactgtgaggtaccatgaggtatcaaaatttacactaaaattttggtacctcatggtacctccttaaataccgtagaattgctcatatacatgatagatttctcgaaaacgactgatgctttccagtttccaccatagtttattatccatcttagccgatttttgagtgatcccgtctcgaccccgtcgcactgaagacgccgctgctttcgtcagtgcttcgcttgaatccatacacaactgaaagcagtgctgctttcgtcactgctttgcttgcaaccctgaaggcctgaatggctgaatatatactaagtcaaatggaacctttgttcgatggatcctttctctcaacatactctaatagcgtcgcaacttgcatttttaaagaaataatttttnccnccccccccaaaaaggggggggggggggggggtttttcccctttcatgcttcaccgacaacttaaaggctatccccatcttgatgctcgattgttgtaagctcttggtgacagtcggcatgatcatccttctgttttgg

SEQ ID NO: 98722 - DNA, 787 bp, Oryza sativa
  unsure (1)..(787): unsure at all n locations
ctgcgctttgatgagctactcagtggtacagtcactaatgagcctggttgtgagcatcggttcacatggtaaaagtccattatacatccctcaactatagatcgtgagncttatattcgtgccttaatcataaaaccagatacctccaactttctaaacctgtttgttttacctctttgagtagtttttataccggttttatcctaagtaacacccacattattaaataccaacgggataccgtagtctaggttttttgagagggctcgctccatttgttctccccggcggcaaacatgtgtgtttgtgacttgtacgcctacacatattattgatcaaagttatttgattagctgggatgatcatttgccaagttgctaggccagcgccacagggaactggtaaccattatgtgccaccaattattcctgcctttaaaaaagaacaagcgtaaagagggtaggggtaaggaaaccttccccttgctttttgataatttcacaagcttaggatccgggtaagagcgcaggtaaccaaacttaaccgaataggctaaaataatgcccggttgacaattgaccaatttctttgtaaaccaaaaacgagatttttccttggggcctttactgcctacatgttttattttgaacagagttcttctcaattgttaaggggcccaactttggaaatttaaaaaaaaattgtgcccccaaggaaagaaccacaagtttttgctgtcctatggcgcttcttttaattagaatttaaggaaaatcacatttctcat

SEQ ID NO: 98723 - DNA, 639 bp, Oryza sativa
agataaaggatcagtattttagcaggatcaaccagcataatctggtgctaagcttaggcatttttctggaagaactgaaaaaaacagatattcttagcattacaccattatctaaaatctggactttgagaaatggcagactgagatgaagaaactgttctacaaagaatgttgagggtcctaacaccctaaagggatattctggtttacagaacagagacaacagtgaggacacatagtttaggataccagaggagaatttctagttcaggaagacctgaattacataagaagagaaaaacacactctattaggctgaggtcattcccttagctagagccaaccaaggaaaagatggatgtcaacgttgttagcaatcctggagtcttcttcttctcagtccttgatttttgtgacctccttggagtacccttatgcattgaagattttggcctctgcttcatctctcacaagtgctccatctgtgaagtcatcaatataaatatctcattctttcagtgcgggacattatcctgtttcaacgtgggaacattatcactgttcaccaacatcctgttcccctttacttttcatgcacacacacaaaattatacctccttgtccccttgaagttatgtg

SEQ ID NO: 98724 - DNA, 628 bp, Oryza sativa
aataaaactatgaggtgggccccccaccaccaaaaaaaaaaaaaaaaaaaaaaaaactgaagaaagaagagaggagaggaaagagagggaaaaggaaagaagaagagaacctcgcggggtggcatcagcccacgcaggccctcagcattcagtgtcattgagcatgtaggctgtgcaccacctgtgctacccatgagacgatcccaggtgcctgtggaacgcagagcaagaacaccactccctccctctccacctgcatttccatcttgatcatatggaggagaaagtcttagtttaaagctagcctgtctttgacactttcctactccctgtcaatctccattttaaacaatgaaaggcccggtctcaggccataactttggcaggtaacagtgtaaggttagaatttaatgatgccatgtaagtttcatatatatgtatgtttagggttgccatctatgtaagacaactgaagattgttttttacttacactggtcataacaacttttaagaatccagttcaagtgagttgataaaaaggtcaagtccataatagtgcaggtggttctcaaacaggaaggtggtgcacatatgaccaagtgaggtcactgtgatgttgttaagcct

SEQ ID NO: 98725 - DNA, 531 bp, Oryza sativa
aatttctggctccgccattgtatatatcgtgtactaacatgtatatatcgtgtactacgatgaagaatctgttacggactcctctacaaacagcacccaaactcaagtctgactagctcgtaaacaacttttgcacggtcattaatctctgtgatgtctcctcgttgcgaaagtctctcccatctacggcttgctgccttgctgtatgcaagtacgtatcagctcgtgcttgcatgcgtactgcacccaagccacgtaatcaatgcttttgaccaaacacatgcccaatacaccaattaattcgcatgcaccccgtagtttttgtttgtttactctgcatatatacttgcttgattccttgaatgcatctcatgtgcgcgtgtagcacgtacacatacatgcctggtcgtgcctctgcacacaccgcagtaaggagccctcgtgatcaccggccacgaccctatcgtcccggccctccacgttcactgcgccgcaccacgctcgctggcttggccacgtgggtcgggcacg

SEQ ID NO: 98726 - DNA, 1007 bp, Oryza sativa
tttaaacaactatttatctaaatcatatagctaatttttttattggtgcactccattagattatttactataaaatattttaaaattgaagatccaagtttgggacatatattattaaaatcatatagctaatattattaagatccaagtattcatattaggttgtgtggagcctctgacccactctaaatgaaaatgttcatggatggatcatctctcaaactacatcaatcatattagtctatataaacacatacatttagtgaagcctcatgtcccacccaatttatcctctaataaaccataataatatatatgcaatttaaaaaaagaaaaacaaattacttttactttcattgacatattttctaaagaaaataagactatattcttttcaagtgatgaagaagattataaataattgcttacatatattacttaaatatgatatagcacaaaatgtaataggttagaaaattatataggcaattaataccgacgaaaataatttacggagaaatcgtgacagttgatctccggttaatatttcgcttttataaatatcttatacttagtgtacgtacgatgcatgcccacgcgaatgcgcgggttaccttcctagttttaaataatttcggtcaaaaacaccaaaattcacgaatttttcaaaattttgacaaacatcgatatttccgaaattaactgcaaaccctgcctgcacccgtgtcggcctggcacctccatgtcccggttatttcgacgtcctccgataatgtgcagacgacatgttcccgaggcgaccatcggagacaccaaagcagccggatcccatcgtccatgacttggccggagttggtttctccttggcttgggattggtctctcgttgatgatggagatcagtttgtctgtcgaagcagtttgcccatcggcgattcattcagcgatgcaagtgaatgatcctgatctttgctcttgaagaattgctcaaacttgtaccatgtttta

SEQ ID NO: 98727 - DNA, 639 bp, Oryza sativa
taacacagtcagaaatcgaaacgtactctcaacagttcgcttaggcatggaagtttgcggcattctggctacacaataacaagggaagacttactcgtggctgcaaccctactagctcaaaatttattcacacatggttacgctttggggaaattatgaggggatctctcagggcagagtgagtatcaatatacctttctttaagacccatagagggcttaggcagggggaccctttgtcccctctgttattcaatctggtgggtgatgctttggcagctgtccttgaaagtgcaaaaacaaatggggttttagaaggtttggtgtctaatctagtgcctaggggtttaactcattttcaatatgctgatgatactatttttttttatcaagaatgaggagtacaacattagggtgctgaaattttattgttttgttttgagaaaatgtttgggatgaaaattaactatcaaaagagtgaggtttatgttctgggagttagtaaggaggaggaattgagagttgctaatatgctgaattataaagtgggtagtttaccttttacttacttggggcttcctatggtggttgagaagatatgaatgaaagatttgtgttacattactcagaaagttgataa

SEQ ID NO: 98728 - DNA, 1962 bp, Oryza sativa
ttttcatctattagatttatttttgaaggcccactattttcatgtattagatttatttttagaaaaaaaaaacccacaatccacctccctcccttcttccccaccagcccacccttttcccatatgttacgtacgtacgtaggtatcccttcccctatcaattcttctctctctttttttcttttaagttttgttataattaaaaataatattttaaaataattttcgtatagggaaataatcataacctttaaattgcacgtaaatattttttatcattcttcgttatcatatccatggtgcttaattaaccattcgaataaataaaaactactacattctttaactcataacaaatatttgatttttatcatatcctaaccttaggatgcaattgaagctgttaaaaaaatataaaaaatggcaatgtatatcatatgatgatgtatcactttataaaacattcataaataaattaaatatcatagatatgaaaaaaaataaaaacacttaaatcgtgagcaacattacaaaaataatttcctctattatttcaaatcatatcaggacctttcgcatgccattccactaacaaaaaagattgtgcagaaaatagataatgtagatcatatcatcatttatcacttcacaatcatgcataattagattagctctatagtaccacaaaataaattactataattagttctgattagcaatcaaaaaaacaataccaccgttctaaaatattgacatgttaaaataatattatttttcacaaaacaaagtaatgttacttaaatagttcatgaaaaattgacatcaccacaactttaatatttaaaccaatctagaatatcccaaactaaaataatctaattgtgattagcattaaaaatattatctccgctttaaaatatgaattatcacaataatgaaaatctagctacgtccatataaatattttgttataattatatctttagtatttaaaggactataaaaaataattgaaccagaccgatatgtcttagttaagaggaatcggaggtgtatatgttgatcatttcctcttcgatctttggagtttaaacttaagttaatcggagtatatagtatataaggtccagtgtgctcgactcatacatgacttgccttatgtatcaattctatgttacacttaaaccattatatcaattctatgtatataagtactgatatccactaaccattgagggaagaatattattatatactaaaaggccattgaacttcatacaaacgctcctaagccaccacgtgacccattatttttaaacattagattagatgtattaaagtaatccctccatatatattaatctctcatgtacgtaccacatgaaaataattactattcatataaaaaacctggaaaaacatacgtacgcacgtatgattaattttttttaatttttccctcctaatcctcaaatttaaaactaaaactttattatgtttgtacctacctatatacaatcagtccatcgagtcatctgtgactcctttcactctaggcagtagaacccaagcctacttacaaatacattttttataagtgtgtacgtagatagtgagttaggtgttaaatttgtgatcgatgttagtcttgaggggtatagctacgttgatgcaggactcatatttcaaggcattagagaaaaaagctatgaccaacttcacacgttaggtgggtacttatatctaattttaatggttttctcttattaattggtagaagtgttatttaaaaatatttatacatttagatacaagtgaaacatgtgcacttcagtatcaaatggagatgatttttttattacattaatgatatattaagtttttttataagcaattctatctattaaaattctattaagaaggcacctagctctttcaagagaacaaaaatataataagtag

SEQ ID NO: 98729 - DNA, 753 bp, Oryza sativa
ctttatcatctctgtaatgttgtccacacgtggccaaaataagccttataaagtgaagtagagtgagttctattttcttaatttatgccagccattttctccaacactgttggttaacacagtcttatgatttatacatgtattcacttatgttgattttgcagctatattgaagttaaatgagcttatttgattctcttgtttgatattaaggttcacagttgacagcaaccccaggtggtgttgcacatatcttctggatgcatctgatcccttatttgtagaaattgggaagctttttattgaagaacaaatcagaggtataatgcatgatttccactacttaattaatggtgcttcagtatcagacctaaagtcatgttttagttctgaaactaaattcctaactagaaaagttcacagcagatattcctaagtttcactatttttcactggttgtatttctaacttgtgtatttttgtgctgagaataactgaattgtttgtgataattattcgagggtacaaacgaattaattaaatattacaaagttgaaaaatggattttaaacagctttctaagaaattcatatatagaaagtatctgcaaaaatcacacagtttaggagcttgggaagcgtgcgcatttatcccccattctattccttagaggaacacaccgtaaccaatcagttttgtttaatccacaagtgttggtttttcatttaagtagagagtagtagtcatcagcac

SEQ ID NO: 98730 - DNA, 617 bp, Oryza sativa
ttataaggtcattttcaatgagagttttattttcattgaatagggtatcatgtcaatatttttgttaatatgataagtaataataaagaaagagatgaaatgagtttacactgtttttaatgtgacttgtctctacatgtgttgcttataagattaaaaaaataaaaatgtgtcgtatgggctattttagcaatcgattaagtgttttgtttgtgtgggcaacactttttgaaaaataaaaatgaaacctctcattagaaggggatggacgtgcaaatgtgattagaaccagttttataaaaagatataggttgctatgatttttttcagtacaataaatctgggcagtaatatgtccagattcattgtacttagaaacatctcatttaatattagattgggtttttaagtacggagataatattagtttgggttttttttctagaggagagagtatgtgttttaaaaaatagattaagttgaaattaaccccaacccaatccaacctgtccacctcagtggcacctttattaaacgatcccaatacaaattcgaaaccaaaaaaaaaaaatatcctactggtggtcgactagattaatattggaagaaaattgccc

SEQ ID NO: 98731 - DNA, 611 bp, Oryza sativa
attcctgcagcccctgaccaagcaacacacgcaaccaacacgaaggagaaaagaaagcgaaaacgatgggatccaaccacccaccacgcaccatctactgtagcatcgctctcctgccagccatcacaaacccttttaccaaatcaacccccagatatgtcatcaaatccaagatctttttgccggtttggttgttgtgaaaagtgtagtaaattgtgtaaaacctctatttgcattttcctttctctattgatgcaatgatatcatcactgtgttacaaattattgtcccccaaaaaacagtaaaaaaaatatatgtaacaggaaataattaacaagtgagaggagaggagagagagaaaaaattagcagaggagggaagagtaattcttggccaggtttttacttgccggacttctccgacgatgtgcccgccgccgtgctgtcttggccggagcagaaggcgtcgcgccggccgtctgggcggacgacgaagtggccgagcgacggcgtgccgctgccggcgacgcggttctcgtcgcagaggaactccttgctgaggacctgctccagctcgaactggaagtcgtggaccagaacgtcggtggggcc

SEQ ID NO: 98732 - DNA, 550 bp, Oryza sativa
attcctgcagcccatggttagttaaaaatatggagggagtaacagagtttaaacattttttgatctaagaacacacggacattgcatagatcaaaatattcagtatcagtgaacagcaagcttttttaataaaagagcagaacacacacgcacctgaaaaactttctgccatatagcttcttgaccagtgaaagcaagaggcaaattgataccttgaagagccatccagtcaatttccttctcccagcgctcccaatcccaccaagcaaaagaatcttataagagaaaagtagtctttaagaaaatcatttccactttccataaaaagtaacagctgagaaaaattgctcaaagttagcatggtataaaattcaataaaacaaaagatcgacaccgaaggcaccctaaaagtcacaccggacagtacaacacaaagagatacaatcaggaaatatctcattcaaacacaaacatgggtagcaaacaattgaatccaggacatcaatttgggagatggaaatgcagcactattcctgacctgaatattttc

SEQ ID NO: 98733 - DNA, 546 bp, Oryza sativa
attcctgcagccccggcagggcttcgccccttcttctcttctcctcccctctcttctttttttttcactggatttgaggggggaggaatgatggctgggggctaggcggcaggccttttataggcagcgaggcctgccgcccggccagagggcggcaaggggccgcctgcaaaatggccggccccgactggcttttttgcattcgggcccctggcggcaagggttttcctgcaaaaaaaaccctacctccgtcaccgcccgttcctctcccgtttgccacgtcagcttgccgccctagaggtgtgcggcagggtctatttttgtaattttttttgccgatagattatttctgtaaatatttaaaaaaaatctaaaaacgaaaaaaattccagattcatcgagcgcccctgctgaggcgccgaccaccgccgcccaaacccttccctcccaaaccgatcccctccgccgcctgcgccccgcccctctcgcccgcacgaaatcccggccggcgcccgaccaccgcggaatcacgcgcgcgcgactgcc

SEQ ID NO: 98734 - DNA, 541 bp, Oryza sativa
tcggccacccgcgggggcacaacggtggtggcggccgagcacgggggagctcctcgtcccatccactgtcttccgcttcgcctagctcgccttccgctgctttgcccaccgatgcgctcgcccgccgccgctcttccgccgcgctcgccttccgctgcaccccccgcatccgcactcctccgctgcacgtaatggcatatatacatgtgagtgtgctcagccatatacacatgcttggctaatatatacgtctgcatgttatcgggcggcaaaccaacaagaagctagctaggctatagctggtcgtctccatgcatgcatatatatgctcgtacgaagacgcatgtacatgcggccgtctgtacccagcgtatatgcgtatgagctacgacgtcaagtgctaccgcgaagtcggcgaagacggcgagggacaccgcgcccacgccgaccaccgtccacgacgccgatgacacgctgagtgtggacatgctcctgctgcagctgcgcgagctgagcgtccggcaggaccatgggatcaggc

SEQ ID NO: 98735 - DNA, 886 bp, Oryza sativa
tggatgatttctttggcgggccagcatttcttgcatggtctcggatggccaatatgcatgggtaagtcatgcttatgtagttatgtttcacgttggactattccaatgattcacactaccgtattgtgagtcgataaactgttcttttacataatttaacaagaatgcggtctgtttttaatttctttaaatattccttagctgtgagaccaggacaatagaaatttggaactaccaccagcaaaactattttactaaaagatagagctgcgactcaatttatgtagttttgtcttgtggacagtatccccccccccccccccccccgaactaagggggtagttgctggaaacagttagcttatcggttgtaagatgaacttataagtcccttttttatgagagatttatacaagccaccatgttgataatatgacttatattgatgtttcatattagtgttttgctatgagttcaatttttgttgcaaggaactgtagctcaaagaacatgtagtgacaaattgatttatcagatggggcggacctcttcctcaaagctggcttgatgatcagctagctcttcagaagaaaatcctttctaggatgtatgcttttggcatgttcccaggtgatgcaaaacagttgcatttttttagtgcatggtctttatgtggtattgtgattacataagcatgcatatgttttacagtagattatttagcatagttaatattatgtgatctcatgaaaatatagtggttcggatttctctcctgccatttctttcagaacttctctgctaaaatcagataatttatataaacaagtatgcagtctgccccttctagttgttaaacgctgacccctgttcattttacattttaa

SEQ ID NO: 98736 - DNA, 546 bp, Oryza sativa
catcgagatcaacaacttttgtttgggttatttttctatatgactttgtttaaatagtttgaatttggatttcaaaatatgacaccttcaaacaacattttcaaatactaaatgatttcaactgaaaaagtcaccaacaacaaagttgtataacttatcaagatctacaacttttatattaataattttttcatccgacataattatctgctcatagatatcataagaagcatctattgtttgaagttcaatttgattacttaatgatacacagacactataaactatggccctattaatagcactgataacacaatgactcgattgaacatagttgcagaacacaataattgcatcttaatgacttactcttgattgaatcgactccctcaaccgataaatcgaatactacgaagttattatcactaaaatttgaaaatgttgatttgttctattagaaaaactagcgagttatgtctattcgttgatttgtgaaagacggttagaggggctatcatgttccgattaacactcgataccgtattc

SEQ ID NO: 98737 - DNA, 1035 bp, Oryza sativa
tgatacctgtgatagtagtactagatgtagatggttgtactgggcgaaattcagcgaggctaggagttttggaggattttggttgaactagtttctgcgagaattcaataaaatttctgaattatgatggagccacggagaacaagcaatctgaaagaagatacgcaggtactgcgagtgtagtgcagccagaagcaagttatccgtagcttgtgaaagcacagttggcttcttctacccaaaatataagaacctattaaccaaaatataagaacctattaacgaatgagatattttctagtactaagtatattttctagtactaagtccatattcgtagtactaggaaatgccccatccgatttaagttcaaattcgtagtattaggaaatgtcctatccggttctaggttattgtacttaagaacagatggagtaggaaactaggttattgtacttaagaacggatggagtaggaaacaacggtgtactcacacagagctgattgtctgaacaatcttccagaggtcatcaaactgctgatcagatcagaaaaaaagattgaaattttggatctcaataccatttttacctgtcttgaacggattgcaacaatatgcattcagaactttagacatgcatacatactgcattggaaatgcgtggaacaaaaacccatacctgccttatgggaactataagaaatatgttgtacattagcaacaaagtgaatttccaatacaaacataagatcatcaatattatccatgataaataaaaatacagggctggtataagcaacatacaatctccgcttgttcagaacctaaaatttgtttacagttgtaccacatggtatgctctctacaactaatgctactaaggaaatttcacagcatcgcgacagaacaaacaacagatgacatatcagtaactaaaatcatgtgttctgatatgtccagctgatgaggcatgcaaaacttcaggagatcagaaccctctacttcaaagtcagttttcgttgggtttcaagatg

SEQ ID NO: 98738 - DNA, 1572 bp, Oryza sativa
aagttgtgaacatgtaaagaactagtactttgatgttatagtggttaactagttatcaatgatagccttttatttggaggaccaaacatgatccaacgaactttcaaattcattatctatatttggcaaaaatttctgatctctttccagttctctaagtgtgtactccgtaattacttctgtacaacctctattttataaatgcctgatagttttcattttgccatgtcaaccagatgtttgataatccttttgccatgagaggaggtcgagatgtcaaggttctattgttgttcattaaatgatttgtttaatgacaaagaattgattattggaagcttacttttttctctttttttccccaaatataggttccaatcaaactatcattcatggaagccgtccaaggctgcagaaaaactattgcatatgaggctgatgttttctgcgatacttgcagtatgtgtgccacttgtttattctttccttctttgatgcaggcatgtcggttatctttgtccaccccatttgtttgtttttatggcttaagcttgtcatttgtttgatgcagatggaagtggtgttcctcctggcactgtacctcaaacatgtaaagcctgtcgaggtgctggtgtggtatgtatcctttgacaatcttttccccgagtatgccacatattgatatttatatatttactttaacaaccttcaaaatgttgtcattgagtgcagatattcatgcagcggggtataatgagtatagaaactacttgttctaggtgtggtggaagtgggaaaattgtgaaggtgcatttctgctttaattacatatttttatttatttgtttcttgaagattctatagttcttcatgataaataaagtcccatctgtcatggctgtctttgttcaacaatttcactcagtggcggacccagcacaaaattatagctatggcgaactttctaaatgtacttagtaccgaaacattttttttataaaaaaacacaaacataccaaaacattagtatataatgtatatgataaaaataattagtgtgcatatccaataaaactataagtaaataatttactgttttcaatataggtgaagatttattcatgaaggtgagagcccctagagccatccaaatgttcccattccaaattattctccaaatatttgtggttagcgttaaacaaatagtaattatacttttgctcaattccttaaagaacaattccaaccgatgcagatgcatcatcacttggtcaacatgacaacttgctccaccataccagtattagcttgtactagtactaatactaaaagattagtgcttattgcccccatcatcacggtaaccaccaatgaaacagtcagtagtgttgttgtttagttgatagttactgctggcagataggtatggcagctgccacaccttgccacaagggaaggtccgccactgatttcactgaaaaatggtaaacatcacttctatgagtgtattttgttcgttacaaaaagatctacttcctccgtttcacaatgtaagtcattctagcatttccc

SEQ ID NO: 98739 - DNA, 661 bp, Oryza sativa
cggtaggtttctatgtacccctcagtatgggagtttgtcaaatcaaacatgtgatactcacctaatcaccgtcatagcttcattttcactttaataaaatgctaatcaagaatataatttatctcattgttcttgttggccagccttgcatgtatacacgtgtcccaagatgactaccctacatttttgttctcttcacatgctaatgtcgatgcaacacaatagcacacgtgcaattatagttgggattatacaaaaatagtgaatgcaaaaaaaggaacattataattatttcattgcggctagcaacatgaactaaagtacctaaatttaatttggaaagagtagacaagttcgaaacaacaattaggaatgtctccaaaataacagaccatttgttcatagaaaatatataaaatgttcaccaagaacacaagattgtctcaattaaattaactatatatgcatgctcctataaagtattgataaaattgcctaagtgtggaagggttgaaggcttcaaagtgttgccgacataaacaggacaaaccttcggtttgcttgttctcagattaaagttgatctgctcctgaatcaagctactaccattggagcagtacatgtgtaaagtcagcaagtttttggtcagacaaagtaccaa

SEQ ID NO: 98740 - DNA, 753 bp, Oryza sativa
gctacatatttaaaggtagtatgagaaataaacttacactgtggggaatgcaactgtttaaattataacaaatggttagatatttttatggttagtaactcagtgttgataatggctagatattgttacgtttagtgttgatctctccgaagcaatttaaaccatctgattttctaaatggaagtgtgatttcatatattttaataagactccacgtttaatgatgatagaaaattggtagctttggaatgctatgttctgcatttctgacgatgataaattactagtagtagctttagcgatcagactgcatacctcaatggatatcgctctcctttgtctttccttgaaaccacctatagctgctgtcgtgtacctatgcgtggtaaaattatgtaaacaatcagaaatctggatgatagatactaactactacaagcatccataacattttggttgaattaatggaaggatgaaacatcacgatttgttcccttacagtttttcttaaacaaaaatttctactattcacacaaccaatgtaattccttcatataaaaaaataactatagcaaacagtccagtgctcacccgacaacaaaaccagcacagtgcagcaagaagacagacagcatcacaaccccaatatccccagaaaacaggcctccattcccatatgatgcatcagcaattgttgatctcagccgtacaaagttctcagagaacacgctgtccataagaataaaaaaatgg

SEQ ID NO: 98741 - DNA, 524 bp, Oryza sativa
gaaaagataaagctataatagtttctagaaaagcaacttgaaagcatcacttcctgtgtggctgtgctacacaaaatcctttctataatttacgcatattaactaaatgattcctccatgttagttattttgtaggtaaactttagaaactgtgcacttaattgatccacacttccattcattaatctgcaaagttacttctgagtactgaattgcgtttgtaaaaattgttgtaagagatcaaattgatttaggtaattttatttgtctttgttgcatattactaatcttgtcattgatatacattttttaggttgggaacaagctgaatctgaagttgctgccctaaagaagctacttgaagcttcagcccagaagaatggttccctcgaggttcaagtcagccacttactgaaaaaaatgcttctctcgaggttcaagtcagccgcttagatgaggctctgaaggaatgtgtcaggcagctgcacctagcacaggaagatcaagcggagaaagtccatgat

SEQ ID NO: 98742 - DNA, 720 bp, Oryza sativa
acggccgtagaggagtataatggcagcgtttgacgggacttctagaaattataaaaacaaaacccaacggaacaataaactctaaaaactatatgatccaatttttaaaggtctagaaattataaaaacaaaacccaacggaacaataaactctaaaaactatatgatccaaattttaaaggttctaaggagaatgaatagaaacagtggtaaatcgagcaagcaaataaagaagaaggatatgacagaattaagaggtatcaactggtgtgacttttaaaaactataaaatcaaaaacacgatgatgataaggtttgatctttcaaagccttaagacaacgagatagctatttaataaattttaaatattaaaaaatatataattttgtatgggtgctagccgcgcaattgcgcgggctacccagctagttattattgatatgaaaagacaattatgcccttcattaagactatatatttctcttaaacttgtatcctcccctagacttttaacatatccaagctctaattaataccgttttcaccagataattggaggtgtgggatagtggtctctaaaagaaggaaaagaaaacgtggataataaagaggactaatgaacaccacgcataaacaaagtatttatgggataaatacttcggtctaaaaataaggtgttttagggacagagataagagtaggattattttggatagagc

SEQ ID NO: 98743 - DNA, 567 bp, Oryza sativa
tcccgcatcacttttgtttgaatggagactgaggctgacatgtgggcccgggtggcattgggaatgaaaatttgggagagtggcatttgagcactggcattttgagagagtggcaaatagtaaattctccccttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatctaggtgtgcagacgaacatggatgatggcgagggaccaagtgctgaagtaaacgagacttctgtggaggaggtcaacgcacgagaggacgggggcgtagtagctccagtgggcattcagccaggtggagtggccgacgagggggagactgtcggtgccattgtggatgaaatggagagggaggattctgacaacgagcgtgtagaggaaggtgattctgactacgctttccgttgttgcattaaaatctgcctg

SEQ ID NO: 98744 - DNA, 551 bp, Oryza sativa
tgaaacaacggcggcgcgacggcgcggggcgcgaggcgacgagacggcgcgcggcgcggcagcggcaatgggacgcgcgcggcgatggcgacagcggtggcgcgcggctcggggcgggatgcgatgggcggcgacacgacggcacggcgcgacagcgacgatgggacggcgcggcgcgggcttgacgggacggcgcgcggcgcggcagcggcacagctcgaggcggcgatggaacgcgcacgcggcgacgggatggcgacggcgacggcgcggcagtggtggcgcgcggcgcgaggcgggacgcgacggcgacggcgcggccgcggcgataagatggtgacggcgacaggcggcgatggtgacggtggcgcgaaaacaggcgatgatggcgacggcgcgcggcggctggcgacgatggcgacggcgcgtggtgatggtggcgacaaagagagggggaaagaggaggagctgggttaggggaccccgtcgaacaccttaggtgcaatgaacagtgccgttttctaattaacccgattttagtgtattttcca

SEQ ID NO: 98745 - DNA, 876 bp, Oryza sativa
cctaattttgcatatatgcattttactcaatatttgtgttatcttaactaatgaattcaccctagattaatattactcatattttatttttatgtaatttatttgagttttaattaaggttaattcttattccatcgtatttaaatttaattgatccaaatatggttgcgataatattttatttatttctatccccacctaatctttattttaatttgtatttattttaccaatttgtttttaagttttattcctaattaactattctttactcacgattaataatcttcgagatcaaatccagataaaatagacgaataagattggcatgatgcaattagtttaaaaagtttttttgaaaatccgtatttttagagttttgattttgtcggtcgaattttcagggtattacatcctacgatcattggtggagaagtggttttcactcccggttcgtaacccctatatagtcccggtttttcaaccgggactacgaatccgggactaaagatcgctatctttagtcctgggtgaaataaccgggagcaaaaatcgatttttagtcccggttggtaacaccaaccgggactaaagatactttatctttagtcccggttggtgttagcaactgggactaaagaggcagatccggttgcttctttattcttttcttctcttcattatttttcattatttttaatatattgatttcaccctagccctatcccgtccctaaattcccaaaacaatcatcctcaaattgccttcaaatccacaaatcgatcatctcaaatacatcacaaaatctaaaaaaaaaattacatcacaacttctacaaaattcaaatcacatatccacatctcacacaaatcaaat

SEQ ID NO: 98746 - DNA, 698 bp, Oryza sativa
ccttagaaggccggttttatgtccaaaactgatggaaattaactcttctcataactatgctacagtatcaaacttttaaactttgaccatggtttttaaagtaaattttataaaactccatctagtatagtctaggttacacaaaaatacatgaattttggcatgtgacacatatcctcgcgtattatggtcataaagtttcacacagtcgcaccattaaccattttgacatattcctatattaaaatttgactctctcaaatataacttcaatctaattcatatcctaaattgcaatgccagatatcttgatcttcaactattaaagtcagtgttatttgattccctcagcagttttgaagggttgtttacgttgacgtggcgctttagttggtccaacctgctgagtcatcctatagggcctacctgtcagtgacccttatatttcttctcttcctttggcctcttctccactaccgctggggtggcctcttccaccgagctcatccatggcgcccacgattgaatgcaagagaggtaggggaagaggagagaatagaatgactaacagcttcttggcctactcgatggcgtagggtggtcgaagtgaaagagatcaaagatgttgtcggtcagtcggtgtagacgtggataggacggtcagggtgctccatctccagcagtggcagcagtgtctg

SEQ ID NO: 98747 - DNA, 651 bp, Oryza sativa
tagcttatctgggcaatgatcaatctggccagctattgaccaaaccaaacactggccaatggtcaattagttagcttaccaatgccattaatttgagcaattgtgcctgagctagcatgcaagtgacgtaggttgattaagaaattcatgtctccaggtaatttaccaaatgtacagcctctcaagccaagaacctgaaggtggcacaagctgcatactgaattaggcagtttcgcgatcccagtaaacgagaggtctaaatatctgaggtgtttcgttgagctaataacatttgaaagagcggacgtccgtcccagccatttgtaactccttgaagagaaggccagtaagcgtaggcttttggaattacacaaaaaattactaagagggagatgagtttcattattgctgggttgatgactgccgtcaagcaacataaaagtgcgcaattgttcagttttaaatttatctggtagtgtatctagggcatccatgtcaactgataaatagcggacatcctgtgaaacacctctcaccttattatcgttaccatggtattcatcagaagaaaaagcacttgcaaaatcccagaccaaatcatgcataatgtattcagttttccttgctgatggctgaagaaaggccctattg

SEQ ID NO: 98748 - DNA, 694 bp, Oryza sativa
ctctctctctcctgttccgttttgtctggacatgacagttgtacagtttggcttctgcatagagcatagtttaactggccaaacagatcgatcgatcggctctatcaggaaggatgcgtcttaattgctagcctgattagttttctgatctgagggtgtaatcatcgtgctaaactatactcaccttgtctggcagatagcatcgaacagattacagtgatgatcccaccgtcgctacgaggcaacagaagaagcaaccttttttatgtccattgtaagagactgagtaaatcctaaaactaatggtttcttcaggtaatcggtgacagttcactggaatatgcggaaaatatataccccaaatgctagctatagcatctttggatcaaaggaaacggcatgaaatcaaaatcaaatttaaaaagatttttttcttttttttagcggttaaaaagattttttttattacacagcaaatgtgcatatgcacaacactacactcatatacccacaaatgcgcctggccctaacacaagctaaagagaagcaaacaagcggtgcatcccttatctcactagattcctattgagatttctattgaaagcccacttaaatatgtgtaatattcataaatttaaatttaaaaggatttctaataaagagtgtgagggagctagtaaaaaacagggatcca

SEQ ID NO: 98749 - DNA, 587 bp, Oryza sativa
agagaatacaaaagagaggccaccttcccaaaataacagcaattgaagtttgcacttgcaagaaacccaaccgaaaaccagagcaacctaaagctaacaccctagctcatcaacaaccatatcgttatgcaaacttggaaacgccagagtccacgccggagggcctttttgccacaagcatgtcagctatggattaacggcaaccaaaagactgaggaagtcataaaccacccgcattaagccgtcaaaatccaacttaatcttgttgctgcttggatcagtgcccgccgacaccatttgggggaaggaagcctcagagaagggagggccactaaaggttgcggccatagagaccgcccgcatcgagtcttcttcaatccgactataacaaattgctagctagttccacgccctccaacgcccttttagggaaggaagcctcaaaggaaggagggccgccgaacaatgtggttgaggacaatccaaggaaataaggtggagacgaagagggagctggacaaaagataagtggtgcaggggggaatcccacagctgaaagaacgtcaaccgcgtcaacagggaaggct

SEQ ID NO: 98750 - DNA, 542 bp, Oryza sativa
gtggatcccccttttaatgctgatagataggatgaatcattggtttgcacagcaatctatatatgtgttgtgcatgatcttgatagggggcatgactagtttctttatccaattgtcaggacataaatagcgatgtgcttcaagggaaggcaaaggagaaaaaggtaatctttttttgtgtttgtggtttgtgatcccacttgtgtatacttttgctcctctttaggtagtggtagggctgtcaagcaagttaattaagtatttctgaaaagtggaagataccattcaagtttgttaatttgttcttgttggttatcatcagtttatacttaatagattaaaatactgcagcccatggttagtgcattatagttatgcatgcatgctgctcctgaaagagacttgaagaaaaaagagaggatcaggaaatttatttgtttttaatccttaaaacttgacttctgaccatatcaaatatgcatcgtgatatatagctggtcatttcttgtttcaatatttgtagggaggatatagaaattaaa

SEQ ID NO: 98751 - DNA, 745 bp, Oryza sativa
acgaatgtgaattgtaatgtgttatatagtactagtacttatcattatcctagtaaatagtgggaatgtgggatctcagctgttgctactaatcctcgcttccttggagaatcttaaggatttgatttaatgatgttgtccatgttttaagctcagtggtggcaggcaaagcgcaggaaaaactccagctacagcttcatgctagcctgtctttgggacaaaaatcattggaaatgcaactattactccaactagtcaacagcaagaaaaggctccaaatattcagtgcagataattcaatataagaaagaatatgctgttcaatacaagacagaaacttagcagcatttctatgctgggaatattaatactatgggggttgacacatactaagtatgatcttagaataaaaccagagagatgtatgaagttaatggcaagccagttcataggatagcacggaataataatactatcaagtatgtcctaaattgcaaaatcattaaaaaaaatgcagcggaaaatagctttttgtacctatcagcaaaatgcagggtccagcagtaactggaatattttatgccacagctcatagatattaggtgctatctgggaacaatctaggtggaccattagagagtttagtctttaggtactacaaactagatatatagaaggtagctaatcaatgtgattgctgaggttagctgttgcagccatttaaaaacatggataattttggatg

SEQ ID NO: 98752 - DNA, 616 bp, Oryza sativa
cgcaccccctccaccacgccccatcgtgccaccgcgcacggcattgtcgctctcctccggccaggtccagaagcagggtgccggatccagccacgggggcgccagatcagaagcttcgcgccgcgccgatgtcagcccccacccatcacgcgccacgtcatcatcctcgcgctgagccgtcgtgttgccgaggaatggcctcgccgccgccctcacagctggcagcgcggaactccggtggtgcgctccggcggcggcgaggggagaagaggaagggagggggcggcgggggctagggttcaccccctgtgccgctcgcgcgagagggcgacgcggggttgtgccggcttcgtactcttccaattgaggataagatgaactgatgtgataagtagtatgagattgtacttattttaaaacaaaatttgaatataaaatcatacttattttaggaggatgtagtatttgggacttggcagtaattttactgttcttggtattagaaggtaccatttattttatataaaacttggtatttctcgaggtataaaaaacatacggttaggaccgtaacgaactgtgttagctgtaggtttgcatctgttcccaaggtgat

SEQ ID NO: 98753 - DNA, 668 bp, Oryza sativa
tgttggtctactgtgcttcaatatttcaatgttattaggagcttatttaagcataccatatcaatgtattcaagtatcatcgtctgacatttactctagcaaggattggctttctgctgaatcaagttttgttgcttaatgctcattgaatccaatgtgatgcatgtgtttatattttgcagcaattttatcttacgacagttctatttcccttagtcctcagtatccctttttttttgttatcttaccagctgtctgttgattagtagttagcaaacatagagcgacccactttaatgacttcccgtgacatgaatatgacctcgagagattagtctagtgaacttattcagactgaatgttgtattgttaactgtactggcgtttggtcagtatctttcgaaagagattgaatgtagggacgtaattttattgcaagataattcatttgttcttgtggttcagtatcttggaaggtcttgtgatgttagtgaattcttttcgtagcattgcagtacttgctccgtccttaatgcatgattcaataggctacgcaatctcgtttgtagcaatgaattttaaaaatttggaatcgctaactatcgtttgacagatttatgagccttccataatgggggatccactagggctagattaaaaaccccgcg

SEQ ID NO: 98754 - DNA, 545 bp, Oryza sativa
tcacctgatgtccctcaactttacaccgagttttgtttgtcatcccttatcctcaataccacaaatcttcacccctaaatatacaaaaccgttcaatttatatcccatggcagtatagatgtcttggtttcgctggcgtgacatcttagtcaacaaaatagaaataaaataatacgtgagtctcacatgtaagtgaaatagaaagaaaatgtgagacccacccatcggcaacgctgtcgttgggatgccgcagcccgaggacgttgtggaacgactccggtgagggcacgaagacggtgaaggcggggtctcccggtgaaaccccaagcgcatcagcgtcatcctctcccggcctactccgtcctccgcgtcatcgtcccctacagcatccgccgtcggttccatctgccgtcgtcctctacaccccaccgacgccacctcgctctgcccgacacagcacagcgacgcccacaccacaggctctctgaggcgtcgtcgctcgcccgtcgcctgctaccccttgcctgctccgcacaccgctgctg

SEQ ID NO: 98755 - DNA, 563 bp, Oryza sativa
ttataacttcgggatatgcataccacggttctcaaactagaaattttctacatcagcattgcctggctcgctttaagctatttattcggtttataataatttaggagtgtaatatttaattcattactataaacaattgtcaataacctatccaaatcatgcatgaagaatggaacaagtaatacaatgctacgaaaacagttcaataacatcacaagaccaaacattgctacgaaaacagtttcactaacgccacaagaccaaacattagtatcgaccttctaagataacaatcacaagaccaaggcctatctttcaattcacctccatccatagtattccataccttccatctcgttacgaagatattgaacaaaacatagtatagttaaccatatacgaaattcgatctgaaaaacggaagttcatcagactagcctctcagggattcatgtcacaggaattcgtttacgtgggtcgctctaggattgcaaactcgggtaagataacgaaaaacagacactgaggacttagggagataaaactgccataagacaaaagtc

SEQ ID NO: 98756 - DNA, 568 bp, Oryza sativa
tttacttatggatttgaacaatttgctcgtaccattaggaagacaatcccttaaattagccataaataataccccattcgttttaaaatataaatatttttaggatttaaaatttatacctcaataaaaatatttctacggcacttatttcaatacaagaaaagtccacacatttttaattcaaattcaaattcaatcgtaataggtgctaaacaacccttttactcactttgtttcataatatattggatatgtttttcttctgtgcaaaaaattaagaaaatagtataagtaagtcatggtacaaaagttgacaagtgagaaataaataggaaaaaaaactaatataaaagttactaaatgtttaacaaagtttcttatatttcatataaacgaaaaggcacataatctcttatactataagagggatgaagtgttttggagaactagggagggaggtaggcctagtacataactcgaaccctactcctatctccaaaattatggccttgtttagtttcctcttttttaaaaaaaaatcattagacacatgcatggaacattaaat

SEQ ID NO: 98757 - DNA, 512 bp, Oryza sativa
ggaggatgtagctggtgaatggtttgatgaactagtcaataagtgcttcttacaaccgacagtttggaaagcttggtatattatgcatagttgggttagagactttgcaatcgccttatcttctaatgaatatcagggtgttgattgtacaatgggaaatctcccacgaagtgtacgtcacttgtccgtagatatggatgctatgaatataccatggaccgagtatagcattaaacagttgcgatcattaatattattcggtggcttccgtcataacaactctagcaaaggtttcaacaacatttacaacattttggagggcagttatgatgctgctgatagcatttctgagaggtcttataacactactgacaaggacactgctgataacatttctgagtggtcctctttcagttttgatgatggggaagttgatatcgttgctatcattttgaaaaggtattgtgacattattggtagcattctaaataggtcaacaagcttgcgcttgt

SEQ ID NO: 98758 - DNA, 602 bp, Oryza sativa
aaccctttaattggagtatatgaatttttagaggaaatgcattgattcttttatatttttatttgttaattacatgctacatttgttgacaagtttgatcaaattatgttctttacaattctcagtgagtgagacattttaattttaggattaggatgccgctattagcgacatagtacataaattttagaacaaacacaaacatcctttttaattctaacatatttaaccttacaaactagcttagtcacactctttattagaaatccttttaaatttaaatttatgaatattacacatatttaagtgggctttcaatagaaatctcaataggaatctagtgagataagggatgcaccgcttgtttgcttctctttagcttgtgttagggccaggcgcatttgtgggtatatgagtgtagtgttgtgcatatgcacatttgctgtgtaataaaaaaaatctttttaaccgctaaaaaaaagaaaaaaatctttttaaatttgattttgatttcatgccgtttcctttgatccaaagatgctatagctagcatttggggtatatattttccgcatattccagtgaactgtcaccgattacct

SEQ ID NO: 98759 - DNA, 867 bp, Oryza sativa
actcccggttatttcacccgggactacagatagcgatctttagtcccggattggtactcccggtttggaaaccgggactaaagggggttacgaaccgggactacaaagggtttctccaccagtgtatagtgtatgttaaatttgtgtcataaattggaggggtcataaatttctgccatttaacatagagaattttgtccttatataaatatgagacttgcaatagcaatgcgtgtggtttgcgaaatttctaatgggcgattgatcgccccgcgtgatcacccctcctcacgtgatttccttttttggcaccgcattacttttctattttagtaaatttatgcatctaaagtttatacacctcaagtttacacatctaaagtttatacacctaaagtttagagacccaaagtttataagtcaaaatgcccgattcaaatttgaatttaaatttaaatattttatatatatattatttctatatatctaaagtttacacacctaaagtttatagacccaaagtttttaagtaaaagtttatatatccgattcaaatttgaatttaaatatttttatatatagtatttatatgcatctaaagtttatacacgtaaagtttacagacccaaagtttataagtcaaaagttgatatacccgattcaaatttgaatttgaagttaaatattttttatatagtatttctatacatttaaaatttatacacctatagtttatacatccaaaatttataagtcaaaagtttacatacccgattcaaatttgaatttgaattcgaatattagtttatagaatcaaagtttataagttgaaagtttacatacccgttttaaattgaatttgaattc

SEQ ID NO: 98760 - DNA, 569 bp, Oryza sativa
gtgtcaagccacaaactatactgccttcctaacataggtgtagtaaaccaacagatatattttaaatattatactattttgtaacacattttgtaacacgaagtggctgtagtttagtggtgagaattccacgttgtggccgtggagacctgggctcgaatcccagcagccacactatttttttaattttttcttaacactttttattttttatttttacctttcagtcattaacactttttaatttttttcttcagtcattagccaactaataaagccttgatttgattcattagccaccctttgattcataaactttttgaaaaatatattttgccttgattggattcaatcattaacactttttaattttttttcagtcgttagccaactaataaagccttgatttgattcattagccaccctttgattcataaactttttgaaaaatatattttgccttgattggattcataaactatttgtcattaaccacgctaataaatccttgatttattttcagtcattagcattctttcttgatctttttcttcaggcatcagccacac

SEQ ID NO: 98761 - DNA, 1430 bp, Oryza sativa
cttatatgggggccatattctattagcccttcaaacatactagtagggaaaaactcaatgatttggctctgaaatgtcaaaaggaaccccagaagtgctaatttgatttacgccgtcaaaaacgaattcaggtataactttcaacaccataatcattctagctattatgaaaacacaagccatgtgcagaagttgtgaggcacataatctgaacatcaattttcattcagacaatgaacaggcagatgaaaacgagccaacaatgtttctttagagaagaaacaaattacttgtttatcactcgatcggttagatgaaaactcgctattccctacagaagaaactaaatgctttacagtgctgctctatcttttgtttcagtcacaagtcagaatattaatcagtctaggccacttaaaattcgatgtaaacgttgcaaatatagtaccgataaaataagcaaattatgtctatgtgaagtcgttttagcaaccatgacagatccctttcatgtcttatttgtttgcatgcatctctttcaagtttactattgaaatgttctctctttttaggtgcaatttgtacctccatagtccatactccaggacagattctaaatgttgtacatttgccttctcagtactcattcaagggacaggttttgttttctatttctcacttttccttttcttccagaggaatgtctgtttgccagagggcatgcagaaaaccaggagatgtggctgccatgctgccatgcaaagaagaagtttttgtcaaccacaacacatgggcaccaatcaatcatccattagaggtgtggttagtactactctactgctcatcagcatgtcagccatcctgtctctacgattaatcttgtataggtaattaggctacatacttatagcaccctgtgtcatgtggtcttcacccaaaatgccgtagctgatacgttgttgatggggattgggccactgtgttatgctcccatgacctgaaattaattatcagttcgctgaaaatctgaaaccggtgcttgtaatctagttagaccaagcaaaatgcatgccacttgttattataatgaagtggctttgataccatcaattaactacactttcaaagcgaggttactaaactatattgatcttcttcttaatccataggaaattaaaaaggctcaagtttgtgtcaaaagatcaaaacagtggacataaatctatcactcctccccatacacacaacacgttttggtctgcacgttgtcgaccgtggcccgatcaagtactgatcagcaagcaaagattttttgagagctaattaatcatggtgtcttaactagtactgatatccatctttgaaaacctagttaggctgtgatcgaatgcaattaggctttaattaattaagctgtcatatggtacgga

SEQ ID NO: 98762 - DNA, 687 bp, Oryza sativa
tcttgatgctaaaagaatttcattctaaggagataaagtggataaacataaaggcagcatatatgtgcaatgaccatgcttgcagcccatgaacaagtagtggttagggagtagctttcatgaagggagaatagttaagtgcttgactgttgccaagatttgaaagctaaaggacttattaacaaaccaattaaatttttaagggctagatgacctccccctaatttggcacctttagcttgtcccttcatgcatgttaaaacattattttctttcaccatctttcgtagccttatcaatcgatcttaggagttaggtttgcaagcatgaagtcttgagagctacacctatgtatagccttttcgtttgtacgtctcatgcatggttcatcttgttactgtctgaacacttgactactgatccaaataaccaattgcccgctgtctagatcaaagaaaagaacgaattctacgtcgtcaactactgtgcgatgttaattaatctgagatttcgacattgctaataaatgaatgtgggacatcatatcgtgtacttaaaatgaaaaaaaaaaggttttgagaaatatattgacatgcaattcttttgcgcattcgcgaaaaataatgactgaaagtacatgatgttattatggcaaagaatgctctatcctcacacgcttggaggtcc

SEQ ID NO: 98763 - DNA, 1628 bp, Oryza sativa
gcaagtggtgaaattggtgaatggtgatcgatcgcctcgcggcttggagtggagaaggcgctctcgatcagatatccagatcgatcggaactagcaatgggtgatcgtgctgtatgaattaggaaaggctcgtccaagaaaaatggtactgtaatgttactactattcgacgaatatgggcaaagctcccgttttcagggaatcgagaagacagacacatatgctatgctatacaacttgcacgtacgattgatcgattccggatcgtactgacgtatttgtaacctactcgatctctcactctccgtgccgttggaatttcgtgctgtcatttttcttttaagatcggtttaacccgtgccatcgatctacccacacacacacattgccgactgctacccatcgatcgatcagcgctgggaggtttagtgatcgtcgatcgtatatatgttatgtacagcttggtagctgcgctttagtcttactcctagctacgtgccgtgtttcgcttgcttgctactaggacagtacagtacgtactactagctaggatgaggagcaacacacgcacatcatcatgccgtacgttttgtcagctgtcgctgcccacaccaacccggcatccgcgcggaccagcatcgggcggccgcgccgtccgtctgcttccgagcctttccttccgcggccatcggcgcatgtgctatcctgtcacctcgcgagctttgttcgcatccgccccgccccgcccaaccgcagctgcaacctgcagcgcgcgcgcctctgctgcggccggagattttttttttctctgcgcggcgcgcgcgagcgccgtgtgcgggtttttcaccaccaccacgcgatcattcgacgcgccacggcgtttcgatcaaggcgtgcgcgcatgcgcgtcggtttccccgtgcgtgttgctgtttccatcggcgagtcgtacgtacgtacatggccacgcgccacgtacgtctcgccccacgtggaaaagggagagcaaaatgtgtgtgcagattatatatatacgcggatcagaagtgaggtcacggtgcgtgcgtgagcttgagtatatgtagtcacacggaaatcacgtatatatattcagctgtgtactcttgtgtgtgtgtgtgtatgtatggcagtatgggacgggagactgtttggcatgcactttggtttcaagaggctggcggtaggtagatccggccaagtttactcgtggtgctagttacagccacatgattggggtatgtactgttgtcatacagaacgttctagcgagcaagagtagcactactttgctagtgatcttccaaaaagaaaacaataagaaagaatagtaccctctagtagtatattagttgtactaacttgtaagtaataatatgctttatcaggccacgaatataagagataatatgttatttaagagagtttaaagttgagataaaaatactttatattcctaggagattttacttcactagaaaagataactattgcttgagaacaggagtagtatacaaaagcacatataggcacaactaatgtacacatgctcaacttgattatatttctagtcccatttttcatcaaggatgtgagctcatcgtactgat

SEQ ID NO: 98764 - DNA, 559 bp, Oryza sativa
tgaataaagcaaagtgtggacgtatcatgccacctttttgcccatgttatatacgcatgtgagattaacaatgggccaacttgacatatattttcccattaaatcttgtaattacaaaaaaaaaagatggtatacaaattaagtggcaagccacacggttgtagccatgattagtttacataagcataattttcatagatagcggtgctaaacatgatgggctatcaaaacattgtgtatttttatggtggttaattcttaatgctgatagataggatgaatcattggtttgcacagcaatctatatatgtgttgtgcatgatcttgatagggggcatgactagtttctttatccaattgtcaggacataaatagcgatgtgcttcaagggaaggcaaaggagaaaaaggtaatctttttttgtgtttgtggtttgtgatcccacttgtgtatacttttgctcctctttaggtagtggtagggctgtcaagcaagttaattaagtatttctgaaaagtggaagataccattcaagtttgttaatttgttcttgttggtt

SEQ ID NO: 98765 - DNA, 642 bp, Oryza sativa
gtgtgtataactagttggtaaaaaggtagttttatgttagagaatatattatttcctttggtcaaaaatattttactcctagagaaagattcatgcaaacctttaaaattcctaaccatcaataatttctcaaacacttagtttgaaaacgaaagaaatgatatatgtagttctgcgtcaaaaagaaattatatttctcataataatatgaacttatattgattattgggattttaaaatttgactgaaccttatcataaactttttttttactagagggagtaccccggtaactaccaagggcaataaaatttctctaagataaaaatctagcaaccggtgctacaatttgatttcttaactggacggatgcagttgatttttttaataaccgaattcaatcagttcccaacacttgtaggtagtggttgccaagataatcacaatgtatactctacattggactacatcttgcagtgtatacattttgatctctagtgtatagacacgttgggacctaaccttagttggtgatgaaacttgtatagaaaaatctatttttctatgaaatacaagcaatcaaatcaatcaagggttggtgccgactccttttctgaaagagaagtaacctgaatcaagttg

SEQ ID NO: 98766 - DNA, 1113 bp, Oryza sativa
ggcggcgccgttcggggaggggcgcgtaggtggcgccggtgggggagaggcgccggtgggggaggggcgcgggaagacgacgccgatgagggagaggcgtggagaggcggcggtggggagagaccgagagaggcggcctgcggtgagggaatgaaggggaaaaggaaattagggttagggtttgtttggttcggggttttgatggattaagagccgatctgagccgtacatcaaaacgaacggctcagatcggtcacgtcgggccgcacgcttaatggcagtgagaggagaagtagggggaggctagacttcttgctggcgcagacaaatgtgcgggttgaggtggaggagagaagaagggaggaaagtgggtcggctcagctatgggctaaagaataaaatgtactgaaaatggcctagagagaaaggaagattgaaatgatgttcaaaattagcttatgcaaattccaataaaatttcaaagattgtatttaattatggagaatttaataaaattaattccacccagtagatctacccatatcttcagagtccatattgacttgcaccgtgtaaaggtggaaatcaagccggctttgtctttttttttatctccctttcttcgaaattatttgtgaaaaataatttaatatgagctactatatttctctctgtcatttgagactttttctagcaagctaaaagtaccaaagcagtgtgaaaataactttggttaaaaagaaatatttttagttttagtacaccgtagtaaatcacggctattttgctagtatgtactccctccatttcgaaatgtttgatgccgttgactttttagcacatgtttgaccgttcgtcttattaaaaaaattaagtaattattaattcttttcctgtcatttgattcattgttaaatatattttcatgtaggcatataattttacatatttcacaaaagtttttgaataagacgaacagtcaaacatgtgctaaaaaatcaacggtgtcaaatattttgaaacggagggagtattaaaaatataaaaagaaagccttaaacagcccaataggtaaacaaacttctcatttgggcctttcttcacccttctggt

SEQ ID NO: 98767 - DNA, 694 bp, Oryza sativa
gttgcgtgggcttttcttctggttggaggtaacttcatactgttttgtgcaatgctagtttttttttttttttttgatcaagggcttgtcaatttgtgcaatgctagtaattatgatgttggagaacttcatagtgtctagctgctagtattcacatttccatccctgttaagctctcaatatatttgtgtttacttgcacaaactactcccaatcagagcagattatttgtttttggtagagttaaagaaccatattttttagtgtaggtttacagtttgtctagccctgtgatgtatgttacacttggactgctacgtgctaaatatggggctgggactaatttctgggaatgatgccaaatgtcactagtttgcttccttttgcagcattagtgttcgtattatcttcgtactagcatgcagtggcataccatttggctacatgcttgcgcaatagtacgattttttttttgaacatttactctagttctttgtagttttcttgactgtgtattgttttgtagaatattgggcaagatgatcaattcaggccgtggagagacgatcacaaacgctacaaaattatgtctctctgagaacacataacaaagttcttacttgcatgtgattatctgcagcatctcgcccatcattgttgtaaatacgtacccagtaaaaaaccgtagaatgga

SEQ ID NO: 98768 - DNA, 722 bp, Oryza sativa
ctgattaattattcaactgttttactattctcttaaatatttattaaatgctgtttatgcaaatgagctattttatgccatcctttgttatcctgtgcacttgcatatttgctgtgtggcttgttgagtatgtcatatgctcattcttgcaatattcattcatcagaggaggagtacttcagtgaaggtgatgatctggaggattaggcttgttccgggttgagatgcctgtggagtggagttgccatagctgttccgtagtttgctttagtttattttattttccgctgcgtagaatgtattctttgagaggaactatccacctctgtaataatttattatttgcgaatattaaatagttatttatttgtactctattatcaatttgttattgtgtgccttggctgattcctggacgagggtttaacacacatgtaagcgtttggaattttggatagaaattccgggcgtgacaactttgcgcgagggaaagtcgatcgggccgagaagggaggggtcggcccgagagggaggagggaaggagagaggggcgagcgggccaaggagggggaaaatatcttgggccgaaaatggcccaaggaggaaggggagatttaactttggttttcaatttatttaattgattaaatgaactttgtgacttctaaaattatttcttgagttccgaaaattcgcggaaaaatctggagagtattttaggt

SEQ ID NO: 98769 - DNA, 589 bp, Oryza sativa
cagcattaagtatgaaaagaagaacaatatctagacaatcaagccgctagaagtttcatagagtggtagatatcttatataatctgaatcaacgtcaaaatctaacctaatcggttgctctattcgatagatgttagccgattgtaagttagatagtgtcacaccctgattttcgtttcaggatttataaattatttaataaattattatcagaatttatattaaatgttcattaatttacaagtgaagttaaatgtgggaaataaaatttcctaaatataaagcatggatggatttaatttttattaaattctccatggttaattatactctctggaactttctcggatttttcggagctcaattcctaattttaatcatacaaagagaagttcagcaattatttaaatattaaattaatcattaaatggtctgattgtaatttttttaagtactttgagtgtccaagtattttcaggttttttttcttgaaattatttgagcattagaagtatttttaacaattcaaagatcatttcagtgattaatttaattggaaaagtaattaaagttcaccttttccttttcg

SEQ ID NO: 98770 - DNA, 731 bp, Oryza sativa
aaacaattctatttgtggtgctgggtccacatgcaagaatacagaaggtagctatcgttgtgactgcaatttcggccaaagacgtgacaatagttctgataacatgggtaattgtgaacccatattttccagagctgccatagcagtcataggtgaggttcaatacatgaatgcaatgttgattgaaatttgcagcatgccatacattccacatataatatataatgctctaattacatgcagttctgcattccatgtatacaccatatttgcattgcactacattcaacttgaagctcaacattgaagtgtgaaaacataattatttccagatagaccatggctgtgcctaaatgttatcttttcgcatgagcatagaccatgtggttgtgcctaaattatcttttcacgtgagcaatatatatggactacgcaattgcatgaatatgtataagttacctttgcagtattgcatgttctatatattaactattttgtttcctatttgtccacagcaacagtttttatcatcgcacttctagtcgtgttactaatgttcattctattggagcgtaagaaaagaaagctgagagcttatttcaaccgaaatggtggacaattgctgaaaagtatcaagatagatatttacacaaaggagaaacttgaccaaattactaaaaattacagtactattattggaaagggtgggtttggtaaggtgtacatgggaa

SEQ ID NO: 98771 - DNA, 3762 bp, Oryza sativa
tggcacacaaaataagatggactattagcatatgattaattgatcattaattattatatacttaaaaatggatataattgatttttttaagaaagttctatataaaatgtatttaacaaaaatatactgtttagcagtttgggaaatgtgaaaaaaaagaggaagttgctcagtccaattcctgaatcaaactcagcctaagccactcctttttcaaagctaaatttttagacctcacaaagattaatctatctattagcaatactacaaacatatcttaaaagttgccaccatgttcactttagaggttagaaactcaaagtaaaagaggtagctaaaaacattctttccaccatgtttgtcttctatactcaatttctccagatcaagttttctttaatttgctggcaaatcagtttgacaattggccatcgtcctcttatatatggttgtgcatagaaaatatgtaccactaccatgatccattgtgatgagaaaggcagtatggcaacaactatttatacctagccgatatcaacttttaatgttagagctggggaaacttaactatagctagtagtatataattgctataaaatttctattataattttgtaattataaagatattaaatgaaccatttcgtcccctctcgactctcgaggtggccacgaagtggatccaccagatcatagaagttctctcagtcatgtttgtgagtctttcttttttcttttccacgcacagttaaaataccggcaagcccaattacttcatccatttttaataattgacattatcagtttaaacatgccgatcctccctctgtcccactcaataagacacgcatgaattttaagattcaactatttaaacattttatcactaattattttattataggttaaattttatttaataaaaaaattatatcattggattgatatttaactttatttttatataattatagttttgtgctataaaagttatagtgctatatgagaaatttaaaatcgaatattagtttggagaccatgtcatgtttgatcgtaacttattcagtgggacagagggaatacttctcactctaaatttaagtagagtaaccaaaatactctcaataggtaaataaaggggaaaaagcgcagtaaacttgcatgttagggtgaattcagagaaaaaaaagacttgaaaagttgaaagacgtgaattgccaagtacctaaaaccaaagataataatcgagaacatcaattattcgaaaatgacgggcaatctcctcgagcaaataagcattaggctcaaaccaaccataatggctaatgatcatccgacatggatcgcgtctaactttccctgcatcgtcttccgagactgaccatgaccatgcccaccatcatgacttgatgagagcaggctgcgacgtcgtttgatgagaggagcgccaggcaagaagggcagaactggcaaaggtagaaaaccgacgaggctgtggctgcaggggcagcgccgtcatttcgtgtggttatctctccgctctaatctgataaacggaaaatccaacagatacattcagaagcatcatattccaacaaatatcatcgatgaaattaatttttaaaatatactactccgtttcataatataacaatataatactagataagatacttcatagtaaaacgaatccggatacgaagatataacaatctagtaccggatgggataattgatagtacaatgaatttagacatgtttcatgttcggattcgttgtattatgaaatgtctcatctggtactaaactgctactccctctatccccacaaatataaggttttttatctggatgtgacatatcgtagtaggatgtgtcacatctaacaaaaaaaacccttgtatttgtagacagaatgaatatattagggatggaagaaatatcatacaaccgagcgaacttatataaaaataccattgttgttagggttcaatctatttatggataagttagtttgtagcatgatatttcttgagagtttggtttgaaggaattttttttgaacaggaaggccccattgtttcctccatgcaacatcacctgtttggccgttgccaaaatttaaattttaagactcaattttgatgttgatttgagaagtttttttatcgaaatttgttttttagctttagtatttaagttgctaagaacacatacatagaacgtttatctgattattcttttgctaataagtcaaatgacgtattatctgtatttggccaaactaagcaagtgatcaactgatgatgaggttcccacgttggcacggacatggtgggtggaaagccaatgcccactggggaagaagaagggtgctgttgaagcaacaagcaaggaaggaagcagtgtgtgagggtgaggagtacacgtggcgcacaatggaggctccgccacgtgggtgccgcatgcggtggcgcgcgacacggacgagacggcgacgcacggggaacgggacggacgggggtgtggagaaacggaacgtgacgcccgtgggcccgtcggctggacctcttctgggttccacacgtgcccgtcttcacgaaagtgctagccgtgtaccgttatcttctctatatgtttttcttttcctttttcgggagttctacgtacagtgacttttaaagaaagcccatccatttcaggaggtagtacttactatgtccaaaaatattcatcattctattttgtttaatatcgattaagatttaagaaaactaaactatattatctattattaaataatgtatagctggaagtaggaaggtattccctccgtttcacaacgtatactttctagcaatgtaagacatatgtatatatgtttagattcattaacatctaatgaatgtgagcaatgttataaagtcttacattattaattatatgaagtaatgagagatgattaatttgataatttccgctactctaaattcaaattttacatctagaaagataagtattatagaatgaaggtagtaactctttcgaaagattaggtgtgtaatatttctttcatttcttaacttatactctcttattttttgcatgcacgtttctcgaaatgctaaataatactttatttttaaaaaatataaaaatgatttaagaattatattaacctattttcaattttgttaatacttaatgaatcatgcgctaatttgtcccgcgttttgcatgacgaggaagagacgttcaaaaagaacatagcctaaggagcctcatttgccccaaaatttgatttctagaacttaattactgagttgaatttatcgtatttttgaatcgttaaaaacacatataaaaagaacttaattatagagttgattttatggtatttttaactcttttaagtcgttaaaaacttatataaaatttttactataattttttattgttaattaatcatttaaaatataaccagttgttggccaatagagagatgacgggctggctggcatgatatttttgcatacggactcttaacatgtatgcctgcagaaatagcctattttcttaagggcatatacgaaagtagagtctaatatgagctttctatattaattaatgtcactaaagattatcctcttacaatagtagagacaataagatttctaaaccattaatacactaaatgatttttggttatacttctttccttttctccaccctcatataacaaattttccgttaataaatgct

SEQ ID NO: 98772 - DNA, 502 bp, Oryza sativa
caaaaacccaaaatcaccaaaatttcagtaattttggattttttttggctgaatttttttaacttttaacatattttgacagaatttaaacaaattttaaccaaatttacaaatgtttggcaaacaccgaaaatttcaggaagattttgaccttgctgttgggggccgaaatttcgaaaattccaaaccatggcgctctatcgccgttaagccgcggctcgacgtgtagtaaaccggcgactgctgggacatcagtgagaagagcttggagaattgaacgagctggtgctgacgcgcgtccgctacgggaacatcgtcaagctccaagtacggcttctgcgccatgagcgggtacatgtacctggtgtacgagctcggcagctcgccgagagaggcattgttagcgaaagtagccattgtactgtagcgaaacctgcaaactgaacgagctaggacgcgagagagaagaacgaacacgacgaagtactccacaacgctgatc

SEQ ID NO: 98773 - DNA, 703 bp, Oryza sativa
tgcagccctaactaatctcttctttgatttgtagacaacagaatcctcccctcctcgtcaaagcaacagtggcagggacatcacctacaccccaggcttaattcctaatggaggtgggccatctcctcctgtcatcggctatgatgcccccaagacttcagctcttcttcaagagctcatcagagaaccagccgatgccggcaagaaaaggaaaaccagatcatcagctgtagatacttcagccctggctccaaagaagaagatcaaaaagaaagcttaaccagctgatgatctgcctgccctagatccatccattgaacaagctctggataaagaagaaatcggagaagatgttgatcaagccgcagccgaagtaagcgatactgaaagaacaccatccgcttcacctaagcagacccctccaactccttttggtccaactccttttaccagagtaagccaccttctctaaccacttttgtaatcatcttactttatagccgattgctcacatacctggtaattgcacaaaaggaaggctgctgtgaagaagaaatcggctccaatggcatctaaaccagctccaccggtacaatagccttaattctttcattagttaatctcagccgattttatataacacttgtctattttcagcctccttcctctccttctcctcccattcaacaatcatcaagcgatc

SEQ ID NO: 98774 - DNA, 647 bp, Oryza sativa
aaaatggaacaatgaactgaaatcagaaattgaatcaaggaaaaaattgcctaaaatctatatgggagaccaccgcctattttggtgcaggctagcaagctgtatatcttacttaggtaccttatttgtcaccttttggttcatatatattttgtttattcgagttacaagttcatagctagtgctttattccattatccactgaattttttggttgagaccggaatttccaaaccatacaggaaagttccaatttgaaccgaaagttctcatttttctaatatgctatgaagtgtgataatttttttaggaacgcctattcaccaccccccctctctaggcgacattaaggtcctttcaccaatacttttcccttccattgaaatcttccaaaggattggcatgttaagtggttctacttctcaaaccccaattcttttcttgaataggacttcccctagttagtacatcgctcattaagcgtccttcagacaaagaaatgtccaaagtcagcacactcatcgctagatttactgccatgagagggcaaggattgattggggtagatgtcacttggcacttcataaaatcaaggttgcaacctacaaaagatggatctcgtgaaataaagaatctttggataattg

SEQ ID NO: 98775 - DNA, 648 bp, Oryza sativa
cgaaaactacaacactccccttcttgcaaaccaatttataactcatttaaacaactagagggactagatagagaattacttatacgcatgcggtcctctagaccacatttcatcatgaaaaggaagtatagtcaaatttgaacaaatatatacttgatgcacattatattgtcatttactatcataattgtcaataatatgaaaaatcacatcagaagggcatggcaattcaaatctagcaaataatttcttctctaaatagttgagtggataaagatcatcaaattgaatatgaccccaagtatttaaagaagatagcaatttaagctcttcattttcgctagcaatgtgaatacatgttaaactcaacacatagtggttctactataaaattaacatgttcattcactagttgtggcatggatataagtgaagcatcgcacaaatcttctttatcactagaaacatcaggcaaaattgttttgtgacaaaagtatttcaacaattgcttccactatgggttgctctaacgtagcataagtagtggacatagttggcacatcataactatgcataccttgagtagtgcagcaccattatcattacctttttcttaagacatgactagatagctactgggaggtggtt

SEQ ID NO: 98776 - DNA, 601 bp, Oryza sativa
agcaaatagcaatcgacatgtacgatatatgacacattttcagttccttcttgcagagagctgatcagagtcccttctccagtgttttgaaaccaaattgcaaaccaatacggttttcagaggtacgtacaactactgtttgaaaactaaggctcagttccactatcatagtacatagtataacactacttttccagactccaatttagcatttagagtctgttttttttttctttttttccagaattgcttgctggaataactcatatactagtacgtaaaaagtacctttggcaacaaaagttaacccatactagagtgcaagtgcactgaaatcaagtcctgataagcaatttggttcaaaggcacggactatccagtctatcaggtttcaggacaaacagacttagtaccatctattctaggttctgcatatggttatcgaaagatggttctttgcacaaagaaagctaagataagccaatcaaactcccagaatcttaccccaaatgttgccaagaaatcaagaaaggatagaacagaattttctagaacagaattttcctaccaacaaatatgaggttggggattagcatgggtc

SEQ ID NO: 98777 - DNA, 714 bp, Oryza sativa
tgagtgttagccgtgcatctcttgtcccctgtttgcataaatctcaaaagtattggcaaaactcactatctatgattcccactggaagtgcagtacccattgtgaaataatatgttctcgtttcagactatatatctcctcatcttttacttatgtatcaggatctggtgagattctaaatgttgttttacatatgttcttttttacataataaattgtgagccttttatggtctttgaggagataccacaaggtacacgcattctatagctattttgtggtatctcttggcaacagtatgaagaaagtggtacccagtatgacccaaaaacctcatatattgtcagctcgacatttgaagatatgggaagtcataatgattgtagatttcataatctacttaagattcataatatgctaagcctaaaagatcacctaatgcggaatattaggggcgctaaccattgtttgaagccattgcacttgttgcgatttcctctcttggaaccggagtgaaagaagaggatggagtctcttgaactgctctggtgttcgttggcggcgtagtagtttaagcagagatgatgtggcaggctggcagcgtcctccggcctccacctgcatcggcctggactgtaccatgtttcccctccagcggtttagcttgatcgggattacgttatttttgtgttggtgagatttgagaccgagaga

SEQ ID NO: 98778 - DNA, 601 bp, Oryza sativa
  unsure (1)..(601): unsure at all n locations
tgtctctcccccccccttctgccgctgttcatgtgggatttcgttgacagatgattaataatataataaatctgtggctaatcttgttctttatccgtgcctttctcccactcatattttctgtccctgttgggggcgtggtgacatcaagtagatccatccatgccttgtttagttagttcttggggggtttatttgttgatttcgtcggtcccaaaatgtgtggcgtcccccgttaacaggacacggtttcttgtaattaatggccataggcgttgcttggggagaaagttgatcattgctagtgatttatatttttttttttttttttctccagttggggaagtaggnaagttgtttgtattatccacctgaggttgggactctgttttgttgtaatctattgaatttctatgcaaattgcagtcttatcatcttgggtttgactgaaatatatcagttggatgtaggtgagaggcatgactgtgtatctattgtgtgtagatgtgcttcaagaagtagccgatgttagatgtttgtctatgtagacatgattatgactttgtgtaacattatgtacgaacgatagtagatatgttgg

SEQ ID NO: 98779 - DNA, 537 bp, Oryza sativa
ggggaaggttgtcgcccgccaccgccaccacgagctcaccaccgtgtgcacgccgctcacggttgccgagcccgccgctcccccccaccagatccgggcggcttgggaggaggggaagaagatgggagatggagatgaagatgggcgaggaagatggaaaaggaaggagtgggcgtgcggccggattaaatggtgggcacctattttcgcgtgcgggccacttaacatgtccgcacgcgaaaataaggctattttcgcgtgcggacgtgttaagtggcctgcacacgaaaattgatttttgtgtgcaggtaactgctcggcgccggtcccctgattatcatgtgtggtttctcttacggggcccgcctgaaaacaaaagtgtcccatgtccaggaaaatgttttgtgtagtagtgacggcatcaattttctaatctattatatgttagtattcagccgaagctctataccctactttaggatacaaggcaatacggcaacgaagtcttactctattacataatacatggattcggtc

SEQ ID NO: 98780 - DNA, 873 bp, Oryza sativa
tgtttattaagagacgaagggaatatgctaaatggagaagtttagagtgtaaatggtggagatttgaatggatttcgggttaaggagttgtagtggcgtctatcaccaacagcaaagacttgctggtgaactcttcctttgatgggagttaacactgttacagagagagaagagaaggtcttcttcttcctttgatttgtgtcgatcactcttgcccagctatgtatgcctagcgccgccgccacgtcgatttgcctcatccaattaattgcaaaaatcgattctccactactttcttttgaattttcttttcagttcagaattttcttttcagttcgtcattttttatcctgagttttatggattgcttcgattttgataaaaaatcgaaaaagaggatcacttcgattttgataaaaaaaatcaaaaaagaggatcgagtggatcaaaatatctcaacaattttggagattgagaaagattcgaccgcatttgatggagaggatcgacttcgtcatggtacggacatgagactgttcgagcagggcctacaacaatacttgtgggttgagctgaaaagaggtaggccagacacgagactgtttgagctgagcctacagcttcacttgtgggctgagccgaagagagatatgccgagcagtgaaggtagcagctgaaaaggaaggaaggaatgaacgttcggtccaaaaacaaggaagcattcggtccaaaatcaagggagcttaatgtacatgataaaaaatgtttttacccgttgcaacgcacaggtattttttttattactacggataatagatttatttattttgagacggagatagtatgctaaatggagaagtttagagtgaaaat

SEQ ID NO: 98781 - DNA, 534 bp, Oryza sativa
ctgcgtgatgcctatgcctcatcaaaactccacaaatttttattgggaaaaatttggagaaagaggacatagcatacacttgcaatgtcgcacgaattgcctcgttaaaaaaccttaattataagggaaaaaaaaccttttggggccctttttggccgccggccccgaaaacttattcaagggaaaaagagtacaatccacccaattctttgttcaatctttctagattgattttgggtacttgattttctatatcaagattctgaaatgagtcggcgaaattcttcccctaaattttgcatttctataattacccctccattggaggtgtgggacacactatttaatgaagatgtcaataatgagttagcggatgaatcttcaagactttacatgactcagttaatcgtttctatgcaaattcatgtacatagaaaagcttgggggttcatatgcttagggagtttgctactcacataactaatttgcatatgtgggatatatgctgctttaatttcataaatggcggggggt

SEQ ID NO: 98782 - DNA, 599 bp, Oryza sativa
agactggtgagtacgttatacgtactgtacatctcacgggatcatcggaacgtgcaaactaatcgaacgtgccacacacctaataagcacgcggccccagcaggtccatcctgccagacgtgcgacctaccaatttcctcacggacctcaccgatgcgtacgtttgtgtttgacgacgtctagggctgtaaaagaaaaaaaaagctgggcactcagtagccactccacaaaaggcccttgggccattttttccccaaaaaaatcgccacgagaggtgcagtataagtggctaatccataaactcacttatatattaaaataaaacaagtttataaataagtttcactagttaatcaattacacctttaaccgactcatcgtaggcttaatagttctagcttggctatagcttctgacaagtcaagtccgagcctataccaaaatctcgtgagctttgtcgagctgagctcaagctattatcgagcctgacaatatatgtattttattttttactttacaaattagtagatcaaaggatatattatattatttatatataagtattcaacacaacgaagtagtttgtatcggtgccacat

SEQ ID NO: 98783 - DNA, 549 bp, Oryza sativa
cgacgtcacattgattttcgtagcaactccgtacgagggcatcggtgctcctgaaaatattggttttatactctgtaaaagacgaaaaatttgcgaaaaagaacatatctccaaattacatggaaatatccacgagtttcaaaaaattcaaattcctataacaacaataagaaatcagcgtcctacaaggtaagttcaataatacatatcactctttgttctctctataatagccggctgaagtctaccatctgcatgtcatataataaaattttaaacaaatataaatcacaaagtgtttgctaaaatgttatcatcacattttatgactgattatagtcaagatctaatggctagttataagttttccattaaatttgcactagcattttctatttacatctatttacgtcaacttaacttacattgtaaatacattaaaattacatatataacttagggacttacgatgtatgtacgtgttaactatattttatgaaaaatacgacggaataaatataggtagtcccaatcacaaaatcaactcat

SEQ ID NO: 98784 - DNA, 557 bp, Oryza sativa
ttattataatccaccttaataatggggatggcaataatgtttagttattaaaaaaaggggtagtacgcactgaaaaaatttgagactcaggggaagttgttgaagaagatcgaaccttagaaaaagaattatgtcgtgatacagtgatttgttctttaatgagaaaaggttagaatctttaatacctgcaatgcacgttcttatctttatcgtggagacgtaaataattactactacaatacattttaattgaaacagaataaaacaagctcgatgatacaaatcaataaaatagtaacctaatgatatgacatgcgattttattgacaaatttattatcaccactcgtaagagtggtaaatagttaattattccaatgagagttgggttcttctttgtatggcagggagaaagaaaaaagataaatgagtaattttacactcaagacatgactaatgggttagggaaataatttcctagctaaaaatacttatatttttaagacggagatagtacctccatttcatctcagtttttcattcatttacatttctcaa

SEQ ID NO: 98785 - DNA, 752 bp, Oryza sativa
tgaaggtttgagaccgctggcaatatatacggcctcatcttttcgcttatgcttatcagtcaaaatttgaattttcaactttaaatttgaagctgattttgagggttttttcatcaaagtttattttttagcctttacttttaggtcgctaataacacgtatataaaagttttattaacgaattacttctcatttacaaatatgctgtttggtttattttacaaataagccaaacaatgagggcgatagtatggcctaagtgttggagcggctacagtctagctagtacgatgggtaggcatgcagcagtgagcaagccatggctgcctcctactggccggccaagccagccatcctgcagcctagtactacttggtagctagttcctcctagtagagtagtactccgtagtacaagtatagtagcaggatgaggcagagaggccgggcgtgcgtgttgcaatgcaatgcattgggtgttttggtgcgtgcgtcgccggggaggggatcgatggtggatgaactggcatggcatcatcgatcacacctgtgccggccggccggagctagcgagcgatcgagcgaagacgaagagagaaagtgagagagattcctcagcatgattgtgtcgtggaaggaaggaacaagcatgcatgcaacccacaacccaagctgcaatattgcatgttcatcgtactacataggagtacagaccagtagtactaccctgctttgcttgctgggctgcaggaa

SEQ ID NO: 98786 - DNA, 1283 bp, Oryza sativa
  unsure (1)..(1283): unsure at all n locations
acttattaataaaacttgaattcaacaatggtttggttacatagtactgagatcttatctgaaagttttctagcaaatctatttctaattatatgagctaggattgggccataacctgggccagcccattacgggttgggccttgatagtcgtcaatccatggtagaaaaaagcagcccacaaggccatgggatgccaggcttcggacaatggcctagggtacccgatgcccggaaaagctaatccccgcgcgcgcgttgccggcgcatactccggcccacacggtccatgcacgcacgcgcgcacgcctntntctcttttttctttttcttttggcgcaccgccgtctcttcttttttccttttttttttcttttttctgccacacgggagaaaaaatcgtaattagtttactactccctccgtcctagaatataagagattttaagttttttcttgcaacgtttgaccactcgtcttattcaatttttttaaaaattattatttattttatttgtgacttactttattatccacagtattttaagcacaacttttcattttttatatttgcaaaaaaaatttgaataatacgagtggtcaaatgttgcaagcaaaaactcaaaaccccttatattgtgggacggagggagtaatgattagtctcctatttttactactgattagtttactagtaatttttaaatcttaacttaaaaattttcaaatttggacttgaaagttttcaaatctcgagctaaaaattttcaaatctggacttgaaagtttttaaatctgagctcaaagttttcaaatctcgagttgaaagttttcaaaattttcaaatctggacttgaaagtttttaaatctgagctcaaagttttcaaatctcgagttgaaagttttcaaaattttcaaatctggacttgaaaattttcgaatctcgagttgaaagtttttcaaatgtgagatgaaaagttaaaagtttttaaaatttgacttaaaaaaaaattcaaatttcgagttaaaattttcaaatctggatttaaaattttgaaaatttgacttcagaaatagatttcttttcaatttgttagttaaaaaatcttgtgaaaaaaagaaaatcctaactactactgtcattatcttaagctataattatctaaaactaattaattgattagttaactatacctcctatctttagtcccgaaacgcgcgtggggggcgcgcacgccccaactaggccccccccaatgcctgaatcgcactaaacatgcgtg

SEQ ID NO: 98787 - DNA, 651 bp, Oryza sativa
gggactattatcacgttagattccccctcttgtatgatgtatcaatcacctttttattgagtagcccaacgacatatagcagttcacatgttcacatttatttcttaaaggatgaaataatatatttgtaaccggacacaaaagaatgggttgtttggttcatgtgctatgagaggacaagcgtatactaatatcctcttctggaaggaggaagaagaagatgacaaggtccttctcctccaagaagctgtagtattattcaggtttaaggtactgatctaatgaagacaatctatcatcaaattgagctttgatctggtattgccaatgccatattattattccgaggactttgtagtttgacctacaatatgctttacaataatccaatgtactactccatttaaaaaaaaaacctaatatagtattcagattcatggtactctagtactatatttgttttcctttcgaatgaagggagtattattatttgcccttatcaaattaccaaaatgcctctaaacttatcctaaggccttctttggttaatcccatcgggattaaggtgcggaattaatcctactcaatcccttctaatccctgtctcacgcggaataatagaacagtctagagtgagtaaccaaaggtgct

SEQ ID NO: 98788 - DNA, 529 bp, Oryza sativa
cggactccaagacgcagtgtgtgtatgacaggtggaaccagatattaatagtgtagtatgtaactattgtatgaattggctattaaattgattgtatgtgatatggagctagtagttggctatactattaacttgctcttagagcaaggtcaatagtgtagctagcagtaggctctaaaattttgtcatgtctcaggtagagctaacttaaagagcaatttatataataaactaactacaagttagttataagctacattggttcaaacgaattaacaagcggtaggacccacaaacgaattttttttattgtatctcctagccgatacagcgtgaggcgctgtgcaagcaccggcttctttctcaatatgtgattttctttccttaatctcgttttaggatgattgataagttttagagccttcctaatagcactattgtacttgctcttatctccttaaaatatatttatagctgacttatagcttgctattgtatacctactgtaataaggtaataaggttgttca

SEQ ID NO: 98789 - DNA, 699 bp, Oryza sativa
acgattcaatcagtggagtcacattatgggtggagggccagggtttatcgatgatggccaaatatggtgctagggtcatttggtggctaagtatagcatgatgatttgttggcttcagcttgcagctaaattgtgggggcttatcggaagttggtgcaggctgaccttgatcaattcttacaacgatagtaaacaaagtgacatgcatccagataagacatagtgtgaccaaaccgacaatttgggctagaaagaatgtggaatctttggcttggctataggtaggggtggtaatgggtcaaggcccgtgggttctttcacaacccatctcaacccttaaatatttttagcacaaaaaaactactaaatttcagcccaacccttttttggacccaaccctcacattttctaggccaaaatgttgggcccattaccacccctagctataggacattgcacaacaatgtgcactagctagttatggaagactctaaattcctcgttggtggttgtgtagaagattgtggagtgtatgtgaagctcggggaggttaggccatggtggtgagcatgatttcactcactactacaaaaatctattaaaaccttcataaggactggccttataggtgccgattcatttaaaactggcacctatgggcattttcccacctccgcacaatgaaagggctgcaggaat

SEQ ID NO: 98790 - DNA, 567 bp, Oryza sativa
ggtggcgaagatgaagtgcgtggtggtggactacaacgccacggcgaacatctacgcgcggccggtggaaggcgtggtgatggtggtggacctcgaccggatggccatcatcgggtacagggacagggcggtgttcacggtgcccaaggcggaagggacggactaccgggcggacaaggtcgggccgccgttcacgggaccggcggcgccgcccggcgtggtgatgcagccggagggcagggggttccacgtccacggccatcttgtcaagtaagcaaccgtatccctcatccgtttcatattgtaatcgttttgattttatttttctacttaatagaacttcttttaagtttgatagaatttattgaaaaaattagcaaaactctaaagtaccaaattagttttattaaatgtagtattaatatattttaataatatgtttattttatattgaaaatattactatatttttctataaacattaattaatttgattagaaaaaagtcagaacaacttgtaatatgaaacggagggtgtatatcatatatatatatatatatatatat

SEQ ID NO: 98791 - DNA, 610 bp, Oryza sativa
gagatttgttcccaacctaccgtaacgaacacaacgtagttgtcctaaaataaaacatgtagtagttgtggacttatataatataatattggctactattccctttgttttatattataatccaatttaactttttttttcaaagtcaatcttttaaagtttgatcaaatttataaataaaatataataatatccctaacacaaaacaaacatgtttatcaaactataaccaatgtcacatttaataaaactaatctcctattatagatgttactaatatttctctattaacttaaaccaaatttagaggagtttttttttgcggttatatagttctaatggaacatatattatttgttgaatattactactagtagtacatgattaacaatgtaaccagcgtggcatggcttgggccgcaagaagagttgactgcccagttgaccgacacatgccacagttgtactcccaccttgtgttgtgtgctcaggtaaaaataaataaaacggcgtggcttcctgtgcaaggagaggaggaggagagcacagggcacatgcggatgcggcgatgtggcagccaagagggaggatagctgggtcccacggtagta

SEQ ID NO: 98792 - DNA, 512 bp, Oryza sativa
tgaacaaccttattaccttattacagtaggtatacaatagcaagctataagtcagctataaatatattttaaggagataagagcaagtacaatagtgctattaggaaggctctaaaacttatcaatcatcctaaaacgagattaaggaaagaaaatcacatattgagaaagaagccggtgcttgcacagcgcctcacgctgtatcggctaggagatacaataaaaaaaattcgtttgtgggtcctaccgcttgttaattcgtttgaaccaatgtagcttataactaacttgtagttagtttattatataaattgctctttaagttagctctacctgagacatgacaaaattttagagcctactgctagctacactattgaccttgctctaagagcaagttaatagtatagccaactactagctccatatcacatacaatcaatttaatagccaattcatacaatagttacatactacactattaatatctggttccacctgtcatacacaca

SEQ ID NO: 98793 - DNA, 583 bp, Oryza sativa
actcgtttgatcttcctgggaattagttcattctgctgcgtctcgagaattttcatggctgtcagcagcactcaaatctatgtaatgttttgatgaataacctgatgcgtaacggatggcaaataaatagattcaaaacaaaaaatacaaatgcataatcgtcctcaaaattactagttgtacaagaccatgtgcgatcagttaattacatgtaagggaaccatggtttaaaagaatatattacacactcataaataggctttcaataaaattttagtgagatagatgtgatgttagtttcgtctctttgagcgttggtgggtgcatgggcaggtgtggtgttgcgtgtgtgtaccgtgtaatcgaaaaatacatacatgttcatgccacttttttttcaattctccgaaatctacaatacatacatgttccaagtgtatgtcaacgatggttttatctgtagcttactgccagcagcactgaaagtctgaaaccgtgaagcttttttttaactggatcaactatggtcattgatttgtgctttttgtagaattagaggtgctcccatgattatgatatgctt

SEQ ID NO: 98794 - DNA, 689 bp, Oryza sativa
aatttatctctcttaaaattaaaatagttggcaaattagttttatttgttattaagaactaatatattttttacttttagctgattattaatttttttaaaagtcacatagtaatttttacaacaaagcgcgaagaatcacgtagtgaactaaatgtgccagtttgttctttaattattgacataaacaaatagctcttcttgtacaataaaatgtactgctaattattactacctatattttgtaagctaatcgatctcttgaacaccggtgacataattttgaatgtctcattttttataattaccctttctaactaactgttacgaaaatttaaaaccataagacaatgttttgacgatatatctaccaacatcatcttcacttcacagttcaaattatatatatatatatatatatatatatatatatatatattttacatctatcaataatctagggattctaaatttttttaatatttgattagacaagtgttgggacattatctattttgcagatcaatccatgttttcaggatagataatggttagctataggaagggtaattacagaaaatgtaaaaaaataaagacaatgcggatgaaaacagataaacaaaagttatgacgtatagatgcaacggatagaccagatgaagccaacggtaaaatttgcctttagcctca

SEQ ID NO: 98795 - DNA, 530 bp, Oryza sativa
tgacggtttaccctgatatagtgtgtaagactgtaaatgtactacttgttttaataatcatccctcaaattgtgcaagtgtttaaataatgagtagccactagactccattgcatggatgataagttaaaaccaggtatcttctacctttcaataaaattcattactattactaacttgattatttcattatcctagacatgtacacatctagtgcagccttatatattatgatgggaatatcgtttctcatgttgcccaacaaacaaattttctgatttttgaggtgtgcacatgtctgtctgaactatttacccccatacccagccgatttttgcaagtgattccccatagaattttggcaaaacttttccattttccatgaatctgcaagtgatatagaagttcccaatgcaacgcatgctatcttctagtagaaatgatagtggaatcctaatacaagaatacagtttaataatgcctagtaacagaatgaaaaaaatagaacatggtataaaccatcagggtacc

SEQ ID NO: 98796 - DNA, 573 bp, Oryza sativa
tgttcattctacaattcgattacatctttatattccttataattaaacctttataacaagatatcacacgattatattttgataaaaaattgaacgttgtttcaccccttgaaaaaaattgttttagtttaccgcataaagtgtttcagagaaatggtattaaaaaataccaactacaacaccagtaaccacctagtatatgaaaacactaagtcccaacaagcaaaacaagaaaagtcatatgaaagatacaatatatttgaaaaaacatgatattgttaaaatatttttatatcacatatgaatattaagttgtaactatcgaaacactacaaaatacttggtgaaacattccaagaatatcatgtgtaacatttgcaaataaactagtaaaacatcatacaatactagttgagactgtcacatctataaaacatgtgcaacatttaaaaaatccatgaaaaaaatctaaatattctttttatcgaaatataaccatgtagtcgtgtcctaaagatttaattgcaacgaatttagcgatgcaatcggatagatatggagaagtaatttagg

SEQ ID NO: 98797 - DNA, 668 bp, Oryza sativa
tacataacccaatcagaattgaagatattaacgaacactatataattcataagcagaagacagcatgcaaaaagtatgaagccaagtacatactgagaaagcttaatggtccaaatcaactattcattgaaagaattgttaccggaaaaaaagagaaacagttcatagaagatatttgtagaactagaaccctttcttgtactaagcaagcaatctgtgttatttcatgttaaataaaatgaaactcaacattacaagaaatacagtgacacacaatcatattcaagaaactataccagaaaaagttaagacaaagaaggaaggcataaaaagaagtgacaggctaacagaaaggtgggacagtaaaaaggctgaaatgtgcatcacagctccaagcaggtaaaaaggaatgctaccaacactaccccaacacaatttagtaaggtgccacatactccctccatctcaaaatatttgacgccgttgacttttttaaaaatgtttgaccgttcgtcttattcaaaaaatttaagtaactattaattcttttcctatcatttgatttattgttaaatatacttttatgtatacatatagttttacacatttcacaaaagtttttaaataagacgaacggtcaaacatgtctaaaaaagtcaacggcgtca

SEQ ID NO: 98798 - DNA, 545 bp, Oryza sativa
agttaggatgctggagcatgctgaggtggtgatcctgagcacagtccgcaaggcccgatttcggtgctgcatctcccaaccgatgacaactgattgaatgagacaacagagagttgcgaagaccttgatggaaggaagcataatcgagtgtatttatcacatgttagactctgcgccgctgaagtagaaatccaacttgagtgtacgactgagttatatactcaggtgtaaggcagttctatattcaaaatatttctctcttagagtggtgttttcagactgctttggtgtgttaggctctatccttttgtcgaaacatcatgcagatttccttttgttgtaactgacgcatgttcctgctgctttatgcctgtgttatataatccccctgctggaacatgcacaaactttgctgcgttcagagtatatagtatgtacaatttgaaatgttcccgtggcagagttctgctaatgccaagctttcggttaatcttccttacccgtttcctagattcagctcctagttactggctgagtttgtagtg

SEQ ID NO: 98799 - DNA, 581 bp, Oryza sativa
ggcgaattcgagctcggtaccccccacgagcgagacgaacacctcgccgccgaggagcatcaggacggtgagcaccacgagctggccgttggagaacacctccatctcgacggtggacatgctcgacaccgtggcggccgacacggcggtgaagaagcggtcgatgcggcgcggcgcggcgccgggctcccgcaccttgagcaccccgaggaggccgtagccgaggcaggagatggcgaggaagtaggcgacgtgcatggacaaagcgccgccggcgagcgcgcgccgcgacgtgggcatattggagcacgcacgcggccgccgtgtgctcgctccggcgcggccggtgcaacggctggctcggcgagcttgtggatgagctccggcgatcgatcgtgctgccgcgctatatatagtcgtgcggacgtgggaggctgggagctatggctgagcaacaaaataggccacgcgtcctacgtaccactaaccatttgatgtcatccaatttcgaatagagtaatactccctcaattctacattgattattatataatcaaaaccagaatttctaaactgattat

SEQ ID NO: 98800 - DNA, 516 bp, Oryza sativa
tctaagtcccatctcggcaccgtaacttgggaataaggggagtcgagaggtacaagcccctcctaggcactgccctcctcatcggcaagcgcatgcaatggaaaagctgtgatgcgatgcatgcgctagcatgcttgtgatgctgaggaggaggcggcgtgactctttgtgctaaggtgatctttgtgttgatttgtcacgcccagaaattcactgatattttccgaacttatttgtgcataaaatcctcgtccaggaattagctgaggtacacaaactgacaatttaatatacatattcatcaaaataactaaagagattaacacttactgaagaggcacttagtccacacaacaaagaaaactgcagcggaaaataaaatctagcgaagctccggctccactcccacaggcagctcaactggggtataagctaaacgtcttttccctctggatcctttttcttcaactgaggtttaattgattattgcaaggtgagcatatgacatactccgca

SEQ ID NO: 98801 - DNA, 1735 bp, Oryza sativa
aaccggtgagcaatagatcgatcacttgcgcatgtttttctaaccttcttcctagccgatggccctaactcgccaacgccgtccgtgcgaaaccaccgccgccgtacgttgagccgttcccggagtagacttcactgtccaagcttcgtcaatccccggttaaccatcggtgagtctcattgtgcacatcagcaacccatgcattgatgcatgcactgatttggctcgattaatttgagccggagatcgattaatccacggtatgtaccgacgtaccgtacgccgtcggctagggcaaaacacggccactagggctgaggtgaaaattttataaacaatattactattggatgaagaaatgatcaaaataaaagttacagatattttgttgttgatgactttttcacttgaaatcatttagtatttgaaaatgttgtttgaagttgtcataatttgaaattcaaattgaaattattgaaacagagtcatatagcaaaatgaccaaaacaaaagttgtagatcttgatattcataattttgaagtatttaatattatatttgtaaatcgcgacgaaattgatataacgtcacagtttttgggccggtttacgatgaaatcgataaactgtcacggtattatgggccttgtatcaatagttgcatatccatgacgatttctgaaaatatcacggaaattttgtgacagattaaatatattcttgtagtataagccgccacgtggcattcctataaacactcctaagtcgccacataggcactatataatctcaccgttgattttcattaaaatttgttgatctattattttacaccattagattgcatctattattgaaagtaataacttcattctgtttagatacaaacgctactatgtactaccgttctccagtacttacgacgtacgagtagtacatgcgattttaacgggaaaaaaccatacgtacgaacatagatagaaaagacaaccaataaacatagatatataaaaatggacggttttttctacaatataaatatgaaatatattacttcagaaatataatataaatatatatagttaaactaatatctataataaaatataaaatacccaataaatattctttaaaccatcttctaaattattttgaaattatatatatccaatttgcgatcatgttgtatttctttaattaaattataaaagttatattatggtcctaaatacaccacggcacatgaggccaacatatgtatgataacttttcaaaaaaatcacaacatattttagggagggcaatatcacttcacaatttaaatcaacatatgtaaaaattctattatatactaaaagtccattaaacctcctatggatgctcttaagtcgctacgtggcactcacttctaagccaccacatgggcactatataatctcaccgtgattttcacttaaattggtggactcattattttacactattagattggatctattattagaaaataataacttcaacacttgtgtttttcaagtagttctgattaaattataatttgtttgagattaagattctcaaaatgtttttatatttttagaactatttcactatacatatttgccaaaatataaataataaaatgatgatatggatattatcgtggtggtatgtctcatgagctataattttttaaaatatcatcgaacgattaccctcggtcattttcaaaagag

SEQ ID NO: 98802 - DNA, 684 bp, Oryza sativa
ttcctgcaccccttcatttaaagagcatataaacttcaaatggccataacttggccatttgaactcagaattggaccattcaagtctctaatttttccttaagaagtcaagaacccatttttgtgctttgttcttgctggttatatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaatattttgatttaaattattgcattatcgctttatttaaattcccgcgttatcactgttttatctagccatgcctatttacctttgttatgaccttattattgctattgttattatttccttgttcaccctagaataaacaaaaccccaactagtggacactctactcatggtaccactagtatgatttaggcagatgcttcgctggttaattaggcaacattatgtggttttacaactctagactttgggatattcatatcacctggacactacggaatggttggattattgtggaattggattcacacctccccctctattcaaaatcctcaaaatggttttaggctgggctcggggtgcatggttttgatagtagcaca

SEQ ID NO: 98803 - DNA, 672 bp, Oryza sativa
tgacgatgcgaaaaatagcgaaaaggaaataaagcacgtttctttattaacttcgaaaaaaataattgaagaatagaaggttcacaacacgatacaactcactttacaagtaaattacatcttcgcccctgtaatcattatccctccctaaggaatggtcagacgaactaggttcgtcatcactactaatatcatacacaaccttaagaggagtagggggcgaaacacagaccaaactgttgcgacgctgaaagatcatttcctgacgtttcgtcttctgatgatttcgccaaaagcgagccatatcctccaaacgtcttgaatgaacaaggtcgtaatcttctaagattcgcccggggtgcgcccgcagccagtcggcaaccttgaaaaccttatagctatgaccgtttatctccatttcgcgataaacaggacgaaatggacatcgcaccttcggcaggtccttcaatgccacaaatttctcgttttgacttcgccagctcccggaaggggaccgaatgcacaacttccggtgaacgccctgatagacagcgcagagaaagcaaaacacagcttacatagtaagaataggcggaaggagggggaggtatggcataatgcgagatgagcgaaataataatatgccaaagacctcgaccatcaaaaagcaat

SEQ ID NO: 98804 - DNA, 634 bp, Oryza sativa
agggcgaattcgagctcggtaccctttctatttagaagaacaacaattgttattatattagttctatcattaccatatatggttgagcaaaactaaattttggtttagccaatagcatgtttggctgatgaatgctacttgattgattaaacactcatcactttcctatttctagtacgacaattcatcatctttgcatgctaactatatgaattacccaggtttatatattgagacgtaggaagtatttatttattattactcctctgacttagagtcaggctgatcagaaacacaacgggaagttttcctggttagacgggctccactaatgcattgattacgcacccgcattacaaccatacgtgcaaaggacgatgaaagagttactttggatgtactactttgtaaatttaataatacctatagcacaacactactagaggatttaactttttccactcttcaccacacatccattttacccctctcacatgagtagcaaatcttttaccactccactcctctagagtggtaaaaagtaaatattcgaaacacttggtggtgcacatgatattcagctcttcctctcccctctctaagggatttaacgttttgacactctttatcatat

SEQ ID NO: 98805 - DNA, 670 bp, Oryza sativa
ccatgatattctcagggtttagaattcacccctaccactaattgagatcattgatgacacaacccacatgcctcttgcagtgtcttatgtggggtctatccaacaatatgttcaccaccatgtgtccacattattaatttggtatctctataccatgatccatgagatatgatcatcaattaatacatgtgctgatcatataaacatatttattccacacatgatatttgatcagggatcctttagaaatagcgacacataacataaagagtctcatgaaataatcacatatttattaaccaataatgagtttatctatttcaaggaacaaagtcggataaatatgtaaacatagtatgtgatacaatcatctttatgattgcctctagggcatatcactaacagtatcccctcgtatacctttttcttccaaattcgatgctaataattatgaaaaattctaaaaaaaattgacaatgtagagtataatgatacctactagtccaccaaaattcatgttcaaattcgatctatacatcgagaaaaaaaaagacaaatttagatataaacaatacgctactattcatacgctgaatttgtcttttttatatctcgacgtgtgagttgagtttggacttaagattttgtgaaattgtatatatgtgatata

SEQ ID NO: 98806 - DNA, 625 bp, Oryza sativa
gtaggagatttttttaaaaaaaaatcgaaacaatgtatgtagacacttatatacccacgtatatattcatccctataaaaataaaagaattattactcataaatatgatcatcagtgctaagtaaaatacataggtgaacaggttccaccccccaaaaaaaataaccagtatctacgctcagttcgtggagatttcaagattttgaaagcaggtgactgcttagatgttgggagtgaatcaacaggctttagaccccacaaataggcttttgtcatcaatttgatcaatttttcgaagtgtcctaaatagttctccaaaaaagaaaagagtcataaattccaaagctaaagtactctgtgacgcaaaatatctccctccatgaactcccacttagtcactactccctccgtccaaaaaaaaaaaggcaaactctggatttccgtgtccaactttgactgtccgttttatatgaaatttttttataatttgtatttttatggttgttagattataaaacatgattaatattttatgcgtgacttgtctttttatttttttcataactttttcaaataagacggacagtgaacgttggacacagaaaccagggtttatctttttttt

SEQ ID NO: 98807 - DNA, 673 bp, Oryza sativa
agaaccatgttaaatcatcatccgatgtaagttacataatatttcaacatatatttctccatcattttctacaatatcctagttcttcttcatttagttaatgttttctatcttctcattagaccatatatcacctaaattatttctagcctttagatgattaatctatagtccaaattttatccctcatttgcttcccacatgaagccacaccacctttcttttacttttaaattatcaatcaatattctactttaattattctaaaccaaatcaattctatggttcatagtcttttccaattatcgatcaaaaatataaattctataagcttaaggcatctcgctatgttacacgttatttctactactatcatactaaactcccgcagcaacgtgcggagtttcatctagttaactaggggatcgagaacgtcatccgacaagtctaaatgaagtttttctcaaaaggacaaaaatcattacaattaataaatattaactaagtagaattttctacagtacattgaagttttgtagaatttgttgtacatcactcaattacaaaacacctcataggtaccggctcatatgtaccaatttatttaaaaccgacaactattacctttttcacctctataggacgaaaaatttggataaaaaccggacatata

SEQ ID NO: 98808 - DNA, 564 bp, Oryza sativa
tctatacactaaattatagagttggtgctaatagttctttagcagatcaagtggactatttacaaaaacaacaaagtgaggtcaggtccaccacagtattggggctgtgcccttcttttggaatcttcatctagtggtacaacatggctacatgggagtccatagagagggagatttttttcgacatgtgtacgtgtatgctcgtccttggagattcaccttacctttgaaatctacactttgaaaaattgattgaactaaaaacaaagacccattcgtggaggtctaaatagttgattcgccctaatattgaaggtcttctaggtcgtcaacttctttcaaaatccataatctcccacaaaacagatagcgcggcacctaatatcttataacaaaacagttaaaccaaggtgaacacttgattactttaagagactaaaagtaggagtcaacactcaacttgcatgacaattacttctgaacaacacatcaactattacgttaaaatagagatgatgataaatcaagggatatagtttcctccaataaaatgtcgaactacat

SEQ ID NO: 98809 - DNA, 608 bp, Oryza sativa
taatctacaacatcgaggggcccagagatatctctccataggaggggcaaatcccatcttgattattcatatcccactacatgtttcatagcatacccgaaaactacttttataactacccaattacggagcagcgtttagcagtccctaagtaagctactacacatgttgggaaccatgataatctcaggtctaaggattcaacactaacactaaatgagatcattgatgacacaacacacatggctcttgcagtgtcttatgttgggtctatccaacaatatgttcaccaacatgtgtccacattattaatttggtatctctataccatgatccatgagatatgatcatcaattaatacatgtgctgatcatataaacatatttattccacacatgatatttgatcagggatcctttagaaatagcgacacataacataaagagtctcatgaaataatcacatatttattaaccaataatgagtttatctatttcaaggaacaaagtcggataaatatgtaaacatagtatgtgatacaatcatctttatgattgcctttagggcatatcactaacagtatcccctcgtatacctttttcttccaa

SEQ ID NO: 98810 - DNA, 504 bp, Oryza sativa
tatttatgccttcggtttgctattgctgcatatagtatcacaacaaaaatgatgtataatgttgaagagagccttagtttagctaaagaagatggaaatctcttatattctaaggagctttcagctgatactaacgagataattgctccagttataaatagaacttcctttctattttttcttttcctttttcctcccttcctttcttcttctcctgtggttctgtttctgtcgatccaatcaattcctctcggtgtgcatgggcaggagcctagaaaaaccccaatcagatgagcaggccaaacccagcccaacccaagccgccatcctccccactgcccacgcacggccacgccgtttctgcttcgtcttcaatctgacgtttttttctccatgaaagcagcaacgtatcctccaattcccatcacagatctatcatctccctcatcaatcttactgtttaatgccaaaaaatgaaactgggtaccgagctcgaattcgccc

SEQ ID NO: 98811 - DNA, 778 bp, Oryza sativa
gagtagcaactttacaattgacacttcctaattccttaatattctttcataatgaataagtctgaaattaagctccgctcaatcctttaaacattgattccagtgttctgtatgataccacatataaccagcattccacttgcattcattcagaatttcagcaacaccaatatgtgcatgtggagaggatttggccctactagaagcttaccgccttctcttccagttttttactttcaatctgtatgctcacagataccagattctgtgattgcatatttttgaattacaccttgtattctgtttgtagctaacctcatctagatagtgaaggcactctcatggttggctatcctgataactatatgatgacttttcacctttattttttttcttttttcagtatcattttacggacagagtggtaaaatatcatatgctaactgtatattgaaatagaaactccgtcaagcagatgagcggccccttatgtaatatcttaagttttgacattgtttatagtagttgcaaggaggttagccattagcattgatattaagataaagattgaaaatagactaaaaaatgacagtagaactgtttcaatatctagaactatatcaagctaggctataataaaatatgttttacctaatgacaccggtgactgaaaatcctggatccgcccctggtcgagacacgtatgattgttgcatccttcttgtgtacgcatggtgagcacatcacaagaacccaaaggaaccctgggtaccgagct

SEQ ID NO: 98812 - DNA, 548 bp, Oryza sativa
aagcatggcagctcactcctccttccatttaaccttcaccactctaattcaatcatcgtcgctacctcgctcctccttcgtgagcttcattgctgctgcagctcgcctcatgcctagggagggcgacgaggcgatggaaaagcagtggtgcgcctgaggggagtgtcactgtcgacacagctccgtgcataacctcttagactgtggtagtggagacagaggagatctacaagttcgtgccccatcggtcccgtcctctgagattgccacagatccactgtataacaacctgtcctccaaaattaaaccgcactgcctaacccatctgatgagtggccccacttacacagcacaaactaatatggttgaagcgacaaactcttataaactcgttataccctgctaaactagcaacacggtactaaacatgtgcatacagctcttaagttgattctacccttgctaaacgcggtactaaagttgtgctactcgtcattgtatcaacaacaaatcaagaaaaactcttgattcagtaattcagaaaccaa

SEQ ID NO: 98813 - DNA, 2123 bp, Oryza sativa
atggcaaccttcttaaattcaaataaatttaaaaaataatttgaaattttgataaattttacacggtttcatatggtttgccacgattaccgcgtggtaacctcggacccggtggtttaggaaccctgctaagcactggtccggtttttcttacaccacgggttcggttcgatttttacaactagactattgagatgccactggagagaataattctttgcaaatgccaattttgcatatgtagaaggacatgtcacattaccaacatggaggtggcaagaaaatgacccatttgcccttgtttgatcttagtgtacattgagtatgcggataatatacacctacaatacttgagcaactatatacaaacatatatgctagtagatccaatagatttattgtacttcaaaatattttcgttacaaatttatcctctcatatcttgttcacattactaaaatttttgcacgagataagtccataaaataactgaacacatgaaaatctatttatattgtcgagggggcagtccctcggatagaggggagtggagacccctctccgggtgtgaagattcgactagggggttagtaggagagcagtgcgaggtatctgcgatcacggcaattttgcggcgcccatccaccccgtgaggagaagaaggcaagaggttatacaggtttagggcatccggaggtgtaataccctactcatgtgttggtattcgttatcttctctagatcagctaagtacaagagaggctttgcaagctacaaagcggaagtactgacctagcaaaaagcaacccttcatccgtatctagtctccttccttttatagtccaatgaggggctcacattattacaaatctttcctttggtcttgtctcatcaaccttcttcttgttgtcggctggtgtcataatgcagccctcaagaaacccttcaagtcttacggttcatattaccctaggctcctaggcttcgtctgagaatgttgggcgggcctccgccaatgtgctcaccacgtggtgcgtggtgggcctgacgaggcccgaccttcccgaaacagcgccacggttacttctctgcccctttggttgaatcaagtggcacgaggcatgtgcgacgcgtgtcctaggcgccaccgtccaaagtgacttagcgttggcgtcttgtccatgtcctttcaactcagactgcccagggatcccccaataaacctgtttcatttatggtggggcgtgctgccttacagttggctgtggagcacgtccaacttcccggaagtttctaaggtcacaccgtgctgcgcttaaagaaggttcattattccttgatgagcttctcgaaggcgttcttgatgaaagaatatcttgagattgtgcgtcttgtatcttctggcgcccctctaaggccctatttgattcagcttaggattattataatctaacttattaggagtaagctgaaacaaacaaatagattattataatctataagccagattgttataatctaataagctgctctaaaggagcttttttcagattattgagtggctaaagacccactacccctacatacttgagaaaaattacccacctatgccatcaaccaaacagatagctgagggtattatagactttagtctttcaaacccaataatccatgcctccaataatccagacaaacaaacaactcacaactttattttatatcagcttattataatccagcttatagcaatctggtttaataatctagattataataatcataagctgaaacaaacagggcctaagccgagggacgcgagctatacaaggtccaaggtgagcccaaggcctgaggcaaggctaggccaaagcacaccttggatcacgcttttatgcttagcaagcctcatcaccattcttccttgtgcaacgtgtgacttgtacgcgctaaggcaagcccagggcccagagctaggctgggcccgaggcagatcttagctcatcttcttaagatatagctcttgcatgtttctatgcctctcttgccgaggatcatagaacctgcaaggggcccagggccgagcccaaggctaaccttaaactatactcttaaggcacgttgggg

SEQ ID NO: 98814 - DNA, 1899 bp, Oryza sativa
ctccatccatagttccatctcccgcttgccacccacatgaattccctcagcatcgcctgccactccggaggtgcatgcagtcaccatcactctgaggggaacggggttgacacgagtgccagagccagtagcaccaaccctcggcgctgatgacgccggcatcatggcagtggacctcagcaccaaggtagggggcccaaatctggaataagtttttggagggtttattcataaaataagtttttagaaaggcctaaaatgtgtaactggaccaattaccggctagaaaccatcgataaccaattgctaagtggcccaaagaaatgggacattcttgcaattgcatacataaaaatgaacatcatatgtgaatccatgagaaataaacgttatgacaacagcacaagcacaactattaggagtggcacggaaattaaatacacatgttgacatgaagatttatagttataacgagtaaatggccttcatggtgcacgaacttgcgtgttgggtacaagtaggtatcacaacttgcaattgtttgcttcaattcaacaacttgcctagtccgtgcaaacccgggccaaatcagtccacgtaacggaaaatgatatgatgcggaaagtacacacatatcccaaccccagttggccgataggtgaatattgtgtaattaataatgggagaacattatgttgttgtttataggatgttaatttgcagggagcagagatgcagcagctttgtgcaaaaatgaagtagaaggatcagattactgtgatggtctctttatattgtgttggtttcaatctttggagctattttatggtggaattaacatcaagcgatagctttagtaccggttcaatgtccaaactcagtagcatcgaagggaatttttttgttcctgattgctctagtttggtttgctatagtacagaacacaagcacatagttcaatgtctaaactaagtagctacagcacaacttactatataagcaactgatgcgtgtactacagggctacatgtcatcaatgagtgccacctcagatgatttccacctgcatggactgttttggccctggttcgaacagactaaggcaagttgttgcaccagaacgaatgatttgcaagctgttgcaactatttgcacttactacacaagtttatgcacagtgagcgtaatttactctataacaactgaacatgatatttgagtacatcacatattaattcattagagtccatagtacaaataaatcacatacaaccagacatgggtagagactctcatataacacaaataataggagtaggaacattttgcacatatgatggcatgaggatgatgcggaaattgtgacaaattcataaaatttaaattcaaaaatcattttggccagtttattccagtaccagtcactggcttcagaccggttaccaccggtgcttggaaccttgttaatataaaatggtaggattgtgatatcgacgagcaagcccaaccaattggataaagttatgcaaaatgaactgcagttctctaaaactgctgctttaaggctgtgtagctttactggtagtatatgattgtgaggtttactcatttgttttggtgatttataagtactgtttgtattagcaattatacgtttctataaaaccagcataatttagtgttaacaacagagaaattcgaagtaaaatacagattatgaaaagtaatgcgtctgagagacttaacatagtaaatttgtgtgtttgtaaacagatacaaagaaaacattcagccatgccaagaggtatataccttgagcactttattttttctcccacgatcccggtttgtaatgatctttataatcttagtaggatttgccatattactcatttgtga

SEQ ID NO: 98815 - DNA, 548 bp, Oryza sativa
attaataaaattaatcaactccatatatgacttgatatgtggcaaagtggtagcgtagcggcggtcgtaatcaccttagatgccttagacacgacgctttgtcacgcgtgcaaaaggcaaaaagtgcagacgtgcattgtgtagcgggccaaaaaagagaacttcgaacgctttatttataagaaaacaatagatccgatgatttaaataatgggtccaccggttctagtgtaagtataaattagttattatagattttaaatttttaatttaatgggtacataatataatagtgtagactttattttgaaacaatgcattattggagaataatagtccaatgtaataaaaaataaatccagtgatttaaataatgagtccatcagcttaaatgcacgtataaattagttaatatagatcttaaattgtttatttgataggtacacaatataattgtgtaaactttatttttaaatagtgcattattggaaaataatagcacaaagtaatgagtacaccggtttaagtggaaattatcttacattatt

SEQ ID NO: 98816 - DNA, 571 bp, Oryza sativa
catgcagttgtatctgcagaacatgggttgaaattattttaggggaaaggcgaaatggcaaaaattaaaattgtttgcttcattaacatcaaatcaaacatttaatcttaagcagaatgctcaagtggcaagccggtaaattctattgtaatctgaattgctgtacacatggatcattcgcataatgtacagttagttaattagccaccagaatttgattgattatgctgtactctaattttactgccataatgaagagaaaaatgcagttggatttcaattttagctccacgggccaaattcaatcacaacagtggcagtattaacatggctgtttttccagactcacagcatatgcagctaaaccctataaaaaaaatgtccaggcatgaggcgtccagaaccatcaaaagagagagtccacattcaaacttttctcactgctcacaactcaaataatgagctctattaaattgtaacatgcacggcatacacataaatgcaataacagttaatttctgatctgaaggttctggttgccgattcggttatactgtcctaatgtgacaaa

SEQ ID NO: 98817 - DNA, 864 bp, Oryza sativa
cagtgggaggaggggctctgcctccatcccttgaagcttgcgcggaggtggcggggctgggtcgtgacgacggcgatgacggcgggggcggtgtggagcggagcggcgacacgggcggcaggcgcggcaggcgctaacggcggcggcgaccaggcggtcggccaccacggcgcgcgcgcgtgggaagcaacggtgcgtggcgatttgagcggtggtgacgggaagcggcaacgagagcggagagggagggcgctcggctcggcgcggctcacgcgcacgcgcgcgcggcgcacgggcagagcgagggagagagagagagaaagagaaagatgggccgagagggaatcggcccatcgaacccgggggaggcaaattagacttttgcggaggaattgatttgggaaggatttggattcgggattgaactcggcgatagatcggggatttgagatctgagatggcacggacactagagaacaagcaaagaaacaaatttcgcaattagggtttttaagagataaatttcccgctaggcgccacgacggaacgggcgctacactaggccattgaatgaagagtaccctgagctaaatcttagcaagagggaaatatattaggtacgaataaaggttttatcctaatgaaattatgttgctaggctatcgagaaaaataaattgtatttaactatttaccattagcttccaggtgttgataatccatcaatatatgcatatttccatccaaatagttccttttttaatatcttctgttgtttattgatatcttccactaaattgatgcaagaggaaatactaatagtgattctcataggtaaattaaaaacatcttattacaggggtgc

SEQ ID NO: 98818 - DNA, 641 bp, Oryza sativa
attttaaagaaccatcaggtatgtcatcagtgctctgttcatggaaagccatgtttctgattttcattgagctattcttaaagcaattgaatagctttgatagattaaataaacaattagttatccttgctatttctttttgatgttcaagtgaatgaactcatgttcagttattaatacatatcctcttgagttgaattggcacgatatgaagttgtttctttcaacacttgtgacttattattgtgtgaaaaacagctgcacgagggcaaacgaatagtcgtcatggaagattagttttacattagttcagcgatttaagggaaggccaattttccaccgctgatcttaaaacattggtcaagacaaaaacagtggtgaactggtgatcagaagcagagatttcatgatcaacctgttgatctgtttctgcaactggagattatttttaaaattgaactagatttctcattgtggatgtggttagaagagaggaatagtaaatgggaactcatgaatttaatgcttgtgaagtgtaacttgtgaaattctcaagctactgtatcttcagaaatgcatgagaataagaatgatttaggtagcaatttagaaactatcaatttgctcctctgaaattccca

SEQ ID NO: 98819 - DNA, 703 bp, Oryza sativa
ctgcaccccgattgcatactgcttaccaagccataatggaacttctattcaaacacaaatggtgttcgaaaagacttaactttgcctgacaatttgcttcgtgaagctcatattctctattggacatctcctgccatgggtcataacaaggtaagctcatttcaatgcttaatttagagcagctttcagatatggttttcaagtgtgatgagcttctctgcattcagcaacttaagcatccaaacttcacttaaatgtttataactgataacttagtactgattagaaagtgcatcctatataattgttactgtcttacaactgtaatttctctgcattctttatttttagtgtagactacattccgttaccatcttactgataattatatgcttttgtgtgcaaaatactaggcttgaaagagaaagtgctccgcaaagtcatgatatgctaagatgcctcatctaatcaatatcactattgtgctattatccactggtatgcaggaagcgcatccagaaactaacaaaagagttcctgcaatagttgatgctctcgaaaaactggagcttacttcgaaggtatatataagtaaaataacactgccctttcgtaagttttaaaatgttctatataactgaggccttactgtctgtaccttctaaaatgactgcacatcagttaagaaaacatgttctttcat

SEQ ID NO: 98820 - DNA, 1703 bp, Oryza sativa
tgacacatgctatgctattaaacaacgggccttttgctgcaagtactactattgctgagcttaaaattcaaattaagaaccgggccaaaaataatcacaacataattcaaacaactgtgttagcaatggcccggcatgtgtccccactaaaattatttttcggtgtaaaatttgagtgaaactaacaaaattttcagtcaaaagattgatggataggcactcctttatttctaaggactgaaatctaacgtgtttttctctgcataaaaatggtgtcctttgtgtttatattaccttttatatcttagtattttcaattagtatggagggtagctggttattactccatcagttctaaaatatagctgaactaatctagatagtgaacggagcgagtaatatatagtagacgagtaaactactgctccctccgtttcaggttataaaacgttttgactttggtcaaagtcaaactattttaaatttaactaaaattatagataaatatagtaatatttataatattaaattagtttcatcaaatcaataattgaatatatttttataataaatttgtcttgggttaaaaatattactactttttttccaataaatttaatcaaacttaaagcagtttaacattgactaaagttaaaacgtcttgtaacatgaaacggaggtagtacttatgacctgtgcggctgtgtccagttcacgctaaaattagaagttttgttgaaattagaatgatgtgacggaaaagttggaagtttgtgtgtgtaggaaagttttgatgtgatggaaaagttaaaagtttaaagaaaaagttggaaactaaagtaggcctacgtacaatagggatttggggcagcataatgtttgtgatttctactcgatgctctacagtgcctagctcaagcactactgcacatgcaccatatatatatatatagagggaccgcctattctgcagttgattgcaatttttgcgtttgatcagtcaactttgtgcaccattagatatgtatctaacggtaaagctcaaaaaatcaaaacgtgatgtgcaaaaaagatcacaatctggtgcagatgtttgggcccaaaaactaacaaaaagcccaaagcccaaagttggttaaaacacacttttgggtccaaaaacttacaaaagcccaatgtttgggccccagttttttgtgctgtgttatgggccatcgaaggtatgggcccatgtctttttggattgtagttcagtgagtctggattttcagttttttagctgtgacttgggcttttttcaacaaaacaaataggctctcacatgatacccgttttgggctttttagctccgatttgggttctgtcacaaaaatggtccactccctggttcccttaaaaaaatgtcttgtgctccaagatagaaactcagatcaaaacttagatccaaaagaaaaatgagaggagagatcaaaactcagattggaaaagcaaaaaggagaaagggagataaagaacacgaagaagaagaaagaacgtgtgctcgggggggacaggaagaacctgagaaatttttacttcatggaggttgttctttttgttctctgttcccacctccctccttttcacctcttcctcccatcttttgatttttatttgctttctcttccctttccaccactcccttcctctgaagaacaacgtgt

SEQ ID NO: 98821 - DNA, 638 bp, Oryza sativa
cgatgtcctgataggctgctaagccacatgttaaactgtgacaaaaaaaagaagtagtgccaaattcaaacaataccatttgcatcttgttgctttttgagaattcgtgcaaaggttgaaatcatgtgcaaactgcatatgcaggtataacattattaattcacaaaatttaatgtgttgcacagaaaatttgattactatctcatatgagtaaatgtcaactacaacatcttggtattgcgaaaaattgtgttaactattagcatgattatagttgcacaaaatcataattaaagttgcacgaattaataaccaaagttgcacaacattaaaaaatggcgactgtaggaataggaaggtgcaatttttgcaaataaaagtaacaaactggatagatatgacattatattattcgaccgcccacatttccaagctcaccagcaaaatcaaaaaacttagcagaaggaaatgtactcttcttcgcctgcaacaagctcctcccccgtagatccaacgctccctgaaaacaaaatcgtagtgagctattacatctgagcatacaatcaatctgaagttgtgcttgtttataaccaaaattaggaaaaaaaatcatatagtagtcagctaaaaaagaatta

SEQ ID NO: 98822 - DNA, 700 bp, Oryza sativa
atcccatttcataatcaatacagcacaagtacctcaagcatgtgtactatcaacatttatgttaagacaacatttttttagttattgtgatcaatacaaagtacattctgtgtcagaaaacacactaacaataagttcaaccctgcagaaagatgggaattcaaggcatacaaaaagaagcctacaccgagaattatactgtccagtacagtgattgctcattgtgcaattttgtaagacctgcgaactctagtaaatatttcagtacgcctctgaaagtatcatgtattcatatgtcaattgtaacttgatccactgctaactatcctaacatattaaaatttgatattttttatgtgcttatccaattaatgatctcgtaacttcatttctatgcataaccctaattcaatcaagtatctcttgctccatcacaccaactgatttttaagtgaaaaagacgcttacatcacattgtgtgagaatggttgaagtttttctcagaacacttgaaaacgtttttattaggaaggttttaagccatgattacaaagggtgaacttatcgaatggaaaaggggcagagatgattattaggaaattccctttaagaatatcataattcaccgttatgaagaattcaagactgccataagctctacagatttttaagaagttacctcgaaagatgtgcctgaact

SEQ ID NO: 98823 - DNA, 711 bp, Oryza sativa
gctaaagcctagggtgtggtcacctctctatcaacaagtttacctttgttctccatcaatcaactgtgcataaacgagtaaatgagagcggacaacataatttgcactaatttcatgagttctattatatttaaagttgtattaggggaatttgataaagtttagtggaggcagttttgttcaccgagccaaacactaaaacacactcatcgtcatcgtgactaaattttggtaaggtttggttgtggtaactgtggtcaccaacttaaacacgctcatctcgctttgctaccatttggtcgtgtaattagtatccagtagtttagccaaacattcccaacgaaatgaaacagggggccaaatagaagggcttaaaatgggataaaacaaaactttctgtccaaaaatgggaaatgtaaagccacgtgaacatcacaaaaatttggcaaaatgagacaataatgattgccatcgatccaaacaatcaacaattctagaaagcatccaagggtgtttagggtaaaacttatagtatagttctatttatccaaaagatataaaatcaactaaaaaaataaaaaaatcgaatgaaaaaacacacactaaaatcaacaaaaaataacttctaaaattcaaattccgacgatagcctataagccaacaagcacaatttttcattatcacgcttggtttgggcgtactgatgttaca

SEQ ID NO: 98824 - DNA, 636 bp, Oryza sativa
ttccaatcggccgtcaccgcccgtcgagccgttgtctgccacgtcagcttgccgccctgcactagggcagcaggatctatttttataaatttttccgacgatagattatttctgtaaatatttttaaaaaatttaaaaaaagaaaataattcgtatctattaaccccaattatgctaccggacgttggatttttcttggcttccacctggcttgggatgcttaatcgcaacggttttccccttccactaggggggaacctttcattataccggaaattccatctcggtttcaatctggtttatggtccggcatttaaagcgccagaccggtcggctttgaaaaatattaaagatagaactatttggtcttcggcctgggttagaccgaaatttcagaaatattcagaagaatcgcccagatccacattaatttccaattaaaaaaccttcacctggaggaaaattcttaaaaatcccagatcggctttcttcattatcatatacctatccccaaacgggttcggcacctttgttcgcttggggggtaaaaggaggcccatcagatgtgccccccggggtggagccacggaggatcgcggttgggcctggccgttggggggttgaggcctccgggct

SEQ ID NO: 98825 - DNA, 510 bp, Oryza sativa
cccatgtttcagagtgtgaagttttggcagcggaggccaccctgcttttctacgaaaggctgtagcaacctgttgagtagtaaattaacttcttttctggacaatggaagtataacttccagcctctgcaacaactaagaacacatacaaccatgtctatgaacactaggatttgaaccttggtgggtggatccacgactccaccaccacatcaacgggaagcacgcttccctagtaaatttacttagggacaacacattttttagggagatctccaaaaaagtttatgaataattgatactcttttgtttgagaacttaatcttgaataaagaatcatcaactcattcttttttttcctgacctcgtggagtttgttctagtagagatgaaatacgagaatcaattgatcaactttgtttcagttgtaatattattgttgtgtgctggtgaaaggatacaatggatagcccgtgatagcctagcctgactttgttattttcccctttgg

SEQ ID NO: 98826 - DNA, 645 bp, Oryza sativa
ggaaagaaatgtgtccctgcaatcaaagacgacctatatagtttagagtgtggagtgatataaagcaacagtatttattacacatgttacgtgcgcttaccccacgcttaacaaattcaccatctagaccaacagaagcgcgtagcaaatgaatgcacaagatctggaagaggatactaaatcaggtttagcaacatattgtacgacataattccacttatgttacaaaaaggtactttggttgtacctttgggaaatgagtgatagccagctgctttgttgcctgagaagatatcgaacatgtcatttcctccggggtaaatatatgcctgcaactgcaagtgccatagtcgacacaggtgtgtagtttgttaattttttcctgccaaagataacaatacagggtatcatatcaagcttagttaaacaactaagatacatcaaaagataaaactactacctcatcaacttcggatttaagagacaaatatttggcagcaacattgtgccaacaatgatcacaacgatagttgtcaagatgctccaacgccgtaaagtgctcactgcaatccaccaaactacatccattgatctaaatgtcacacgataagagaaacataagggaaacaagcattatgaatagcg

SEQ ID NO: 98827 - DNA, 724 bp, Oryza sativa
aaaattcctggtcgataaaattagaaaagagagaagaagaggtatgtaccattagggaagattgtgatattcaaacaaatcaaccttgatttgtgtgagggctattgtttcttaaaatggatagctttatggttcaatgtactccctccgtcccaaaaaaaacggctatgtatctggacatgacgcatgtccaaatacataaccaggagttggcttttttgggacggagggagtaaaattctagtctatgacaattctaataatgatatcattatgattttgcaacatatcaataaatatgggcacaactaaatgaattaagtttcacttttggacccgcggaaggcctacgcccatcgaacaactagataacaagaaaagcttagggagaaacatatatataagttggcttcaatttccacgtgaaacatacatatttccaatttataaataactttcaatacacactgctattcgaaattatcaatagttaatacaattattttgctactaaagtataagacattcccttcgagccaagtaccaacataaaaaatatttgggatgctgctatgtaatccaactagaattaacatgcaaccaagtgagcatacctcaattggttggatttattgtggtggaatctgttcgcctgggtttaaattcttggtacagatgctcacatttacaactaattattttttcagtggtaagcgatataact

SEQ ID NO: 98828 - DNA, 656 bp, Oryza sativa
cccacccagccgagtactagtagggagctgccatccgctgcactagtgaaaaactgcttttccgctgggtgcaaagcaaagcagtcgccattgactagcccctccctgtctgccacttgcaacagctaagcactctcattatctatgtttggatgatgaatctatccatggccattgggtatttgggtgtgtgctgagcctgagcctgggcgtcaacacatgtgctggggcgagggagtagggctggggccaggcatctctgagccgtagctaggggttgggccctgcagccttttgtttgggtcgcagcggtggttgggttcggggacgcggtctcctctgcttggggacgcgaccaccgctgcattccatggttgggtaatgcgccagtccggatttggatgcggcacgcactgtactctacggtggcacgccaccagccacggtgtgtctcccgattaggggtggcaattggagttagaacaaaatggagagtgatatcactcgcttgttttaatatacttttgattaaatttagactgatataagtgtctgaatttagattgaggggtgcatacatgctaaaggaacccccctcctacctagctccatcgtttagtggggaggataagaacatccctgctcacttttccctt

SEQ ID NO: 98829 - DNA, 769 bp, Oryza sativa
cagcgatattttttgagatcactaaaccacaaaaccagaaatgtgtaccccaatactcaatcaaaccgtgcactcaaggtcctatggtagtatatatgggtgatttcgctgacgtggcatcctagtcagcaaaaaaaaattaaaaagtatatggggcccacatgtcagctgcacattttattttcttctccttctcctctctcttctcatcttcagtgaaggaggccagcggtgggcggagcggcggcggtcgagcacagcgacgggtagagcagcggtgggcaagcgcgtcagcggagcggcggggggctacgggcgtgcacgacggctagtagagcagcggggggcgagcgcggcggcggtgaactacatctccaagagggggggtggaggaggccaccggtgccgtgtggtgcacggtcaccccgaccgcaacccgtccttgtcatggtcctccccttcatcgacaagcctcctgaagtcgaggtccatctcgaggagctcccccgtgctcagccaccaccaccgcccgtgcccccgcgagtggctcatgatgctaggagcggcaccaccagcgggagaaggggaagaggcagaggaggagatgatttcttggtcactgattgcctccctcgcatgcaagctaggcgagctcggacgggctcgccggccgcctccccttccctcccaatctgcttcgcccgcggcctgcatccacgctcgcccatcgccggcctccctcattgaagatgagaagagataagagaga

SEQ ID NO: 98830 - DNA, 798 bp, Oryza sativa
gtgaacacgctcacatatgtgtggtacaaatgttcaccaatgtgtagtaggtaatccctccgtcctattttaagtgcaaatataagtttctgtatccaactttgatcgctcattttatttgaaaaaaatttataattagtatttttgttgttatgagatgataaaatatgaatagtactttatacgtgtcttatgttttgaactttttttaaaaaaaatttaaataaaacagataattaaagttggaaacgtaaaataatagcgacactgaaaatgggacggagggagtacgataattatagtttatgtatagtgtactaggttctgaacatgttttctactgctagctgaccgcacgatcgtgtcgctatcttgtcaccggatcagcttttgttgtacaggctagtaccaaaatttgtacaagatgggaagtgagctccattggttaggaatttttggttgaaccagtgaatccatctgcttcaaccgttggagtgctaaacaggccctaagctcgacacgagtattcgagtatttatatttacagttaattatttttttaatagtagatgacgtatccatcaatagcttttcagaaggtgttcatcagttgtatgtgccgtgtgcgtttgcatttatgttgtgttttgtcttggtcaatagtgatggtatttgccgaaggagatactactagtataacacgaataggtactgctagtattgttacactacaaataattgacacatcttgattattatgtaatcgtactcgatcaatgtccatgaataatccaataa

SEQ ID NO: 98831 - DNA, 2034 bp, Oryza sativa
ctccgtcccattttcagtgtcgctattattttacgtttccaactttaattatctgttttatttaaattttttttaaaaaaagttcaaaacataagacacgtataaagtactattcatattttatcatctcataacaacaaaaatactaattataaatttttttcaaataaaatgagcgatcaaagttggatacagaaacttatatttgcacttaaaataggacggagggattacctactacacattggtgaacatttgtaccacacatatgtgagcgtgttcacgagaaagtttgtgtacgccgctgactttggtgtgccaacgtgacagcatccatccccgtacctgaaaccctgttcctggtcagagtcagccgccgattgacggtctctgcaccacgtggacgacgtgcgccgtcgacgtcgtacgcgacacccccctcgacggcgacacggccacccacaaccacctccaccaccgtagtccgtagtcatcatcatgccgtcacatacgcggccacgccgccgtgtggcgcctttcccctcgcggcgagagcggccgggcgcccgggccggcacgtttgctgtgcgcgcgcgggcaccgccacggcgcacccgaaaccgaaagcaacccacgcctcgccacggtttcgtcgataaaattaattctgtttattttccaaacaaaaaatttttcaccccgtcatatcgaatgtttaaacacatatataaataaagtaattagatatgaaaaaaaactgcttcctccgtttcacaatgtaagactttctagcattgctcacatttatatagatactactacctccgtcccataaaaaatgaatttctagctttaaacctttgtcccataaaaattgtatttctactaatgtgggacccaataaactgattgcatttccttgtaatcttctttccttccatcttatttctaacccattgtcatgacattccttttaatcaagtttatatatggaatgtgtgcatgtactgtgttcattaaatagggatattttagtcatttgcctatccgaataatatgtccttaattctctagaaattcatttttatgggacgaaggtagtaatgaatctgtatatgaatgtattatatatatagattcattagcatctatatgaatgtgggcaatactagaaattcttacattgtgaaacgaaggaagtaattacacatattgtgtgtaaattgtgagacaaatcttttaaacctaattgcgccatgatttgataatgtggtactaccgtaaacatttactaacgactgattaattaggcttaataaattcatctcgtagtttccagacggaatctataaattgttttgttattagtctacgtttaatacttcaaatgtgtgtttgtatatccgatgtggtacgccaaaaattttcgtttgcgaactaaacatgcccttaggctatttccccaactttcttttttttgcgcatgcttttcaaactactaaacattgtgttttttttaaaaaaaattctatacaaaagttgctttaaaaatcgtattaatccattttttagaaaaaacaaatacttaattaatcatgtgttaatgagtagctccgatttacgtgcgggaggtattggttcccaacatcaaagaacaaacacgaccttaaatccaaatactatactttcatataaatataagtataatttatatataaattttaatataattctaagcagttagatttacttcaagttttatacaaacggggaagaaaaaaaactaacacgtaaggggatttggtcctccgaacttcacttcgcgaaaggttacatacaaattatgtactccctgtctagatacacggtgcttctaattctctctcatattgctatatttttaaaactaataagaactttataataacattataattatattatagtagtatttttttttaaaattatggatatagagagtcccatagagagtccgacttggttctctctctttttgggcaagtcgcaatcatt

SEQ ID NO: 98832 - DNA, 604 bp, Oryza sativa
caaagagggaagataaaaaggtgctggtgaaaattgtggagattggagaactgtagttgcacttcaaattatttacagaagccaagatcagagtaatgacatgttatggctggtactgcaccaatcaaccccaaaaaggctagatgctgcatgaatgaatctgcaagccccttgattccaaaacgattaatagattgactacctattatttgaatgttcttaacccctaaatcagtcgaatttccgattatcagatgaaaatacaacggattagatttgcccctccaaacacatagactcaaacagtaatcccacctttccccaatccactgagccgccatcgcacacaatccccaattccccatgactcgcactcgcgagacgcttggcgagcgcgtctgcctgtaatgcgccataggtgccagcaccggcaagccagcaagccattccccaccgcagggccactgcccccacgccgctttcttcctcctctccggcatcaccttcttcccctctggtagcctcacgcgacacgagaactcaacggaaaccgtgtgcgggcgaagaccactaccaaaaacccaaaccctagtgccgaggatcg

SEQ ID NO: 98833 - DNA, 681 bp, Oryza sativa
agggaagaaatcatgagacaaatttttttagcctaattagtccatgattagccgtaagtgtcacagtaatctacatatgctaatgacggattaattagtctcaaaagattcgtctcgcggtttccaggcaagttatgaaattagttttttcattcgtatccaaaaactccttccgacttccggtcgtctgatgtgatacccaaaaatttccttttcgcgaactaaacaggccctaaacatcaaatgtgacatgtaagatcaaatttaatcgttgatccaaacaggcacttggggacggagggtgtagtaaaaatctcctgcgatattgctgacacctagtcaaatcagtcaccacttgcgcggagctgaagagccggctcgttcctctccttcccgttcacatttcaaaacctcaaagcccccacaaacttcggaatcgaggtgagcgggagttcggagagatcaacccgagggccgccggccgatggcgatagatcagcccatcaaagcaagttctttcctctccctctctatctgtatctctcgtttctcgattaaacccagtttttttgggggtcatttgcttcgcttattcactgttcatccggttgattagagaccgagggttctttgatttgttccactctctcttgaatcatcgattaatggcggcggatttgg

SEQ ID NO: 98834 - DNA, 538 bp, Oryza sativa
ggtggtgccatttacacgtgtatgatggaaatgggtagaatgagatggagacggcgcctctggagccattggaatggaggatgatagtggacagggtaaagtgttagataatttattgaatatatatatatatatatatatatatatatattatcgataataaactacgacatggagttgataggtcttaggataaaaatatagtcagactcttatcttagtggtaattgcatgatggcagtaggcgagagaacgacttgttggtaggggtaaaaatcggtcgggtacggttcggatcttacccttcccatatcctaacccacattttataatcggaatcgggtcgggcatggatagtgccaaatacagatacaaactcggataatgtcgggcaaaaatacggaacgaatgcttaccaaaatggattagtacactatcgattacggatatttattcagatatcaagtcgaagcaacaaccttatctatcacatactccctccgttttataatataagactttctagcattgcccatat

SEQ ID NO: 98835 - DNA, 697 bp, Oryza sativa
  unsure (1)..(697): unsure at all n locations
agaagcggcggacgagccgagggtgacaccgtacatctcgacgacgacgacgaggaggcggccatgacggccatgcatggtaaattaattaaccagctcggtcttgatcgtggttaattagcaagtcctgttcctccagctgatgattaatttnttttgttcaatttcaacagtgttgaattgcttggtaaatagtagtggtagtgacataagtacgtttcaccactatatggcctgtttggatagcttctgcctgccgaagattcttttagaagccactactgttagacagtccagattttcactcgaattctaagaatccgtagttgtagaatccaaaaaataatctagaaatcccaagctatgttttccagcttctccaggttctcaccagctagcttctcaccggttgtttctcagaattttaagctcccaaaacaggacatagggtcgtttggaagagacgagtgagatcgtgtgggggcaagggccaattggtctccctctgtgccgtacggcccacgcgcacatggttggtgcaccagagcatataagaacgcacctgtgggctgggctggacggtccaggtctctggagccaggctagatttagaaggtacgcgtacagccttgtcatgttgtcccatcgcacacacttgcacaagaaattactccaaaagggcagaggcaatgtacgg

SEQ ID NO: 98836 - DNA, 697 bp, Oryza sativa
cgagctcggtaccctaaaattcttggcaatagaatatcaatcatatgtaatcatctgcccccacaaaaaaaatgcattgtacatgtattcctaattgtacaactatttattctggaacacttgatattaattattcaagccacccgatttaggagcaccatcttacaatgattgaagatacatttgtaatcatatttcctttgtacgtatgaagtgatcacagtgatctaggaatcatgcaatcacaatttcttacaaatatttcacaacataaagaatagtgttagttgcttttacactaataaaattcttataaacagtgacaccccctgagcatctatgtccaactacttctgctaaaacacaaaagtttagtaggctagctattgttttccaacgaatatacaaaatacatgcaaatattctcttaggtaagcagtgaagtacacgcatatatacacaatgacccttaaccacagatcatgaaaaatacaggaactaataaatacatgaaccaatcatgcttatgaacccatcaaggctcaaattaattcaaatcaatcatgcaagttcaaaatattgctgtggtgaacatgcaacgcaatcttttcgaaccctccaggccaattagttagctgccataataacaactggaagagaggcgatatatacctgtcggtgctaaccgggctttgct

SEQ ID NO: 98837 - DNA, 538 bp, Oryza sativa
caggagtggatggccatctgaaaaaatcgttttggtccgtttgtaaaaatgatttttctcatagtgaagcttaatacggctgggatccgccggccagggccccgccgtcgatcgatatcaatcggcgccgggaaaaaaggcgccgacgtacaggggcggacctagggggtgtgccgggttggcaccggcatacccaatttttttggaaaaaaatactaggatgtagtatgaaatcaaatgacataaaaatggaatcctctcagaaaatagaatataacaatgatcacggtttagaaatcaaatcaggggaagaggaaaggaatagatgaagagaaacagtgggggggggggcagctagatatatagattaggacatgggattgattgttctgaattttattgatttttcatgaattatgggccatatttgaatagaattttgaaaaagccgaccaaaatctgtcgaaatttttccatcaaaattaggtgttttctttttaaaaaaatatatggtggagtgatcgctagaatgaacaca

SEQ ID NO: 98838 - DNA, 513 bp, Oryza sativa
aaaaactggaccaacatatcttgagattgatgaagttacctaacacattcttccgagaaatattaatcacaatgcaagaataaattccaattccttctaaatcgcaattaccttacaaccataagcatcattactacaaggttttaacaatgtggaactcagctacaagtctatttgtcagtaattttcttccaaagtttatctcactagatactagtgctgctaatacatactccctccgttttaaaatgtttgacaccgttgactttttagcacatgtttgaccgttcgtcttattcaaaaacttttgtaaaatatgtaaaattatatgcctacataaaaatatatttaacaatgaatcaaatgataagaaaagaattaataattacttaaatttttttaataaaacgaatggtcaaacatgtgcttaaaaaatcaacggcgtcaaacatttcgaaacagagggagtaattcataatctgcacaatgcagatagttcgtagatataatgta

SEQ ID NO: 98839 - DNA, 527 bp, Oryza sativa
gatgtaacacgatgactataggcgaatgtcgagctcggtaccctgagaatctctacaggacagctgaccgcctgtgcacatgctgagagccgactgagtcattattacggggcgggctgcccgaacttattgtggtcgagagctagtactagccctgcggcttcggggaggattgcacgtggggtgagagatctaacgcactgcgggatatgtagaggatgaacatcttctgttgacaggagcttatctgcgatccaggagaagactgcgtcggctaggtggagagtgttcactttatacgaaaaccataccggataaagcgggagcagccttcttagacatgactaaatgtctgtattcatgatgccctctgtgaagaaaggaaacaacatgtgctgaaagggacactgttggccaccctgctgcactgtaccaatggatggtggtggaatgaacactaaacaatctaagtctttagtcataacttggaatgaaagacattatatgtatgtatgttctatgctacc

SEQ ID NO: 98840 - DNA, 603 bp, Oryza sativa
tatagggccaattcgagctcggtacccaaaaaaaaactcaagtgagtaaagaatcagaataatatgtgtacacttgggaagttgaaaataaaattaagagcaaacattaatttcttataagaatcatatactctctaataaacatcacatcaaatttacataatgcctgtcttcactccatgcaaaagacagtttggaagtttggtcgaaccaaatgggtcagagatatgaatcactagcaacaccttcagtacggaagagctctacagcatttggtgtcatcagaaaggagaaagtaaaattgaattcaaagtttcaaacagttgcaatgttttctcaatgaccaatttcaacccaaaactgctccctcagaaaaagattatactagctaaatttttcgttcaaatacacataaccaagagaagcaactcgctctgtaattaacagtcaccacttaaactgaactaatacagacaaaagatgaaaatctggttgttgctaaaaaatgacataataaattgaagtaaagccttatcagcacatacaagtatttgaaacaaaaaaaatgaaatgaagtaaccaaactttaatggataaacagag

SEQ ID NO: 98841 - DNA, 739 bp, Oryza sativa
tatcaggtacacgagatcgccaagtgtgttatccagagatcccttgccacgatgacacctatgttgaaacctatcctactgtccctttacgccgtcttgacaaggcctccgaggaacctaagggaacttcagctggggacgcccaaagccgataaggccttgtcggatcctgtagagacaaaagaccatgtaagatctggtcgtgtaagagttctcgccgtgcgtattaaccaagccgtgtaatcggaaaatgagttttccaacttcacggctgggggctaggatcagtgcttgttcaaccgaggcaggtcaaaggtccaagagccttatcatccgagaacgattctccgacgacaaggctaggggctagggagagtgtatgactctacaaactgactgattggagtcggtaagagagaagacgctcatataacaaaacattagtctgtacattcaattcactagtctgttatattataacatgttaccctttgagcgttcgctcgggggctatttttattaatattcttttttgagtactgattttaggaaaattctattcgacattatcgaaggctccatgtctctatggttctacaccaagatcgactaagacgagtacgataaatgtcgacaaggctccgtcgcagactctacgccagctcgattactcgagaacggttggtggatctcgacaaggaatacggaatgaaaagatggtgtacccgccgagataaaa

SEQ ID NO: 98842 - DNA, 640 bp, Oryza sativa
atgttagagcaagctagaaccacatatcaagaatattaaagaagagagaaaaaaacgaactgtagatttgttgccagtggcaatacagacttgaagacgttgtgtgtatatgagaggtgtgaccgggtattaatagattagtatatttttattcgtaactattatataaataggttattagattagttatactccctctgtttcacaatgtaagtcattcgagcatttctcatatttatattgatattaatgaatctagacatatatatctagattcattaacatcaatatgaatgtggaaaatgttagaatgacttacactgtgaaacggaggaagtagatgatttatagatatcatttggctatactattaaacttgctcttacctttaatcttgatttttggccggaacagcacagggacgcttatcgattttattagatttaggaggaataacttaatctcgtctcaaagcaaaatatttgttttatcccataggtaaatatcaaaaggaaatatgggtctaggatttgacatgctacttattagtattacgacatgactatgccccattattttatcacgcaaatatagggttctcaatggctgtatttagttcaccaaaattaaaagtttggtt

SEQ ID NO: 98843 - DNA, 766 bp, Oryza sativa
atatggcaaaggactagagtttatttttaccatcaatccggttaagacaaccactagtgtctattgccttcctaggagaggtgtaagaacttagactgtagtttctatggcatcatgtgtacctagttgttggatgtattcatattgtgttcttctatcatgttccttttagcactgagaatctgcagctaattgtcgatttctaggatcgacaacatattttatagggtgcgctagatcaaagaaagaaatggtgacacaaatgttatactggttcaggccctcgacgtgaggtaataccctagttcagttgtatatggattggatctgtgtccggtatgaagagtggataatgacgcaaggtgcagccatcatccgggttgtcgagagtcatccctcgtctcgggaccccttcccctctatataggatgaggggggagggttacaaggaaagtatctagttgattgcaactagatccctctattccatctataaaagatatgtaggatcctcgggatttatactttatcccgggtttgtctatttccttatttacaaggcagccatatgggcctatgcccttggcccaccgtatgtcgcagggcccgaatgcctctccttgggtacccgggtaccgtgtaacccacagaagccagctgggagagacaagactggctgagtacttgtagacccccgattttggaaattggaaatcttctgtgtttatccgtaccaatccctggatcagtagggtaccgagctcga

SEQ ID NO: 98844 - DNA, 652 bp, Oryza sativa
gggatagtgggtccgaccagtcaaccagtcaaacaaaaccgtaaattggtatctgtgggccccacatgtatgtgaggtatttaacggatcgtttgcacacaacgggccagaaattaaatcgacttaggttgttattggttttcttttttcgggaattagttggttaatttgaagggtcgtcggtcgtcctacgactaggcacactctattaattactccattggtccatgagtaccagctaaatctcatcaaatttgtgacaagattttgttggccaccgccgttttgattggtatataggagtatatggctatgagcatgtcgtttttataattaagtaggtcgtcttgtgtcgtaataagcatgaacccaacaatcatctctgtcatttgttgctgttggtcgcacgcttaaactaatacctctagttagggagctagatgccaacgcttaactaactaatcagacaagatatatacactacagtataagcatgacttaatcctccgtgcgtgaagaagtgcacgcacgcaacagttaattaactcgtacacctcctcgctcgcacgcttcttcttcttctttttttcttctttcgaatggctaatggattgtttgcgacaattattcgagggtaggggatcctctagag

SEQ ID NO: 98845 - DNA, 683 bp, Oryza sativa
catcccactgtgcttgtgtttgtcgccaaaaagtttgactgtaaataacaaatttgtaaatagtgcgtattatttatagtcaaatttttttttcggtcgtatactaagttgaatatgaacttgtatgattgtggtgatatatcacatatttatccacttttttaagaaatacaattttcttttgcaaacgtgttaatatttcaaactgaaggcaactctgaatcacttatcattgtggaaataaaacatattgaaccaaacagatgaggtgagctagaattttacaagttaaatcatgtgtatgggaggaatcaggattgtactacctggcaaaagaaccacacattcttactttgccagcttgcagcagaaatccatgtcatctttgatgccatgcaggcaggacagatccagtttcaccttcaccaagccaaccaaacatcatccaccgtgagaaattcccttcgattctctgtattatgaagcagcatatttgacaaacatggaaccctcaggtttagcccagccttgggcgcaggatgttggcaccaggcagagctaggacagagcagatgatctcaattgcttgtgcacagccactttgtcaggtagacatcatcagcagatagctcatatggcaagttttgtgatgagtaccaattgacctgaaattcaacttgaat

SEQ ID NO: 98846 - DNA, 534 bp, Oryza sativa
atgatggtggtctctatttcatggagctcacgcttgatgtccacgccaaggcacattgaaaggtcagtgaggagcttcatgaaggttggcgatgctgccaaatgtaagccagccagcaccacctttgccatggaacagcactagttcttttctgggtgttattttctttcttctttcaatactatattctcttttacatcaggcaaaagtggagctcattgaagcagtgtcagacgcaatgaagatcctgggtattcctggggatacctaaaaatttgtgtaataaaattaatatatataggtatatcacatttgtatatatttacatagatctaatacttcattcccaatcttttttctcaataaatccattttttttactcctagctcacaccactttcaacaatctcaaatgccctaactctatcccactacaacactagggacatgacacttgtaatggttgagtgaatacgccatcttaaaatcctgcttccatgtcacgacgtcggcatcaccatgcgatccagaagt

SEQ ID NO: 98847 - DNA, 636 bp, Oryza sativa
ggttaaactttgagcagtttgattttaaccaaaatcaaaacaacttataacctgaaatggaggaattatttatctatttagaaccattcaattatgtgcaattctacaggaattcgagacataccactgcatatccttataactgtattttctaattccttttaggaccaaattacccatgttcttcatcccctatgcttagcagtaagctcggtaacagcgtgctttctgtggtgaacattaaaaaacctggatatataaaatttattattaaaagtttaaatgtttgtttaagtttcttttgaactaggttaacaatcgtataataagcctgttaccacggtaatcatcggtaaggaaaatcgtggtatttattaacttgctatatatgcatttgtacggtacgtacagttggataagatttatatttatattcataaaggtcctgttcgatttaactttttggctgattactcgtttggcttacatgagaagagactcaaataacatatgaattattatacttaaatagatttatttgaaattataaaaaaacttctacatgtaaacaaattacatcatttagtaacttatataatgtgtctttgataatctggttgcttagaatataaaaag

SEQ ID NO: 98848 - DNA, 684 bp, Oryza sativa
gtagtgtataccgaaaaaaaaaacattgctattgtttgtgatttggaggacatcagctatgcgttttggttagcgttctggaagtgtcaagctgtatttgaccagtggaaacgccgtgtttgttttagcggcacaaaccagaatcagattgccatcaatgtaccataacatttcataccagaatccgatcagtcttgaaatttttattgttggcagcttcgttgtcccaaaatgcgttgataatccgtaaacagctatagtacacttccaccaatgctttttgtcacagatcaacagtcaattgcattctgatgaagactgtcacatcggaccaaagcaactactatccatgaacatgaattatcaatttgtccgtgaacaatgccagggaataccaaattacgaatccctgtttgactcgaattcaattcacatccatccatgaaccatatggcctgcacgttggcacgtataatctgacaggcacaatcacctactgctacgacacacgaagccattgtagatacacaagcaaacagtttggccccaaaaaaaaccggatcgtctctgtctgcagcagcaagagcaagcgaacaacggggagagtccgaattcgcagcagcaaagatttctgtacccttttctgcaggcgacaaaatcagcaaacccaatcaccggcagatt

SEQ ID NO: 98849 - DNA, 661 bp, Oryza sativa
attcgctggaatgctaaaacatgccatcccgttccaagcagtggaacaggatgcacccagctctccactgcatgtgacggtgtgagcgaaatgagctctcctccacgggcgctgcgccttcttccccacacgcactctgggataaagcaccgtcagctgctcatcattgtcgtcaacaaggcaaaggaggacaaagagattgagagtcaaaggagttagttgaatggcggccagaaagccaccattggattccttcacagcaccaccgacaaggccaccgcaaaaatctcccccatgacgttcatcgcggtgctttctcggtgccctcccgctccgctttcttttcctcctccgagaagataaacatgagaaggttcaatgcacggagcgaggctacatcgacgagcaagagctcggctggtgcaaaagacgacatctgagaggggatgccatgtcccccaaggtgtaagtgccccacgttggccgcattgaaaagggagcgtggggcgtgggctaccagtagagccaagctaaacaagctagaagcggcaacgacatcaggaccctagaccaagatgtgagggaatagagagtcggggttagagaagacagttagacatgagcaggcgttgaaggacggatctaaatgtatcaaacctag

SEQ ID NO: 98850 - DNA, 984 bp, Oryza sativa
cgacgaagattacgcgaagcacacaagcaaagctacaagcctataaagaagcaataacaatacataaaaataaagcacaggattctttaggttataacaaacattaggagacttgaacggatcgattcggagctcgtatgaccaagatatgatcatccgaagtttaatgctgttacatgaagatttgcggattattataattaggttttgcaactataaaacatgtggaagcgctagcctgaaaaagacagaaaggctgcgctgttgacatgccgaccccacatgtcaacctaaaggaccacggtagaccgagtacacagagacggtccacgggtcgacggaagcggaccccgtgtgtcaaccgaggcgagtggccgacaaacggactccactagacaccacacggcctgcacacgtggaaaccacgcggctaccgagcgggcacactaacacggacactacctggtcaccacccgcacatgtgaacgactaccgacaccggtacacgggtaccggggtcgacaaccgcacaacgggtacggggcgacactgaaaggacgaggacgaggcagcgagaggagagatccttaccaccacgcgacgaggcgtgggaaagacaacgacgaacgggcgcggcggaaacggacggcgagggaacgacttcggcgaagatccttggacgaaggcgagacgcggccggcgcaacgattggcgacacggaggcgaggacgaagacgacgacggggctgcagcggcacacttgacggacgcggacgacggacaagaacggcttgacggagggacgaacgccacaacgaccgggaacgacgagaggacgacgacgacgacgaccgggaccggcgaggaggcgacgagggcagccggcagcggctgcacggagacgaggacggcgcggaccacgccgctgcgatgccgacgacgaaggcggcgccgcgagacgacgagccggcgagaatgaacggt

SEQ ID NO: 98851 - DNA, 644 bp, Oryza sativa
aaattggggcaatttaagagaattcaatggggattaaaaccccccaattaatttgaaaacagcgggcttgaatggggcagatttgaagtagaaacggcgctaggtttgcacgggagaaagaaaagaccggttgggggagaaagacgggtccgacaggcgggacccgcctgccaggcgcggtcaacgcgcgtgggcgcgcgcgtaacaggcgcgtgcgcacgcggaagaagggcggctcgggcaggggcacggcgtgggccgggcggccggcccagaagaagagaaggggaggggtggcccgggaagagcggaagaagaagggagtgggccggggaagaagggaggctttgggccagacttggcccaaaggagggagagggattatttttaggtttttctttttaataaactttgataattgtttttgttgtttaataaatatttccggtgctctaaaaattcaagtaaaatttgagggctccttttagaccaaggagaatttaacaaaaattctccaggccacattcgaatttttcttgtacgtattatagtgtttgccaatttcttttcaaattttaattaattctattattccttttagagaatgatttttaattcgggatgaatttatcaggacgtgacaa

SEQ ID NO: 98852 - DNA, 592 bp, Oryza sativa
tgaatatttaaaagaaaagttatatggtcatagtttcttagatataagccaattacttcgaaaagctctagctaaagaaagccgcgttagagaagccaaaatcgcatagaatgtcaggtctgatcaccctcatgttaatatagttgatcaacaaaaatcttcggatgatgagacaattgttgtatccacaaccaaatgggcttggaactccaaatctaaaccattcgtttggtcctctcttaagtcggtggtcgcaagaattggcaagaggaggtaaagttcacattttatatggccaaatgcgataggattttttactacttattagaaaagaatcaaattaaattgtcacaaggccgtgtcataccaacacttgaggaattgaagcggtgagtatattgtatgtggcgcaactcttattctcatgccacaaatcattgcaatgtattccgtagacaaattcaattggcccttgatgaaggatgattgacttttacaaaaatgcaagtggatgagctaccttttcctatacgcaccattggattgcttaaggacaagaacacattgaagactttaaaacttagggggggca

SEQ ID NO: 98853 - DNA, 597 bp, Oryza sativa
ctagtttttttagataatggaatatagtagttgtgtggtgagacttgtacatgtctagtacgttgtgtagtgtagcttttcctaactatttatgcagtctgtttgacaacaataaatacaatatgttcatcgttcatttagactctttcgtagggctgcctagattgtattctgatgtcctgttgaatgaaccagatatacagtgtattgaagttcagatgttgtggcgtgaaagtgcatcagttatcaactatgaactgtttaagggttacgtacaaagaggaggagaaacaaatgagtttgttgcaggttatctttctatctcaatgtgaccattttgtggtcaatttgcaaccagaatgagtttgtgtaacagtggttttttttcacattttgaatttgaataccttccaacagactgcttttgaatgccacacatagtacagataattccatggccccatctccaaataattgcttcaaaacataacaaatgtagtttttcgtataaatggtggtggttatttgcaatgatgtgtgctgtatagtttaattgttctctgcaggttatgacttcttgaacacgacaggatatga

SEQ ID NO: 98854 - DNA, 985 bp, Oryza sativa
acggaaaaagagagagagaaagggggagggaagagaggggtagaataggaaagagaggaagatgagagaaacgggcttttttgggttgtgatactcattgggctacccatatatgacctgcatggtagaggtgagtacctctagagtccttcagttagtaggggcaccctaggagtggctcacatttgtgatgcccttaggggaagggccgcacggaaggcatatgtcaccggtgagcttgggaaagtgatgtaaggaggcttgtcggtccccactgcctccactctggtaagagccatcactggcaagatccatcgatcgatgcagcatcttttggagagagaaaaaacaggagacagataaagaagatacacgtgaaattacctaactatccttcttcttcagtacctctctatcttatataaaatcatatagacagtactactaggtacaactccttctcacccgttaggtcaaatgaaattgatggctcagattacacgtaccgggaaaggtacctgctggacagtaaaaattctcttaggattatgcagtgaaggacaaagagacggtttaggattgcacgtaaaacgagaaagctattaacacatgattggttaagttttaattgttttaaaattaaaaatggatttatctaatatcttgaaacaatttctacataaaagttttcacatgaaatgtacctttctagccatttggaaaaagtgctaacgaaaatcgaggtaaaatatgtatctcgatcagaaattgcttgtctgatttactattggactttatgtaacacccagaaaaattgaccaacaaaatcaaaactctaaaaatacggaccttcaaaaactttttaaataaactgcatcataccggatttattcgcctattttatttagattttattgcggagttcaattaatcgagagtaagaataattaattaggaataaaccactagaaaagaaattgacaag

SEQ ID NO: 98855 - DNA, 1683 bp, Oryza sativa
atgaatggttaaatgttagtcaaaaagtcagcggcgttatacattaagatacggagggagtaacatttttaacccgagatagatttgttctgctgatagattcaattatcactatgatggaactaatttagtattataaatattactccctccgtttcgtaatgtaagtcactatagcattgtctatattcatatacatgttaatgaatctagatttatatatgtgtctagatttattaacatatatatgagtgtgagcaatgctagaatgacttacattatgaagaaacggaggaagtactatatttgtctataaatttagttaaacttgaaacagtttgaatttgaccaaagtcaaaatgtgttataacttgaaatggagggagtactccacagaataattcatcacgaccctaatatgaaaattccgtcctgtagaaagagtttttttttccgaatagttcaatgatttcttttataattacaaggatacaaataaattaattagatattataaagtcaaaagatagatttaaatagtttttcaaagaaattattgttagaatgtcatttttttccgaaaatcacaccgttaagcttgatcgggaagcaaggatgtttatgcccctattccttgggggaagaaaaagcctattagccgtctttttttctttcgggaacacacaaaaatcttacacgttgaaaagtgtgtgtctatatatatgaaaagtacttcgtatataccaccatcggtaatacgtcgagacggttacgaagacaagaggggaatagtgcctgttgggaggagcttctagctgctgtagcttcttccagaattagaagttccctcaaacagtccaactttagtccagatttctaagaagttgtagttgtagaatataggaaatgaattagaagacagaagctgagaaattcaacttttttaaattcttagaagctggctaccaatcagctgtttctcagaatcataagctacgctaaacaggccctatgtgtcacgcaatcgctagaaaaactcaatgcgcctctcccctctctaaagtctaaactcagttccgacggtcatcgggtcgtcatgcacgaacgacggtgcatcaaaacgatacagacggcaagatatcgaattaatgttaacatggatcgatatgtcgattctctaaacgtaccgggaacgacgatcgaccacgtacggcggcgcgcggagatcgacgagacgtacgttgctcgaaccggcgcagatcatgcatgaacttgcacttggtaaatcaacgggtcggccgggaagaatggcggatatatatgcactgcaagttcttcagcatcacaccatcgcaacgacgcgacttccccccacgcgcaatcgcgtgcgcagcgagagccattcaacgagattttttttgtggtagccgtacgtatgccatgcacatggattcgatgatatgctcgcggctcgcccctttgttgtcaaagttccgagggaaaaactctgacgctacgcgcaaccgagggcctagaaaaaaactttttgggcgtagtcatgctgagtaagcatgaaagagtaagcgtgagctgaccgtgagtaccggtactactatatcttctgtcgctttctcgaataggaaattagaaggaaacaattataagggattgattaggattagg

SEQ ID NO: 98856 - DNA, 532 bp, Oryza sativa
gaccctagaggatccccaatacgtagaaagaaagctgcagggcgactgaaaggatcttctgtggaggtatgaaacttgtcttgatcacatatttgcatcgactgccacattctcactctggtatcctgttcagagacagttggagggtgaaactcatattcagcagcagcttaataaggctttggaggataacctgaatgcaaatgaagtaacaaatcaagaactgttgccactaacacctccaggctttgaatcaattgtcaatggaaaacgtatgttctgggaactctatctttgctgtaaatgttcacttattttgttgcattcaatgtagcagttttctaatgatgttttttttggcaggttctcgtgattggaacactgatggtttctctgaagttaacttaaattctagtctgttcgatgaagagctgactgctacaatcagtagcatttgtcaagataatcataatagagatgcagaatctgacaatgtggctaccgaagtagctgaaatcagccatcttatgga

SEQ ID NO: 98857 - DNA, 599 bp, Oryza sativa
cctcctgttgttgtcgctgatggcccgcccttatgtcgtgtgtctgcttgattcttgcagggcatgaacgctgtcgagcgcttcaagactgggttcgagaatttcaggaatactatatacgagtatttttctgatgccctgagagttcgtcggtgtgtttaatacgattttgtgctaaatcgaatctatttgtttttgtcggttttcagcaagaggccggagctgtttgagcggctcaagactggccagtcaccaaaggtatagtgctgccatcagattaatagttttatacatagattatgaaacctataatttgttctttccagcacacatagaatgcgccggcataatttgctgtctctactaagaattatgccatttggagggtgcatacctcacattacgctcttttggtttgtttgtggactgaagtcaaactcgactaaggaattctgatgggaacagctcattaccattgtgaccattgagcaatatatattgataaaaaaaatagttgacaaaattttcatcttcagtacaaagtactagtggaatttcttcaaaattctacattagaggaactaacatgaacaaaagca

SEQ ID NO: 98858 - DNA, 503 bp, Oryza sativa
  unsure (1)..(503): unsure at all n locations
cgcgccaaggcccgtgtccgggaggacgtcgncgacgatccggcgcacaagcatgncagcgcccacgacgnagnagcccgccgtgatggcgttcttgtaccgttccagagcttcgctgttcggagacgccatggctgtcctcgctgcagctgcagtgggaggctctgattaaggttttcgatctaatcaagtgtttgagtggtttcagtaacagagattagcattcagcaggtgaggagagcttttggagtggttgccgaaagggaataccttattataaacattgtaaaggtcggtttaattggttggtgtttgatcactctgtcatgtaattaaccaccgtatactaatgtttgttgtgtaggttgtgattaatgtttgcttaggaaggagattagtgggtgctgactagctaacagttcggtctaccgtgtaaagcacttcagtcagtcaacaggtcccacccgggaccgcgcgtggtgagcccggtcgtgactgggaaa

SEQ ID NO: 98859 - DNA, 530 bp, Oryza sativa
atcttatatatgtgtgtaacaactaacattctatcccttatgctctttcaaggaggtaataatttttttatatcttaaattctcttatatagtgtgtattggaaaacatatagattaataattaaaacttacagtgtaattatattgtaagtttttaaatttatagtgtaattaaaatgaaaatatagatatattacagtataatactgatttgactacattttagtgaaaattaatgtatcataaatatatctagtgtcttatatttttaaacgaaattgtgatgtcagatcagacaagtcaatgggccgtggtttgtacccaagaggctcactatttcggaacgggaaactttcaggggaacaaatatttagaaatttccattgaactttagaaattttgatcatttttttagtaatgaaattcattccagccttttcttcaaagaaactatagataatttttacataaagttgtgggacgaatgactactattgctaaacctcaagctatggttagcgagaatttac

SEQ ID NO: 98860 - DNA, 507 bp, Oryza sativa
cggaattgaactcgacgatagatcggggattgagatcttgagatggcacggactctagtcaacaagcaaagaaacaaatttcgcaattagggtttttaagagataattttcccgctaggtgccacgacgtaacgggcgctatagatatattttatatttatctatcttgttgtttttttttaaaaaaaatctttttagttacattttggatgacatgtacaaatcactagggaagacaatagttcacctcagttatattactttcctgtcccgaaatataaaatctaggagttgatcagacataacctattacaataaggatatcttgatatattgtacaaggttatgtccaatatatcttttcttaagtcactactcctttcgtcccaatatactgcaatctaggatatgatgggattatattcatatatccatattcgtagtccacctatcctaggttgctacatattggaacgaagactgtatattttaggacaagaagagtat

SEQ ID NO: 98861 - DNA, 662 bp, Oryza sativa
ctacttgaaagagaagataaggaaatgttgaagcatatttacatctggagagagagcaattacactcggggaaaacaactggctgtgtttagtttcatgtcaaaattagaagtttgactaaaattgaaagtttgaagaaaaaagttggaagtttatatgtgtagaaaagttttgatgtgataaaaaagttaaaagtttaaagaaaaagttgggaactaaagcagacctgaaaattgagccaaagatgtcggtatataattgaatgacagttactttaagtgggttctttgaaaagagcaaaaatagaaaaaaaaataaaataaaagtacatgcctgttgaatcttagagcaaatacaatagcaaactataagcaagctataaccacgtatcgagaagaaaagagaagagggagaagaaagcaggctacagatttgtagccgactgcaacacggactccaagacgttatgtgtgtatgagaggtaggacctggtattaatggtgtagtatatttttatacgtaactattgaatgaatgggctattagattagctacagatgatttgttacgggccctgttgggacagattcagcttcagcttcaacccttctagagctggagctcaagcaaacaggttcagcttcaccaaactgggagtagag

SEQ ID NO: 98862 - DNA, 596 bp, Oryza sativa
cgcacaccgttgtaacaaatcacctacatattatggaaaccctctattaaaggaattcgtttcatttttttatgcacaaaaaatgtttcactatatatggatcaaatgttacaatgaattggaatattcttttgcaacaaatcacccacgtattatggaaaccccctattaagggaatccgtttcattttctgttccattaaaaatgtttcacttagtgtactcgtaatgtttcactatatatggatcaaatgttgcagtgaattgaaatatcatttcgctatttgctaaaatattgtttttacgcagggtgaaacaaccccattttttgagaaaccgttgtttcatatattttagtaaaatgtttcatgaggtgatttggttttgtttcagtttttttttaaaaaaaatgaaacatttgcgatctacttagcgaaacaattctgatttacttgatttaacatgcaacatttaaaaataattcaataataagctaaatatttttttatcggattatatccatgtatggtactgttttaaagatttaattggaacggatttaatggtgtcatccgaccatgatttgaataaataatt

SEQ ID NO: 98863 - DNA, 607 bp, Oryza sativa
ccgactgaaagtggccagtattttttttcaaaatacccagattgcccccgtgtcccaaactcggtcgccaaacaccactcggaggactgcatcatgtagatcgccgccgggaagtccgcaccaacgtgctcttctttggctgccaggacacccacaggacaggaggcaccaccacggcatcaccgccgccgtttcgccgcagtagtcgggacacgggcgaacttacacacaacaaccgccgaacgccgctttcctccctccctccctctctcctcgtaaaaatacttgctccaaacgccatccatccatccatccacccacccacacacagccgcaatcgccacctcattctccgcacgcaaagccgtcacgtcccgccacatcggcatttcggtgaacacctcacgcgcgcgctcctggtgtcggtcgtctgcctcgcggcgggctgcaacgtcgtgacacgctcctcctcccatggccggtgccagcggcgacggccggcgagcaactgggactggtcggactatgacgccgcattcactgaggaggccgacggggcgatcgccgcgctgcaggacacggacggagacgggctcgccaccaagca

SEQ ID NO: 98864 - DNA, 519 bp, Oryza sativa
agtagcgaagacgaagactgtaaagggcgaaaagataaagaatatggtgcatcgaatagatgcacctaattaggtgtagcccccaactatgtgattagttaacaaactaaacatatagttgaaagacaaaataataacacaatcgtgcattatatgacaaaagcgtacgcggcgcctaaataggcatgctagctgactgctttttagccacaataaaagaaatctgagtggtttacactctaaaaggttcacgaatgaacacactcgacaggcattcgaatataaaaactccaaagattacccatcaagtattataaagattatggtaataaataagtcgaatagcctaggccatgactatttaccataaaaacaggcatataagacgccaaggaaatgactataataaaaacaagtcattcctagttaatcccaaacagcttttgtagcctaaaaaagctcgcaaaaacagcataacgcctttctgtcgggcacctttttaatttgcattgcaatatt

SEQ ID NO: 98865 - DNA, 514 bp, Oryza sativa
ttccttgattccaccacagcagctgtgaccaatcacaatgatacattcaacctgccaaatggatgtctgtcaacatgtgcctttcatggagaataataagatccttgttaactgttgaaggggcgaatgtgtgagttcaccaaatttattctagagtggaattcttccatatccatttgggcactttaaatgagaataaatacagctaacggagttcagctatagtgctctacagaactccgaattacagctataatctgaaagctaactcgtccatgctagaatcatttaacacatgatgaatgttacagactctattattcataatatggaagtaagtggactgtatgatggttgtcgcacaaatatctagcactgctatgtgtatgcacattctttctaaaactttcaaagaacatacagtttcgaaatgcaaaacagaagttcactccctaaatcataccaggggtacttgatttgtgtatacattgccccgacaaaacctaatggtaaa

SEQ ID NO: 98866 - DNA, 623 bp, Oryza sativa
caaaatatgtgacttgtagaattttccaaagctataccgaaaagcccccctgttggtatttcttaacgatattactagaaatataattcccagcaatggcgcagaaatactcctggtatattatggttacggagtttatccacaagtacacggatataccattgtagcatttaacccgagagtattccaagagtatcatatttgtttaatcccgtgggaagattataatagagagaaccgtactaataatttatatattacttgtaataaccatagtctaagtaggggttagtataatccaaagggtagggtgacacgcaagcatagaactactcattctcatattaaattatctaagctaagtggaaagaaaatagaaaagaatctatttctatacttctagtatacatactgtacatacattctagtcatatgattaacaaactaataccctctatccgatgccctcctgatacttcaagaagccacccctagctgccgagtttcttacgacagctcgtcatgaccatacaaccggggctaaatacggaggagtaccctcccccagaaattaacttaggactatatacacgcgcagaggaatagacgtactgagctgtcac

SEQ ID NO: 98867 - DNA, 641 bp, Oryza sativa
tatccccgtccctaaatatttgatgcctataacttttttaaaaatgtttgaccgttcatcttattaaaaaaatttaagtaattattaatttttttcctatcatttgattcattgttaaatatactactactactcaagtttttttaataatattcacaaaagtttttaaataagacgaacggtcaaacatgtttaaaaaagtcaacggcgtcaaatatttagggacagagggagtattactcaagcataacattacttgaaatgggaaatctatattgaattacaaaccaaacttccttttattactccagttatctatttatatttggtcggacacctcaactttgttgacactgtttctttggcaattatttggttcattatcatagttattatggctagccacaagttttactcatagctaggaccctatatatcaaaagtttgttgtagtgttggctgagttgcggctagcaaaatgcatttttgaaaaatgacagggtagcaaaatgcatttttgaatactagctgggggaaaacgtaacctttgcccaagtgtgggtttgacaaagtacccaaacatatatatgccaccgttggtgatgggttcatgttgaaagattttgctcaatttattaccc

SEQ ID NO: 98868 - DNA, 521 bp, Oryza sativa
tttatgacatatttgactttttgtgtccattcgatttattaaaaaaaattaggtaactataatttattttgttgtaagttgttttatcactaaaagtattttaagcatgatttatgttttatacatttgcataaatttttttaaataagacgaatgatgttaaaaatcaacgacgtcatctattaaaaacgtagggagtaagttttttttagctgcgctgatatcctttataactaaacagcatgcatcaccttgtctaatcacgaaccagtcgcgctataagactaatataagtgcgcgcacaataattagattttaccgtaacaattatatatatattaaactcctatgtttggtacagcatcaatacagaaaccgatcgcccccgtcaccgttgtgcgctgaaggaaaaatcagaatccgcgatgtccgccgacgaggatgccattcaccttctgtcccgggggtccgtctagcaacttgccgagaaacaacccgccgccggaaccgggtatatgtcc

SEQ ID NO: 98869 - DNA, 627 bp, Oryza sativa
aagtattcttgacggcctccccccgctgggtgaacgctttaggacattgaaggtgcaaatcactatttatgagatggcattcaatttgatttgacttgtctaatctttattatactcaattgcagggaaaagaggctgacttgcttcttagtaataagcttggttcagagagcaaggagcaactatcacaggttagatgctgctcttttgttctaagaaataatattgtcagaatactactctctctgtgactctgtcctaaaatgacttgatttctagccattccatggagtagtcagtgaaattttctagagatctcatgtcattggagttaacatgtgatgagagatctaggttttgcctatgttgaagcaaagactagagatagatatatatgttaaagttgttgatctgttcatccacatttcttgatttaatgatatcattaaacaaatagttttgctagcttgtttttcatcatttcctttctacatgtgctagattgagttgagttttattggatttattaactaaatggtgactgcatttctacaactgtggcaaatatatatatttttaaataataataagaactataggtagcttatagcaagctcatattttgac

SEQ ID NO: 98870 - DNA, 532 bp, Oryza sativa
ggcgaattcgagctcggtaccctgacaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaaataaaatcaataatttaccaaattatcgtttatcaacaataatttgaattacatcacaacttagtatcagttagcatcacaaatgaactgagagaaatggtataagaattaagaaatgagtcaaaattagctaatacatatgtatcgggttgggcatgggttacccacgggtaaaaaatgaaacccacctattgcccataacgtcttcgggtctcgggcgggcgtgcccatgggtaaaaagtcacacccacgcccgtgcccatcgggtcgggtatccacggatacccggacccatgggtaaaattgcca

SEQ ID NO: 98871 - DNA, 628 bp, Oryza sativa
tagacgacccgccgaacagaagttgaatggcatcctcgtcggcggacatcgccgattctgatttttccttcagcgcacaacggtgacgggggcgatcggtttctgtattgatcctgtaccaaacataggagtttaatatatatataattgttacggtaaaatctaattattgtgcgcgcacttatattagtcttatagcgcgactggttcgtgattagacaaggtgatgcatgctgtttagttataaaggatatcagcgcagctaaaaaaaacttactccctacgtttttaatagatgacgtcgttgatttttaacatcattcgtcttatttaaaaaaatttatgcaaatgtataaaacataaatcatgcttaaaatacttttagtgataaaacaacttacaacaaaataaattatagttacctaattttttttaataaatcgaatggacacaaaaagtcaaatatgtcatatattaaaaaggaggtagtatatcttttaaactaggtattattttttaatccaattacaccgttatatttattacaattaaatttttaaaacaagattttacacgattatatttcgatgaaaaatgtatgttgtaaatattacttttatcatatatg

SEQ ID NO: 98872 - DNA, 685 bp, Oryza sativa
atttgttagggtatcgggaggtagtaatgggcttaggcttgcacagtgctgtcagcccaacttcgctattggcgtggatggtctgtgttccctagggagttaagcatatacctttgccctgctatttatagctctccccaggatagcccaatgccggtgcaatcggcttttaagcagctatatcactatgggccattgcggccatgcatcatacaaaggtgctcgtcagaatagtgtaattctaattttagtgacctttttagatggatgagcaggctgggtttcgaggatatggttaatggtacttggctattctctcagcatgagatatgctaattataatagtgacataggtcacagcataggctaatttgacgggtcggttgttattctttatacacgagttgacagatcctataacagtttagtaggcggtttctagtcatcaatgttgacctatagtatctttggagttctatttcactcggatctctttatgccttcttgggagtattatgcagtaaagcaatgtccatgttatagttatatctaggtccgcataagtttaaggatataatccggagagtgaaagggagataagctcactcgcatgaaggtgttatgatcatcagatatatgcatagtaggtattaaacaactctcatagttgggggggacgcgttat

SEQ ID NO: 98873 - DNA, 723 bp, Oryza sativa
  unsure (1)..(723): unsure at all n locations
cctgcagccgttacggccggcgaggatatgcaactttgttcaacctcgaacaacaattagatacggagtactacatgggactcccatgcaaactagtcgtgctcctacgacctaaccacaagtaatcaagtcggacacgacaacagctactgcatgcccatgattgagcatgcacatggacaactgggaggaaagaaaaaaaacacacgtattcatacagtacgtgtccatcaagttagtatattaatttttttaataatctactaatttcgtagatatatccggcatatatctacacaggagagagagaggaggaggaggaagacgtttctggaaactatccggtgacacgtcggactgggctgtcggggcccacggccacgtgtgggctgtgttgtcagggcagttaatgtgggcccacggagagacgcggttaaaatgggcctggcctgttgaggcccaattaagtacacggcccagctttctcatcgtctccttcctcctgctctggcttggcctttactgtcgtcgctaacttcttgctgacgacagtccgttaatctctcccccttagattgaatgaaacagagaaaattaattttatttttatggtaatggaaaaatatattcctcaatgccctttaatctctctcttgggatttacngaacaaggtctacgagaagtttgtcatgtttgtaaccggtggcacagttttaatattt

SEQ ID NO: 98874 - DNA, 702 bp, Oryza sativa
atacctgtcaaacttgcaaaacatgtgtcatatatatatggtcaaatacaaagagcatttgatggaatatgatcctctttgttttttttttacaaaaaaggaatgatttgcatacttgcatttctttctatcaattgcaaagctctgaatatttcagggaagagaaaaattctgaacaattgcattccagtgcgccatgcccatgcttcaaccaaagacagagtatctattctttcagaaggtgcaaagtagtagcacagtgaaccaaatactaacaaccagctgcattattgcataggcagcccataagatttggtctaaagcacagggaaaaagccatgatcacatgcctgaaattgaatagatccttcttggccattgtcaaagcttagataaacctcaaaaatttgtcggcaaacgaagacgaacaccaaccgataaaacttctgaagaacaggatagagtgcgtgctgtatctgtcactctgcactttcagaagtttcggttaagtggtgaattgatggaggtggaagaaagtaaaaatttctttcagccgccctctgttgcttagtggatactagatttgattcagagggaaagagagatagagagagttatgtgatggacaatcaggagctttcaggtattcagagaaaaattcagagcatgctcaaaaagaaagagaagcacatagtggcaggt

SEQ ID NO: 98875 - DNA, 561 bp, Oryza sativa
caatgtctacaatttgccatcatataatcatatttatccccttttttccgtcaccatcaattaacgtcctttacccatttagaaattttacatattgctaaaaatacctccaggttgcatgtgtttagttactcactcgacgaccgatactcatccctctatggtgttgttccccccctccttggtggttgtgcccccctcccccccctcctccctttttagccagcccaatagtgttattactccctgtttgatgtcattatccttccctggtgctccccaacctgaactatggggtgattctcctttgtttgtgtaagctcaagctgtcacctccctcccacattccctctaagacctcctccctcgaattggccaacactgccctctcacataacgcagcaccgtgtagagtctagatccgaaggtagtagtgagaggtcaaaagaaagtcagcggcaaaagggtcactcttgacctcctctagtgacggtgtgatgagatggcagtggcttggaggtagcccaagtgcccaacaacgatgacgttgagtatggtgat

SEQ ID NO: 98876 - DNA, 641 bp, Oryza sativa
acggtgggcgtgactttacaatgtaaaaaatgaatggcaataccaatcatgttttattttaaaaatcttcaatgatataaatgggcaggtcatatagaagtatagtggtggagccgacagcggttggcgaggcttctagaaattaaaaaaataaacccttaaaatttgaaataaaaaaattgacaatgggaaaataattctatgagttcacaaataaaaaaatcggaatgaaaaatatggaattttcaaaaaatagtccatctgaaactcaacgatgatatataatagtaaagatgagagaaacattaggcctgtaaagcagtaagttggtagcaattcatgcgacatctaaaagctataaacaataccataaatagaatcccaataatgattaagaggaggggcgatagacaagccgttaagcagcacaatcacgacggttggagggacttctagaaactaaaaggtaaatcgcaatgacaatcatgttcgatttttaaaatctcaatgataacaaaaatacatgagcatagtggcgaagtcggcggcacggtggttgggcggatttctagaaagtaaaagatgaacctcaacgatagttatgtccaatttttaaaatcccaacaacaataaatatggaa

SEQ ID NO: 98877 - DNA, 607 bp, Oryza sativa
ggggtttcaaggtgggagtaaaaccgtcgcggaggagagcgcgcgcggtggtgagccaggtggcgcgaacggtgccacaacgaagcaggtttgagaattctagcgtggtgaaaatggtgcagagcatgtcggccggtaggtctaactagttgacgggcggtggtggtgacgcggcggccatagtgacgaagagctagcgctagagccgacaagaagaattaatatccctaacaactaacaatgaatcggtggggcttgacctcatgtcaatcttgttgttgtggattattttgctagcaatggaacagagaaggagaacagaggagagaagctctgtgtttgtttcacaaactggttatgctttgctcaagtattgcacgttacattgattgttggacagcagcatcacatctaggacatagctgcctatttataggatggctaggaacttttctgaacacaactagtactggtacatgcatgaaaatactagaactccaaaagaacatattattgtctacactactctagaaatttcacagaggaaggacttgctccttgacttttgtttcatgagtagtagagaaagagttagagagtaggctgg

SEQ ID NO: 98878 - DNA, 532 bp, Oryza sativa
ccatctctattggggagtttgtcgacaacatcaagcttcgtcgctgcctctgatacggggaaatgtagcaggatcagcaaggagaggagaggaggcgcgagaagagccagagcaaggtggcaccggggagacgccaacgcaccgccggtggagcaggtatgggtgcgacggagggaaggttgtttgcgacgaggctagactccatgacggcggcggcggcgtctcctgaactaactgtcggtgaaagatttacccacaatttatgccaaatgacatctacttgaatgatgatgatgaagtcatgaagagtactttttcacctaaaccctttctgaattagccacacttcctatttggattacccagagttttactaaaattttaaaatacgtatagactatagtataaatgcatacaccttgtcacatatagtgtatattttagttgtcaatcaacattaaaattcaagaagctttattgcttctttggtacagtacaaagtatatacatttataaaccgctttacaaagta

SEQ ID NO: 98879 - DNA, 1499 bp, Oryza sativa
atacagtgcagctgggtacgtacctgtcccgggtgcttttctagctcatccaactggatcgatctttctttcaggtaccccttggaagagaccaccaggataaatataagttaatttggtgttttctgttcacgcaagaagccaacaataatgttacaattaaagagatgtcattggtaaaaaaacggagatcaggcatatggaaattattagcagaagtgttatatttattgagtttaatacaccaactacaactagcagcttagctagaagattaagccaatgcgaaaagtgagccgcagttttaaagaattgacatcttgtctatatgtccatatcatgaataaatgaaggatacaaagaaagctgtggctgatgaactgtagaaacatgaattaattaattaaaaattctatacaggtaaaacctttatatttgtacattttgaaagctaatgatggaaaataaagaacaatgagaaaaccacaaaatcaacttagaattaagtttgacaatttaaatttggattgtagttaataaggagcagttatctaatttgagtaccacaatgctcaaactcaaatttactactagttcggttagggaccccaccccaccttccatgcttcattagttcctcttaatacaaataatgcagttacaaattgaaatgtcaggattatgcccgtacccagtagaggaaagtttagtttttaacttcagcaagcgacaaaaacaagctgaatataccggttaattagtgacaaaaacaaagatattactgtactttctctaatcaaacttatatgatgtagcgaaaactgaggttagtttttccaacgtcaaatgtttttgactaaagaaagtacttaactaacatgatgcaatagagctggactccatcaatgcaattatcatcatgtcactattaaatactccctctatattataaatcgtttgtttttttgtcaaactttttttagaaaattatagtaacatttccaataaaaataaactttgtatcaaaatatattcgatgttgaattttatgagactaatttggtattgtaggtattgctaattttttttataaatttggttaaatctataaaattttgaccaagaaaaaaaatcaaacatcttataatatgaaacgaagagagtagtccgccgtatgaggggaaaatcctcacctgatcacaccattgtaacctgtgtgtgttcatcctttttagggcctagtatcaaactctcactttctctttctcgtggtaatcaggagggccttgcttccactttgtctccccccttcactcctataggagagtgtactctttaaccctgacagagagtagtagtaacatgacagcaatgcaggccggccctgcgactgcgagggtaaaaaggcatctgaaaacataccagtttttctctgccatcatctcctcccctgcccttctctatcacgtcagtcagtctttcttcagtgcgccaaaaca

SEQ ID NO: 98880 - DNA, 709 bp, Oryza sativa
  unsure (1)..(709): unsure at all n locations
attcctgcagccctgcttcaaccttttgcctagggtccaatgaatctgttatgcaacacatacaaaactgtattctattaaggaatatcggcagccttgttgaaaaaatttaaaagtgaattacacgtatgtatataggtcatcacttattcttgcataccaagttttatcttaggtacttgacctaattttttctttcaatttggaccaacttttctttcctttaatttaactttgaaccctttcaatctcttctctaatagggaaataatctgaatgaaaggaaagtattggcccttgccccccccttttgggggccttttttctcttgtacaatactacatacacgcctcctttctcatatatcttctgcattgcaccccatgtattttccgttgctttgactctttcatatcctatgaaccactacaatattgctagagcacaccgctagagagatgggcggagttgacctacaccatccatccctatgcacccttttcgcagtcaccatgttagtagaagtagaggatgggagcaacgaggtggcgtgtggtagtggatcctccaaaggaggatgcattggactaatgggggagtattttgccattaggaaccccgtgagtgagtctcattttgttcttaatggacgttttacccatcaaggatcanggttcaggtccccattaccttatgcaggatgccttga

SEQ ID NO: 98881 - DNA, 539 bp, Oryza sativa
tccacgtttgatcgaaccgtccgcccaaaaagcgcacggccgcgttgtgagtctgggccaaggccggcccaacaagcctcgtcctccagcgccgtctgtctcgctcctattcctttttaccgcgaacagatgcgttttgacggccgcactcgcctttttggcgccaaacgaggccacagcgccaggcgatcatctgaacccttctcttccttttttttcagcacggattccaccgttgatcaagcacaggtgaagtaatatggcctcttctcttcctttttttcagcaaattatgtgattgtcttccacctcctccattagacagtgttggaataattcatcaaagaagcctccagcaaaatctgcatatttaagatggaagaaaacaggtctgtaaagctatggttgttacttttttcaccatgatcgggtagattttacttgttcgatgaccaccaaatcattttttttgttcctgtagagtgggtgtgctacctagtttgttacctgaagttggcatggaattcaatactgttgat

SEQ ID NO: 98882 - DNA, 603 bp, Oryza sativa
  unsure (1)..(603): unsure at all n locations
ctataagattatagataatataacatgtttgcatgatgtttaaatgtgatgattgttagtggatcatgatgtggcatcttgttaattactccctccagtttgggtttatttgtcgtttcgcacgtgatttcaaaaccaaaaagtcgttaggtagggttgttatttcctatttcgtccctattaaatacagttatgtgtagcatgcaaacaagcaactactactactctctcagttgggttagtgcattcatcttggtgtgttgggtcctgagttcgattcttgctctagacacataccccattgatttttgtcttggcgattatgcatggcaccatgcatgcatgcatgcagcccatacagcttcagtgcagatagcacgctaggcggcgagggcatacgaaaattaaaccagccaattttatccaatctgtgcttatgcgcgcgtttttccgccaaaagttttcgtttctgcttatttgccacgctaatttaccgcgcgctgcgcgtgtatttatactgtatacacccgtacttgtagacacacctttatattcgagtccacaacaagcagaaagtatagtgnaatggatctgaatatggag

SEQ ID NO: 98883 - DNA, 650 bp, Oryza sativa
cgcccctggtcagcccgagcctagtgaaattccaagtgattgtgtgtgtgagatgaaaagcgagcacaagtctaaatgcataatgacctaatgtggcaattaaaatcatctctttgctaggtcattacccctcttaatagtacagcgaaactaaaaaataaactagcaaatttgatcgcccttcacctcgatcaattttaaaactaaaacactacttttaccgttttcttttcttcgcttcgcgccatcaaattttaatccatcgatagtcatccatgcgcacacatgacgtggatctaacttaaaatgtatagctcaaaagacaatggttagtccacaattagtgcttgtcattaattaccaaaattaacaccgggggcctagatgcttcaccggtgagcccaagggagttatttttatttttatttgctgactggattgccacgtaggcgccacgtgtgcaaacttaagtcaaaaccgctcaaaatagtgttgaggggggtaattcgtctggtattaaaagttcggggtgagtaatgtctggtttccgggtttaggggggtaattcggtcgaccaccatagtttagggggtaattcgtactttttcctactttaaataaactttgatataaaaggttttcgcatgaaa

SEQ ID NO: 98884 - DNA, 536 bp, Oryza sativa
aagacgagagaagagaagaaagggggaaaaagaagggatgtggggcccgcatcgttttctctcacttacatgtggacccacgtactttatttatttattttcgctgactaggatgccacgtcagtgaaaccactcacgtatactgccataggaccttttgtgcacggtttgtgaaagtttacgggtgcatatttctggttttgtggttaagggacctcaaaaaatctcgctgttaagttgagggacctctggtgaacttattccgtttgggggggggggatgggccgaaatccccgtgtgccatcccggccgggtctaattttcttccatggcccatatgcacgttcgcctgggccggggtggaggcaattctccgcccgatccacgccaaacccccgggtacagaaaaatcgtctcggagacggttgttttcttcccgagcaaatacggcgcttgtcttcctcgactcctcacggcgatagggtttggatgcggcgcgaggtccgggaggtggctctagctagggtggagatccg

SEQ ID NO: 98885 - DNA, 582 bp, Oryza sativa
gtaccctccgaccgaagcatatccttttcactctccatcaaatccttcttcgcctggatttcctccaacctcctcttaagatcctctgactccatcatcattttttctttttccttcaccaatgcacataattccatctggagcttctcgaccatatgattatatttttcctccacattcaaaaccttcaacccaagcatttcattttttctttttccttcaccaatgcacataattccatctggagcttctcgaccatatgattatatttttcctccacattcaaaaccttcaacccaagcatttcattttgacccttcaagctactctccacctcctctttctgccttgagatgacctgagcttcctgctttgtctcctccaattgcttctccactttacccttctcgtcaagcagctgggcatttttgttctccaactccgacaccctctccccaagtgtggagacctggtgcattagggtcctcctcttgtcatctgtgaagaagtatgcaacatatgttttagaggggtcttaggggagagagatgggaccacactgtgcaaaaggataaagatgat

SEQ ID NO: 98886 - DNA, 597 bp, Oryza sativa
aggatccccatttgattcaaaacatgttttaaataggatgtttttaaagccggaactagtgctacacagcctgcgtaatcaaagacttcaaatttccagggactaacatgtaaggacagtggaaggaatggacacaatatattggttcctctgacagaaactcacctgggagcatctgatgtcccatttgcacatgtcctagtcttccacatctggacattccatctgttataatcgagtgccgtgcatggccgacccacccaaaatacgaaaccagctgtctacacttaaaaagagataagtagtggcagtggtgaggggtgaatttgtcaccactcccaccaccaaggcatcaacttgctaagtaacattttggaacgaattaagaaaggatatatgtgggccaaacggccaacatatcaataacaaatatatatgattaggagataatgaataagaaataatggtaatagcatattcataattttcattaattaaaatcttgttaaaacgtacgagtctacgggcagtttgcttgtacacacataaaattgagtctatcgcattggggtaccgagctcgaattcgccctatagt

SEQ ID NO: 98887 - DNA, 1379 bp, Oryza sativa
  unsure (1)..(1379): unsure at all n locations
tttgccctttctacttgtcccaccatataacacaaattaagtatgctttaattacctgaatgacacaaattaagtatacttagagaaatctacagtatattaacaaaataagtaaaaaaacaaaatgagtatagaaaaaatgctcgaaatgatttagttgttccatcacttcttatgttattatagcaaatcacaccaaccttgcaaggcgttgcatccgtgcgctcacttgttagattcttgtactagattgtacccacatatcaaattgttgcgctaccacgcttacttctcaagtttttacactaaattgcacttgcatgttaagttgatgtaccattaatgcaatttattcatcatgtataatactatttgttattgtatagctagcttacaaattggaatgatcaaattgagttaaactaaggagatagtcattggcacctcaaaattatgggagttaggctccactgcannnnnnnnnnnnnnnnnnnnnnnnacttttcaattgagtgccggattccaactcctaatggtaatggtatgaaggttttcatcaaattttggtaaaaccaaaaatccccatcaaatttaatgtttcaaatttgaattctcaaaagtgattcaaaaatttcacacggaatagcttttgtcccacatcaaaaccttgaattttcacagtttcttgcatttttgtcaaaaatgtgaacatttactccctgcgtaaaaaaaaacttctatctcgaacctgaatatgcctatgccgaggttcctatctagaaatgttttttcgatgaagggagtaaagtggtgtttgtttttactgaaaatgaatacaaaattaggatatagaaaaaatccattagcacatgattaattgagttgtaattgttacaaacataaaaaatagatttatttgatattataaagcaacttttatatacaaagttttcatataaatacaccatttagccgtttaaaaaatattgctaaggaaaatcgatgtaaaatttaaattttaatgaaaaaggaacgggtctaataagttatggcgacagaactatttttcttcctctccaagaagcgaagaatattgcttatagatcgaatgaacatactgaccaagttttgacagaatgacaggtggggcccatgcccctaccttttttttaaaaaaaaaattcccttcttaaaacaacacaaattctcgcctccccatcttccagaaaaaaactcctcctaaacccccgaaaaccctaacctttcgtccgcgccgccgcacgggtcgccatggctctcttcgccgccgctcgccgcgccgccacctccaccctccccctcctccgcgcctccgcctccgccgcggggaccacccgcgg

SEQ ID NO: 98888 - DNA, 652 bp, Oryza sativa
cccccagaacgacagtaatacattcccttccatccaatattgcaggacaattcacctctagtatactaaaattcttaaaccgaatggattcgccgcgacctccgccagccacgtaacctgacttttgtgaaaaagcccctcgcttttgattagttacgtgccggtccccactacatccatcgtccgatctcgcggtatggtcgatctggccgtccgattctccggacaaaccctagccggccgtcctcgctccccaccacccactcgacgccgccttgcctcaccactgctgccgggggccgcctcgtcctccgcctctccccgccgcctccacctcctccgccgccactgtgtcgtccccgtccccggctgcctccgcctccgccttcccctcgcgcagggtgcagccgtctccgcctcctccaccgccgtcgccgtcaacgtcgctgagcaccgtctccgccgcccgcgttccgccaccgtccctccgtgccgtactaagagtaggtgtatatgcctcttcctccccctcgcgctgccgcctcggcctccccgttgcgccgtcgctgtcgccgagcaggggcttcaaggcggacgcggagaaagcgaggaggtgagtgctcctctcctcttcccttctcggttctcttat

SEQ ID NO: 98889 - DNA, 598 bp, Oryza sativa
ttcagccttaaacaaccacaattaacagtcctaagcagagaaacttaacaagcttttcaggctaacagaacatcaaaaggtccacaagacaacagggtcttcagagagcacatcttcaggctgtcatgcacgcaaaaaagatcagacagccagatgagagcgggtacaataaccggtagccatctcagtaaaactaacgaggctgtaggacagagaagaaaaaaggtagtaggaacgggcgacaatagtcggccagctctacatgagctccaaggtgaaaaagcctacaagataggaattttcaatttttaaaaatggccatgggcccacaagtagtgagatgcatgcaatgaaagatgctagtcagttgggtcccacaagaaaaagaaatacatctcgggattaactgctagcttactctagttaatatggacatggatggagccggcagccagcaatactattgaacctgcttaagagcaagtgcaatagtaggctatataccagctattaacatactttaaagagataaaggaagagagagaggaatagcagattacagcacggattacaagacgtaatatgtgtataacatgtg

SEQ ID NO: 98890 - DNA, 576 bp, Oryza sativa
ttctttttttgaaaaaaaaattgaatttttattatttctaattgtatttttatgcggactctaaactcatctttcaacattatttattttttaatttataatttcagttacttctaaattgtatacctatatggactctagtattttctttcaacattttattgaatttcgaattttagtcctatatggactctatgctcttcttctaatattccttattttcttaattccgaattttagatatttataaattatatttctatatgcactctatactcttctttcaatattccttttttaattttgaattttagttatttctaaattatatttatactagaaaaatgcccgtgcgttgcaatgggtaaatgctattttaattttattattgttataccgtttagttagggtaaaattcacagtgaaaactcgattggatatttttttagaaaatcataagctgcaattagtagtccatatttcatctcaagttagcatgagagatttttcaaaacatttcttgtacgctccttttatacttccaaaaggaaacaaacttaaaatccaactcaaaca

SEQ ID NO: 98891 - DNA, 677 bp, Oryza sativa
tcagctcggtaccccccatgacttgccttcttggaaagggagggcaaaacgaccaacatgatcgacggcaaaccttaacctgagcatcttgaagagggcgaaggacaggcataggtcccgccgccgcgccacaccttgatcccttcgaccgtcgctcaacttcagcagtttccctttgcattgccagaccttctcgacatccaccgtctccggaaccccgtaggctacctgtttgacttgctgcccgaactccaccttctccacctctttgccatcgacgaggtagatgtactccttcatggtttcggggtcatagttgcccttacaagatcggacgccggtgctgctcggtggctcatgctctatgtaatccaacacgacctggttctccttggtgagcccacgggagcgattcgtcgacaggtacggaagcaactcggtgttcggcgtaattttactgtggcatttatgggtttattatgtatattgggcctgttagctttagaaccttttaatgtaagacaatggtagcttgcatattatacagagagggtcttgagtttcgtcaagaattttggtttcggttacgttatatagtcagcgttttattggcctgtataatttacccgcgcgaagaattctacacacattattataaattgtcaataaaaccatat

SEQ ID NO: 98892 - DNA, 579 bp, Oryza sativa
cggcggctcgagcgcttgatcaaagagtactattagaaatccaacataaatgtatgctcattatgtacgtgaaagattaggggtaactatcatgtattgagtagactttgtttcgtattgataaaatttctagttatttcctaattgtatttctatatggactttatactctacttctaatattctttatttttaattccgaatttcagttattttctaattgtatttctatatggactctatactctacttccaatatttcttatttttaattacgaatttcagttatttcctaattgtatttctatatggactctagtttcctcttctaatattccttattttttaattccgaatttcaactatttctaaattgtatttctatatggactctgccttttctttttctccgattaatgtgagaatttctagcccatgagagcgaacgtggaggctcttttttctattcctttaataatataatagatcgatcaaaaccgactagggaattagaaggttggacagagatggtagagagataaaaatgagagtatatataggcaaacggtgttgggtgtt

SEQ ID NO: 98893 - DNA, 574 bp, Oryza sativa
aacatgtccagaggtagctagtgggactcttgcctcgggtaatgtactgctcaggttcctcaaaataatctagctcttcaacctccaaaaaggctcttcttctaatttaaattgtaaagataaaactaaatgaataaataatacaaaaatgctaaaatgttctaattaacatgcatgattcttgtgcagtggtttggtagctgattttatagaattattggtgaaggaattgaatttatatttttacatctagcagtcgtcccttgtcgtctggtgcgattggaatctcaaacatttggtttggtgggacagcgccgccaccactccaccacatatgaatcgtccatgacaacgaacgcgaccggccggcttctcagagtagcgcaccaattaatccaatccatgaagaagccgacaatacgaggacgagcagcagctaggtcgtgtacattgaactccatcaccataaatcattcattctctgttattctctactttgggctgctctcattgataccgaagcatggttggatgtcaatatggaattaaaaatctcattcgtacttgaactttt

SEQ ID NO: 98894 - DNA, 604 bp, Oryza sativa
ctgctgatagacataattaaaatgcagcacccaatttctgtgcatcaaaacaaaacaaattacacaaacagcacccaattaccaacgaaacgccatacctattcactgaacattctgaaaacgcacgctaaggattaacggaagaagcagaaatcaaacttctcgcagtatatccaaagaaaaaccccaatcaccaaacagatatcacagccaagctttccaaagcgcgcaatgcggcgtaccagagctgcggtggcgcggccgctgcacgatgttgcggaaggcgacgcggggctccgcctcgccggcccacctgcacggcaccaaaccaccacgtcacttcacagaatccacgtacggaacggaagccctgctagggttagggtttggggggggggggagtttccgggcggcggcgggtgggaggtcgtacccgatgcggaaggtggaggcgccgttgtcgatgacgatgggggtggtgctcgggaagccggcgaagtcggtctcccggtccgggcggtaccccgacggcatgccggccggcggcgacgggctcgccggaggcggaggcggaggggtaccgagctcgaattcgccctatagt

SEQ ID NO: 98895 - DNA, 649 bp, Oryza sativa
cccagatccggtcgtcgccggctcatctcctttctcgtcgccgagctcgtctcctctcccgtcgccgagctcgtctcctctctcgtcgccggcttgccctagccgccgagctcgcgtcaccctagccgccgccgtcgagctcgcctccatggcgtcgccttgcctggccgccgagctcgcctcgtggtgagaggggtgacgcgacccacatgtcgttcgcccctgctcgcccgagcgctcgggcggctgcatccggccgaatcggccggatccccccatccggcatctagggggaatattcccctccgggccgccctatcccaccttcgctcaggaaccaaacacccaaaaaaaaatgggctgccaagctgaggattgcggattgcggtcaggagatgggacccaccatccaaacacagttgaggattgcggtcggcggactagagatgggacccatatgcaagtgagcgccaccttgtttctcacacccacccctctctctctctctatagtgtctaggggtgtgattaataaagtcattaaaccgacatgctaaggggccatctgggaattgggacacaggactactatcaaatggtccaatttgggcctattctatatatactcttctcactaaacaaacgcgagt

SEQ ID NO: 98896 - DNA, 687 bp, Oryza sativa
ttaacgagtggcaaaaaaaatgtctcgcggccgtgtctgatacataactttgccaggagatctatctgttgatgcacacaaccgggggagtcagacttttaggagtcggacttctttttttttcgtttttttatttaaacggtgttttttctcggacttttttttttccttttaacggatccgatctttttttttcaggggaatcggactctttttgttttgtttttttttcgctttttttatttattaaacggacgaaggaaacgtttcttttttttaagtagtagtagattataaaaagaacagctaggaagaactctgttgtcaaaatttgcttagcatatgtagtactccctccgatcattgacgcacaatgtttttacactaaaattagtattaaaaatctcatatattaatgacgagacagagtgacaccttactactctgcatagtaaaaaaaaaaccatccacaatgcaaatagcaaaaatttgaaatccgtgcaatttcatgccattgaaatcttgaatgaaatgatatgatagcacccttagggtccctttaaatcgcatgattgaaaaaacataataatagaaaaaacatagaattttgataggaatgtatatataaaacagatattgcaaaaacgcagggaaaacataagaagggtagtttgattgaactgaaaa

SEQ ID NO: 98897 - DNA, 633 bp, Oryza sativa
tcggtacccctcaagggctcaaggctgttgtctgcattttttcttgtgatgaacaaagaatggaagacgccattgataacttccaatggtcacaagagttgaagctttggggtttcattttgcgctgatcccagaaagctgccctggatagtctgtatgatataccggagatttgtatctactatgtgccattgaccatatattgcacgcacgcagcgtagcgcgtgtatctttctagtgtatcttttcttaaggtgccccacttcaccacatgtacgatgacacattcgtttgaagcaactttagacttgtttttttaataaaagagaaacattatactatgttttagaaaaaacgaaacactatactaattttaacaaatggttgtatttggcaccactaattcaatataagtaattaggtaaaacgaaaatgcttacagaaatgaaaataaccgatagtagttgttaatgtaacagtaataatgtagggcctgttcactttgctgtcattttcaaccttactaaattttggtaaagttaccaaaaaagtggctacatttagtttgctaccaaattttggtaactatataagaaatcatgtcaaaattttgacaagtttgccaaaattttg

SEQ ID NO: 98898 - DNA, 566 bp, Oryza sativa
ctatagggggaattcgagctcggtacccatctcatgcataaagatatacaaagccgagttgacaaacttacgagcctttggatacgacaaatggtccaaatggattgttagaccaacacaatgcaagcctgcaagggacaccagatcaaggtcatcaccacctgattggcgaaaaacttcaggaatactgttgcatactgttgagagcgctatcacgattggtaaagggacattagaaagcatcacatcaatgttaccccatcacaaagagatcgatcagaataatggtcgttgtcaaacaagcttcaatttcacacccaggtcagctagcagagcacaaatatgggttgacaaaataagtaaaacatcaatttttattcctagttcattttgtatacagtactcgcgtttgtttagtgagaagagtatagaataaggccaaattggaccatttgatactcatgtgtcccaatgccccttgttatgtcggttcaatgacttttaataccaccaccaacaactcaccacaaaaaactactcctacattacttatcggttatcacaag

SEQ ID NO: 98899 - DNA, 675 bp, Oryza sativa
ccccgatcgtgatgctcataatctcttttagagagtactcgatttgagttatctataagtttataaaaaaatataacaacacttttcatataaaacaaatatatatattatcaaaaaaatatttaatgttatattaataaaataatttagttttgtagatattactattttttctatcaacttagtcaaatttaaagaagtttgataataaaaaaaaatcaaaatgatttataatatgaaacgaagggagtagtaaatagtaattacgtggaaatacgcacatatcgtgtggttctatgcatacatacaatatgcttggtttgatatacgtaacaccctaaaaattagaccgacaaaaatctaaactccaaaaatatgggcattcaaaaactctttttgaataaattgtatcatgccgattttgttcgattattttattggaatttgatttcggagtttataaatcgcgaataatggataattaactaggaataaaccctaaaagtaaattgacaaagtaaataatttaagtgcaagttaaaataagatttaaatgagtaaaatattattacgaccatatttgtatcaattaaatttaaatgtgatggaataagaattaaccctaattaaattcgaataaattaaaaataataaaataaaatatgggtagtgata

SEQ ID NO: 98900 - DNA, 555 bp, Oryza sativa
tttttgtttacaaataagattgcatgcaatgatgaacatcctatttgtaattatgccatgccttgattattgatcacctataaatccttgtaaccatgattacgtatgagtccctagtcgattatgacacttgcttagaaatactactttagaatcttgcatactcatatttatcaaatattatatgcttgggcaattacctttggggaggtaattgagatgcggcatgtggagacatgagcgccacattgccatgataatgataacatgatttgtgaaattaggaaagaaaactaaacacttgttttagaccggggcggacggtggatttgggtggtatccgggaaaggctagtaccgtccccggtcaattaaggaccgagccatgaagttaagtacgaaacgaccccgtacaccacacttctcgaatggggatagacctagcggagtaaatagccgagcggaggcagtatccatgcatagtggtttctcatgtgtaaggcaggggctctacaatggtgtcgctattgttaggactgccatgtgatgagttgaa

SEQ ID NO: 98901 - DNA, 1047 bp, Oryza sativa
ctcggcgacgagaaaggagatgagccggcgacgaccggatctgggagggcaccggcgagagcgagcgacggcggccggggagagaggatacgaggtggcgaggtgagagagaggaggcgcggcgacagggttgccggcgagagaggaggcgaggggcggcggcagagaccttcaggcgagggcggagaccttcaggcggcggcgaccttttcttttttttttgtctcctttcccttttattcctttctgcttttttatttctatttagattttttagtatattgatatttttttggtgagaatttggaggggtatactcaccacctctaatgaaagggtgattgcaaccacttatccatcccactcccccaaccaaacaaaaaaatggatcaccatatccactttcatccctacaaccaaacaaaaaactagatcgtcatattcactccactaaacaaaaaactagatcgccatatccagcaaaatatggaccgccatatcccatccaaccttgaccgggaaccaaacacaccctaacagtcgcgcggcgcccacgattggtaaattaagggacattagaagcatcacattaatgttaccccatcacaaagagatcgatcagaatgcatggtcgttgtcaaacaagcttcaacgtcacactcaggccaggtcagcagagcacaaattggtagacaaaattaaataagaaaaacatcatttttagtcttcttttgtatacagtactcgcgtttgtttagtgagaagagtatatatagaataaggccaaattggaccatttgatagtagtcctgtgtcccaattcccagatggccccttagcatgtcggtttaatgactttattaatcacacacctagagactagagagagagagagaggggtgggtgtggaggaagaaggtggcgctcacttgcatatgggtcccatctcgaggccgccgaccgcaatcctcaactgtgtttggatggtgggtcccatctcctgaccgcaatccgcaatcctcaacttggcagcccatttttttttgg

SEQ ID NO: 98902 - DNA, 735 bp, Oryza sativa
gcgcgcgggcagtcggctgctcgtttgcttttttttttttgtaatttgtgtttcattggatctataattttttagatgttgtgattcattgcatcacatggatctgagatgtataatttgtataatctgtgatgtatttaatttgtgtgtagttttttaggatttgtgatgtatttgatctgtgtgtaggatttgtgatgtatttgatcttaatatttaggatgttgatttggagatatgcatcccatttgattcgggagaaaatacagggattaacactagccattagcaaatcaacaataaaataaaataaaaaagatctcgaggtctttagtcaccaaccgggactaaagattccccctctttactcccggttggtgttaccaaccaggactaaagatcgatctttagtcccggattcgtagtcccggttagaaaaccgggactacaaagggttctaaaccgggagtaaaaagcatttttccaccagtgcacacacaatttttctatcacatcgtaccaatttcaaccaaacttccaaacttcagtgtgaactaaacacagtctaaataaagaacaagagattacacagcagtaattctaaaaaaaaattacacagcaggaagttttctagcggagtttagcgaatctgccattacataaaatcaaatacaagaagataaatataaagaggtgacgtgtgattaattgagttttactccctccattccaaaa

SEQ ID NO: 98903 - DNA, 607 bp, Oryza sativa
ttctcttcagtatgctgcttaaaacgcaaagtgtaaggttttctctgtgctgtccagttacatctaattccttatgtttaaagactgatattagtctttggttgggtgtgatgtgcttcttgttaatcgcaatacttgatctttactatgatactatcggtgcatatttagttccagtatgcccttttagttaagttgctgaagcattgagcatcttgtcatgttgatcttcttgtgagtggttcaatatgatttgttctgttttaatggaagtaaaaacgagggctgtcccctcctaatgggaagagaaaagagatgtatttcagcaaccatgtgttatagtacaatccaattagtttgctaagctattatggccgttatatcctgctctgattatttatttgatttgctgtaaagttattaaatttttggcattgttatacatgatttgtacttgattatatgctgctattggtggttcatgtaattagagctgaatgggatatttgctagaaacacattgcttctttcaacaacccttatgtaaaccaaaataaagtgctggtttctctgctgcgctgattcccattggtccatacctgaaact

SEQ ID NO: 98904 - DNA, 586 bp, Oryza sativa
cgtaggttggttggatcatattcctacgtcggcgcagacgtgggcgccgcgcgactgttagggtgtgtttggttcccggtcaaggttggatgggatatggcggtccatattttgctggatatggcgatctagttttttgtttagtggagtgaatatgacgatctagtttttgtttggttgtagggatgaaagtggatatggtgatccatttttttgtttggttgggggagtgggatggataagtggttgcaatcaccctttcattagaggtggtgagtatacccctccaaattctcaccaaaaaaatatcaatatactaaaaaatctaaatagaaataaaaaagcagaaaggaataaaagggaaaggagacaaaaaaaaaagaaaaggtcgccgccgcctgaaggtctccgccctcgcctgaaggtctctgccgccgcccctcgcctcctctctcgccggcaaccctgtcgccgcgcctcctctctctcacctcgccacctcgtatcctctctccccggccgccgtcgctcgctctcgccggtgccctcccagatccggtcgtcgccggctcatctcctttctcgt

SEQ ID NO: 98905 - DNA, 734 bp, Oryza sativa
ttatatagggggtaattttgtaaattcgcattttctcagttagatccggtcgataggcgtccagtcaaagcagccgctgccggcgcgcagctgcggcagctcgcagcggcaagggcagccggcaggtggccgaagcagcagtgcggcatgcagcagcagcaggcagggaagccccgcggcggcatgcgacaacagcaattttaaaaaagtgaagaagaattttataaaaaaaacatatgtaccgattcacaagtgtttgtagagaattagacttgttaattaacttaattattgcttgtatccattgttattgaagcggatgaagcctgaatcatcaaacaagtctgatgcaaacatgcagtagttatatattatcacgggctcaggcttttaatactcaagaacttatatcgctagagagactgacggaagcaagttcctggaagcggacggctgctgctgggcccgacggcggcgatagtgctgcgcacgagaatggcagtatgttggctttgctcccggcggaggctgtatcgcttccggcgatcggcagcggcggcggcggtgacggcatcattgcgtacgacagcggctgggcggcgcttgtgggactgtgggagccacacgcgagacaacgtacggctgccggcgacccgacgtaccgcgtacgaagtagactgaattggtatcacgaacggatgacgagatccgaaaaataccaccgatggaaaaaa

SEQ ID NO: 98906 - DNA, 643 bp, Oryza sativa
cggtacccccctcaacctataagctgagatcgattagtatccctcaattataaaactaggtataacacactaattatcaaaatcagtgcaaattaactctctctcggtggttcttttgagcggtctcatttaacttattattttgactttgtctacacacatactatgtgacgtttatgtagcaatcatatattctaataaaaaatcagaaaaaccatactccttttttctttgctcctaggggttgtattttctcctacattcgtatttttttctctcggtttttaatatgtagatatacaaagtttatatacacgtatgcaaagtttatatacgcatatgcaaagtttgtatacgcgtatgcaaagtttatacacgcgtatataaagtttggatatgtgcatattttttatacatcgattttttggtacacataaaaattatatatacacgtatgtatatactttatatatatatgcataaactttatattatttaatacaaaatttatatgtatatatacaataatacaaagtttaatatacaatatatacatattcatatatacatgtagtagtagcagtagtagtgtatgagttgcagatttgtagtagtagtagcagtagcgtatgagtagtagtgg

SEQ ID NO: 98907 - DNA, 627 bp, Oryza sativa
atcggggcatattaagttccagtatgccttttaagttaagtgttgaagcattgagcatcttgtcatgttgatcttcttgtgagtggttcaatatgatttgttctgtttaaatggaagtaaaaccgagggctgcccctcctaatggaagaagaaaagagatgtatttcagcaaccatgtgttatagtacaatccaattagtttgctaagctattatggccgttatatcctgctctgattatttatttgatttgctgtaaagttattaaatttttggcattgttatacatgatttgtacttgattatatgctgctattggtggttcatgtaattagagctgaatgggatatttgctagaaacacattgcttctttcaacaacccttatgtaaacaaaattaaagtgctggtttctctgctgtgctgatttccattgttccatagctgaaacttaagtaattgcaaaatttgcaggaactcatctgtttttttactcttataataaatgtgaggtatgcattcgagctacaggcatgctatgtgcatgcgctctctatctgaaccaatagacttttgtaaatccgtttgtacaggacattgagttcaactaaaattctactatgcccaat

SEQ ID NO: 98908 - DNA, 645 bp, Oryza sativa
acatcgggtcaaacgtcgaacttgacacccaaaaattttcttttcgcgaactaaacagaccctaagagcaagtttaggggcataagatggtggcatggtggaggttctgttgttaaaccctggtatcaggacttgatcgagcaatttggtatgttcggtgaaaattcatgctcatttgagtgattgtacagtactccgaagttggtgttttctatgctccggtaattgtggatcactggtataatgaggaaatcaacctaacgtataattgccatggtctgtatttgtgtgtatgtggagactggtgtgtgtactaattttctggaatgtcatttaatcagaagagttgtttagaagaggcataggcaaattctcttgtaaggcttatgtagttcgagtgtttaacatggttataacagtagtgttttctatgacgacatttatgattaaactgtgtctacaattcctgccttttgtgcagaaaaagaaaagcactgataaaacatcctagagttgagtgcattgcgctgctgcgactgattctaaaagcttgacagcaagagttagaatagagcaatattctgcataattttcctgcatctgtgaattttgctactcttgtactccctccgtcccaaaatataa

SEQ ID NO: 98909 - DNA, 613 bp, Oryza sativa
atataccatcatagaaatagtataaggagacagttgcatataatacaacacttattttttgaatatatatttcatcattgtacatatatatatttagacagctcaattatatatctttctgacaattgctaacacaatatttattatacaaaagtttgcttggaaataacataataaaggatataatgaggcaataagaactgtgcgtggagggccggaagataatgtctgtcatggccggcaagatggacgagctctggatagggcgtatggagtggtgcgtgctggaatgtaacaagaacgccatcaacttctacgagggaatgggcgagccacgcaggtgtgctcccgtaatggcacatatacagactcactggcgctgcacactggaaagtacaatgggactaagagaagggcaatggggcgaaatagatcggtggttgattcttagttgtccagtctcaagtaataaagaaaccggagatgtgtgatttagggtattggataagttcgtgatgtcttagcttgatgttctttcaaatgtagtacacaatctttgcagaaggttaagggaaaataaacaaattcttaaattataggaaaaggcaaaaaa

SEQ ID NO: 98910 - DNA, 594 bp, Oryza sativa
ctatagggcgaattcgagctcggtaccggtcttccgaattttggtagttcagaaaccttagccttctgttgacctggattgcctgaaattagtgtatcaaaaataaatagttcaaattttctatagcttccaccattacaaatagtgtatatatactccacagaaatgttaagaaacaagcactttaaaaggtccaaaagtcaaaccatactagtactagaataaatgttacagtattgttttaccattctcatttagttaaaagaatataaatatcattagtatggggctatgggcttattaggatgcatccaattaaagagcactagaaataccaatgatgattgcacaaccaaacatcaaataaacgaagcttcattttaaatgtaagatctagggaaaatgaacaatcagtatgctatcacttcaggtctgaccaaactaccatgacatttaaaacgaggggaatcatcatgtacatctacaaatatagccgcttatgtgtcaactatgatcatcaacaagtatgcgattaactcaaagaaatacataccggcaaagataacaagaccatctgtagaaaaccttgctaaa

SEQ ID NO: 98911 - DNA, 712 bp, Oryza sativa
aaaattgacatttttgggatggattttgtattttggccttgaagggatgtttgcaggggggttcaaggggaggattcgaattcgcatttgggatttaaatattggaatttgaacttccaattcgagagttcgcattactaatataataatttacttttgttaattttatacttgtattgcatatttgcaataatacatttatgatattaaaaaaattatataaaacaagcatgatggcccgcgcagattgcgcggctagcatcattatattctctcatataataacatatatgttttctcaatgtattatttaaatatattaaaatgaaaacataatttcaaattttgtactaactttacggaactactaatgtgtaatattcatattgtattttatatacgtgttaattattaattatagttattaattatttttaatatcaaattttagttatttgtaaattatattcctatatggactctagactcgtcttttaatatttcttttttataattctgaattttcgttatctgtatattggatttctatatagactctaggatcttcttccaatattatttatttttatttttgaatttttattttttttttctaattgtatttctatgtggactctaaagtctaaactcatctttcaatattctttaatttttaatttttaattttagttacttcctaaattgtatttct

SEQ ID NO: 98912 - DNA, 684 bp, Oryza sativa
aacattattgctttgtgactaaattggttctaaacatgtagttttgtgataatttagttactaaacatgtagttttgtgacacttcatcttaaatttgtagttttgtgataaatttggtgttaaatgtgtagttttgtgatacactgagttaaatctgtagttttgtgataatttggtcatagtatctgtagttttgtgaaatttactcttaaaattttaaaatatagaccgtatatgaaaattttaagttgattttgtattaaggttgtttggtttaagtactccctgctacttttaaaaatgttattttaggtatgatgaaattaattgagatttgaatatgagtgggtacatagatcgaactgacatccacctttaataaactccatataattcacatttttttgcatgcaagtaaacaagcaagaacaaagttcctatcccttagtattattaggatcttcttggactgacggttcttttggctctccaaccaaaagttgcttctcttctgactctccaaacaaaatttgtttgaattttgactcttcaagtaaaagttgttttgactctccaattaaaacttgttttaggggcctcagatattgatagtcctttaatagcctctcttctgaaagagcatcatcttcttcttgtggagtccatagaatttgaacaccctg

SEQ ID NO: 98913 - DNA, 610 bp, Oryza sativa
cagtggataattaatcctcagttacaaatgaaaagattaagttggagaaatgcatgatgagcagggccggccatgtttctgatgatgataacccgatcgatcaactcttgaatgatgcaaagatcaagaggctatcgttctgtcctacaagttaataaagcgacaaatacaaatgcatgcttgagttgattggattcgaagactgtgccatatgcatgttggaccattgatcaatcactaaacaatgattagaaaatcaccaaacaagtcgccggaaccaactagtcttggtccccccccccttgtggatcatttctaccgaatccttgttaaaagaagagagaaacagattatggtgttggagtagtttcccttgctaaaaccacatcgattggcagctgcttttatatcggtgagaactgagaaaggatataagaaaattcagaacacattaattaattatatctgacaatgttgttatcatactgataaactaatatagcaagaaagcattgttggcatgcggcaacaaacacaagtaatttgcctctagctatatgttttgaataaaagccacaaatcttctaaaccatactcctgacaaattttt

SEQ ID NO: 98914 - DNA, 971 bp, Oryza sativa
ctacgataaacggaactttacgctagcttgtgcttacgatgcaacataatatcatgacatcatttttaagtatttactccctccattcaaaaagtctaatacctatttcttttggcaccaagaccaaggaatataatactcatccaccatgtgacaaaattaatgaacatgcaaccaataaatacaaaaatagctttttaggtttcgatcaaccatttaatttaacacatagtgataacaaatagaacttaagacttttggaaaagccatagaatggaatagatattagacttttgaatagagggagtataaaatagtaaatttcacaaaattatatataatttaatcaaaatatcaaagtatactttagatttaataaagtatcgtataataaaattacagatttagtaacgaagttatccaagtatactttagagtttatatccatatataacactattgagtttataaaagttatagttatatgataaaactgatattaaatctgtagtttactaattaatatgatatattaataaatctatagttttgtgaaaaaatattgtttaatatgtagttttctaatatacttttttaaatatgtaattttgtgatagattgatcaaagcagtggcggatgcaggattaaaataaaaatggggcgaagatgctcatctcaataagaacaactaaacgcaaaaatatcatatttatgttgtaatcatataaacatatagtataatcaataaattaaggcaaacaaaaaaacaaaaatgatattaaaataaagtaataaattttgcgccatacataaaaagatagatattaaaatcgtagacgcgtgacaaagtcagtggcatataatagattctctcaaaaagatactagtaaacatatcaatttgtaaatatgaatcaattcataaagaatggttgatagatatcttttaaaaaataaatatatgagaagat

SEQ ID NO: 98915 - DNA, 569 bp, Oryza sativa
aataaaactatgaggtgggccccccaccaccaaaaaaaaaaaaaaaaaaaaaaaaactgaagaaagaagagaggagaggaaagagagggaaaaggaaagaagaagagaacctcgcggggtggcatcagcccacgcaggccctcagcattcagtgtcattgagcatgtaggctgtgcaccacctgtgctacccatgagacgatcccaggtgcctgtggaacgcagagcaagaacaccactccctccctctccacctgcatttccatcttgatcatatggaggagaaagtcttagtttaaagctagcctgtctttgacactttcctactccctgtcaatctccattttaaacaatgaaaggcccggtctcaggccataactttggcaggtaacagtgtaaggttagaatttaatgatgccatgtaagtttcatatatatgtatgtttagggttgccatctatgtaagacaactgaagattgttttttacttacactggtcataacaacttttaagaatccagttcaagtgagttgataaaaaggtcaagtccataatagtgcaggtggttc

SEQ ID NO: 98916 - DNA, 1267 bp, Oryza sativa
ttcaagtcaaatttcaaaaactttcaacttaattgttgaaactttcgacttaattttgaaaactttcaacttcaatttcaaaaactttcaactcaacttgaaaatttctatgtcaaaattttaaaaagttgaaatcaaaatttaaaactttcaactcaaatttcaaaatcttttgactacaaatttaaaactttcaattacttttctaaaatgattggtaactgaattatttatgtttgttacggttttaaaaataatactaataacagtaattaccactaattatcataattagcggcggcagcgcgcggactagtcgtcagggggacggcgcgcctgcgcaagttaagcagcggacgcgcacgcgcttcctaggaacccccaattctttggtaggatagagttcatataatatgtgtttggtttgctaccaatatgctttttatagtgaagaaagttctagagtactaccaaattaggtatgggtattgccaatgcattggctctaatccaaaccaatcaaactactatttaaattaccaaacaattggtatggcacattttgaaatcaatccaaaatggccctaacatgtgcagccggaaacaaacacgagattcaatcgtaaattctactttattttggcactcgttagttgtgcgtttagataaaagataaagttaggccatgaactacaggaaaactattggcacatgactaatgaaattttaattattattataaacttgaaaactcgatttatattaaaatgacttatatatagaaagattacatatgaatgcaccgtttattagtttgaaaaacatgctaacgaaaccggagataaaatttataccttattcagaaaaataatgaaacttcaaaacacaatttaaaatgcatcgtgagcgatttgagtcagtttcttttttataccgtcagaccactggtccgtccacctcccatttcttttcttttatcccatggatttgtttcggtcccacaaactatttcttttcttttattccatgatttcttttattccatgagatttgtttcggtccaacaaaaagtacctcaagttaccggtatctcatggtaccaaatcgtttccgatcgttgtttctaacaatgcccatcctaccgagttaaatccaaatatatatgcttcatatatgtgtccaaattatataaatgttatttaatttagatgatgaatagatatcaaaacgtcctttatatatagtatgaaacagaggaatatgcttt

SEQ ID NO: 98917 - DNA, 680 bp, Oryza sativa
caaattaatagaataacatcaagttatacataaatgcttctctaatgcgtgaagccgattgtagtggcgagactttctctgtctattgccttgaaacatgggtcccatatcgatgtagttgtgcacctccagactaacctggagtacaattttaatgcctaatttactatcacatccttatcgagttgtgcatcggtaagtagtaagttgagcactattggtgactgtggtctccactgggaccgccttaactcccatatgtacgtccatgttatacttatagcaacgtagcaaactatgttattcatgcttatgcccttcatgaaaggaaaaagagaagatggatgtgatcaaaagaatgttttttttttatgttttgagagtagattcatggtatagagtagacaccacgtgcttatggtgttaaacattatgcaatttgaaaatgagcgaagttgtaattcgacggtactaaaagagaagatggagatgatcaaaagatttttttttttaagttttgagtagattcctggtatagagtagacaccatgtgtgtttatggtgttaaacatttatattttgacaaacatctatagtttagcgcttggtttattttcaatacttaatgttgataatcacatgagacaactttactaattcgaagaatatatttatttttt

SEQ ID NO: 98918 - DNA, 632 bp, Oryza sativa
aagggtggtccactatacaatttttattatattaactagcacatatactataatttcaaattcttaggtggtccatggaccacggtgccacctagctggctacgcccttgaattgcgccatgatttgacaatgtgttgctacagtaaatatttgctaatgacggattaataaggcttaataaatttgtctcgcaatttcctgacggaatctgtaatttgttttattattagattatgtttaatacttcaaatgtatgttcgtatatctgatgtgatatggaggggcaacatttttttttgccaactaaataggccctaacctgctcgctgggttcaaaatattaaacttagggcctgcttggaaggtccataattgatccaaaactggtgtaaaatacaggcccgaaagattttccggtgcacgtggggcttaccacatatttttgtcatatctcaatgacatatcatatgtcacatatggacctcacctgtagtaaccggttcccgtactattgaaggaatcgatttgcaccggttttcaaagagaaggaatgtgttatatcccattttatggttgagggagacaatttaagcaagagttcataagatgaacgacaaaaaatatacttatt

SEQ ID NO: 98919 - DNA, 941 bp, Oryza sativa
atttctaattccctcaataattcacttgattaaattgatttaacttttattaaatttctagaaaatacattatttaaacgatttttaatcccgaacgaaaatcggggcatcacacgatctgtgattggtgatggaccagatctaatgtgggtaggatgggtatgctcggccttgtaatgatctggcccatgacgagaacaacattgagggttcgtgaggtcggtggcagtaggaccaatccacgacagcgagggacatgtgtgctcgcccttttgtgacggttttggcttgtgcggcgatcctaccatgcaaaggtgagataaggctagccggtggaggggcgtttgtgcaagggttcttcacactaatggtagttggatgctggtggggtaatgcaattgcgattgcaggggtgtataggttgcaagtaaaagcgttgtccaataaattgtaggctagcaacggtaacactttcaagtgctgtgatccctctagaatacgtttgccgaggagcctcgctcttcccttggtaggacactccaagtgaaaaccatgtccagatttcttaggccggcgacaacgcattatggcgtcacatcctcgttgaaggtgtcatctagaaggttctgtttttggctttctaccttaaacagttggggcaatgcttatggatgacggtaggtttgtacgaggaatgagtactgagtagatctttcttgttgcttgccctatacctctgcaacccctctcggaccactaatttcagttgtttgaaggtgttgtcgggtggttaaaatgtggatgtggtggtggcatccgtcggtgtggcactagacatttggtttgtgtaggagctacagcatgtggtggtggttttgtttttctattttcgttattaactcccataattttagtcttatagtagtaattttgtactagta

SEQ ID NO: 98920 - DNA, 504 bp, Oryza sativa
caacagtgtggtgtagacttacaacactgtggatgttaaatacttgtagaaatcatagatttaaacagcaaagaaatttactagctgactaatagaagcagagtcatagcaatatataagatgacacatagttctttaattagtcttaccgtgttaaagaaacatatagcgacttcatcataggatctaccgataatctgcgtcttcagcgcatgtgtgatgcagttcactatcgtatgaaaatgtgtctcctccttttcatctgcctgcaataaatggcagaaaaaacatgcttaactactacctagcaaaagaacttgattgaacatagacaatccaatccagaccaaacatcacagataaaataatcggtaaatgtatcatcccattcccaatatccatcgctaattgcaacacttgagctcgcacagggcagagagatttatcaaattaggcgctgaagctgctggaatttcaccttggtcgcaggggtgaacatcttgg

SEQ ID NO: 98921 - DNA, 639 bp, Oryza sativa
atttacttgtgctaaaagtgtactctgcatgagtggattagtttactttggttctcttcttcttggactgtacacgtcaagttactgtcagtctgtgacaaacttcttgctgaatgtcaggtgtatgttaaacatgcgttttagttgagattactattgattggttgaattgcatgtaatctgtactaatggcaataaattagttatttgcttcatttatttgtgccaaacgtgtagtctgcataagttggattgagttcagactcttaagtctgaatttcagacatgttcaggaattgagttggttgaaatttcagagaagttcagaattgagttggttcaatttcaaagaagttcaataacttagttacttgatctattgtttatgccaaagtaataataccatggaagaaaaccatgcactgaaaacattgatctgcgaggtgttctgtgtcaggtggaatgactgaccaaaattctatggtatgtgggaagcgtgatccatcctattacaacgtgtgggcaaagatgcaatctcctggtcctcatcttaatagtttgtatgattggcaattttttcatgggcgacgtaaataatatccaaccttttgcgaatcttattaactatagagcggattt

SEQ ID NO: 98922 - DNA, 1070 bp, Oryza sativa
agaatcattcccctggaagcaaggcttcacttaccccctttctacactttcttttcactctctaccccttgctttctctctgaaagcttatctgtcccttgttccttcaggcagataagggaaacaatgagcttgattaattacctctagcaccacaaaatgctccaatcaaaggaatggttactactaaagagaacaatggagttaaaaaaaaattggtcaccaaccattgtctattaaagcaacatgtgtagatatgatgaatgatgctggtaggacttggtataaaatccgccgtaagtcgtctttatgatgctggcgacaatgacggggtttgaatctcctgaagataaagatagagatgaatattaagtgtttcacgtaaaacgaggtggtaatagcgtgtgattaattgagttttaattattataaacttgaaaatggattaatcttatattttagaacaactttcatatagaaagttttcacacgaaacgcaccgtttagcagtttgaaaagtgtggcacgaaaatcttaatcttcatccaaatcttattagagaaagaacagggccgattccgaggttgtattgtgcaagacaaaattccatgtgatggtaaaagacaatggtgtcgctaacaatggtaagaaacgcactggagttgacacatagattcctcttaccaaggaagagggaattgcaaccgatggtgctcaccaggacaaccattcccagcataaggtcgggtagcctgtaaactgaaaaatgccgatgaacactactaagatttgaggtggtcaccagatctgaatctccaagccgcattccaccaaattgtaggataaatgtgcttcgggtgttcttgctggacatttggcaatcaatcttggcggcggcggcgaggtgtccgtcggtgaatcgatctgcaatctctggttcatcgtaaattggcatgatcatatactccctcagctccgtttcattttaagtgtggttgtaagttttggtgtccaatatttgaccatccatcttatttaaaattttataaaaaaaattaaaaaataaagtc

SEQ ID NO: 98923 - DNA, 577 bp, Oryza sativa
cttgtgcaataagggctacaagttgtgggcgagttggattcccgtaaaatgcaagtgcaaacctgaaatggtacaattcataattgtaagttttcaaatgcaccatgtaaccatataaaatgaccacatgaaatatcatatgcatggttagtataagcatgtactaggctacagaggacctttgcctatgcatgacttgcattaggacggaatacatattcccagtcacttagtgtcacaaatacatgacttgcattaggacggaaagcctaagtgacatcactggaaacttacagttcagaaaaaggtgccaaataaacaaaccatttgagcctatgacttaaagaaatatattccctgatgtcaacaacagtatagctttacaaatcataaaataacacctgttttcttcctttttctcattttgttaaaaactcagtgaattgcaatgacaagattggcaaaaaatcccaaaacattttctattgtcatttaacaattcaaacaactctgggccgctttgtacattatctaccctatagttcaacaaatacttttactcaatctttcattcttt

SEQ ID NO: 98924 - DNA, 1422 bp, Oryza sativa
ccgtgtccgacccgatgcccaattataaattgtgggttaggatatgggaaggatgagatctgtccgaacctgacctgttttcacccctacgtctatattattgcaatgtgcaacttttatagaaataactcatatccggggcccctctgggtcacccgcgggttaattccgattcccgtccccatcgccggaattatgcggggccctgtccccactcacccacgggtgagaactcccccggccccgcccccgtaggggcgggtccccggcccaacggggaaattgccacaccctaatccggtttcatccaaatttatctcgagtcaatgggaatcatcgttgtagctgaatctgaacttggccttaggccttgtattagactagggccatctcggaagtgtctcccttcagctccacgaattaacctctataaatgtttatgtagaccctctaaaacaattggattttgattagttgaattttgcaaagcgccattcatcatgtctctagctctccgctcaattagtcggcgactatgcattgagagccgccaatagttggtgtgttgatttgcctaatcgattagatttaccacttttattacaactatttctttgtgcttaatcacctattcacaatatttagattacatcctatcttgttcttaaaatgttctctcgttagcattgcagggatcatcaaccacgcgtcacggttggtacgatatcgtttgtggggtagcgattacacgacgtcttgaacttgttctggtcgtagccacatcgcaaacgttgcgcttgatcaaagagaaagctatcccctcaccagaagattgggccacgagagagagcgtcatcaggatcgctccttttccgccactactttctttttagtgtgaggattaagtgtctgtgctgcaagtatttacgctttatttatatttcgatatgtataaagatttatgatattattacctggcttgattcctggacaagaaattatacacaaaatcgtctgaaaaatttggcttattttttggggcgtgacacccacaagagatctagcgaacgtcgtatgctcacatcccttgatagcgaatgagtcgttgacacgtgggtaccacgttacgttccagcataaaaccacttacgaaatcttcaccgattttcgaagatgaagaaagttctcagtccggtttgttttgcggttgagggagaagttcttattagcagaaacaaataaggaaggcagaatagacttgttccccttgattgctgcgagccgcggttccatacttccatccgtgagcctcagacatcgccgccgtgagccctagcctcgccgccgcggcgcgtcgatggacgtcggcgagggcaaggggttcggagccgtggttgatggcgtcttgccaccggagatgct

SEQ ID NO: 98925 - DNA, 526 bp, Oryza sativa
ttcccaaactttgttaacaatatgcttaaggtagaaaacttctgacctgattacccctattaaatctgttttatctctaatttagcctccaagtctccaacttcctcagtcattcaggtgttttggcatggcaggcagcttcatacgaggtggtcaagctcaagggcattcatatctattagcatttaataagggtaattaggaaaaaaagtacctagaaaacctaaaaacaaaatctattttaggaaaaaatcaacatcgtaaaaagtcataaaaaacggaaggagtatttaggcatagcaatcccccctatcattatgagagttgtcttgttcatttatctttcctactttgttgtaaagttcataaaagagttaacataacaatgcatagaattacttaatatgcttcatatagtcacataacatcatttttttacattttatttgatattttaaaatgcatgattagtgttatgttgatgcttggttatttgttaacagattcgctacaagcaaaagacagt

SEQ ID NO: 98926 - DNA, 753 bp, Oryza sativa
aagcccagatgcctatgtatcctgccacttatcattagcttctccaggtgagatagaggtttcaagttgtccatagatcaagaatatatcgatcgcgatcttctgcgaaaacggacaatgaattcagagatgtctgattgaggcccatagatctgtgttgtgggactccagtaccttcatgatctcatccctgtcaagcatccaatgtttttaaccatgtagctgttggcttctatgcttctcagagactgtagatgttgcagttgacttattttgctacttgctgacatcccaaaccgcccatctacgagtaggtggtgaagcttagttaacattgtggtttcacttggcaactccagtacagaaccattgagataaagcatttgcagattgctaagcttccctatcaatctcggtatgtctttcagttttgtgtacccgaagtttaggtagtgcaagtaaaacaattggcactttctgaatattgcaatttctcaggcagcagtctgaaccaagacgatgatatttcctctgaaaacacgaacatggaccgaagctgagatgaacattttgctgcttggactaaattgccataatccttttgtaagaagcacactgtgatccattggtcattccatccgagttaggacagtcccatatggtagcaattttttccttcttggatatggttagggctatttctctctcttgataatgcatctgggcttctggaatctctttggccttccttcc

SEQ ID NO: 98927 - DNA, 579 bp, Oryza sativa
agcttcctatttgatctttattgattatgtgcatatgtgttccttcatatccatatgtatgcacatcttgagggggagcttattctatattttgtttattataatatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtcggttatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttactccaatgttatcttatttaggctcatttacattgagaacatacatatgccttctctatatgtataagataaacccccattggtcattctctaattatacatacact

SEQ ID NO: 98928 - DNA, 559 bp, Oryza sativa
acaatcaagccgctggatgtttcatagagtggtggatatcctatataatctatgtcaacgtcactacttaacctaatcggctgccttctagtaacagatgttagtcgattggaggttagataacgatattgccggagattatatgagatatatgataactcgacgaattacataaataagattagagtatcataaagatggaagcactaatcctgagaacgcaggcccgcataacaagttttacctctagttgaagatcgaaaccgatgcagctcaacccgaaagcaagaactcgtcgaaacgaaacgaaagtaaaagggtggcgatgcgccgagattgtattgaacatgtgttaaattgattacatggggctcggggtctatttatacccgagattacaaaatatgcccgtgtcggacacgacttttatctctaacaaactctaagataccataagtctttgcggcagacttttgtccaaacatatctctaagggaattacatgaaatatcctaattaatagctacaattgccttctcaggactttatccatacgtgg

SEQ ID NO: 98929 - DNA, 526 bp, Oryza sativa
aagtacaaaactttgaggagaaaataacttcgaaatgttggatgcacacttttctttgcaccaaaaataagttgtcaaaagacttgaggtccacatttgtacgatttggttgataagatctgactttgagcaaaatcgactctctgcaaaatctttcttgcggtgagccagctgaggaagccatgcgaaaggcaagcaatgcatgcacgccaccgaccggctatatctctatatatcagcatgtgcatattggttagtgtcatgactcatgagcagttgtcaacatgtcaggcgcttctagtacagcgacctgacgaaacaaaaaaaagttggaaagcggcaaaaacacacttttgagtcatcaagaattgtctttaaagccatttaatttccaaggagacttttgagccatatcatttttttaaaaaagaaacacgttataaaaacaggtgctcatatacgtgtgtacatacggggtacggcaactacccaaaaaagaatcctagatttaaaccactcatgacgg

SEQ ID NO: 98930 - DNA, 587 bp, Oryza sativa
tagcccatgccacagtcggacgaatgatttgagcaccacaacatttttgaagaaacaagtggcgaagtggttcatgagcatctatcttcttacggtagactaatgtgcgttaagcaaccaaactatacgctaactacagcacctatccaaacaggcctgcagtattgattaggttcgaggaaaaaaatattataatgtctcttattaaatgatttatggttagatatgagaggatgattggaagtaaaaaagaaaaaaaatataaattattaaaagtgattgatgaaacaagtaatactgcgttctgacatctaccgtggcttctgtgccttggttctacagtacttcattttgttttacgttgagtagtgcagtgatgaggccaaactggccaagccatgagctgtgaattgtgatgaacagaacaccaccgagagagatagagagagagagagagaggcctatgcacctaggcgcctacctgactgctaccgaagcgaaaggcacagtgaccttgtgggtttggtgcagtaagagtaggtataatagcaggctataagccagctataaatatattttaaagagat

SEQ ID NO: 98931 - DNA, 803 bp, Oryza sativa
gttgcaccaatatgtgccagggttcacaattccaatggaaaccggtcgaattccgcgaaattccgaggtttcaacgaggctcgaaagtagaaaccgtctgatatttcgatgagtttcattcaaattcaaatttgaattgataaaaaagggaaaaaatcaaataaaatcttataaataatatgatattaatagaacaaattgggatataaattttcgaaaaaaatgatgtattccatgtatttactgaaatttacagtagaaaagaaaagaataacgaattaaaaaaaggaaatcaattttagtttacctctttttctagctaccgattgaaatttcgatgatttcacccggaatttcgccaaagccgaccggttttcatgagcttatcggtaaactaagggaatttgtatttaaattttggtttatgaaatttgttcggaatctaccggctttccaccggattagtataagatatgtgcatacaaggttggcaattattagtctcacagctgcttgtctggagctgctaaagggcttagaagaagtactggcttcttaggttttgcaacaaaaaattgcaatcaataagtagtgaccttgaggacaaagtaccacacaatttgatcagtcatgaacctagagagtgtatatgttccaagctctcttagataactccctaagcacagcagccgcaatcaacacagctgaaatttggttatcgttgtcatttatgattgcaacgttgtctctattaaaatcataccatgacttgttaccatgcaagacttttttgcctgttagcg

SEQ ID NO: 98932 - DNA, 880 bp, Oryza sativa
tgaccatcttgcagggcttcggttcgaactctgtcattgtcgctcgaccttaatggtttgagggcataaactcctagccatccatcccgcctagaaggtggatccgcccttagatcatgaaagtcgaatctaatcagtgtatatactgctaaagattctaggatctggggttagaaatagagtacgtgtattaaggaatatccgcatgcacatagctaacttttctaatatcaagccacaatcgtgcaacatacatacatgcacctaaaagttgacaaaaactcctaaccatccactgttgctaaattagatcgtgcagacaacattctccttcttttgacacatgagcagggaaaaggtcaccctgcgcacccatgcatttccatgttgcttcccctggaaaaatgcatgcacgtacggcagtctgaaaatgacaccaccgatcactgatgagtcgcacaccgtggtcgctctgtgaattgatgatatatatccattgacaacctcgtcaactctgctcgacagcttatctagcaaaatttcaatttgaaagttatttttttactgatcgatctaggtatttttacatcatatatagtctatatattttctaactcttgcttataaaatattaagggcccctttgaatcgtaggattgaaaaatcataggaatatgaaaaacacaggaagtattatgataggaatacaagtataaaacagagaattgtaaaacataggaaaaataaaggaatgaacatttgattggaccgcaggaatcagatgagagagatagactcaagtgaagttttacaagaggttagagtggatgttaaatttcctacgtttttcctctagaatcgtaagaataggaaagtttcc

SEQ ID NO: 98933 - DNA, 691 bp, Oryza sativa
ccataccatgagatttgccagcttaccatcattcatggggcatctagaagtagaggagaaaggggtctccattcaaggatactttatggtgacaagtcggtgatcttgtatggtccaatgcaatgcatgaacacacacggatacagcaatttgcatgcattatttgcaccaaaataagttataaaatttatatatataatatatgtacacgtattgctcacctgtcctctcaagtccccatctggtcaatatcctctctctcattccttagatgttgacatatgtcttatcatgtgttatacaaataattctactttaatcatgtaaactatgtataccatgtaagtaatgcaatatttgcaatttgcacaagtctgaatgcacctctaacacagctacatcagagaccaataattatggtttcattaaaggttttaatttgagaaaagaaaagaattgaaaatgacttagtgagagttacagaggtccactgatctgaatgattaggcaattaagagcaactttgtgcaatggttggcttgtatagttttcagataagcatcaaagctgaacctactaccatgggtggtaggattggaaaggcatatgcatgctttccattctgactgaaataattgaatttttctcacaataatcatggccctgtagcaaagagaacactggtttgggg

SEQ ID NO: 98934 - DNA, 512 bp, Oryza sativa
cagtattctctcgagatccagaagttattccgtaccgacttccaatattactcataaaagaatctaccataaatcaaaataagctttagaatcatgtcatgcaaaaaaggatgctcaattttgctacacaataagtatagcagtccaattcaatctacctggactttcagacaaaataaatataatataaaacatcaatacgaaatagtgatgtactgcttctaatgagatcttggagtcaattttacagaagaaatatgatattatcaaaccttaagttcctaatgggaacagagaagcaactcaagacacagataacagatcatgtgttcgactttctaaaacactaggcattatagtctgttaaataagttttgagaagaagatagaacatataaggcagctcaaattgtaagctacaaaatgcaggtggaataggaatggtgataatgtggcaaaagaaaatgaaaacccaaacgaattctacagatagatgataggaaagattgcat

SEQ ID NO: 98935 - DNA, 1137 bp, Oryza sativa
tctaatattccttattttttaattccgaatttcatttatttcctaattgtatttctatatggactctagtctcctcttttaatattccttattttttaattccgaattttaactatttctaaattatatttctatatggactctagtctcctcttctaatattccttattttttaattccgaatttcagctattttctaattgtatttctatatggactttgccttttctttttctccgattaatgtgagaatttctaaaccatgagagcgaacatggaggctaccttttctattcctttaataatataatagattatagtaatttttaactatatgtccgaacatactcttgttcagatagatacatagtcaaaaattgttatattctgatacacggacggagtatctggtaccatcatcggtaataagtattgggtgtttataagatttcaagtacaagattaatttgatcctaattttcattatatgatcgtcctggcggctgtacaagctgatcgagttctttgatctcaatggataatcaactaaccgtgcgtgtggtagttgcaattagttattggattctttgctatctgaactatgattaatgccgatgctgaaacagtagaaaaataataggaatgcatatataggccgcatataaccctcttaaaactttgatatttttctgacaaaattaaatgtttatatggtaaatagaggccgatacaggtttggtccaggcccaaaccagcccacggtatattgtgtgacatcccggcgcagggcttaatagaatactcatatcaacaagttaatctataaaagttgcgcacgaggcgggtagttacatattagatcaaggcatgcctctgcatggtgaaaataaatgcctataaaggggtagcttaagacttggcgctgatgataattaattagatttattttttcacgaacgcgtaaaagattgctcgtaaatatatggtaagtagatttagatgtaactacaaagagcctttgatatcctcaagggatttgaccaatcaaaagcagataattataaatatttgatctgtagtcatcttagataaactaatctaattatgtgttggcttaaattgagacaccacactttt

SEQ ID NO: 98936 - DNA, 649 bp, Oryza sativa
catattaaattaatcattaaatggtctaattataattttgttaagtactttgagtgtccaagtattttcaagatttttcttggaattatttgagcataagaagtatttttaacaattcaaagatcatttcattgattaatttaattggaaaagtaataataatcctcttcctaatcttgggccctttccaccccattttccttttttgtgtgcaccggcctgccacccaagtcaacccaacccaatttcccccctctctttccttcctttctttggtttcaacccacccaagaacaaaaagtctatttggcctccttcgacactgtttatcttctacctctagcagccgaactgagcccgatttggctcggttttctcctccaatctgacctttccccttgtgttatctaaaatagttgaggggaaatatcctcttatcctcctctatctttacccccaaaaatcggagctaatcgttgagtatcttatccggatcgaactcgttttcgagtttatctccaaaactgagtttttgatttcccggatcgatttcttgcgggaggagtccgatctctttaatccaaggctataaataggacccccttatccggctctttcttttgccccctctcccgtgatctcccgtgcc

SEQ ID NO: 98937 - DNA, 636 bp, Oryza sativa
ctcacaaatgcaatgctgcatcaagaaaggcaccaccaatctgaaaattctgattgacagtcagaagaagcagtagatgattgcatgcatgatataccaggtgtatatatcgatcgatctatacatttttcatcctaccagaatccagagtttgactcatagttaatggctatgattcttttcttttttcttcttcttcttctctacttttgattttctgatgaatgttcaggccttcagggttttgtctcttttgtttgtctgatgaatgttcagggtctgatactctctgatcccgctcgtcttttttgtaatgccattggatttggcgtctgtttgatactacttgattttagctgccgaagaacatactgaaatgaaggaacccattgggtttcttgtctgaatcttttgttgattctcaggactacgcatgatgatctagttcattgtgcctcttttgttgattctttcgggtaaaactgccatgtcaacttcaaagatgcagcgttggaaccacaagttattctgtcaatggtaagcaagacacttacttcatcgaccaccactccggcgaatactggtcctaaagcttaaagttcacacataaatgcatgattgcacactacaagttac

SEQ ID NO: 98938 - DNA, 683 bp, Oryza sativa
tgcaatacaaacatgtcatatcatgggacactacaagggacatgccgtaccagtgcatatatccatcacagtacctatgatattctatctacttatatactgactcctgagccattcacggctgcacatgatcaactctacgggccagattctattcgtccttaattatctataatcatgccctttcacctcaatagatcgtagcctttagatgattaatctactgtccatactatcttcctatcgactctctcgcataccatcataccaccttaccttacactatcgaatcaccattgcacatactgtgcgcacgaaagagaccatagatgacgttaattaacagagccacgactaatctaactaatgtacacgtcatcttcttcgggatcatacgaaatccccgcagcatgcgcgatggttcacctaggagaaaaacaaaataagtgcaaaatatttggaaccatcaatccaagtctagaaaaaggaataacgaacaacaggtgaaaaatgcaaaagaattttgcctcacgtccccactggccccacctgccagctacacagcttcacatgtctctcccccgtctacggacgcaggctagaagtggccaaacgggcggcccggcccggcacggcacgggcacgggtcccgaacggcccgtttcgcacggcccgttaggcac

SEQ ID NO: 98939 - DNA, 571 bp, Oryza sativa
atggattatgcgacatagcaaaaagtttagaccagtttttttactagagacgataccgcagttcggagcaattatggctttcatataatgatgttgttttttatgggagtacggtttattttcctttgcaggttgttttattaattatttgtccagaagctcggtttatatggtattatcaagtcagcgtatttatattttcagcaagtggttaaggagttttaacgtggcacccgggtgatcacttagttttcatgttgtaagacattgatctcgatagtttctatgatgttctttacttctttgaggccttgtgtgatttatccctttgaatatatatgtgtagtgtacgtgatcagaggagcctcattaccagatgtattaatttgatattaatagtcattgacttggggatatatgtctcccccatttttaagcgtagtatatatagaatattttgcaaaaaaaaactacatcattgagtgtttgataaacatgtaaacggaacatagttgaagtttgtagttgaggcaaagtttttagcttaagtgtagcagatgtctgtgttcac

SEQ ID NO: 98940 - DNA, 582 bp, Oryza sativa
ttcacacaattatcttaatgccaatactagtgaaatttcgagccggcaaaaaagttcaacagtttgttttccaaaggtacacaaataactcgctgccactaataatttgctaatgtcacccatgttaagattttaaatcccaatgaagagcggcgtatcaacagtaaagctgaacaacaaatagcccaataagacgtactaggctgtaaaaaaaaaaagacaaacccagacacacatatacaagttcgtagctaagattggttttttttttttgtaacggaggggtagtattgtaaaagactaggtccatctaatcctaacggcataactagcgcactcgagccccatactcccatggtctcgccataaggccagcaacaaaatacagccagtttattcttagtcgtcattgcatgaacaatccctcatgtttagtaaggtacaaacgggtaccatcgacgaagcacctgcaagcatatccggtaaagaaaacgggatatcatgagaatgagcagactccagacataattagcttatcgatcgcagattcaggcaacactaattcagagtgagcctcaaagt

SEQ ID NO: 98941 - DNA, 542 bp, Oryza sativa
aaccatgttttggggaatatatatcaaaaaaatggaaggaattaatagtataaggtctcattcttttctccaacaagagttggatgaatattaagattttcatggcatgcttttcaaactgctaaaggccccaaattttgcatttcgtacgaaaactttctatatgaaagttgctctaaaatattatattaatctatttttcaagtttgtaataattaaaactcaatcaatcatacgttaataccacctcgttttgcgtaaaaagcttaatcttcatcttcaggagaaaagaacaccacctaaataaataattgatctgtagttaaatatatacctcctcttcttcatgtgtatctttggttttatgaaacctctgatatagttctgaaatattttccttgagatggtaaagtatggaaattatattaatgttaatacttccatatacacaaacttcaccccttttcaaccttgctggcattcatgtatgatgcacgtacgagtgggtttgatcttgaaaattttctgaatagatattttta

SEQ ID NO: 98942 - DNA, 573 bp, Oryza sativa
actgttgagatcgggactctgtggagggccggacactacttgcgccgatggagcgagcttaatggtcgaatccctttgtctacaattattatatacacatgggtacatatatagtgacatgcaactttccgcgaggtcataggatcacgaattcacgagtagattgttcagttctaactaaattataccatattaattagtaatatcagtcgataattgaataattagtatatataggatcctcggtaatttatgttttgggttcgtcaatatatatatgtggtatgaggtatgttttagtaggaatattcaggaggtaagtacgtgtacagagacataaatcgagaaaatattttttaaatagtttccttagatattgatcttctattaacagaaaaggaacccagaaatctttttttttttgttttttacaatctgctggaaagtccaaacagcatatatgttcccagaaaaaaaaaagagaaagaagcagagagagcagcaaggctgaagcccaaacatatttttttctacggcccggtgcgttgacaaatctgactaaaacagaagagg

SEQ ID NO: 98943 - DNA, 736 bp, Oryza sativa
ttttttccaaaggttaatactaatagattttgcgagaaggccataactcatgaatttaagtgtggttgctaaattacatgaaatattttctcctaatgttaataatcacaaattgcacatgcctcggcccaatgctagtactaacaacagtttggacaaaagaaaaaagttcatgcgttttttcaaaggttaatactcatggtttttgtcaaaaggctaactcaggaatttatagcgtgcaaactaaatttcacattttttgtcctaatgtaaattatcaaaaatttcaacgcaacattctcgatgctactactaaccaaattttgggccgaagaaaaaaaaatcttgcatttttctgaaagttaatactcgtgggttttgcgttttttttccaaaggttaatacacacgagttttgcgagaaggctataactcacgaatttatagcgtggagtctaaaatttcatgaaatgttttctcctgatgttacgatatggtccatatgctaatactagcaaatttttgggccgaagaagaattcttgcattttttttacaaaggtttaatgcaaaatttaatgaaaattttaacctgattttaatattcacaaatttcacaaacaatggtcccgatgctaatactagcaaaatttttaactatttgttttccagaggttaatattcatgggttctactcgaatgctataactcatgaatttatcctgatgttattattca

SEQ ID NO: 98944 - DNA, 675 bp, Oryza sativa
aaattctcactgttttatacgatagcttgtagaactagacatggcaagcataacattcatgagataaagtattagatgatgtctgagggatttgaaacttatggtcatggatacggcaaggccatggatgaagtttttctgctttacgatttttgctcctgtatcatgtatgatttttgctcctgtgattaaatccatttattgtttttttaatcgtttgatagagtgagcttttttaaagtcactgaaaaaggtccaacgcccaagtgcttttaattagtgggcttctttgttcctggcattctaccgagaaaactatattaatttcatatgaagggcttaagcccattccagttttgtaatcgcgtcgacgcggcacgcgaccatgatgcgtttaatggcggcgaacgtattttaaaatttttttatcattttttgttttgtcagcatctcacaatttaaacttttgtcgtattgtgtttgtattttgtctttgtctttgcaacttttataattttcctacatattaatcaacctaatgcgctatcttaataacaactatgaaatcatattatctaggtcatagccctatcatctaccggttttgtattttgttggtgtttgtcttatttgtctttgtcggattttaaaatcttcccacatattaatcaagct

SEQ ID NO: 98945 - DNA, 591 bp, Oryza sativa
taggcaatggcatcaaagcacctcttgaacggcgatgtgggctggtacatgtagcttccatcgggcctgggcgtcttctggatgctcatctgcgtcccatgtagcatcatgtgcgcgatgacgcagaggccgtaagtgtcagcctgcaggaagaaaccaatcaaccaaccaacaaacaaactggcagcgtcaggcaggggttgctttcagagatgtctaggtgagaggaggttttgagtaagtagcttgggagggtacagatacctgaaacgtccaggctctctgttcctgcatctcgacgcagctgaacccggaggttcggcagtcgccgtagaactccgcaccggatgggaagaggttcaggtcgatgccacggccccagtcaacaaggcagagcccctggaatgggaatcctataagcatcaggagatatccagaacatcttaaccaagtttttcggcgtgttgggaacttgggattgagaagctgacttgattccgctcggatcttgtctcgcctttgaaggtttcgtctgtgatttctccactgcacagaccaccacacgcaaaacaaagatgcgggtgaacgaaa

SEQ ID NO: 98946 - DNA, 616 bp, Oryza sativa
gtggttaagtcgagaacgggattttctgtatcgacccactcgatgtatgcgcaagccgtagtgcgggtctgtcgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacaccagtttggatcctcaacacctcggcgtctagccattgacgaaagtcggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttccattggtcgtatgcgccaaatggcgggcaaatactcgtatcacacgcgaataaaggaggctgcatcggggtgcagga

SEQ ID NO: 98947 - DNA, 677 bp, Oryza sativa
aattacttaaattttttgaataagacgaacggtcaaacatatttaaaaaaatcaccggcgtcaaatatttagaaacggagggagtttatttcattacttggcactaggaagaagagtagttggggtatgaatttgtataccgtttcgaatatttcgatccatttcctaaatttatggattcattgatcttactggctaacccctgcatatgcggatatgccacacatcagcatctacccaactacaaactgcaagattcttcatattcattatgagcctaaaagtccttgcaaaacagttaagcctagaagttactatattataattcattttgatttttttcccacggcaaacttatttagttttgatcaaatttatagaaaaatatagcaatattttaaacataaaaacaaaaggccatcaaaatatattcagtgttatatttactaaaattaatttggtgctataaatatttctatagttttctataaacttgatcaaaggtactatcaagaagtttgacttaaataagtcaaagcaacttataatataaacaaggagtatttacatataatcttggctcacacatgcagctacataggatgccaccaatctagccaagctacatgtaggagacgaatcactctaataccttatgcacaaaaattcatgataaa

SEQ ID NO: 98948 - DNA, 549 bp, Oryza sativa
agttctcgcatgtcgcaccccacacgggtgcgtggattgaaaccagataggggcgcaagttaaacttataaaatgcggtcgcaccccacacgggtgcgtggattgaaacggtttgagtgaagttaaaagcttggatttggttgtcgcaccccacacgggtgcgtggattgaaacgaccatattgacgttattttcaatggcccggtcgcaccccacacgggtgcgtggattgaaactgctgtctaggctaaaaggggtttttaactcggtcgcaccccacacgggtgcgtggattgaaacaaaggggggaaaggttggggatataaagacgctgtcgcaccccacacgggtgcgtggattgaaacagagacgacatctttttttggctcatcacgcactgtcgcaccccacacgggtgcgtggattgaaacaccagatggacgtttaaaacgcttgcaaggctctgtcgcaccccacacgggtgcgtggattgaaactttggtttctgtcaaaggtgtgtcaatgtgtacgtcgcaccccacacgggtg

SEQ ID NO: 98949 - DNA, 2171 bp, Oryza sativa
cttcctcctagtgttacaccagatgggttggacatggaagaggaattcgggatgaacgttcgtagaaaaagggatcttcatctacatccagtaattcatgttggagtagaaaaaggtataatgagctagatatatggttaatgtaagtgcatttttataggtgtgtatcgacttcttgaataatcatcctcaataaagttgcacgactctcttaaagcggtaagcatttttttaaagattattagcttataactggtttttaaagctatgcaagatatggtaggttcttctgcacgctgtactgtcttcttccagtcttcgtacttgcattggatgcctaatttctttgtgttgttctactattacctggataattgcttgataaacaataaaagagaaccggacgaactagttaggcccaaataaagcaggcccaactttgcccgttagatgtcttggttacttcttacttgggcctggttttctccatggatttgtgcagccggacctgtaaataattacaggtagacagtagtattaaaaaaagagtacagtactacatccatcagcagcctctgaaaattattcccctgagaagaaaaatcgcagattctctaacaaccaacggccttgcttggactatcgagtcagctgacagctagtgacgaaccagtatgaaccaaatacgcgtagtatgtaacttaaatggaattattaattatattgcatttttaatagcaggaatggcacttactattaatttatactcccactgtttcgttttaattgtagttgtgagtttctatgttcaacatttgatcatccgtcttattcgatttttttattagtatttttattattattatatgataaaagattaatagtactttatgcatgacttatatttttaatttttttatatttttaaataagatagacagttaaacgttcacggaaacccgctaaaatagaacggacggagcatattgcattcaacttgagatacctgagcattatagcatcactattttctcatgtagtagtacggtggtagtacgaaatgacactttttaaatcacctccactgatgatccactccactccactcctctcagtttctagcttgaccatgggcggcgaccacaggctacaaccattccaaattctagagaatctcaactgcaaattaacaaagttgtagcactactcctaattatgaaacacaacacatgtccagctagctagagaaatcatatctctgcactgcatccatacatcacctgccattcctcttctcacccaaaaaaaataatatagcaagaataattctcctgtacatatgtgtcatgaactctgaagaaactatataattaaagagctagaggtagctaatttctttaaagacaaacatgttaagagtagtagaaagatagctgagcaagctgggccatgtgcagcttagcaacactgttcgcatccgcgttatagtgtggttatttgcttcgtcgtcgccgctgaattggcgtgcaagctaggctgaattatatcctgggagtttagtactagacgccgttgtgttcagacaatctcgctttcagactttcagtcgttttttttcagagtttcagagtgattgcgagtcaagctagctatcagccaataattaacgaatgattaaatgtgtttccgccgttacgcggttggatcgatccaatccatcgatcgccggccggtttggggcaggaggcaactgtctgcagctgcatgctttcattgcttcctggtctcttcttcttcttcttccctgcagccatggatggagagagctcgagctcgacgtggtctccaagctggaaagagagctatctgacgcgacctgatttaaccctctgcgattattctgcatgtgtcgtgctgcgctttgtgggagtactccgtactggagtgagtacaccagcacagctagctctgtcagatgctgatcatgatctctttgtttccagtgctcccacaaagctgtcgcgttggcattctgccacgtcgtcaccgccacgtgcatgcgtccgtggcatggacgtacacgtacgtacgttggatactccatcataaaattaatactccctccgtcggtccgtcctaaaatataacaacggttaggcatcagaatttgt

SEQ ID NO: 98950 - DNA, 608 bp, Oryza sativa
cttgactagtgaatgttacttgattgtttgtgccttgacaattcagtattgtctatatttgtaattattttaccagtgttttcatgggagcattgcttactcaatgatatgcttgcagatggacaattgtttgattgatgatcgaagaatacatgttgactttagtcaaagtgtttcaaaactgtggggtcagttcagacaaagcaaaagaaatgcaaataaaggtattcttatttccatggccttagaatatgattgcagttttcagtttcttttttatttaagctaactgcatggtagctttcttttttcttaaggaaaagcagtaggggagatcctctactgttaccctttcctacaaggaaaagaactatataaatctatccttcatcaaaattcttttcatctagactttggtggcactcaatttcctttcagaccataattatagcatcctcctgtatcctatagaaatttatttattcctataaggaatttagtgttttgtaccatgcggaagatgtctagagaagtgtactgattattattcagcacagttaaaccgtgtcaagtgtaaagatggcaacaatgttcccaatagccacagg

SEQ ID NO: 98951 - DNA, 539 bp, Oryza sativa
gtatccctaccagtacaattcaacaacgggtacatgttgaatctgaacagtcttaacttaataggtaattgccttataatatgaagccagtgatgtatttctttttttatgcatgtaccagtaacattaatatatttttgtaagttgcagataattcgagtcaaaaggctgtttcagatattcacttaaaatccataattatttatcctgtgaaatcatgccaaggatttagtgtaaagagttggccactaaccactggtggtatgcctaaattctgcacctttgacttgttctttcatttgtaacttattttggttaccttatatgcatagttcataagttattatgtgttttgttttaggcctaatgtatgatagagaatggcttctccaagggtcaggtaggtgaaattttgacacagcaaaaaggtcaattagcgattcctattttgtgtatctgttaagccttatgagttatgagggcgcgacatgtatgcatttatatggtgtttttatactgacactgcatatctgcaacct

SEQ ID NO: 98952 - DNA, 523 bp, Oryza sativa
agttgtgcaggtgtgatgtctggtatatgaccagaagttgctctgtgtgtttgtagtagggatttgaaccgtgccttcttgtttaaatgtcattttatagctttcatggatgatcctaggtatcattcaccttcatcagaacggaatttgcagttatgctagctcttatatgattccatctatacaagtgtatgctgtgtattcttagtattgagcgttcagaacttgctgttccttttaagctcagtttgtatttatatgttgttccttttaagctcagtgtgtatttatatgatttgattagtgaatgtgtcattttgaccacttttctcttgatgtatctttatgtttgaatatatcgtccataaatggagcttgtctttatcgtacatgtgcagtagagtgcctgagaccctcctattcattcaatatattgccgtcgtgacttgcatgaaacatcgttctctttttggactttgaggctcactctgaattagtgttgcctgaatctgcgatcgataag

SEQ ID NO: 98953 - DNA, 619 bp, Oryza sativa
cctgtgcagtcgtgctgaccttgggtgaagcatttgacagaagaattgggaattgatcctatcatcaacgttttcagaggaaacgagtagccgagtactccctccatctcatagtaggtgacgttttcgattttttatttataacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagtaggtattaggtaaacaccgtttggtggaccgaatatacaggtagcagagccgagggttgaagagagcctaaaaacttgctctgggtgaacaatgggccaaccccttctggtttctttgatccgatgctacattccgacgtttccaaaaaaaaaaaaaatcatgacaacgttgcaaacgccatgagaaaagagaacatactaatagcatcaggcatcaattaaatataatcttataatcatacgaccatttcggggctaattaaccacaacataattaagtag

SEQ ID NO: 98954 - DNA, 522 bp, Oryza sativa
tcacctcagaccaaggagcagcatgtctcaatccaaaagatctctttttctcttcttgatatatataagctagctctaggtacagccttatggccaactgctgagagtgacaggtaaaatggccatatctgaacttctgaaggcatgaaggtgaagtggggaaaggtgtggacgatgatcttgtcaagctttgatgatggcttaaatcggttggagcaacggctaatgtagtaccactgtaccaactaagccttcaatgctgaacagttgcagacaagagcaaaagatgaggacaagcattgcaagtatgtgtatatgttcagcatcaatgtacattttttagggggccaagaagaatgacatgtaaccatgaattccaggctttgaaatggacattccaatgccttgagcttctgatgaaagttcaggtccctattgaatatatatagcaagtggattaaaggggtactgatgttgaaaaaggcgcaagcacagtgcccatcagataatcagatggcattg

SEQ ID NO: 98955 - DNA, 626 bp, Oryza sativa
atttatctactattaaaactgctcttgtagtaaaaatagagctgcgcggttggaaacttcagttatggtaaatcgaagacggcaactgtttagatttctaccacgaaacatgtcatacgcttggcaaaaatgtatagcaattgtttcgtaatctatctatctatcttctatctatctatcttctatctatctatctatcttctatctatctatctatcttctatctatctatctatcttctattatatactaaaggtccattaaacttcctataaacgctctcaagccgccacgtggcacttctacaaacgctcctaggccgccacgtgacaatgtctaatctcaccgtcgattttcacttaaatcggtggacccaattatttggaccattagattagattagatgtatttgatttaaaaagaaactaataccttactattcaccggaaaaagaaaacaaattaaactgattttagtcctcccccgtaccccacgcggacatatgcatccatccctgtatatacgtatgtacaggtaacgtactaacgtacatacgtaagaatagaaaacgatgaatcttaccttacattagatgtattttatttaaaaagaaactcataccttac

SEQ ID NO: 98956 - DNA, 626 bp, Oryza sativa
tttcaatgtttgtctgaaagcctccctgtatgataacacacacgattaagactgtgagttgtattagtagtcattagtagccacggggtttcttattgcaaacaggccccacaggtgccctgcaaagcatagtaattcttcaatagttaaatattgccccaagacagtgacaaggggtgggaaaggctgaggctcaaaaacatttgaataatggcagtaccatacttgtatgatattgctatctaaaagcatgatcaatatgagcacgcatcaaaacaaataagaagttgatggcaatggatatagatatctgaatcaaggataatcatgcacattttaaattatgataaactagcatcacatcccatgagttgtgatggatcgaaataaatatacacaaattttgagtttaaacaagtaatcattatctaatctaaataattgtatacatataataatgcaagatcaaccgataactaatatatgcatatgcaacagtgaaagaatgcaatattttacacaaaaaaaatcctataaacagcacatgtgtagatggtctattctaaacccattaatgaaaaatctgatcatgcatagaaccagaaccaattcctctttttaaatag

SEQ ID NO: 98957 - DNA, 574 bp, Oryza sativa
cagttgcattctcgattaggtaatagtcctagcctcccatgttacaaactaataaattgtgcagatgaatcgatctgctatagttttacttttaagttcaatgtctaaacttgttctgaaaaatagtcatccgacataagatgctagcatcagttttatgtaccagcagcagagcagggaattcataattgaagaaatcagccattagtagacatactaaaaaattgcagatataagtaactgtaagcatgcatgatgcatcacaaaagtgtaactaaaaggatcttgtaataaagtctacaggagaaaatcatcgaacagaatgtttgatcagaaagcaatagcaattagcaaccatgtttggttccttagcctaccttgcctagcaaggttagcagttggttggttagattttgggcacatttttcgcgaatacacataagctttgtgtatcattgtattaagattttgggcacagtgagcaacaaattccttgatttatctatcatatcctaggaagactttctctttcaagctttacctagccaaactcccatcatttagtacttcagca

SEQ ID NO: 98958 - DNA, 561 bp, Oryza sativa
aaattcctttattgagagtgccctcaccatttgacagcacttgctgctgttgttcagtcaattcatcaccttgcttcagtaatgggtatggtttgatcatcaacctagctttttagcaagtattcaaaagtactaatgcacactgacctgcacccatgcacctaaaaaaaagacagattcagcaaaccaagaaaagatagctagcatgggctgcgtagttgggctatatgtatgaacatataaatgcaaaagaatatcctctgaaaaaaatcaatcgtgaacacatctcagtgtaatataacgaactcaaaatcagcgaaatgatcgtatcctagtttttttttgacaagttcagaagagatccagctcccaagttgacccatgaaagcctgcaaaggcaaaacgaaactatcttttgacctcatgacaccgactgtcgtaaaattcttcacgacagacatgatggtcattgagacttgcttccattccaagggccttttttccatcacccgaacgccaaaggcaatgccgttgtctgccggctatctcaagttcaattgc

SEQ ID NO: 98959 - DNA, 919 bp, Oryza sativa
aggcaagaaaacactgttccggccggactgacgaggaacccatatcgatccgctcgccgcggcccatggaaacccaacaggagatggcggcgctaccttccgccgccggcgactactaatggggggtgatgctcgagcacattgacgaactcgaggtcgacgacaaggactccaactacaactcctgctccaccgctgccgacgacaccgccaatcccgtgagtccatgacgacctcgctcacctccgacggccacgtcgtaagagtctacttccgcctcaaagcgcccccagcgacgtcacacctatgcccctggcagtcactcttctccatttccgccgccatcgtcatcgccggccgcatcccctagcacaagagagagatgaaaagaggagagaaagagagagaggaagcagaagaggaggggtgagttagactgacatgtggggtccgcgtgggtcccaccattattattaattattttttttgtgtgtgaaactgacatgtgggtcccacggggtttattattttccggatcgaattgccacgtaagggccacatcagtgccacgtcagatcaaaaccgagtcaaaattagccacgtaggtgccacgtcagccaaaaccgccattgaaaccgccgagggacctaatatgcaccggttttgatagttaagggaccaattgtatctggttttgtggttgaaggacgaaaatcggattcgttgacaagttaaggaaccttagatgaacttattcccaagaacaatcggtacgatccacggcccagaaaccaccgcatcgcaccggaccagcccaaccatttcgtcgagcacctcacgcacgcgctcccctccaagccctaaacccattccccaccaccatgcgagccatcggcgccgccgccgccgccgcgaggcg

SEQ ID NO: 98960 - DNA, 553 bp, Oryza sativa
ggataatgttctctttaatccataccaagagaacaagttcacaaatactacactaatacattacactggatacatagatttgagcctccatgatgagaatcaaaactccacaaatataattgcatacatagatttgacgcttcgtcataagaacaaagataggtccacctactaaactggataataagaatttaagacaagtcacaaataaactagtagtgcgccatagttttgaaggtggtagctgcagtgaatgaatccaaaactgtctctaactacatagaatgttgatgattttccattgttgattccaatctctgaaccaatcaacactaccgagtgataatgtgcatctagcattggaggataatatatttcgccatcattcagaaatgtaaacaaagatgtaaaggggatattaccaattaaaggaaacccattggccataaaccgagttatcaagtaaatatccctgacattaactttaagaaacatagaatccgcgtacatggtaaacgagattgttgttggtattttaacgtcagggggatcc

SEQ ID NO: 98961 - DNA, 567 bp, Oryza sativa
ttcttgttgaggtgcctgcatcatggccaccgacggttgcgtatccatccacacacagctgaatgttgagatggcctagctcaagcagggtcacggcccggctgacctccaagcagtgaccttgccgatggaggaggagaccagtgtccaatcgatgacaaaaacaagaagagaaattgatccagatcacaattcaattttcagcaatatttcactgtcaccagtgttttgcaatttctgtaagagagggaacagtctaacaatatcaatatattttacaccagatgctatattgacatctgaatccatgacaatagcacaaaacgactgttcgcagccagttaacacaaaacgccgcacctcaaattatgtataagacttgaatggagaaatcaaaacaaaatcttttgcattcagttaacagcaaagaagaaaaagagaaccataagccatcgattcatcctaattgatcatcctcgacccaatcaaacatcgtgtgctaatgacctgaagagaaacaccctaaatgcgctgcatgccgtcagcgcgagccccgccgttgtgacg

SEQ ID NO: 98962 - DNA, 654 bp, Oryza sativa
tcaagatggaatcctggaagagctctgagagagcctaacaggacaaccgcccatatgctggtagagtacatcatcattcgtatggaagaatatttcactgcgctaacagtatcaggggtgtgtgatatctatttctgaaatgaaactccgtatagaccaccataaagaaaatcacacattaccagactcaggtagatttaaaataacatacgggattccaaagacatgtttgaggactacagaaatccctattctggtgaatcctcctgatataactagacactgctacgtgctcaactcctgtaaaatccttgaaaaggatacataaacgctgaactatatatcatgtggttttcgaaacgatgaattcatcaaccaatacatacaaaacagtggacagatgcacgccaaaccacacagatgaacttgaggcgtacaagaccagcaacactgagcttgagagttgaggcgcgctacaaaccaatggaatcagagccttaaccaatgggacacgaaatgccatcttccaatctccattcaatgtaccaaacccaaaagtctgagcggttaccgaaagctcacgagttgtcgaattcgttaccctagaaaaaaccgcacgcgcatccgtacgcaagctaagcacgagcatacacg

SEQ ID NO: 98963 - DNA, 681 bp, Oryza sativa
tgcgagcagcaaggtcgatgccgctgacgaatcaaatgtataatgtatatataagagaaacgactagtgatgtcttggcggcgcaagccactgaaggtgaaaaagacagatggtgctaaggtatctcaccatcgctcaagcatagaaaagagaactagtgaacaggagggggagggagggaggaggccggtctagtagagaacacacataacttttacttagggatagcgtctaaaggcatcaaactaggtttagactgagtttgacagcgtcggttgggagcctgtggttgtggttggtagcaagtgcgcactgttcatgtactgttcatagaaatcgtgggcctcccaaacggcgtcgtgcgcggctttacttccgtccaacatctacagtatgtcaaaagcacgtgagcaatccgaacggattaccaacctcaccatcccgctcccaacgggcgctgtcgaactcagatttattccatactagcttgtagaaaggaaagtacactagtacagtactattgtacagaatatacccttgaaatacattgatattctttattttcgcagacaaagatgtaagtgcttttttttcataccatcaataatagctaggcaagtcagggtgtgtttagttctttggatgtaaaagttttgaagtatacggacatatatgtgaagt

SEQ ID NO: 98964 - DNA, 671 bp, Oryza sativa
agtctgtttctacccagccatgatcaatcattcacgaagtcagaagctcagagcacaacaagtaaacctcaaaatccagctaagggggtacagagaaatacaggattcacgtcgaattttccaaaatgtaaaatctggatgcttactagacgaccaaaatgccgtcttgtccctgcacaacggtaaactttaccttggcaggcaaagaattttaccactgctcctactaatccaagactagactggtacttttttttttgccgggacggccaaaggatggccggccaatttcattaagataggagaaaagactacactggtactgcccctataattagccactcaatagcatcaagctttttgaacagcctatcaatcatgttcccaatcatgaattgaaacagaggtagtactatcctattattcataaacaggtattactattaggacgaaattaacatatattttgttcactgagccaaacactaccaccgaaaataacatttttttttgctgaaaaatatgaaatatagatttcatagaaggtgatctctttaattacctcaaggtagatatccaatgccctgtacacgccgtcgtagcattcccgagccgagtccggcaggctctcggcgacggcgaggaacttggacaccctcaggccatggtcc

SEQ ID NO: 98965 - DNA, 623 bp, Oryza sativa
cctaatgtaataatatgattgaaaatctccatttagtcagcaataatgctcgggagtaaaattatttacacgatatgaaccatgtcagttatgttccaaaaacaccgtaatctactataaaatccataccatgcagtaaagtactattattatttttattagatacaaaatacattcgaaaaaaattgtagagcagcaagcaatagaaaacgtgatccttagcacgccaacgagggatgtaactctacgtcatatcgtagttctatttggctattctttcattgcttactaaacattaaacattatccatgcccatttggagatcaacaagcaacatatattcttacatagtactaaataattgtatttgcacagtcaatcatgccatgtaaaagccaacaagatggtaaaatcacccaaatccacatcacatacttcataggatcaaacatatatcgcatacaactcttttaatgatgtttatatagtctggtagtgcagccggaaaagtttactttgcatatgaaatttatgtcaccaagtaataaataggcatgtattcaaacaacgttgtattaaaatacaagtgtgtttgaggatacaataatacacatctccatcat

SEQ ID NO: 98966 - DNA, 597 bp, Oryza sativa
aatttaaggatgaaaattcaaattttagctgataagcataagcataagcaaaaagatgagaccctttatatgtatacgtataaagtttatgtttatacgtgtaagtgtatttttttatctttgtactccctccgtttcagattataagacattttgactttaatcaaagtcaaaacgctttataacttgaaatggtggaggtagtatccaacaaaattatatgtataaactttttcatatgtgtatacactatttagacataaaaaatttgcacgcatatatacaaagtttgtatgtatacgcacgtatatacgaaaaaaaatattctgttggcccataaaatacagacggatcgagcccaatacaatattgaagcacaccatctaagaaatctgaagtagtggtagtgaaataaagacctaacaaataggggtggaaaaaaagctcggattcgtgagctcagctcgggcttggctcgagcttggatggcttggctcggctcgtaagccaaacgagctaagcccaagtatgcttttcagctcgttgctgaaatgagccgagcccaagctggctcacgagccgtttgttttggctcgc

SEQ ID NO: 98967 - DNA, 709 bp, Oryza sativa
aaccgaaaacgttcttggggattaaggataaatagatcggtgtgaatcctatttcacaataactaaacgattccataaaaggacatgtgatatgaacatcccaaagtctaaagcggataaatcacctaatgctacctaattaaacagggaaacatgtacctaaaatcatactaggggtacgatgattacagtgatcactacttgaggtttagtgtattgtatggtgaacaaagaaataattacattaaccatattaaggtcattacatatgtgaataggcatggataaataaaacatggataacgcgggaatttaaataaagcgacaatgcactaatgtaaattaacataatactataaactgggattcaatatgttcaaagatgatgtgacttgccttgctcgctttcccaaacgtaagatggaacttccacgaagagcggatctttctaagctgcatcatgtacacaaccaacggaaaagaaaaggcttttactctgataaactccgtataacaagcagaatctaagcacagaaatgggttcttgacttcttaaggaataattagagacttggacggtccgcttcccaaatcaaatggccaagttatggccatctgaaaggtatatgctctttaaatgaatattcgcaaatcttttctttaaatatgaatgtaaaatggaattattccgccagccggagggagaggg

SEQ ID NO: 98968 - DNA, 592 bp, Oryza sativa
cccgagatgatgagctcaactgacccaccgcagattttagagcccagcgctcatttgaaacaaaacaatttggcttatgcttataagctaattttgaattttgaaaaagagttgattgtaagggtttttcatcgtaatttattttcgagcctttgctttagattgctaagaacatgtatataaaagttttgtttataaattatttttcgtttataaatataccgtttcgcttattccattaataagcgaaactatggcctccttttacaacatcttcctcaaaattagttcaattcttacaaagaattataaattcctttcatttagaaggaagcctcaactgacttatcaggagccaaacataaaaattgaaaaatctgactatttgagccattgtgatagactcgcataatcccacatgtcatcctcacgagtgtaaatacaatcaaattggcaacatataaagtgtcaaatcatcaaattttatgatatatatatggagcccagcactcatttggaacgaagaattttataacacttctcacagagctagttcagttcttacagagatcttatatgcaattcctcaatt

SEQ ID NO: 98969 - DNA, 537 bp, Oryza sativa
tttgcatatctgcttcatcctaggctaatcgatccatgctacggtaacaatccaatgacctttataggttgctctagctccaacttgttcatccgtagggtgagagtcccgagggagtcagtgatattatttattgcataagcatggtgcttaggctagataaatgtcattggatgtgggtgtgctctagtgaaaaatgaggtaggcagcaggtggtgacagccctatccgtcctttgtattccttcacgttcgggtatgacgtaagagtgcgtaaataccataaccatgctagcagggagtggtctcttgataatacctaggtgcctaggttgtaagcatgtatatgttaagtttattctagacaagattagaatagaagtatagatgattcgtagtttccttaggctattttctactggatattcttatagaggtgaatctcgtgtatgtctactacctcatcaattactccctttgtcccacaaaaaaccaacctagtactggatgagaaatttcctagtaaaacgaatctgga

SEQ ID NO: 98970 - DNA, 704 bp, Oryza sativa
ccagctttgttatgtttttcccataagtgtccaaattaaaaggtagtagtggttagtacttgatagtcaagggtgacttatgcaagttaaatcttaaccaacccatcaaagttaaagtggtttgagtgataaaaggtggaatattcttaattacacttcagggtgatgctgtcacccaaaacttcaaaaaatggtgaactttcatataccggagagtctatcaagcatgatgcataggtgtgttttatagcagccgtggtgaaaactcccaaaccttaaaacaatggtgcatttcttatatttaaagcactgtcaagtatctagagaaagcctctgcgaaaacttcatcttcattattaaaaaaaaagaagcacaaggccaattaatattctgagttacgtgtgcatcagccaatttaccaaaaatactgctatacatacgataaaatttcttatggtcagagcgtatgatacttattctcttgtgtgtgcggcaaatatggggctcgggatgtttcaacccaatcgacaatcatggaaggtagtgtcgtactcccaccaggatgataatacttgtcgttttagacaagagtgaggtcaaactttagaatctttaattatgaatcattttaaagtattcatctttcaaatacagtgactatatatatatagtcactgtatttgaaagatgaatattttaaaatg

SEQ ID NO: 98971 - DNA, 1062 bp, Oryza sativa
gtgtttgtgagagattggggctaggggtatagcgcccccacacatataaagagtgagatgtgttcacgcggatgtgtgatatagagttatatgagaggtgttgtggtgaggggtaggggtgtgtatcattttcatatctaggggtatagtctcaccatgtgaattttgtgaaaaatgagagagattgtgtgtttgagaccccggggcgccccatgggggtgtgatataatatacacatatatgtgtatatatgtgtgtgtatatatatatgtgtatatgtgtgtgtatgtatgtgtgcgtgtgtgcgtgtgtgtgcgtgtgtgtatacacacatatatatacatatatatatacacacaacacacacacacacacacacacacacatatatatatatatatatatatatatatatatatatatatatatatatatatatatatatatataggaaaatgcagatttgcactcgggttcacatgtacctacaatctacaccgttgatgtgttccaagattcgtgctgcaaaatgtacctaaccataaccaaatgaatgcttactataggagaaaatattaggattaggttggttcacaatatgtataacatatatgttgcattttttatcaaataggttttttcaataataatcatatatgacatttatatatctagtgcattgtatttctctaacccttatgttgtttataacatgatatttagtcaaaatgagaaaacaatatatctaccatatcaccaaattgtcatcttgcaaaaatgatacttccaaaatgatatatatcctaccatcaaaaactacataaacaaggtaatttatataagcaaggtaaactacataaacaagttttgcatacaagaaatacaaaaattacataaacaaggtattttacacttgtaaaaaatatatatagaataaacatcatgcatgttacattttgttagcaccaaatatacttgccctaagattcgtgcaagctatatatagggtgtagatcgtgggtacatgtgaactcgcatgcaaaaaatctacaaactgtacca

SEQ ID NO: 98972 - DNA, 1190 bp, Oryza sativa
tgctatatacctagaaccaaaatctaacaaaaacaagtccaaattcagttcaaacttggtttgaactcgttagtaaagtagttaatgttaatacctaaacatttaaaaaagtttcatactcatttgaattgggtatatactcaatttcaatcatggtacccgggcaccatggagcaccaaacaaatttactttactatatatattttacccctaccatgagctccacatataaaccttttagaggtagaataataaaagatgcaacactatgccctgagtgaccgagagtatcatttgatgaactttgttttaattgtaaaaatttttgaaaaccagcagaatgaaagttagagagtgattggtgctcaatgatccattctgttccgcaactacccaaggcaaggagaagctacaagccccatgaggactaaggtaataaatgtaaaactattattgccaacttattcaaattctaagtagaaggatatgttgtagacatagtactattgtgaaataaaatattggtagcaactcctgatcaacattctaaattttatctttacttgggggtgttgttgacggtcgctaagtaccaattttgaccaccaacttgcataaataaagggaaaattagcatttcttacacgtatatcaataataaaataatgtagttgtattatgattggagaattaacttagatgcaggaattatagactaaagtgaaggagaaatgaggccggcaagcaaagaaacacatctccggcgaatcacgtgcaagtttatggattgagtggcccacaagtcagctaaaaccgactcaaagtggggccaaccaccctggaactgccttaggggcgcacaagacagtcactggagaaaggtggttgcgaggaggtgggaccaagggttcggttcggccgaaccgccatcagctccactcatcctggccctccacgttgtgctcccacattggcctcctaatggcagttatggagggtcggttgcgataaccgtcatacaaatcgtcattaggtggttataaatggagttctactcctcacttcacaatacacactcaacgagcaattccctcttccactttgtattatctgtagtttctagtaggaataaagcttaggagattcggtattatagtcttctcggagttcttggcatgtctctcttact

SEQ ID NO: 98973 - DNA, 543 bp, Oryza sativa
tgggcgttacatttgcactgtgtttttttaaaaaagaattcaaaagttcaaatagacagttgaattaattatacttgaatattgcgtgtgtccactagcttgtacacctaaacattttcatacttcggcgccgtagaccgtaggatacgtatagtactctcgttgacgaataatcacactcataaatataaatgcacctatacttttgactttgaaccaagaagcttaattttcaacgaaattattcatttattattttgccccgaaacaaggggcaggccggctaatttggagagtacaatcagaaatccattaaactggagaaaattacaaacaaaagctgagaccacgcatcaccaaacacgcatttacaaacttaatcccatgactatagtcgtagatatcaaataaaacacacgtaatttaccacgggtaattaaaatttttaactggatactctaaaagaaatttgttccggatacttttcgtttagagatttgttccggtccaaataaaaagtatcacatggtactgatacctcac

SEQ ID NO: 98974 - DNA, 582 bp, Oryza sativa
tcggcaccgccagctgtcggtcgttccggttgtgctctggtagcagctttctcgaacgcgttactgagattggctacagattcccatagtcgttccgtccatcgtgcgagatcatcattaagcacaggtcatagggagcttctctcagtattgcgttgacggtgccgagatgttgggctggcgtggccgtctgattctccgcctctgcgttagcctgtgcagacgtgctagtcccaccaatggcaaacatgtcacgtggtgtactggaagatgacgagccatagtcttcgagcaagtgtaggactgatggttcacggggattgatgtcgattactccaatgaatcgatctgaggttatcgtcgctccttgttccttgtttgtatcctcgagagaggttcctgactgctggaccttaggaggtgtcgtcttcatggcgcggaaaaagaccttgcagcttgagaagtcgtgattcttcgtcttgtgaataggacaatagacatcacgagttggagaagtacgctggattccacgctctttgcaagcacggatttcagcttgtacattgagaaaaacccagcaag

SEQ ID NO: 98975 - DNA, 1390 bp, Oryza sativa
cactaacaatttattcaaataattcgtgtcaaaaaaaatattcaaattattttacaggttcaattagtagtaatttttattggggttgttggatcagccatcatgtgataagttggggtaccaaggatgtaggagtatcaatcaatacattacactgtcattactcttaaaaatatgggaatgattggttcatggttagtactatttttcgccttataatacgagatctctcatgagagtgttgtgtagtactctctcaagtaacgaaactatgttgtttcagacattttagaacatacttactccgtactcataaagtaagtcgtttaagataatgtttaagtcaaaccttgggaatataaatcatgaataactcttaagttgttgagtttgaaaatgtaaaaattatatgaatagatttgtcttgaaaaatattttcacaaaagtatacatatatcatttttcaataaatacttttatagaaacaagaagtcaaaattgtattttggagaccgtgtcgctgtccaaaacgacttcctttacgagtacggagggagtacttcaattcaaactttaaaaagtttgaacaacaatatatttataattatttagaatggatgaataaaaatcgtatgagtaaatttcttggaaacctactttcatattgctaccattttatcatgttatgaaaagtagcggtcaaagttgtactattttagtattttacaaccgttctgatgcccaaaaataacatgcatgttttttttaaattccgtttcatggaggtaagtcccataaatacagaatgactatacgaatcatcgtatcgatagatggatcccaaggtgttaggaaaatgagcaaagacattttattgactgaatcatttttttttttgtcaattcaaagttcaatctttgtaacttaatttcttgtaccaataatattttgaaatgttttactatatattttatcttttgtttatagtctccacgtctcttctaaattgtgcatcgatcatgcatataaagtctaaatttgcataagttaaccgcaaagtttaatttactttgcattttatttgctttgcatatgtgtgtgtacttttatgcttctctctaacccacctcataaaaagaattgccattgatgatagagattcaccaaattagaattgtttgaaggaaggtagaaggtacctaaaaccaacccactttgttattacaatgtgatccccacacctgggccacctctgttgttctgttattaatttgttgtgacaatgccaatgttcaatgggatcagtatctataatcctagcttaatttccgtgaagcatctaacacaagtctccttcggtagatatccatacgtggctacgtataatgaa

SEQ ID NO: 98976 - DNA, 585 bp, Oryza sativa
cgtcgatcacctcgtatccccccaccgataggttcggccccgccgtcttctcgctcccggcgttgtccagcaagatcgacgcgtcgcacccctgcacgcaaaaccacacacacaaaaagaagaaaaccgaccggtcagccaggcgccattgacacgcggccacaaacagctgcgctttgcagggtttgaaaaaaaatcgcgggagcaagggggccaaggccggtggtgtggcatggcccatgcatggcatgcatgggcgccgtacagggcgcggcagctttgataagcttagctgtcgcgcgcgatgcatcggctcagcgccgcatgtgagctgcacggcaacgcaacgcacgggccgcacggggaaaaaaaatggggggaaaaatacgacaagattcggcgtgctccccccctgtactaggcacgcagtatttttcccgtttgtctcgttgctttggcgcgtcgcgaccgcctcgcccctcgcctcgcgctgccgcgaaccggggaaaaggtgccgtaatgcttacgtatatgtgtacaggcacaggcgaaaagcaagataatatcttctcggctggtcctccc

SEQ ID NO: 98977 - DNA, 591 bp, Oryza sativa
tctccctttcggacataagatgttatttggggcagcatttggagattgggggtctagccttctctgagctctgaagtaggcaagaaacaaacatgaattaaactagtgatacatgcaaaccaaatatgttctgtttttgagtgatataagatggaaagttgtgtgttcgttaatgtgctccaaaataacatagcaatattcttttactactccaaaagagagttacatgcctattgattacggattctctactagtaccaataagatcaaagttaatgattttgtcggaactaatatccagtgatagttcttttcaacataggttacatatgtagtaatatgtttcttcataagttgaggagccatggaaataataattgagaggtgtatggacatatggttagtatggttagaggggtaaaggtaaaggctaaattgctttgattagcagctgggatttgtcttttagcgcctgatttgtgttgcatttcaatatgggtgcccatattaggctaatacatgtaaatctcatgtggttgacttcaacattgttctggtgaggcccttttagggtaactgggtgctgaggtc

SEQ ID NO: 98978 - DNA, 560 bp, Oryza sativa
caacgagagtacatacactcggtagtttatagaatagtggtgtgcaaaagattgtccccgatagaaattgcactgtagtttatattaactgaatgaaaataaattttctgctttgtcatcatcatcaacgatgcaagtgcatgcacggttacctttagcattagcggcccataataatgcaacttctctcttttaagtttttatttttcaagaggacatcctcttatttattgcacgcaacctaaatagtatagttattaagaatttagaaaaaaaaagttttgatgaagcaaattagtatgaaacatatcactccacaaatataaaagtccgaattcaactttcacaagttgtaataaaaacgtcaaatataattgtgaattcacgttaactaatttcaacttaatttgtacttttttcttataacttataaaagtcgaattgatcttgcatgtttgtgtcgtgatatattttatattaatatatcttaattatcattttttttattttttaataattatttacgtgatatgtaagaaaggccagaatgttccatcaaa

SEQ ID NO: 98979 - DNA, 1237 bp, Oryza sativa
ccctccgtatgctagctgactttaatttttgaaggacccaacatgattcatgacagctgacttagtattaacgagaagaaaactgtataacttgccctgttgtgcatgctaaatgtgcagaggcgtgttagctgataaaaaaaatgactctgaaactatctaatgttcgctgataaatacatgtgctggctgctgttggacacaataatcatcagaactgtgctatgatcagtgatgttttctttacagaaactacagttttcagtcaagtatgtatgtactaattaagtttcatatgtccttaccacctcagagaattcagaaacatagcaggagggttctgacagatgttcaggactatgactatggaggacccaaccctagacatgaaccacgtaagaagcctggaaatggacactaatcgcctcttctccacactgaaaccttgacaaagataagtcagatactcagatgatcccaaatgctacaatcaccagaccactatcttactgtaatgtactagaattaagcagaactgttaggtactattgtgtcgttaattaccttgtaatatgttggtcaggtgcatggagttcaggtcattttagacagtacctgcgtgtattcaggtgtgtgcttatataactagcaactggtaaaatacaactactgaggacattttgtaagttgagacttcagatatgtgagctatcttgtttgcaaatcttcggttgtgttttgaataaaacgagcattttggctccgtataaagtttgaatgttcagagtactcgtcaagttgagagcgttgctcgtaaaattcagttaagctgtatgtattaccctccacagccagcgaagatgtaagaatatcagtagcaaaaaatctgaaacacatcttctctcttaacaaatgtgcccttcttatatctgataaaaaaacaagataatatttcacgtgtaacagacatccttagctgctgaattcagaaccgagcagtcatactcatctgcagtagttcagcagcagcagatcctctcgtcctcttctgaaacacaaaacagacaagcttctctcgttactccaccctacaccatccatttatttcttcattcacctcgtcattaggaagccatgcaatcctaactagtttagaccaattcatacatccaaagaaaacgctccaatatatataatatattcaggaagcatcttagtacttgcgacaaactctgaa

SEQ ID NO: 98980 - DNA, 522 bp, Oryza sativa
cctgttatacacatactgtgtcttagagtccgtgctatagccgactacaaatttgtagcccgttgctcttctctcttcttatttatctccctaaaatatgtttgcagctggtttatagcctgttattgtacctgctctaatcctcctgagtggttgggaatttgggtttgtttggtttagtgtggtatattttgaagggtagtattttaagtgggtgtgtttagattatcaaaatttatgttatggtggagaaaattttagaatggtgccaaattaaccataggcattaccattcacttggctctaaactaaaccattacatttactactccatccgtcccattttaaatgcaaccattagtttctgtgcccatctttgatcgtcctgtcttatttgaattttttttataattagtatttttgttgttataagatgataaaacatgaataatattttatgcgtgacttatgttctatttttttaaaaaaaaatttcaaataagacggacgatcaaagttggg

SEQ ID NO: 98981 - DNA, 1573 bp, Oryza sativa
tctcataaagaaccaacttagtactatatgtgatacattctactactataaatctggatgtatatctgtctagatttatcatactagaaatatgtcatatccaattctaaattcgttttttatggaacggagagagtactcttcgagtcttgataactcagccaacacagttgacggtgaacacacctggagaggagaaagcagaggtgtgcactgtatctgtgtatcaatcaggccgagaccgacgctttgtcctctcatatagacactgatcgacgtctcgagattgactctcgactttgccccgacatgcagtagagcgttgggcagtgacgtggcttaatctctggccgtccgtgtaccgatcgatggccacggatcggatagaatatgccggaacacatgtcgtcaggttggttggcatggatagaagatagattgtgtcacgtcgcggtaggcaaaattttcgcttctcgagtggtccagtggacgttgccacctgcgtgtgtggcacgcggctgagtggacggtttgtacaaggcgatttctacagttctactggctatggggcctatggccaattgaccatgagcagctggttggtgcccagttcaccggagccgccaatccaaacggcttgatgcgtcgcaactgtggagctttgcatgggtggagtcaaatgtggagggtggttgttgaattcgttactactactactggtgcatgacaagttaaatcgggagagaaaaagaccttacaaaagaaaatgtgagaaaaggtgagagacgtagccaaatacctgatgaactgtgacgtctgaatatatccgagtattctgcccgtttgacgtgtcataaatcttatataattattagtatatcccagtattctgttcacttgatagaatgatagcttacaaagacacaagtatttactatttgtgctgactagtcactcagtatgcaaaaatctgcaggtttggtagagacaacacatttaactttggacagcaactaatcctagcatcagattaatgctgagaatgagagctcagtttcatccatcttgggagtcatggcctcatgggtcacctgcatgggccaccgtgcccaagatcctaaacttgctcccaaatttatgagtagtttttttttccgaggtcagagaggcataatcacaattcacaaagatctcaatcccaaacgaaagagacgcccgacccacctctcctgttaacatcactgctcacttatctcatctcacctcttgatttgaagcagacaatgcatgatcctcagtcacaagataattctgttaaggcaaaaatcttgcaactatttcacagtttaattcattaacaccacatatataagaaatctcttgattgatttagcattgctaagtagtataattaacagggagcttagtgagcttgctgtgaaattgcaaggctcttgttgttcttggcgagtgtggctagctactgcttgctgctgccgcggttgagcatctccttgtagttgagcagcgagttgagcctctgaagctgcagttgctgcctgaatttgttgat

SEQ ID NO: 98982 - DNA, 596 bp, Oryza sativa
ttgtgaaacgataaccctctctttccatagagatccaacaagtagggggcttatgccccttagcctctgcgctggatccgccactggtgcagcaccaccttaggtggatgatggggaaggggatcagcaatgtacacgacacgaggcaagaaggaggggttccgttgaggctagtggtttaacaaattacttatacgccattcataatttctccccactacaacaaaaacattatataaagacacttttgtagaggcattttgcaaattgcctctaagatcatgagtttatagcgtagagacactttatagagacactttcaaaattatctagaaaatttttactctagagacactttagaaatattttcaacacattttattagattatatcttgtagaggcattctttcggcactttaaaatgtgtctaacatgtaaagacgtttgcttgagacactttaaactctgtagagacacttcttacaataaaaatatattaaatgactaaatataagtaacttagggcataaacatatacaatgaatgacatggggttgagttggttagtgccttgaaaataaaaatgatttgttca

SEQ ID NO: 98983 - DNA, 922 bp, Oryza sativa
tgcacaccgacaatccatgggttcaccctgatatgggataataagaagtggtgtcttaccatctattactgatgagaagaaaatttatgagaggaccgttctcacattggcatgataccgttctggtatgccgctaataacaacaattaatatgtaatttaggctcatagctcgatatatatatggatcggaattaattaatgtaccacacgtaactagaaaagtcagctaaaatcaaagatgacacgagaaactaacgtacacatgctaccttaccactcacgccatagctaaaggagtactacagtgtaaggccaaaatatgccgcatacgcttacacttccatcgccggctagctgagacaacggtgcaatgcagtgattaccggccggtactgcgtcaattcaagccaacacacgaccaaacatttccatgtaggagtataaatttaagtctcgtacatctgattaattgacggtcgttattctagctagcagctggctctcaaatctcatcggttcaattaattcgtctacagtatactaactactcgttgatcatgcatactctctccatacttgtaaaggaagtcgtttaggacagcgacacgatctccaaaacacaactttgacttcttatttctataaaaatatttattaaaaaaattatatatgtatacttttatgaaagtacttttcaagacaaatctatacatataatttttacatttttaaactcaagaacttgaaagttattcatgatttatatttttaaggtttgacttaaacattgtcctaaacgactttctttatgactatggagtagtatatatctactcgatcagagtctgcatgcatgtacctactatataggagtatatgttagcggctagtctctctaaaaagatgacagagtgttagat

SEQ ID NO: 98984 - DNA, 701 bp, Oryza sativa
  unsure (1)..(701): unsure at all n locations
tgctcatcagaggagcactctgcatgcttctatcaaataggttcagctgatcttattatttgcaatttcaggtctttttcttccagcagttgtcagaccaatgttggattcttgggagacagcaaaacaagttcctccacctgcgctgaatgatgtatgtgattcctctctgttttttagtacatcagaatgatctgcaaccatatcttagtttctgaccacatcatttatcatgtccttattttgtcatgttcataatgtgccacccaagatatgtgcaagcactagacagtcttatgaaaattatgaagtaaacttattctttgggcgttgttattattntggggcaattgcaaatttaccactactttgaatcgttattgcaaaactgccactagaaaattgcaaaaatgccattagaactgtcattcgagtggcatccttgcaatattaaaaaaaccagtggtaaatttgcaattgccccttacttattatttcaagtaggctgtaaaattccaggattgagcactctgaatattcgactggcaacctagactgaattgcacaggacctttaaaagattgtgccatgttaccgattcctttgttgacgactttgccatgcttcacctggttatctccagattcacattattgaagtactggaatatcaaccccgctccattgagaacaccagtattt

SEQ ID NO: 98985 - DNA, 936 bp, Oryza sativa
gggagatgatgaagtcgatcgttgcggatcagtctcatggaaccaagaacgtcctctgcaatggtttgcacgaggtaaagttaaaaagtgtataccatgagttgacacttcttattgcatccattatccgtcattctacctgtggtggtggcccttttcatacaaaatgggttactgggattcccgcagactgagatcccgttgaagtgctgccatgccagtatacatggtatggttgttactagtgaaagaataattttcagttaaaacactgtaaaattatcctaacttaatttgttggatatccttgtctccttggtgttggtggtgtgaggcatctctacgagcatgttcaatcttgttggtcaaaaggggtcatttctggcaatgagtgaaaaatgatgagataataaacaaagttcacacttaaactaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttatcttccacggggaggctaggggtacggtgccaatgtcattggcgccctcatgttggaccataacaccaatgacgttagccccacaagaaaggtccattcccggaataaattctactggggtctatccgtcaagtaagttttcaaaaaggaccaaaaaggaattacaggcttataatcgttgataaccactca

SEQ ID NO: 98986 - DNA, 730 bp, Oryza sativa
tagcatttcttagagtagcgattagcaacatgcttttaatctacaatttgcacttaggcttccatcccaaatgtatgcactgttttattgaagcacctattgaagaatatcattaaaagatgggaaatcgatgataaatgttggttatagcgatttactttcttgagaaaattaggtatatacaaaatatcttccctctttagataccattgtaattgaaacagttaggttcactttaataacttcacaaatctcctccaagtaccttcccttgcctcctatcactcctcctaacgcataaaccaaccccttccccataaagagcaggctgacataatccccaagcaccttgacccaccctcccttcccacctgcttctctgctgagagcacacgccactgttgtccccaaggaagttctatcacaagcaaacaccttcctgttgatagagtgccagcactgcttggtcattttagcattctagggatatatgtggtattactaggaattagatgcaagcattacaacttcactaagcttgcacctcacttgtagagttcacacgatcaccgttacagcgcagtcatccagaaggacaccatgaggtgtgtatcgtggtagcacgtccagatttcgtctgataggtgctctctcaaatggtatcggcagtgttgtatttgtagatagtgtcatgcctcggcaaataggttccccattaaggccttgtttg

SEQ ID NO: 98987 - DNA, 1313 bp, Oryza sativa
tttctagctctcgttttctcagggacacttttctagctcttgaaaagcatcaaatgataaaaacatccacatgagaacattatcctgcttctggcaccttaaatgagtggctcaagcgaatctaagcactcagttgcttttgtcagataatctaggtgtaggtgacgtcttgcataatttctaatcggagtatttgagatgcatttgtctgattctagttttgatccactgaactcagttaaaaatgttattagtgagctgaagccttcgtttacaatatgagaagcagaagcatcaggtaaagaaaattcagtacgtacttgctactgtacggttttgcatttacagacataaaccaaacacacgctcaaaagtccaccttcaactaccaaacagtgcagtactgttctatgtgctaagaacacagaattatttggccggcatccatcttcatgctgtcaaaatgcatccatcttcatgctgtcaggactgagagtaactctgttactaggaacagaatcatttctgcattgaaaacactagctgataaagagccgcatagatatccagggttggcattgctaaatgctctcctcttttgcgaattatttggccggcaagtttgaacacgatctgtccttgtgcaaatggcaaattctgaacaaaaacgttcagctttctgactcctgaatcttcaaaggaagcagctcaccatcatcgcaggtgccgtgcttcagaagggtgctggaggatgattaatgccacgcgtaacaggaaagaaagaaagaagaaaaagacgaagaaatgccattcattattaatccaaattacagaaaaggccaaacaagtttcagagaattcagaaaacaaaaaagttgattcacaccagctgaggagcaacttgggtagcttcaggtttcagctctccttcgtcagaaagaaaaaatgagtttcagtttcaagcagcacaggcataacgcctgccaaattctgcactagcacatgaggttccaaaaaaaaaaaactatacaaaaagtggaggaaaaggatattgcagagcaatttttttcccagataacacaacatttagcacgtcgttgcatatgaaaaagaaaatctgatatcgtccgaatagattaattacaagaaataagattatcaagctctgcagatgatactccacggacacattcactgttcacatgaaaaatacttaatagttcatagttgcttgcacgtcatagttttctagtgctaatcacctacttgacatgaaacaatttacaagataagcaaagaaactatatgaaaaa

SEQ ID NO: 98988 - DNA, 773 bp, Oryza sativa
  unsure (1)..(773): unsure at all n locations
cagcaccatgcctggagagccttcacatccatattaccccttgggatgacgagcattgtgatgaaatcatttggaaaccatccactttgcagcatgaaaagctgaaagagctggttgtagttggcttcgagggaacagagagacaggtttactttgttaactttgtgatggaagtatcaacggcattgcagcttgttgctctgtttagatatgggcgtgttgaagaaatggggcgttgggactggaaaatcgtgaggctccaacaccattggagtgatgaggagagatcccagattctgaaccagtttgcccatagagattcttgctccacaacttcagttcaagtagttctagagtgatctcttatattaatgtgttacctgtatacaaggctttaagttatactgcatgcattttgatcttacggagtcactgtttgtcttatgtttatgcgcattcataccgcttattagcaactaaactggtaaaacttttttataccgttttagcctagttttccctaagtaactgttcactgtattgtttgttctcttttcctcattaaaatgagacaccttcttctatatatanaacgtcgataacagcctgaccattaaaaaaaagacatttttatatatgttattagcgattcaaaagcaaatgttgtaaaataaaatatgatgaagaaaacccaaaagcaacttaaaaaattagttctaaaatttaaattttgacttttaagtataagcgaaaatatattgctcttaatttat

SEQ ID NO: 98989 - DNA, 689 bp, Oryza sativa
cctcttttttcaggggccgcgtctttacttagtcgctagctggcgtatgtattctctccctttcccacccccagtgcttggttgtaaattgatttttttatagcttctaatacaaatgacatgcaaagtttttacgtgttcgaaaaaaaaaactactatgtacaaacctgagtggaatcactatgccttcctgttcaattctggttgttccgatggtttttaatcacataatgaccatttcccgtctatttatttttttggttgctttaactgtctattactgaattgcctggcagactgcacatcttcttataatccatgatactgcatttcttctgtgaatgcgcaaaaatcttacgcatcgatatattagcaaggaaaaaaaagattttacaactatgatctttggggggttacagggaaaagggagggcacagtggactaactcggaaagataaccggactcctgaaaataacaagagaaatggagaaaagagtttgtgtcacatggtactgcatttcttacatgtgatgtgagaactcacgagaactgtattgttatttattctatttttttgttaccgcttgagtgtcaaataattatttggttctgataaacaatgttggaaaaaaaatgtacattgcgaagttgtggttactggcatttcatacagtgattgagaagtgtc

SEQ ID NO: 98990 - DNA, 816 bp, Oryza sativa
aacaaagagcagccgaacatacccatagttagtacatgcagtttattaataaaatttagaatgaaatttaaattctagaagttgttatttttaagacatgaaatactctataaagaataaaaacatcttaaggaagaatgtctatatatggagataaagtaaagtagcaatttaaactaaaattatataagtactaggtaggtagggttgtgaaagaaaccatatatcttgaccgattatcgcccctacacatgtgactcgaattttctgataagaatcaagctactcgtatactccttgaaggaagcataaaacattttgtatgcccacactagcagcctactacactagtgattaaaaaacaacgagcttgttctaagcaaatttcccattggttcattctatcaaaatcccttacaaacaatgcttttaactgtgattctttaaactcagttagaagttactggaaaaccaagatgaaatcacagtgctctaattatttgtatcttacagatagatgacagagcttgggcttctcgctcttggagagggggaggagttgggggtagcccacaatatcaggcccatctactgtgagatgggctggatatcgcactattaggcccatcaatgaaatcttgccaggtttcacccatgggccttccacattttctattatttatttttttaggcctaatccttcttccctaccgcctcgccgtcgccgctcgccaccggcgccggagccggccgctggatccgccaaaccaccggcgccagagcctcggcggcctcgcttcctatctttcctcctcc

SEQ ID NO: 98991 - DNA, 1263 bp, Oryza sativa
ttaacagcctttttttgcaatgcatgcatgcaacgcaagcaagcaaagaaaacacaaagtaaaattggaatcatgatagttctgatgattgattactatagctaccacccctacacatctctgaattggaatcacgccacatatgatgtgagaaaattggacaggaattgatcagacacaattgggacatgtacatatccatgctttgtgtcccttttgacatgatcatctcttcctgggtgttgttgctgtcgaccatgcatctgggcttgaaatgtgccaatgtgccattggaattggaatcgaaatctttgatcttttgccggctgcagggcactgtagcatcttgcatttgcacgcctttagctcgcttttttttgtgtgtgtgggttagctaattgagcttagctaggggaataacaagatgagaaacggaatgcatatgttggtgttggtgtatcggtaccaccacgctttgggctgcccaatgccaaaagacattccctttgggcctgacccccatgtgtggcagtgtacccctgtcccctctctccattctggagtactacacctcgtttgctgccaaagcttgctaccttgagaacaccaccactgtgcactgaccaaagctgctgctgcagcagcattcttcaattctattcctgtgtgctaatggcagtatgcccctccatctctttgtctctgaagaagtctgaaccttttctttcttttaaaccaaccgcaccaaacgagacaaatacgaggttttatatattgctatagtagaaaaaatataaaattataatcctaataggctaaatcataaaagaaaaaaaaacacaacaccacgaactgatgtcttctatacgtcagcttgagaaaagaatcgacaccaaaccaaccatcgctatgtgtgaccgatcaccaacatctctacaaccgtgtataggtgcactttgaagtctgaactttgaaatgtatgaggagtattattgttcatgcttctctctatctatctctgaagaagaagaagtctgaactttcacctgcagtttttgtggtgacatgaggtgagagttcgatgcaagtttccatggtttgatcactcgcatgcatcatgcactgccggcaccgcgtttttctgtgcgtaacaaactcgtggcgtcatggcgaaattaaaggccggcgaagaaattgaagggggctgttttgactggaacgatcgaatcagaattcagagagctgaattttgggcgtggctag

SEQ ID NO: 98992 - DNA, 713 bp, Oryza sativa
  unsure (1)..(713): unsure at all n locations
ccgtgggctgagcccnccctnnnnnnnnnnnnnnnnnnnnnnnnnnnnnnnnnnnnnnnnnatcgagatcatctaccgtgtccttggcgtagacgcttgaaccctccacgacgccctcaaaataatagcttgggttcttcatcttcaatcggctgtatatcagaatcggacacttttagaaaatctccaacccaaatcttcctggataaacaatcaaggccatccatctcccaaagagctagatcggcactagcaacattaactgacctgtcggctgtatatcagaatcggacacttttagaaaatctccaacccaaatcttcctggataaacaatcaaggccatccatctcccaaagagctagatcggcactagcaacattaactgacctgtcggctggtacaatctcaaccttgtcgccttgccattgaatcaagcattggtgcatggtcgaaggaatacaacaattggcatgaatccaatcccttccaagcaacaagctgtaagaacctttcccatcgatgacaaaaatgtggtagggatagttttacttcttcctccttcctctctttttcgactcgctcacccctcaacgagcttgaggccgncatggctcactcttttgactcctccctcaccgagcttgagtcgggcatagagatctcgccatgctcgagagaaagagggaggtggcnngtgccatgacnagttga

SEQ ID NO: 98993 - DNA, 601 bp, Oryza sativa
  unsure (1)..(601): unsure at all n locations
gttttattccaagtgacagctctactcatcatctgaacacacatagcctctgctgcgccgtagtggcatggaaaaaacacatcacaatagtacatgcatgatatttatgtgattttctttcaagaaggatgaatacatattatatatatacactagttttatttagctggttttggctggtaccctagaggtggaagaatacaaattatccatgatagaagaaaataattgggatattgaagggaagcaaaatagatttcttgttcacctgatttgcacttgtttgaagagatgaagagacaataactaactagtacacctcgcagacaaggttatcataagattaactctactaatgagtcctgactggctcaaaagtcgactctacggcacctgatttcagtacctacttaatcaaacatttcggagggatattgattatcttgctcatgcccgttatgttagagcattgaggttccaaatcaaggaacatatctttatgtaatggtagatgtgtaatagggtcgataagcttataagctgagatctcccnngctgtgnngggtgagtgaaatcattcaggttcaccnncgcgcgggcc

SEQ ID NO: 98994 - DNA, 664 bp, Oryza sativa
  unsure (1)..(664): unsure at all n locations
tgatggcccnattgttgacactccgttagcatgcacgcgacgcgaggctatgctgacggagccaagcttatcgattacccaccccgctgggtctttcaccccttagctagaaaaagaatgactaactggtgcgcatgacacaaagtgttggttatgaaatatggatgaccataaaatcatgataaagtaagatccataagattggatttgaaaggcttgaacaagcgactggatccatactagaaaagctttagagaggagctaatgaaaatgttaaattacgatcaagtccctttgaaagacataaccaaaggtgcaattcattggttggagccaggaaatgggtacgctatatcctcgaagtttttatatcaccgaaaccacatccaatttgatatggtacttgacttttaaattaatttaaggtgttctccatcagagtacgatattaagcattggctttacaacagcttaagagtaaaagtgcagaaatcttatctattattctaagcattcggccatgtgtctgaaagagcttaaacaaattaacaagcgtagtccatccaccctagtatgttctagatgaattttttttgttgacttggttgagtcccatattaaactattttttagatgaatatgttttttgactaggttgactagg

SEQ ID NO: 98995 - DNA, 817 bp, Oryza sativa
  unsure (1)..(817): unsure at all n locations
agtgccattgttggatattcggcctgccacnnnnnnnnnnnnnnnnnnnnnnnnnnnnnnnnnnnntatcaacaagccctctgccgttatcacgagaagcgcatccgagcactcatactttcgatcggcgactatgtcctccgacgaggtcttcccccaaaagttcactttcgcggtgtcctgagctaaatacacacagttacaatgtcctgtagcaaaatttgcctaaaatatatggcaagttcagtgaggtcaaaaacctcacttcaagttagagccgattttttttagagtgaaatacatggccagtctttaaacttgaggggtggtatcnntttngntctttaactttaaaatttccttatttttattcttaaactttgttcttatgatgcaatctaatgttcttaggaacaatgctcctggtcgagttgctgcaagaatgtacgcccaaccacaacttgagcgctcaggcccatacttatataccctccctcataacttgatatgtcgactgcacatctcaaacccaaatcctgcaaataatcgtaaaatctgtccgattttcaggacttacaaccgcgtcagaagccttggaaatttatcgtgggttgccaaagtacattaacacaaaaaaaataattgttttaactctttggtcccaatgggacttaaaaagaaaacttttttttggggacatttctcaagcccttttacctctcgatggccacggacttcttgttttatcttgtgttaaacgcgtgtctggattgtccataacatataccctgtggaaaacttagatatctcccgtgct

SEQ ID NO: 98996 - DNA, 737 bp, Oryza sativa
  unsure (1)..(737): unsure at all n locations
cgcgttataaattctaagcatgctttcacgcctcggaggttttcggaatccaggttattgattttcaaccccgttggacccatgcctggaggattggatattaacgaaaaaattacttaataccccatttgggggtaaattgccaaacgaaattttaagcctaatcgctcctgatctggcaatgtggggctacaggtaacaattgctaatgacagaataaataagcttaataaatttgtctcacaagttacaggcggattatgtaaatttgttttggntattaagtctaacgtttaaataccttcaaaatggtgtgggtcagcaatattcccgatggtggaacacgcccaaaacctttaccacccctgggatctaaacgcagccatagtgacaatatactgatgtaattttctggtttcaaaaaagaaatactgatgtaatttctatttggactatgtattagtcaatattatatattccaaattgtacttttgggctaaccatatactcccttcattcanaatgcaggatgtcattgactttttacacgatgtttgaccattcgtcttattttaaaaaatatataaatttaatttattttgttaccactttgtttatcatcaaataaaatataatattaacctatagttntacatattcatactgaatttttaatgagacanatgatcaaactttgtgcgaaaagtcaacggcgtcatatattctaaatggaggtg

SEQ ID NO: 98997 - DNA, 540 bp, Oryza sativa
  unsure (1)..(540): unsure at all n locations
tgtcaattaggcctagaggggggtgaatacgctaattcaanaatcaattaaaagcggaagcagtaattttcggatatttccaaaattttcggatatatccgaaaattttcggagtcagcacaaatagcagagtaaatcctagatctagctgcctacaacaagaatatgctagcacaaacagcaactagacctatagcggctcgaacaagcaaagctagtggagagggagaaagtaaagtcaccaaagatgaagctcacgaggttgttcccgaagttcgaatccttaaggggattctactctccgttgaggagctcactaagagccgggtcttagctaatcctttcctcaagaggttgcactaagcactcctccttccactaagggtatctcttccctttcggaggtgagatccgaccttcacaaacttctcctggccaaccacaagtagatcagtggctcgggagcgacacctagccgcctaggagtcctcaacctccaagagtaacaaatgaagcaaagaactcccggagatgatgcaa

SEQ ID NO: 98998 - DNA, 696 bp, Oryza sativa
  unsure (1)..(696): unsure at all n locations
agtatgaaactagacatacngctnnnnnnnnnnnnnnnnnnnnnnnnnnnnnnnnnnnnnnnnnnattctcgctcgacaaccaaaaccatgcttaccacctgcgatgttgctgacacatataatagcaatggttcttgcggatgtgatgaagctaggaccccaccaccaagaaaaaatatcacttttatttttatcttgccgtaatttaggtttgttttgatatgctgcttgattggaatcaaattttcacctcttgctgctgctgctgctgtggaggggaagtaggaggactatttggtggctagattatgggaggaggggagggggtggtcttaatcaatgaacagtgagcagggctaccattaaaatttagctcctttaattaatccgtaggcacctgctgatggcgacctgctgatcgattactgatctttactgatgctcagtgtgctatgttctttaccggctccacatgattggagtgtgcctgtgtctggagaaaaaaaaggaggaacagagtatatatggttcgtgccagcatttatgcaataatgtggggacagttaggaggaggattgacccgattttgctttcgcaatatgaggccgcccttattgataagggaatctttccttatgaagataagtgcccttaatgttgagggcgcatgaattaaaggctcaataagaaacaaa

SEQ ID NO: 98999 - DNA, 960 bp, Oryza sativa
gtataagtaacttcataatttatgatgtggattaggtttagagaattagggatgttagttagatttagagattgatttggggatttgcctacttgattcgggagaaaataaaaaggaaaaaagaaaaagaaaaagggaccatctgtatattgactctttagtccaaccgggactagagatcccctcatctttagtcgactagagatgtcccggattcttactcccgattggaaaaccgggattaaagggttcccaaccaggagtaaaaaagatggtttctccaccagtgaataccattttcattatttgttacatttgcaaaacatttttcatctaaatatttatttaaccgaccttttgcccttgtgaatatcttgattggagaaagagatattatccatttcctacacagattttctttctaaacagataactaatgtttgcaatacaaggtggaacaagattggcttcgagtgctaataatgaggaattatttctgattatattgccatggaccaaacaaaacgaaaaccatatgtggaacacacttttggtttcctctaatatcataaatcgtaggaatgcttagagaaagaatggcaaacaattcagccaatagagtaactagccactacgtaaccatttatatccatttatatcggggaattacttgtgcatatagctccttagtttatgccatgctctcatgcatagggtaacgtgctttcacacaatatttactattcatatattttgtatgacaggagaatatattggtgcaattttgagagaagtattctcggaccacttcacttttatttatcaagaaaatggtacggcctgctttaacttgttaaatactagatatattggacgaaccaatggctgccatatcttcgctaaaaaatttgaaacatatactattttgaaattttacaatacacagtcccttttgttgtg

SEQ ID NO: 99000 - DNA, 507 bp, Oryza sativa
tcgtcgtccccatggatcaactgccgacaagccctatggcccctcccttctctcgagacacacagtgtcgaccgatacattgacaccctcgcgccaaagagaccggatccacaccatctggtctttctcagcgccacgatcactggtagaaaaagcattttttttacgtggaggtcttattttcgctggcggacatgacgcttagagccaaataaccacctacaaaaatataaatcggcgcctgcgaaaattagtgtggtatatatatgtggcacatgcagctgaaatttttctaagtcttcttctcttccctcactctccccgccggcggaaggggcaaacggtgtggggcggccagcgggctccccctcccttcccttcagatctggccggagggggcaggggggaggccggcagccggcatcgaaacgcggaccggcagccaagcgcgggacggtgaccgcgtgtgctcccggcggcggcggcgggcggtggcggctgaaggcg

SEQ ID NO: 99001 - DNA, 650 bp, Oryza sativa
tttttttttaatttgtgatgattcactgagatgtatttgactgagaagttacaaatttgtgattcattgtttggatctgtgatttatttgtgtaatttcttaggatattgtgatgtatttgatttgtgtgtataagtaactttataatttatgatgtggatttggtattgtgaatttgggatgttagttagatttagagattgatttggggatttgcctacttgattcgggagaaaataaaaaggaaaaaagaaaaagaaaaagggaccatctgtatattgtctctttagtccaaccgggactagagatcccctcatctttagtcgactagagatgtcccggattcttactcccgattggaaaaccgggattaaagggttcccaaccaggagtaaaaaagatggtttctccaccagtgaataccattttcattatttgttacatttgcaaaacatttttcatctaaatatttatttaaccgaccttttgcccttgtgaatatcttgattggagaaagagatattatccatttcctacacagattttctttctaaacagataactaatgtttgcaatacaaggtggaacaagattggcttcgagtgctaataatgaggaattatttctgattatattgccatggaccaaac

SEQ ID NO: 99002 - DNA, 623 bp, Oryza sativa
tcctgcagcccagacagagtcaagagcgacgggggcttttgcttggcctcgagggcagttgagccgagacggaatgcggagcagagggaagtactgaaaatctgacgttctgatcctctcacaaaatttattttataattaaaccgtgtttaaaactatagtcaaaactgaacctcgagcttagcaccgagttatatgcttgaatataaaaaaaacaagcatatcagagaatagtgaacggtaggaacattaaaaaaaccaaaacttttagcagaaataaaagtttgcgcgcaggcggctgggctggcacggtgacggcgcaaggcaccggcgcgtgcacgtcggcctgggcagggcgcctggcggccggcggctggggtggggagggttggccggttgggatgggaaggggaggtgaggagaagaaatagggttagaaatgtgggcttttatttgctattgggtcaatggacctaaaatggtgggtggtgggagggttcagtttgggcttcttttaagttttgaatgggtataggtatttttcttttttcctatatatacatatatggaatatatacttcatatatgtattttttgttcaaaaatcttgggtattcatttga

SEQ ID NO: 99003 - DNA, 674 bp, Oryza sativa
agagagaagggggtagtaattgatcattaattaatatttcatggcttgtcaacccttggaaggtaaccacttaaccttaatcatccagaaaatggagaaaatggagagaggttattaggatagcatcttgtgttggacactgtttgcaactgttttgagtccatttctgctaatgccatttatgatcagacatgtgcaagacaagagtgtgcaactagtgttaatagctcaagaacccaaggagcagaagcaagctgaagagtgaagaggaggacagccaagaaagcagcagaggcaagcaagcaagcaggtggtgtgcctgccatggcggccgccgcgctgctagctagctgatggttagttgccgccgccgccgctgcagaggtcgaggagcttcttcctcccctcggcgacctcgtcgaataggtcgtcgatcagggcgatgacgtcctcgcacccggacctcagcgcgtcggcgcgcagggcgacctccgccgccgccgccgcgacgtcgccggccctgtccacggcgtccctggcctgctccaccgccgccctggcgcgccggaactcgtgcatcatcgcgcctccccctgcgtcgacgacggagggcgacaccgccgccgccgccgccgcggcgcgctgctgcgcgcgggcgagcgccgacgcgaacg

SEQ ID NO: 99004 - DNA, 626 bp, Oryza sativa
atgacgtgatttcataggaagaattcttgttgtccacctccttcgacatgaaaatttgatgacatcaattattaaaatttgtattcatcaaatattatgtcacgtggattgctgtaccagtgctttaaaatgggttgaatatgagagggaaagaaacaccatgctcctgtttattttatttggactatattatacagccctccctatatcctaaaatatatccacactaatattttagggtgaattattatattttagaatgaaggaattacttttactcaaaaaaagttgagtgattttctcttaaaaaggacttctaatagtagatagtatttctttcggatgagtgaatattattctgcagcgcgtaacgtttctctcgaaagaacccgtcagatctcacacggtcacgcacacgactcgcacccgttcgcttctcttctccccgctccgctagtcatcaaccaccggggtccgacgaaacaaaacaccacgccatcttcacgatctccgtctcccatccccgcctcgccgcgccgcgccctcctcctcctcctcctcccaccccgccgagcactcacccgccgcctcggtttcgtgcgcctctgcagcggcaggcccggggc

SEQ ID NO: 99005 - DNA, 604 bp, Oryza sativa
cgagctcggtaccccatgttgatgtgatgaaaaagcactgaagtttggattcaaactttagatctaaacacagcctaccgagagggaatggaaggaaaaaaagaccaagccaggaaagacttccgctgctctccaagactcggcacgctagctagctcttcgttccccctcgtttgctctgtacgaggcagcagctgaggtgagcgtcacatgccgctgaactcttctttttctcggtcatatggactcatgatgcggaagaccaacacgcgccgcacaaaaacagaagcgacgacgcatcacgcatactcctatagcctaggaaaacatggtccctttgttgttaggcctaacatgggtgctagtagtaagattttacgggagacggcgtgttttagcatgggtgcagcaactgtgcaagtcctaatcaccagtttgtgcttgtgcactcgactttttttgctgatgaccacgtctacgagagtccgggctatagctgtaatcagggagcgaaacggggaaagtgaaaggaaaaggggggcgaaaagagattcgccccacgcgcaggcaggcagcagctgcattgttgctgttggttgggaaa

SEQ ID NO: 99006 - DNA, 646 bp, Oryza sativa
catgtacagcctcgagaggaggctggtgccccgccatctcgtggtgaaacttctcaaggagaggggtctgatcgagcaagaccggtgcttcttcaacgcggtggcgccaactgaagagaagttcttggagaagtttgttgtcccctttgaggggtgcgtcccgggtctcgccgacgcctacgagtctgcctgtgccgggaagacgccggtgcaagctgagtagtgaccggacttgggggagaacaatggaggtgtgtatgtgtgtgtgtctcacttccattggataacttcattctactgatcaactatagcagggatggcagattcaattcatggtcattttagtgtaggtttcttgcagttgacaaggaggtggatgtgtataacaaccttgagaactgttcagttgtggttgaacaatgttcagtgggttttcatataaaatctgtgagcattacgtctcctatggtactcattttctttggtacaggcttacactctagctggcttctggcatgatcagcgatcacgatgtcctgatgtgcatcttccaattccaagttgaacgagagaaagtgaagaaccatctgagccaagatatactagataaattgcggactagggaagaacactctacataaggaga

SEQ ID NO: 99007 - DNA, 522 bp, Oryza sativa
aatgaaggttgcaatgtaagataattgacagggactttattaggagtaaccggtgaaacatattgaccgttcctcccttggcatgaaaggccatcaactgtacttggatcatatgtacatgatataccagagccagatacctggtgaaatattacgtctcctctctccagatatagggatattttaagacggagggcattggaagaattatcatcatctctactatcatattaaatataaacattattttattctggattgtgggcgacatatatgacatggtttagccacccgacaatacttcaatacccctatccatgtttgaatgtgaaacaaactatcaactctcaactaattatatatcgactcatttgagaatagcttacagtaatacgagccagtattctagattacgatagcattactactggcacactcatgatgatggagcactctctggatcaactagtcacattctaggaagattactgttgccattgccagtgtcaattgacagacaca

SEQ ID NO: 99008 - DNA, 522 bp, Oryza sativa
ctggccttgtcatctactcatacaagccttccttcttcatctgccattgcttctgaacatgcacataagatacatacttcattcataccaaaataaatcaatttctgaccacaaacctacacataaggaattgatttattttgtgacggagggagtagcaaccagctgtgacgatgtcactactcaccactgagaactcttgcaagcaggggctccaaggaggcggagagtcggagacgatgatgaaccagcctccaataaggaggtctcgtcgttggttgctactacctcaaggtagtagtaggtaggattctgtctgctgcatctgcacacaattgtgctgtaactgaaaatgttttactatgtacagtgtgatagctggttcataggggcaaggtttggtgtgaactgtgatgatgtgtgatatttttactgtcagataagcaagatagggttaagaactagcataggtttactgcataatttaaaagtatacgtgaatcatgtctgattttactattg

SEQ ID NO: 99009 - DNA, 587 bp, Oryza sativa
aatgggctcgtgcgctgcccgctttgctgaaaatctcaagcttttttccggaattttaaacccttgggttaaaaggttggatagaattttttttgttttttggtttttaatatgcttgagggtgttgtgtcagcgtagaacgtgtacaggggaattacacgactgtttcatactaggactgatgaagtaacaatattggttgctgtaatgatcttatttatgctttcttctacggtgctgggtgtgtacaagaattgaagaagcgacttcgttttgaagaacaagaatggttatcactctttgttctcaacatcgtctcagcctctaacgttttcaattatgcatttttctgcagcgtattgcatgacttcgtccattacttgctctgcgccgaactgaaccatgagtatgagtccggatggcagcaaccctggtacagtagtactgtgaatctatgttactctatccgtcccaaaataagtgcagttttacactattcatcttcaacatttgaccgttcgtcttttatgaaaaaaattttatgattactatttttattgttattagatgataaaatatgaatagta

SEQ ID NO: 99010 - DNA, 601 bp, Oryza sativa
attagtttcatcaaatcactaattgaatatattttcataataaatttttcttggtttgaaaatattactatttttctataaacttggtcaaacttaaagcagtttgactttgactaaagtcaaaacgtattataacctgaaacgggagtagatagtagtcatttaaacaattttttgtgtcctgcaataaatagcttaaccaagcattaaaataaaacggtgcaaaagaagattccaatggtttttaaaggaattgtttgttaggtaagaactaggatgtggatctttagtttggcatataccgactatataaagaagcaattgctgtaaaagaagtgattgcacggtttggtagccaaataaggctgattgtgttgagtgagcatcaaagaggttttagcgtatgaaacaatacacatagagcagcagaggcatgtggcttttacaaagaaatcaaaacagagcagcactgtttatatatgccaagttcatctgtaagtcgccttcctgatgaatgttcacatgccaattactagaagtgggcgttcgggctaccccgaaaattcgatctccgtcttcgggttttcggtcaattctgttt

SEQ ID NO: 99011 - DNA, 671 bp, Oryza sativa
atttgcgccgtccatctgggggcccacccaaaaggcaaggcgacgagggggcggcacacgccactaccacgtggggaccaccacgcgcggtgcctcgagtgggctgtggggactctggtcatttggatggaccgttgctgttaaaaactccaattaaacagacttatggaacagcagcaaccgggaccttcatctctcaaatattcctaaaagaacccaagtggttttctttcctccacaccaatcatctacatctactcattgaatacatgatcactctattacaagctagtagaagtatgaatgcttatgtgcacaccgtcggaagtaaacattgtaagcatatataaccatctaactacgtattcgaatgaacggggataaatcctaaaaccttgaacaacacctaccaaaagctcattgccacttttacacaaccatgttattgcaacttaaagtatagcgagttgtttttttaactctattatctctttttatgaggaactctattatctatgttatgaagtggttttataacccataaacattttttagtagcctatactacagcaagggtaaatatgagttgcagccatagctgagacaaagaccaaacaagagatattactcatagttaacatcatcgttctagtagtaacaaagcttgcatg

SEQ ID NO: 99012 - DNA, 603 bp, Oryza sativa
gcatatacacgaaaagaaaagaatatgaaacccggtaaccacttggatggcctatcatcagctcgatcttgagctttgggaagcaacccaaaaagggcaagactaatgagagacactagtaaacatgacaagtgtttcaaaatggggattgcgcactttaatcctcgtcgtcgtttgggtgatctgaaatgagaggaagcgatgaatcttagcacaaggagaccatgacagccaacctctttgataaaattaagaaagaagctaggacgtacttgggctctggcatgagcaaagtgatttcgggagttcttaccaaacagtgtatatgacttataaggtgcttttccccttttcacatccttaagggttgtattttctcccaatatatatttaatgaaagagcacaatcttatgctaattaattataatctaggaaaagaaagagctaggaaagaggtcacatgttttgttatcctaatgagcaaaaaaacacatccttttgttaaagctagtatgtccatgggcgatcctagatgcatgatacgtacatactcgtagagtcaaggagtagcaatgaactggtggctacagaagaggagattt

SEQ ID NO: 99013 - DNA, 1389 bp, Oryza sativa
ggatcaatggtatataagggaatagccaattttcagtggcatataagggatcagaccaattttcagtagtatataagggattatctctatattttgggatgaaaatagtatccatatatcatccagaaataataataataaatctatttatagtattatcttactgaaagaaagctacgaaagaaagctagctatgtaaaattcgatgaaaaactttccaatataactacacaataaattattgtaattacattgtaataactagcatgtaactagaatataatttatactaacttgcacttatatatcacaaattcccactagcacacaaatagttaccacgacgagaggagaaccatgtgtcccagcttcaattcccgtctagcccacgcgaatcttacctcccctctctcgtcatcacgtatcttgaagtatgtccaatggatgaaaattcaaatgtttaggggagaataactgtcgaattttttttcttttgcaatctaaaatctatacaatttgcgtgataaatctagatcataactctataccaaggtatattaataatatagttgtaaagatattacaatatgtattttatagaattaatccattgtaggctaatgaataaattgtgtcccttccttgttgttggtggctatgcacttcttccatccaaaataaggctattactacactcaagttgtctcgaaatgaaactatctctccacctacccctcatatctttgtttaatttctcattacctactttctcttcccaactaaattacaaccttttcctagtcattttcacctacgtggtacttcttcaattcacataaaaacctccagaaatgcttacagttgtaacaagtagttgtagcttgtattgaagcaaagaccagatttaatccattataaaaaaaaagaactataataattatgttatattttgaactaatgtgattatatttccaaataaattaatttcgctccgaacaaattgcatgggaaacatggtgatgaatagtattatttttgcagaggacgataaatgcatttatctagtataaatatatatatagcggatttggtatatggcatacatacatacatacatacatacatacatacatacatacatacatacatacatacatacatacatacatacatacatacatacatatatatatatatatatatatatatatatatatatatatatatatatatatatatatatatatatatatatatatatatagtgagcataggccaacttggttaaggtttcttgtgtggtgaaacttgtctactcaagtttagtcatagatatgggtggttatatttagggctaattatttgttcaacgataaatgatatacccat

SEQ ID NO: 99014 - DNA, 500 bp, Oryza sativa
ccttcttctcctcatcctcaatctgaatccgccgttattttctctctctaactcatgtaatggtttctgttcgtgtgagcacccaccattgccacgaatcgttagagatgcagcactgctaccattttttatacaactaaaatactaatacaattaattaatggctggttgattgtgacttctggctgtggtaggggaaaaccaccccaatgtgccgtgtctgaatccaatactgtagctttctttgacttggttgggacttgcccttctttcggtgctacctggctgtgaccaattcatacaaaccgttggtgcttgttcactctgctgtctctgttggtcaatgccactggccttcccagattttgcacatgaaccttcttcgttgctccttcattccgtaatgtgtccgtttacctatgcaacaggtggagggcagaaacacctatgcaacaggtggagggcaggaactgtcttcctgcggaggtcaggattggcct

SEQ ID NO: 99015 - DNA, 925 bp, Oryza sativa
ttaactattaaatacagttaatttactttctaatggtatttctctttatttctttatctattaattgtatttggaactgcactgaaatttagtaggatgatatatgcattatccattatgtacaacttaactaatcctacatcttaaacgcttttaaagaatttgttagtactggttaacaaggttgaaaactcctaagattaacttacacattgatattttaaagttcaagcaaaagttaaagaataattttaactttgataatggtgtcacctagataaatcagcttaaaatacgacttatataaagaggaaaaataatattattaaatagtaaaacgaacaattttctaacacttgaaaggtaaattgagaataagatagtttggggttaaataatctaatgagatagtacgagggagctaaatggattcttcttctttcgtcgttgtggtgcacacagcaattgttgtgcgcgtgagtgaccttatacagatgtaggcctgttgtgggagtcgtcagcccaatgggccagcctattcaattaaggggcccaatattattctacagggctcatcagcaccgtccatctcaatattcttctcctcacaagggacgacgtacggtagtcacaaaaagaaaaaaaaagcattttcgcccgttcaaaagcaatgtaaaaaggcgatactgttagtgttgattcttctcatacaattacattcaattaacatatcataattattattaaagagttcttatatttttcttgataattgcagtgattccttgcacaaagcactgacagagatgtgaagtgccctactccaatgcatgcttgaacttttcctctatgcttacgaataaaaccggctatatttgagactttggatatccttgcctagtgatttttcttctatgcttacgaa

SEQ ID NO: 99016 - DNA, 680 bp, Oryza sativa
acattcccctccggcggcgagccctgccctgccctgccgtgccggagtggtagttagctggggcgtgcggcggggagctcggcaatgggcgggcgggcggcggaggaggaaagaggggaacggaacggaggcgtaccgtgcgttgcgcggggactagttgcgttgcccctctctctctctctcctctcgtgtggtgtcgtgtcgtcacaaacacacaaaaaaaaaagggtaggaggaggggtgggttgagacttgagaagatgatgaaacggagtccggttgcggtaggaaggaaggaggaaacaaaagcagccactccatctctctctctctttctctatttatttattatttatattattatatgctcatgttcttttcgctttatttgcttcgctgttctactggcaccggtttttcttttctttttctattattatatttggggtcttgcagtatactaactactactcccaactaggctactacagtagtataatactccactactactctgtttattatttttcactgttattatatattggaggaaaggagaaaaggagtagtattttccttttatttacttatttattactccatgacgggaaagggagaagagagcccgtgacggactccatccgttttgcgtttttgcaacttggctctcctctcctctc

SEQ ID NO: 99017 - DNA, 1967 bp, Oryza sativa
tgcgggagaagctgtcgctgccctctgacttccaagcttcgcctcctcctccctgcgccaaaggtttggccctgccgccgtcatccttgctcgctgcccggttctcctagcggcacactacggcgacggcgagacggagatgaggaggtgaggcgcggcttccctcaattatcacactttttttctatgatgtgtccttttgctaattccttaaaaattttaaaagaatattatttttttatatattataggatggatgaagtagtaatgtcacctgtactaattttcttttttttcccagctatactagtctactgctactccagactccaggcctccgcctttccggccggctgattgcttttgtgtttcctgcaagacaagccatatttcttgttgtttgtgtgtgtggctccctcctctccaggcgccacagaattgtacagtacactttgttgagttggcgtgttgcaggccacggacatggccgtcacgtcgcctcacctcgctagcttcgtactagtgtactgtagcactagtacctacataaaaagccatccatcctttcctgcatggagtaggatcaggcagcaggaaggaacggaggacgtttcagtttggagcagcattcgttttcgtttcctttcctttgtgctttcttgtgatccacagaatactgaacggatatgattctctcactccgatcctagctttgtgggggaggggaggctgcattgcatgcgcgcgtatatgtatgtcgtggtcgatcgtccttccagttccatgtggagtaggaggagtatttatctctgggattcgattcatgtatatatgatgaacagagctcaatcgatatagatcgctagctaagaatcgatccagaatatactggactactccactatagtggtaggtactaaaagtacttgatacatatgcttccattccttttgcttttgcttttctacttgcattgctggccgcctacctaagcttgtggcaccaaataacccagcctcacgctccaaggatattaatttgaccagatcgattcctactacatgtgcttttgccatgcatcaaaccgtataccactggctggggcggatccaggaaaaaaaatagggggctcaattgtacagtttcttcaacctacagccatttaggaacctttagtttattattcatggtagaaaaattaaagagggtgcttcagaggtatccatagatcttgtgggtgtagaagggactcgagtcccccctgcagccacgttggatccgcccctgcactgccacatggaccggtttaattaatgtcatatcttagctgattatgctatatatatatatatatatatatgctctctctaagtagttgtagatcgatcctgatgcatgccagtttaattatttgacattttacactaccaaatattgatatatatacgtcgttactttttaaaaatgatgaagtgatcgaacaagcctaaacagaaaaaggcacatctaccattccataatctatccacgtgcgcgcgcgcgcatatatatatatatatatatatatatatatatatatatatatatatatatatatatatatatatatatatattgtttggtgctctatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatgg

SEQ ID NO: 99018 - DNA, 1535 bp, Oryza sativa
  unsure (1)..(1535): unsure at all n locations
cgtacatatcgttgtgagtctatataaacattactgtgctagtgtgtgtattntctnttctctatatagaacatcactgatctgngttatatgtgntttggtcgatcatactgtctacttgtccctatcnntnannnnnnncnnaagggnttttgttgaatggcctaaccntggnacacnagnncatcaatgccaattcacatcaacaagaatcttttattcaccactataagttacaagttatggtactacatgtcctccggcagcaatattccaagctagatgagacaatgaatgcagatatcttatcccttttcgatgcatttttatctctatctattttctcctctttacttgccttgagaatactacagattatggtaaaaatatatcaacgtataggagacacacaatattgtaagctggtcaataagatcctgctatatgcttaaaaagttgtggttactgaggatactacaaacagcataatattgaatacatgtaagtaactgtcagtctaagaattccaaggatataaataactgattaatcatatggctgctattatcatgctttaatgttctatactatttatgaaattcatatattatttagcccaatagcttaaatggaattatctgccatatcaatctagctagcaggaagcacaattaacccatagcttatacttaatctaatcgtattccagcgggctttgcacaaaatatatatccttcactgacacacgaactacatattcttaacaagatggacagggactgaagatacacgcaaaataatgaactagctagagactttaagtgtatacatcgatctaaatatgttgttttttaatcataacaatattagaagaaccaagggaaggccatggcttttttctacaataggaaactatgaagtcacaacctctcagcattcaagcaccttacttaatacagtagacaaaaagcattcgaaagaaaattacagacaaggatcccatcttagcatttcacaatagactggctttggctacaagcaaactggttagtttaaagtaaaatagatgcatcaacctgacattagcgtggatacattgaaacaacgctcacctccaaagatggctagctggctagctcgatcgggtagccggtgggtggtgactgccgaggatgaggggaagggggtggccggcacatgctctccttacagttggttgacctcgaaagcaaacggcagcgcacaaggatagtcaagtggaggaggggggagacactgtccactcacccataaataactcgacgaagttaacctttaactatgtataacttgcctaaaatgataattattggaaccgggtggagtatgtctttgtttgatgagtatggtagtagtgcggtaaaataattataatgatgtagctaactagttttttttggctaatttgatttgcatgggtgcagttccaaaatctatccacgtattacctgtgatgaacgacttgcagtcaaacgcgaatccactgcaatcatcgt

SEQ ID NO: 99019 - DNA, 593 bp, Oryza sativa
ttatactgtttgaccattcatcttatttaaaaaaattaaaaattattatctatttttttacttactttattatctaatgtactttaagcacaacttttttgttttttatatttgtaattttttttaataagacgagtggtcaaacagtgcaatcaaaatgtcaaaatttcttatattatgggactaagggagtagctagcttggtagaaaagaatagctgtagcgatttaggccgaattcttatctccatttaaccaactcacctcactcgttttttacgcgcacgcttttcaaactgctaaatgatacgtttcttgtaaaaattttctatatgaaagttattttaaaaaaatcatattaatccatttttaaaatttattttagctaatacttaattaatcatacgctaaacactgctttgttttacgtgctagggagtgaggccctcactcctgaacacaagattttcttactaattaagtggaaaaattaaattgttattatttggaacgcccgtgtaaatcaccgttcaactttccatcatttaattgagaacatgcaagttatcagcggcttatcagtgctagaaattt

SEQ ID NO: 99020 - DNA, 603 bp, Oryza sativa
ttggtctgcctagtgtttctgtcaagattggtattcccttaagtgttagacatatactttttttaagagagtttatatttgtgatcttcatatactaaattaattgttgattgggataaaacaaaatcatgttaatacttattggttatatacatacagtataaaattatatggttttgtttcataggagttgagttaattccccttaatctcgatgacaaaagaaaaatatgtctcatattttttgatgaaagaaatactagacaacttacgatttacacggtcctcccagcaatatagctctttatgcatgcaagcagaaggagaagatgaaggtatgacatccactacagtctaagcgtgtgggaaccttctctcctagcatgtaaaaagaagcaacaatttaatacatgattaattattagaaacaaaacttgaaaaatagattaacataattttatgaagcaaaaactctgttttatataaaaaaagacaccgtttatcagttcgacaaatatccgtgaagaaaacgagcgatgaaaaagaacaccgaagccaccgatcgaaacagccattttcattagccgctctgcgtacacatac

SEQ ID NO: 99021 - DNA, 509 bp, Oryza sativa
tgacattgatatggaagcttatcaatatcactaaagacaatttcttttcgtaaattaagtaacgtgccaccagagacattaactggaataagaaccagcaaggcgacagtcatgatgggcaaaaatatcttgaggctgccaaagaaacaaaacaaaagggttagtgtgcaaaacatagaaactggttaaataaaatttgatcatttgtctcatggcacaaactcaaaacttttgctcacaggaaagtggggaaagggaaaaagaaaaggtccaaggcgctgcctgaggaactatggctgaaaaatcctcaaacttctagcacaagttagttagttagtttccccccacgtgatggtggagttatatatactttgttctgtacagtactataaataagagaatgacaagagtacaagtatcaaaatatgactagtacatcctgtataggtaaaactttttgagtaaatttcatgcaagttccaaagtggcaagaaaagcatctccagttg

SEQ ID NO: 99022 - DNA, 557 bp, Oryza sativa
cctgccttgagcttgaggacgacgacttgctgcccccccgtgggccatgcctcgtgccagcttccaaagccgccgctgattctggatctccgacgctgctggcgtcaccacttccctcagcattctcctcataataatttcctcctgtgctagtacgctcgtcactcgtagtacgctctcgaggttgctgcagtattgtgggaaggttgcctgaaaatgatcttgtcgcagacccaccggcctcaacccctccacctcggctccttccttcctgctgtcccctaccgtcatccctttcacggtatctctccctagaccggctgcaaaaacacccgtcacatcacacacatggcaagggtaacaaacaggtcaagtgaagtttcatcagaagcagtatgaaaatttatttatggtgagacaatgaggcaaccgcctaccagcataacacacctgttagtattggctgaaaactcccgccttgatgaccgccccaactcaacttgatccaattctcgttgaagctctctctacaaaagcaatcagtatatgacatggca

SEQ ID NO: 99023 - DNA, 891 bp, Oryza sativa
tacattgtttgtgatttcgcatctcgcaaaacacaaaaaagaagggcaaacaacagaaagacggtggtgagacagttgcattttctcgaatctttttataaccatttgaatggcatttgaactttttgaagaaaggatagtgctcagagagacatctttcgtggaaaatgtggagtaggagacgcacgggtatctgagaaaatcaaagcaaggcatctgatacgagagaacaagaaaaacattgggtgaataaacatggagcaaaaacaagaatcatgcagcaaaaaagcaagcaagttgcatccatgacctggataaacagaaaaagaaccaaacttttttcatatgagatgctcactctggataatgacccgtctcggccacaaacaaccaatcacatatcacattcccaggaaatgatgttgatgatacatacatccatccacaatccacggattaataagcagatcgatatgcacatccccagcagtaaggcaagcaaacggaaaaaataagtactgatctacagccataaattccaacacaaatctagcatgaaagaggggttatatactacacaaaaacataaacagcacccaccatgaaacattaggattattctttaaacttctaacatcaaggggcggtgttaaaaaaaaacatcagctgggatggagaatcctagtgtgactgatgtcatcgattgtacaaagcagcttatgcaaattaccatattgaacgacctgaaacttcttacatatgctgcgcacaagaaatactcacagcattgttctgtaataattcgagttcattaaccggtaccaattttgatgcaaagagagctatggacattctccttaccataaccaggccttacaatttaagatggaa

SEQ ID NO: 99024 - DNA, 586 bp, Oryza sativa
attaattttatcactgtctgaacttcagttaggtgtaaatagggatctcatatatttaacgcagttcaccttcatttgctgcatcgtattatagcttaaaaaatgtttgaggtggtacaacacttcttagcgttggataggtatattttcaacacagactaacgtattcagcacctcgtggtgcttctaaggaatataggaatctctgtgttattatcgaacagatcatatacatacaaggtctcatgtataatcatttaaagaatttccaagagcaaagagactaggatgagcttgtcatttgtaaaagtgtaagattaggcaaagtactgtcaagagttaagaggggactcagttggatatagcgtaagaaagaagagcctaaaagagccagattgacctatgaggaatcgtttttgcattgaacaatagagaaacaacattgggttagtacattagtacggtataatcacagttaaggtttcacagcggggaaaataaaccagtaaccccacagaccgacaatatactgatacaagtttggaatgaatgcatttcaaaagaccgtttaattataaaaaaaaat

SEQ ID NO: 99025 - DNA, 835 bp, Oryza sativa
  unsure (1)..(835): unsure at all n locations
ccggaggcggcgaggnagatggcgtgggagcagctgcacgacgactgacgagccgccctccgtgcgttcggcatgggcctcatcatgggtggcgacctcctctgcaccgagctggagtaagccatcccgcgggtggtgtacgaccatagccccggtggcggtgncggtggcgatggcgcgggagagaccgtcgcctccgtgccgcccgcctgctgccgcccaccgcccgcctgctgccgcgcgcaagagagagagaggaagagttagagagagaggaagatgagagagaggaggtgagagagattcggtggccggtgcgatgagatccacgccggcggccgctctccatggcctctagccttgagctccgccgcccacaccccttctgccctctctcactctctcgtataatcagaataggtgcctgactggtagggcccaccatttttattattgttatttccatgttggactgccacatcaatcaaactagtgccacgtgtgcgccacgtcaaaccaaaaccaccccggattgacttaggggggtaatttggccggtttgaaaattttggggtgtaaaataactggttttagagtctaagagggtaattcgaacgacccaaatagttcaggggggtaaaacgtacttttccttaaggaagataaataagtagagagaaggacagtgggctatagatttatagccagctgtagcacggactccaagacgcagtgtgtgtatgataggtgggaccaggtattaatagtgtagtatataactattgtataaatgagctattaaattggctatagataaattggagctagcgattgg

SEQ ID NO: 99026 - DNA, 745 bp, Oryza sativa
tatatgaaagttgttttaaaaaattatattaatcttttttttaaaaaatagttaatacttaattaatcatgcaataatacaagctttgatttgcgtgcccctcctcccgaacacagtcttagtatgaagttcccatataccatgcgtacttaatagaaagcaaagagagagaaaacatggcttgtacttcgtctattattttgttattatttagaggattaatatagtctctaaaacgtataacaatggtagtggtaaatatgattgatacattataggttatcccggtatatatggatcaatagtatggaccctatatataagcatacttatacgatgatataatctacatccattattttttttcatgatttgtcaaatctccaatgccatgcaaagtaccaagatttgtgaactgataaccgatatatagtgatataatttatattgtcatattttccataattttcatatccgtttgcattggattacatgaaaggaataaaaatgctatctaaaatataatttccctttacaagttgaaatatagtaaatatacataataaattattaatttaatggtaaataatataattatgtaaactttgttttaaaatgcggtaaagctaattgagttatgcttgtttgtaaagtgatttaaacaatttgctatatctgatagatgtttgtgttttttagactttctaggattttccctaatttattacagcatagttcatagaag

SEQ ID NO: 99027 - DNA, 509 bp, Oryza sativa
aaggaagatcgggaatcccataatcccgttgccatcaccgcctctctgcctttaccccaaggtcaatcctagagtgtgcaccaccgcggcctctgcctcttctccggtctcctcaggattgtcatgtagttcttcggagtctcaagtcatcgaggcaacaaggattttgcaagtattttttttgtgtttgtgtcatgttttggatcttgcaagttttgatgccaattttctgattgagttgtgttctttttgaagcccactgatttgtgctgctggggtttggagaggcagatggctgattatagaagaagagtcgggtcatttgtttcttgtagaaagagttagtctgaagtaaaatgttttgggttaataaccatagatatattactgttaatacacattttgcttcctgttgcaaccgagcatcattttagtttttatttttttaactgggtttttcacacctgtaattgtgatgggtcacaagttattcttcactcttattcttt

SEQ ID NO: 99028 - DNA, 1814 bp, Oryza sativa
taaaagaagacaggtaaatataataaggtaatactgggaagggtatatcatcttactttacatttgatagaacggacttagagagttcttaatggcccatctgtcacatctcgttatctgtggacttccaaatcagttgcagttgaacaatatgaagaaatgaagtatttgcctgcaccatatgaagtattcgagaccaaagaacaattcagctttagtttacacaagcagagctttaaatcacaacatatagtgcaaaatagagtaaatatgagataataataaggattcaaagagtaacatgagtgcacctcgaccatgcatttcatcaaacagttggtgtgctgcccatgggcacaacaaggaaccaccatgatagctgatctggaagacatcctcatcgtaatggaaggataccatccgcaacatgcagtcgctacagccgctgaaggcctaggtgcaaacatgaggctttcctgcgtggcttcagcgatggtgacatggaattctacatatctatcgaacccaacttttaaaacaatctatgcacttgtgtaatcacttgaacaccatgtggattagtttaatgataacaaaatgaaacacgatatataatcttatgattatacctagctgttaagtttgtattcttattggtccctgaaagataaattttcagctcctgcacttgaatcttgcatcatttatataggtaaaacaaattgacagctgcatttataatttcatttaggatttatcatgtaaattcagggtgaaagtgaaacaatacctcagaggtactgtcattgtgtgcaaggatcaaaaacaaaaatggccaactgataaaattatgaaatttgggatctggggcaatgacttttgttgttgattaagtacccaggatatcaatgatttacatatagattgatcttttcattttgtataatttccaaagcataatcaaacattttatcaaatttttaatttttgatatctattggaattgcattctaacatgtatcaatcaagcaaatttgccacaagtcaaaatcaatggtgcaataaacataccatttgagcgcacagctatttctcttatgcgccgaaccagtctagttatagagaaaacactttcgtctcaagatttccttccagataaagaatagaactgaaatgttgcaatggtacaatttacttgtgtttggggagtcaatcaaccaaagaattttaaaaaggaactgcacaaagctaaaaccttaaaacattattgccatgtcacttatatacaaattgacaactgcgaaagatagaccaatatatttagcttctaactacaagggtaatacagtagaacagtgatataatcacaaatgagaggtagagtaaattcaagtcgatagattgacacaagagaaaaaggcatctgccaatccccactcatgtagagctaaaggaatataccaaactctaccccaaggaaaccagtaacaagcatatcaagtataattataacagacgctttactcaccaacaaatcaattgcaacagagctatgaagttgaaccattgtaactaagaatctaatccaacatacaaagtctgaggttgtcacgctcaaacatcaggaaatgaccctttactacgtttacgcgatagctcgtctgcagaggcaacagagggctcaccaagtcttgacgtgcttgagcgcgaggctgccggcctgccgagccggtccgggtagatgcagacgcggtgccactgcacggagcagcgttcagcgtactggtgcggctcctcgcagtccagcgggcggc

SEQ ID NO: 99029 - DNA, 1558 bp, Oryza sativa
aaatgtatttttctaattttttttatcaggcctacttctgtaaatattttcgccggtacaatatttctgtaaatatttaaaaaataaaaatttaaaaatgaaaaaaaatcgaaaatgttatatacccgtaccataatagcgaaccaaaatagcactcctaaacagggaccggattgcaggagcccattgaatgggccgtacaacatatagtgatttatcagtgggccgttgcccaagcccaactaggcaccgcagatccgacggccactaacgcgcatcatctcaccatccccagcatccacaggggccgtcggggggtcggccgccccggacggcgccgccgcccaccgccgatcgccgttggtagtggtatggtgtggcagcagcggcggagattggcctcgtcctcgcacgccggagtcgccgagttcatcctgccgcggcccgcgggccctcgctcgggtgctcgggtcgggggaatcctctaaaccgtacggcgtcgtgtccgcgagggccgccgtaccagatgctgctcaagtagcccggcgtgcatctcgttagagatctatacgaaggggaggacatgaacagcttccagcagaggctcgcggggaggttcagagatccgaccacaccacattggtcatccctaagaaagcgtggaggcgtcgagctactagattttctgataatggcaattttattaggttcttaatttctccgtgtttcgagttcatacatggaaatgcaaaccatttttttgatgcattgatagggaacaagaagtcgatataatgtcgtcatgctaactcctggaatcaaaaccaaatggtgaaatggagaatcatagtcgtttccatgttcatagtagcatattgtcataactcataaattctgacaagtatttgtgtaggtctatatgttttatgcttcagagctgtggcatgctcattgacttatggatctatggataactattttaggtcagcacctagctgatgcttccagactgtgccgaagaaggtaattcctgtaattgattggcaaattatcaagacatcactgataatgcatccagacaaaatgaaaatcatgaagcatgtcattgaaagaaacattgtggatcatgatcgtagccattttccaattgctgttcaaattaaaggtttcaattaaacttttttttttgaaagatccagcaagagcgctggcattatattataagcaggagaaaaataaatacaaagtttatgtacatagacaaatggccacctcgacgggtgccaataggaaggtctaaattaaactcggatgatagttaagtaggatactaggattgaacctctcctaacatgtcaatgaaagaaacatgaacccaaaaccaattcatgcattctaatttcgaaataacacgtaagcaaatgaggatcaagcttaaaatatatggatacaactttggcagacaatatccatttgctaaggggctgtttggtttccagggacttattccaaatccctgtcacatcggatgtttggacactaatttagagtattaaac

SEQ ID NO: 99030 - DNA, 1006 bp, Oryza sativa
ttgaacggtcaatattggacataaacaatacaaaagtgcacttattatgggatggagggagtaaatcataacaaaataaacaacaatctctgtgtcacactattattcatatttaataatattattactatatttatatagctgcacgatcatctgagtgccaaaggtcaactcggcatatttaatatcggacgacttctgtgatagtggctcaggtgtctggaatggttgtctttccaaggtctggttgcttctagctgatggaatttgcaaaaatgtctaagaaaattaggtcacaatgttgtacagattttgctctagaagtatacgactggactgactgcatggtaattctctatgagcaactcagcatgatggttacgctcgcggctaatcatcattgtggaaaaagaaacgccgaacttaattaatatgcattttctcatctagtatacccgattggaacgtacgatgcgaaaaatagagaaatcgattttgcacgattcaaatcatatagggtagttccgacgtcatttggaattaattagtgggtgaccccaacattaatgtttttctttttaagttcctagccatggcttgtcctttagggcggtcccaacccatgatatccataagcagtgtctatgataccatttcaataagacatcacaacataaactacactttacaacccatgatttcttaaagtgggccattaataaatacatcatctctcttctctaccaataatatttattcttcatctattatgaagacactattctctcccaatgcaaaacttgatagcgttgaagctatgtcatgcatgagacccagtttcttcctctcttcactctttctcttaattaatatagtgtcatataagttaaaagtcctacatagcaatataattaatgtcatacacaccatcctaggtggagggttaggactgcccttaatagtaatgacaaaatatgaaaagctaagactattttttgtgggttat

SEQ ID NO: 99031 - DNA, 711 bp, Oryza sativa
aaaaatgtgatcatgtgacattggtttgaaattgataaatgtgttgagttgtgtgtgtggtgatacattatgacttattgttaagtatggcaataagagattgattatgatggaattatgaagaagttaataatgaaacttaaaacttgtctttgttaattgaagcatcaactcctttacaaaagaattgcgaaacaaaacttgctttatgctgaaattgaactacatatttccttcctttgaatatatgccttacatgtagtatggtaggattgacttgtgcttgctagtacattaacttgtttaatgtactgactcttgctgttgatataaccttttgtttgcaggtttagacttagtctttgagtgatgcgggtttcgattgcttcttctaggatgagaacttaatggggtaaacccttagtcggtgtgcttgtgattgggtagtcaagcttccgctgttctctaataagtctatttggccggtcggcctatctaattattaagttgttgtatgtcttaagtttctttcatcttagttgtgtttgctatgtataatcatgcttaagatgaaagtgttaatctagtgcacatcatcctgggaactagatttacatgagtatgagttaggaatatttgagaggttgtagatctttagtcatttttgtcaagtcttctgaatgtgtaacacatctggtcgccgccttcgag

SEQ ID NO: 99032 - DNA, 651 bp, Oryza sativa
ttcctcctcctcctcgtgatgcgtaatttctatctcgatcacaagtaaagagaagaaaacaaaaaaaaaatcttcaggttgcaaccatgttcaggctacaaaaggcatcttttttttctttcacttccccaagcaaagtggcgatcctttggtttttagatgcggccgaggttccaaagttccaacaggtttgttagttacccttgaccggccatttcaccgtgggagtagctatatttatagcgccatatttttcactaaaaaatagtcggtatgtttttacattgtaagtccttaaattacatatgtaattttagtgtatttacaatgtaagtctcaaaattacatatgtaagttctaaaattacgtatgtaaatcccaaaattacatactaattacatatctaagtggtgtgtaactaccgtgtaaatttgtataaaatatgaaaagtgacatattcgttgcaagaaaactgtcgattaagatatagcaattccgtatataaaaccaaccggaagatcgggtggatacggttgccgcagcgtttgcatgcgaacgaatccaatggacatgaaaaccgactgagattagtgaaaaatctgtcgccatctttatagcaattccgtttcacgatctaccctataattcacc

SEQ ID NO: 99033 - DNA, 1115 bp, Oryza sativa
attcaaggtagggaatgcagcaaataggtcataactaccttaacccaattttaaataccaatatagtttaagttcacatgcaactttgcaaacaaatattttcattcctcaaatcatgggattcaatgcgttcaaaggatgggaggagaaacttgccttgatcagataaatgttagcacctaatccacttcttcaccgattatgcaattatctagataaaggacacgatatgcaattaaataccgaaagagctgaaaatccaaaatgctctaaaatgcatgatttatgcacagtgggttggtactgatctaaaatgactttaggtgaaataattcctattttattttattccatttgggagttatgaattttagaagttttatcggtttatagtagtatagtcttaggtagtgttataaaatacttttgtaaagtgatttttattatattagacttcacaggggtgtggagatgtgttttctaagactaacacatttggtttcacaatttttggagttataatgattttcttatagattttacaagttacaacgtgttttaggcatatagtgttttatatgttcatgacttttgagttataggttcagaacatgctacttcctgtttaagttgaataaaaggaataatttggttaactaaaacatttttatttcacatgtttatggtctttactactatggttcatattttataaactagagatgctctaatctaaactagcaatatattatattaacctagaaattgtcatatgagctaagttcttctaagttttagtggatgaggatggaactatggcttcactggtcaatcaagtttttatttaggtttaattagacctaaagtgtatatatacttatacatgtttatgtattacttaaacaacactatgtgtttaaattcttatttcactaagttaaggttttgatctatgttctctacaaaaggtgccaaattttattttactatgttgaagataactatttgctggttctatggaaactttgttcatttcatttggactaaaaatgaattttctacaagttttacaaattaaaggctgctctatgttagtaaatccttatatgaatatt

SEQ ID NO: 99034 - DNA, 1734 bp, Oryza sativa
aatcaaagccactaactattcagcatattttttttatttttttagagaagggtatttttttacccggcctctacatccaaccggatatatacgaactattcagcataatattactaactaccaagatgttccatcttataatattcagcatggtccaaatttagtagttagctacattgtcatcatatgctcttagggtatataattttacgtctatctgctcatgttcaaaattatttcctgaaaagtatataactaactgttgttacctttggttcatgtacgaaagccagaggggacgttacctggtcatgttcaaaattaatgcctggacagtgctgaagacaagtcctgcgtgtgggcatcatggactgtaataaatgcctgcataaacaaattaattctcagtaggtgatttcgattttttgtcattaacgtgacaaactgaacagatgcttcagttagtagtatgtttctgtaggacacatgaatgtgaagctcgtggagaaaaaaataattgttttaatccaatttctgcacacacatatgttctgcaagcatttcgatcaagttcactcggaagtctagcatttgatgtattttatgcagaagcagatgaaaaatatataacctcaaaaggttgatgatcgatttgactaccactactgttagacttctgtccattcaaatggctgttttcagtaagagcgttgacctggttgcaatctagtactactaattcatgcaaacatcctaaataagcaccaaaatatcaatggttgggttattgacgtgggcatgttggtgtgtttctgttcggtgcatccaccatgcatttatcccatatgtacatataccaggaccacaaaaaaactaatatcctcctgaatagtgcttggcaaatgcaccagaaactgtaattgtagtcttgtaaaatatagtaaggccctatttgttcaggcttataagccaacttataagccgaaaagtctaagcctaaacaaacaagcaacttatttgtttggctttttttaaagccataagccactctaacactattaagccaaaagctagattggagaagcttttttggcttatgtgaggttgatgtatgactccaccactaaacttaggacattaaatctaccggcttataaatcatataagccaataagctgacttaaaagtctaagcctaaacaaagagggcctaacttagctgaggtgaatcgtagatccaaattttactcctagccattcggttagggcagcagagaccttgcagccaccttaacgcattttttgattaaacctaacttttaaggggaccatgcacgctaatatatgtcagtatgagattagtttttttaaatgaaaaatatattctttatgacaaagtaattggagaatattaaggacggcgggatgggcgctcgctcgctgcgtccacgtcggattttgctacagtagctacagtacgcgcggggtggaaattatgtgaaaaagccctccgatttttcgtaataatgtataggtccctagcgtcctgtgtttgaagaggaataatcgcggaaaggggcttttttgtgatatgtggaagaagaggggcttttccgcaaaacagcatccactaacgcataccccccaaagccctagctgccgcctctccctctcccgcccccctcccgcgccgccgccgcctgcgcctaccctcgcgccgccgccgcctccgcct

SEQ ID NO: 99035 - DNA, 2199 bp, Oryza sativa
tttttattttttttaccgcgtcacatataattccttttttttatcggaaagttttttttcgcctttttttaccgcgtcgatggagtcagattcttttcagctttttccttttcttttatcggacaaattttttttttgcccattttttttctcctgtttttttcggatcggactatttttttcttttttcgcccggtcgatttttttaccacgatatatataattcctttttctttggaataggacagttttctttttattttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttttttgctccacgatacatataattcatttttctttggaataggacagttttctttttatttttttaaactctttttaccgcgtcgatgtagtcggattcgtttcggtattttttccttttttttccttttttttgtcggacatatttgttttttttccgcccggttttttttcgccaggtttttttatcggacttttctttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttccctttttaagggatcgggtgtttttttgccagggacgggtgtttttttcgcccggtttttttttcactttttttttggatcggactttttttttcgtccggtttttttgatcggacaaacttggttttttctgcccggttttttttcacccggtttttttgacggacgatggaagcacctcttattttttaagtagtagtagattttattttttaaaatatttaaaaaatattataccggcaaaaatatttaaaaaataaacctgtcgcccaagtggagagtcgcaaggtgacgtggcacacggcgttgtgtgcacgttttgcgctgaggtcccttgccgccttctgtaagggcggcaagggggtgaaatgcattttttgccgcatgcaaaattcgcatgcccgctcagcggcctctagcgcctgctcacacgcatcatcctgccaccctcaggaagggttgcagggtctatttctgtaaatattttcaccggtatagtatttctgtaaatattaaaaaaattaaaaatgaacaaaattcggcgattctgcacggcggtgagagcgctggaggttcctttccaaacgccatggagcgcttccaaagtctcccgatcacgggagaattaacgaacactagtaatatgcccgtgctaacgcaatggtgataattgataatgcaaaaaccaaaaggtaatatttaagattcaggaataaaataacgatagagatatttgtattgttctcatgaatattattatactgttaataacttcccaaagttgaccatgaatagagttctacaatattttaacatttcaaaacacaatgtttagaagtaaaatatagatacaaatatcacctgcaagttctacaggtgctattttttcaatacatgcatcgcctggaaacattctgcagcttctactcctcactggtcaccttcctccttatagagcacctcaagaagccacatgaacttctctatcgaacgcatatcagtagaagcaccatattgaagacagtgtgtttgcctaccacgaggcacacgcttataaagacatattcatcacttagcagtagtaatttaactcccaaaatatttggcaaaatatcccggattctattaaagcaaaaatatgtatcaaagtaaatatataggcttttacatggctccaattttgttcatgtaaatgagttgaaaaaggtaaaatgaacatgaatattttgttaaatctgcagataaacttttcggatcatggaaatgcatgtgtcaaatttcatatgttcagatcaaatttcattataccctacgaatacacaggacgcgtaaatcatcaatattgcacactaccaacaactaggcaccacagaaagcagtccgaaaaaaa

SEQ ID NO: 99036 - DNA, 694 bp, Oryza sativa
attcctgcagccctatgtggaccagaagaattagtgtagattttactggtggtagatgtttatatctagattccattttctttgattgcacttaaaaataatgggtagactgctcatagaaattaaacaaagacgggctattagaaagctagattgaatttttaggaggcttaaatagaggaggaaaattctagaaaagttatatttaggcatgataaataatctagtatttgaataaattattttccatgttcacttatgagcagttaaatgtacttttggatgaagtatggctttagccgattaaaatttaatttgattccttttagttttatgctttgactgattaatttgtggtattaaacttagttattaacttgtaccaatattatagtgaattgcttgtgctaaacattgtctatctaatttttttccatggtttttaacttgcacataatattttagagaattaggattactttactttgtatatgtgttcccacttcataattgcacctaatattgttacagggattacattaaacttcttttgggctgagaagatgatatttgagtttaatattaagtccacatgttatcacccaagattaactataggtttgtttagtaattttaacccttttagtttatgctcatgagacctattatgaaaagcgagaccaaaatccaaatg

SEQ ID NO: 99037 - DNA, 654 bp, Oryza sativa
aatgtgatctagaggccataacgaagcctttacactacttagagcctagccttgcaccagcacgatacgtgttcctccatcctaggcatacttggaatatacctagaaccgttaagtggcgggcccacaccttaaacttaacgccgtggtggcggacacgacgggaacccaccacgtggcacaataccgttatattggacacgcttagtcacctaaactaccacgtcggggtaaataggaagctcctctgaattatacgaactcatacacaccggcctaccagaatgcaaggctattcctaaatagattaatcagcttaggccatcccatactagcacatgtggatgtacgaataactttaaatgggtaacacaagttctgtccttatggacttgggcaaacactccccctatcggtatgcaactaacaccatatgcacaccacttgccgcccaagtataaaatcacattttacatattttagttcgcaaatacccatcatattcattttattccagcaaaggttcacatatgaaaatcacattttaattatagatggaatgagcatttgcatatttctaagcatggctaagcaagtagttgcacatagagcatatataaaccaatttgagcacaaagagtgtactgtaaccat

SEQ ID NO: 99038 - DNA, 521 bp, Oryza sativa
gagaccgcgcggtatcgcgcgtgaacggtctcgctcaatcaatcagtgagaccgctcaagcaaacagcgataccgtgccttgtcgatttaattagcgtcaggataattaatcacttattattactaattaatttttaattaagtaattaattactaatcaaatggagcccatcggacagtgtcactggttgcttgagcgatccgcgagaccgcgctgtcgacgtttgatgtcgcaattccgatatttgcatagtatggggatcgttggtgctagggtatacgcgagactgaggtaaaagagatagagacgaagatttttatacaggttcgggcccctgaattgtcaggtaacaatcctacatcctgttggccaaagccggtcgttgatcttattcaccataatcacaccagtataatatttggggtagcctatctaactgttatcaacatggcgatctgaaggtctgactcgtagtcgataacagggtagtcttcctcctcgaatctgtgcccggcaagat

SEQ ID NO: 99039 - DNA, 672 bp, Oryza sativa
aagagcataaataccttgcaacccatgttcctgagctaggacctaatgcatttcacccatcaaatcccaactgactgacgaataaatctcaacagttttactaaaaccctggactgacttgttttgacagatctcactgaaacgagcgaccaagatttttccccttgaaccacaagaacagatcccaattttcccggaacaaatccaattgcaaagaacatatgcaatgaaaaggattcagagggctcttaggtttttccatttggcttgtcctacggtcaacctggctctgataccaacttgtcatgcccagaaattcccgaatggaattccaagcagaatgtgcattaaaatccccgtccaggaccggctggggtacacagacgacaatgttgacattcagatccacgtcttacaaacattataaaagtcttacataaatgcagcggaaagaaagagagacaacatgagctaagtcttaactagagctgcagcgggaacaccactccacaggcatccttgacggcacggacgaagcctactcctcgggtaaaccttcatctgacacatacccgtcctctggggttgggaaaaaaatagagcaagactgagtactacccactgtactcagcaagtcataccggaataggggcatgatgcagggaattatca

SEQ ID NO: 99040 - DNA, 669 bp, Oryza sativa
ccgcatcaaaggaactttccaaatgtgtaatatttaaatggatttcacaataatttaattaacttctgtaaaaatcaggcaaaaaatatctaattagaaatttgacaatatatatatgcaatctattttcaagtacaataaaaaaaaatataccatctattcagcttatcatccgtaccaataatttcaattttaaaactgccaaaaaaagccacattgttttttatataaccgtactaaaagtattgcaaaatagagttgaccgtacacagtattaaggaattacatcttatacatagaatggaaacgataccattaaaaagaatggaagacaattgttcaagtatagtaataatatggatggagtactaatccacgacacataggttcatggaaactccacggactctatattcctatataaattaatcttacaacaatgctgcaataaacaatctactcttcctttcttccggagacaccagtcaggtccctatcagttctctccatcatcttccatcacagtgcaacttatagatttatattgacaaacactcacatatgcagttgatactttatatattttgacatttgattcgcagttgatacttgcacaacaaaaatataggaaaacacgatgcagagtggaaatcaccctacggatgatgg

SEQ ID NO: 99041 - DNA, 566 bp, Oryza sativa
ttaccgtctatgcaatgcaagttcttggcaaatgcattgatcatctaaaagtttctcgtttatcagctggcgctatgattttataattttttatgctatatcaatataaaaggtcgtactatcttgttcggatcatttaaaaaaattgtcagctgtctgaaaacgttgactggaaatggttgggcaatcaaaggatacaacggcttcttatttatattatatatattgagtttcttcagctgctgtcggttatgaactcaacatccaaggccaactgatcaagaacgtcatgggtcgcactcatgcaaggggcacatttaaatcgttccaccattctgcaggcaccttcctaggattacctaatgatctggtaatcttaatctcgcagtaattctgaagaaacagtaaacatatccattctcactgacctgataaaagaatcctttctttcttaccaacagagaatcacagaacaaaagcaacaaacaaaaaaaaaagatgatgagaattgacatcaaaaaaggaaggaaaaaaaagagagaggaagaagaaatacaggtagagtg

SEQ ID NO: 99042 - DNA, 607 bp, Oryza sativa
cagcagtacgggtagcgtttctcgcttttcttttatgttttcttcttgcttttatttttttttagaaaaataactgcccgcacatcttcttccttttatttaggacacggaaaattaggattggtacggaaatttaactacaacaaacttttaaattcaggatttaaaactttcaacttatgtttgaaaacttgtaagccaagatttgaaactttcaactcaatattttttaaaattttcatctcagattttaaaattctcaagtgaagacctaaaaacttttaattcagatttgaaaactttcaactcggatttgaaaactttctgttcagtcttgaaaagtttcagttcggatttgaaagttttcaaatcaaaatttgaaacttttcaactaaaatctaaaaaaattcaagtcaatatttgaaaacttttaacttaaatttgtaaacttttgtctcaaaattcaaaatattcaatttaaatttgaatttcgtctcaaaattcaaaacactcaacttaaatttttttaaaaaaataactcaaattcaaaactctcaagtgaaattggtgaaagattcaatttattatattattaaaacatccatga

SEQ ID NO: 99043 - DNA, 674 bp, Oryza sativa
gccggagaaggaaaggagcggccggattgaaaggaaacagcggcggcggctcggcggcggcgcgctagggtttcggcccgaggaggacgacgggcctgacaggtgggacccacctgtcagcggctgcgaagcgcgcgcgcgcgcgggcggctgcggactgggccgacttgggccgggggaagagagagagaagggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggccctttttatattgtaatttattaattaaaattagattttcttttcaagacttttaaaataaattctagaaattccattgaaacaacaatttatattttttgaatttttagggtgtgacaaacctaccccccttaaacagaatctcgtcctcgagattcggaagaactggcaaacagatacggatgagctgacttcaattcatcttctcgttcccaagttgactcttcttccgagtgattactccactggactttgcagaaacggataactcgattcctggtccttctctcacttgtttccaaga

SEQ ID NO: 99044 - DNA, 572 bp, Oryza sativa
aaaaaaaaaactcgcctggttggcattggctagcgtcccctaagtgccttgaagatgccgacgaacacgctgacgatggacaagatgacgctgatggccttgatgtgcttgtagaggaacttgtagaccatggtccttgccggccggttccgccggtacgcctcgatctgctccaagacgacgaagtagcggctgcccaagctgagatgctggccgatgcgcttgaacaagtccagcgtctgcgtgttgctgaaggtgctgagcaccacgcgatgcccccgcagctgctgcacgtcctcctccctgtccatcagcatcgccagcgccgacaggtacgagctcaccacaaagtcgccgtagacgtacgacgccgctgctccgctgctcgtcgcctccagcgccgccatgttcaccagccagcaggcggtcacgtcgttcaggaacaccggcgacagcaggaactcgccgaagatgcgcttctccctgactagtctcatctcatcatctcatgtccgcgaaccacaccgccgtgctggccgtcaggttgacgccgatctgggccagctcgacgg

SEQ ID NO: 99045 - DNA, 542 bp, Oryza sativa
aaaataaacaatcttgaaagaagaattcatataaaaacccattacgagatttattaaaattcagaataaaaaataaaataatctcaaaaattattagataggaatacaatggtgaaattcaaaaataaaaaaatatttaaagaacattataaggtattaatcaaaatttgggggaaaaaatctgaaattataaaagaaaaaagatttcatttaggaatacaatttataaataactaaaattggtgataaaaactattgaaagaaacacatgacgagataaattaagtaataggcctataaaggagtagagtggtggcggttgatacgacatataaaaattgttaataaaacaccaaatataatcctaatgacgattaaaaggagggacgacacacaggccatgaagcaaacggacaaggtggttgccgggacttctagaaagtaaaaaaaaacctcattgataatcatattcgattttaaaatctcaatgataataaaaaggaaaagcagcgggcgggcgtataggagtaagttgtacagcc

SEQ ID NO: 99046 - DNA, 601 bp, Oryza sativa
atacatctaaagtttatagacctgaagtttatagacccaaagtttataagtcaaaagtttacatacccgattcaaatttgaatttaaattatatcaggattcaaatttgaatttgaattcaaatattttctatatatagtatttttatgcatctaaagtttatacacttaaagtttatagacccaaagtttataagtcaaaagtttacatacccgattcaaatttgaatttgaattatatccattcaaatttgaatttgaattcaaatattttctatatatggtatttctatgcatctaaagtttatacacctaaagtttatagacccaaagtttataagtcaaaagtttacatacccgattcaaatttgaatttaaattcaaatattagtttatagacccaaagtttataggtcaaaagtttacatacccatttcaaatttgaatttgaatttgaatttgaatttaaatattagtttatagacccaaagtttataagtaaaaaatttacatacccatttgaaatttgaattttaatttaaatttgtatggtgtagtagtaagagaagaaggggaggtaaattagtaagggggaggggcgg

SEQ ID NO: 99047 - DNA, 943 bp, Oryza sativa
ctagtccataatttggcagaattaagtgacaaggcctattgcgagagcagcgatccaccagtggctgtaatcaacatactttaaggctctgttcgaaagtgagggatgaaaacctcacttcctagcatgcaaaacacaacaacatttaggtattatcaattaaatattttaaaataaatttaaaaaatcgattgattaatatgattttaaaaataatttttatatagaattcttttaaaaaaattatatcgtttagcagtttataaacgagagatgttggttggaaaagtgaagataaatactcagccgtgaagcctgttacaaatatgtaagccgaaaaatgctcttctggagttcatccgtttcaagccgagaaaaatgaacgaataaacattggttaattgaacccaccgagttagtgactcgatcaattttacggaccgccaaagctccggacaggtagcagcaacctgagctgtcgatgagacatgaacagggaacaagctaggcaccgcacaacacacaagaagcagagcacaacgattcggccggtaaatttaatttctattagaaattacttcacatacgcctagttagcatcatggattcatggtttccccaaaccaagccaagaacacaaacgaactgtacattcacaacgcggatcaacgcctataactaggaacttagggaggcccggagttgcgaacttgcgattcccaggaagaatcacttggatcaatcaatgaaatatgagcagagaacaaagctagtcacaactagaagcagagcacaacgacgattgaacacaaccggatcgaaaagcgcttcaactaaactatgtgttcacaaatccaacggaaattcaatttctagccatcatcacttcacatgcgtctgagccagttagcatatcatagtttccccccaaaattaagccaag

SEQ ID NO: 99048 - DNA, 819 bp, Oryza sativa
tgctttctagcatgtcgggccgtcgtgccttaggccggcctgataaagcacaacccaagtcccagctcccctcgcctgcacgccgccgtcgccgaggcccggagcggtggcgtcgaatgggaggagcgggtggcggcggagctcctcggcaaggaggtgtcggtggaggtagggatggcaatgggtcgggtcgggcacgggtagagcaaaaccatgcccgacctgatgcctaatattgcctgtccaaaccctacccactagagttagcgtgcaaaactccgtgcccgtacccatgcccggtgggcgcgggtatgtccggcgggtacccaatggatctcatataaataataacttaaaatatatataattaaagaaagaaaaataaaatcaataatttacgaaattattggttcaccaacaataattcgaattacatcacaacttagtatcagttagcattacaaatgaaccaatagaaagggtataagaattaagaaatgagtcataattagctaatacatatgtatcgagatcgggcataggttacccatgggtaaaaaatgaaacccgcctagttgcccatgacgtcttcgggtatagggtgggagtacccatgagtgaaaagtcacactcacacccatgcccatacgggtcgggtatctgtgaatacctggacccatgggtaaaattgtcatccctaggtggaggaggacggataacctctttgaatttgctcgatgcgggatgcggcgaggcccaagaagagcgtagcggaggagaagtcgaagggggagaggaccgggtaagaggcgaaggtgt

SEQ ID NO: 99049 - DNA, 548 bp, Oryza sativa
tttgagcccaacaaagaaaagattattcattggatgacagatggcatcatatactccgtgacatatgctaagtttgctgccattttggggtttccgactcgctctcgcaccaatcgtgtcaagattcatgatgagaagcccatggacacaaattctcttcacttcttgtaccaagatgtggactatgagttaggcaccatcaaaggtctccttcccttctatgcctatctcaacaagctcttgcgcaaaactctcaatcccaaggaaggtgatgctagcaacgtccttgcctatacaagaaatttgctttacaagatgaaggctcacccacagctctttgacgcctttgacttcatctttgaagaaatccggcttatctccatgatgcctaagcgaggacttggctatgggccttacattatgaagatgattgagattgtgtccaagaagaagtttcacaaggaggtggcacataccgattaccaagttcgtcccatcaaggttgctgctgtgccggctggacgaaccactcgtgcttcttctcgtgc

SEQ ID NO: 99050 - DNA, 681 bp, Oryza sativa
acatgatagatgtattatgtgaattaggcatggttaatccaaagcaggttattggtcacaagtcataaccagttattttcaaacaagtgcatgcatcaaggagcacaccaaacacagcttgtagtttgcagcagatagaagtgattgtaactgtgttggaaaatgatagtgcttcaaagtgagttggtggcggatcagatggtgttagaaaagaaaaggatacaacagactacgatggattaaacaactgaagtctttcaactgtatgtgcattgcacaacttgagaagaataaataataaatgtcagttactaaacccacagatcagttccttctttctttttatttttatgtgtaatatgaacgcaccaataatatgttttgacaacataatcaaaacccaccaataatatgtgaaaacaatgccagaatttttagatcctcatgtctcagtaggagcaggaggatgtacttgtatttttggatattgcagaatcatcagttaaatttaattatgtgttaaatctcaattattgtttagatgtatcaactacaatattaaactgcaaatcaaaattttcagaaaactatttcaatattgcatgactttcagttcgttatgaacttcatatacaaaaaacctattcagctctcctctcaaattatgattgcaatatcaat

SEQ ID NO: 99051 - DNA, 1468 bp, Oryza sativa
aatcgtgtcaaactctaaaacttattatattttggaacgaaaggagtatatactttcttaataaccgtatccaaccctaaaacttcttatattataggacagatggatatgcggatccgtatgctagagggtggtacggtagaggatttgtttcctgttggcagaagataagccaaggtcacaacatcattgatatacagcagactgatatggaggtcacaattgctgatggatgaaaagacatgtgtatgctgtgatcatattgttccagattgcaatgttgacgattgatatacaacaaagggatatacatagctcgacaatcaatcaacaaaggaattcgcacattcagatgtagtaaggccttctcatgcaactttgatgtaatggaatatattgccatttcattacctaattatgaatctgagtgaacaacaaatagaaacaaaactcgtgtgactggcaatatacagcagtaaataatccttgagtttgaatattcgccatgcaaatccatgatgcaattccagatgtcaaaatttagaagggaaaaagaagtgcctcatcatcgggggcaaataaagcatctagatcttgccagctaacagaaccaaagcaagtatacaacttacagaaaaagtattccacgttaagccgcagcaaacacatactatgaacaaaatccctcttgcaacaaccttcagaaaaaaagcacagttgtcacttaggggcataggctagctagcctgaaaacttgacgaactcaaggcgcagtcgcgcagacagcagaagtaacagccatgggctaatcaagtactcacagttccacccaactttccagcttgtcatcggccaagatgacggggcacggtaccatagaagtatgagggtgctaaaagggcttcagaaactctcactcgttccattaggattctccacttgaggtgctaaaccagggcttcacagaactcacaaaggtaaacatctcaagatggtgctgtcgacaaacttatcaccaggttggtcgtctgactagtaagtttctaggaaaaaaaatatgtacatatcaccagctgaccaccatacgatcaaggttgggacaaaggtcgggacaggatgaggagtagcacctccagaacttgctccctgctggtgatgccgtagggggagacgtgcttgatttcgttggggtcaagtggagtagcatcacgctcacatcttctgcagtggagtgcgaaacgggacagggtggaccagttcttgatccatgtccagagtgtctcgtccagtggtgtggtgtcctcggttgacatggcctcagaaatgaactccagaactggccttatccgtgccgcctcacagaaaaggattatcaactgtgtcaacgccttcctttgtctcttcatcattgcactcctcaagtccgcctccgcatcataattgagcagcacaaagtaagagtggcgta

SEQ ID NO: 99052 - DNA, 670 bp, Oryza sativa
ttgtcatttgatgttatcgcatttttctaagaggggttatcataccttttccctatatttcactaacaataacatatgcatgtacatgcactgtctgttgggcctaaaatgtgctaaaaaaattgggatatggcatttcttattgtacagttgcataaagtgaaaatagaaaaaaattgtgaaaaaattagcacaacacctcttcacaaggtaaatgttcccctactctgtttcaagcttaagatgtattttcgttacctatttaggtattcaccctcttgagatgagttctaaaatttgtttgtatattttttccttcgatgttacacatgatgccaatatagtatatatatgtaatcaataaaattatacatgatccaattttttatcttcctaggcatataaaatgattaaggctacatcttgaagatatggcagctttaatgtatatacttctccaaaacaagttttcagccttttgtacttagaatgaagtagccccattaattttgatgttttgcaaaagaaattatgccttttggtaagcattttttatattggtaagccatctttgaaatgtaaaaggcagggtatgcttcatacctaggacctggaataaattcaaattaaagtattcacttttaaggtcaagaatagaattatccagatt

SEQ ID NO: 99053 - DNA, 660 bp, Oryza sativa
  unsure (1)..(660): unsure at all n locations
tcatatatgaagggcaatatgtacttttatgaatgataatttcatccttgaatagagcaatagatcatttacaaacaaattggatggcaacatgtatatgagatgctctttttttttcatctggggatcattgtggaaatggaaaccatgatattaaaggtaatattcatggcaaggatattgcttgtaagatttgactgtgtttaaaaaggaatttaccttccgaagtaaagatggaataacacgtgcagagcccgtagatattgtatgatttgaatgtaaaggctgattaacttgtcagtaattttgcatagctggcatcacaaccatcaagctgcaacatttgtatcaagacataacttaacaggtagcacatttgaatgttgcgatccaaaaagaaaaataatgcaaaagcttttgtatgagataaatatgagtaaatccaatgtataaattgcaacagagcatctcctatgtatgatttatgagcctttttaccatacaacatttgggatttcgagggacgacaaagtgttggatgggaaattgctcatgaattatgggacatgaaaatgaaatganggatgaatggatataaaataaatggataaggataaggataaggatatgataaggatagggaataaaaaaatagaaaat

SEQ ID NO: 99054 - DNA, 652 bp, Oryza sativa
gggtatcatgtacacaggcaaatgagcaaaaatgaaatcaagcaattccttctgccaccatcttctcttccaattgattttgggagcaactagaagagagcatgcggcgtcatgctgcgcgaccgataaagtttcatacatagattgaacagccatttaaattttcaaagactgagaagagttgtatacaaaatgtgaacaaattggtgagaggaggttaattatcagtgtgcacagagagggccacatgtagtcgtcggtatacacagcgcgctcctcgaatgacattggctcgccgtggagcttcacccaggttgtgacatcgttcggccgttgtcgagcatgtaggtttcgtgtagtcccctgtggagaggaggagaccatggtgatatgacctgtggtgcatggtccaagcgacatgatgtggcagctcaaaaggttgcggtaagggtgaccatgtctcgccaatgccagccctggcctagtcaaccacctctaagctcggttccgtaagcaagcttgcaaattatgtctttgtggtaaatcttgctatcgagcttgatagcgttgtacttggcgaaccggtgaacactttccctgagctggtgtcagtgatgtcgctctcaacattgttggcgccgttggattttcc

SEQ ID NO: 99055 - DNA, 675 bp, Oryza sativa
ggggcaggctacattgtcactgcaaataggttactacaagttcacaggcacacgtgcattacaagttcatcacagccattggcaattagcaaaatacttagagaggaggcagctggcattacagtagaagataggtagataggctcctaactactctagttggtggtgcacttgaggatgctaggtctttcctcttctggggagtcttcttcttttttggtgtcttttttttcctaggtgtttttttcttctttggtgcagagcagcttgcttcacttgttgacactcctggatcatttccttgcctgcacacttgtctcttcctacaaaaaagtgagaatttttagaccatatggcaagcatacaagcctgaatcttagtgactacaacatagcacaatatatcaggagtgtaactaacaataattatcaagttgggttttttttatcaagttggagttaaagaacacaaaccgcttgcacaaagactaattaagaatggaagcacaatgacagcaatataccgtttttggggggtgcagtggctgctcatatcatctgcatctacaggttcagctagcttgcatgttttctcaaaatgtccaaatcttttacatctcttgcatttcactctctttcttccaggctcaagaaatccccttattctctgcactct

SEQ ID NO: 99056 - DNA, 728 bp, Oryza sativa
gtgaagaatatccggttttgtggttcagggggataatttggacgaccgcgattgttcgtggggtaattcgtactttttccttttaaaataaatatgtgtgggacccacgtgtcatcctctcgggatggccctcattccgggctggataattcgggattgatttgaggcccatgcaaacaagagtttaaggtttggttaattacaatgcatggcaagcgagtcagcgagcgacgaaattacgatgcatatgctctgcgatgcgaaattaatttcgctacttacatgtcatctaagttctcctcgctagcatagtcacttccgtggcgagcggcgacggcgaggacgacgcgtccgtcgtcgtcgggtaaccctcggttcggttgttttggttgtcatggcgaccggttggcgtcgagcgcagccatcgcttcactggaatgcagctattccttcaccgtcgctagtcacatcatccaagaaccaagagctctccgccttggacgtacacgccggtgactgtgagccttcccacgtcaagctccaacctgaccttgatcctagggtcggaccgcagccacccggccaccacctccgccgcccccctgcaccgctgccgccacggcgcccagcaccgcgccttcttctccgcctcgacggcctcctccatctcccccacgaggtcctccagctcgttcgtcgccccgtccagcctcagcttccactccacg

SEQ ID NO: 99057 - DNA, 579 bp, Oryza sativa
tgctctaataccttccaatcctatatacgtatctcaatataatttgcaccattttcatttccagatcagctcccaatcctatacatgtgtgctggtgaactgtaaaaccgtcatacagaaccccgaaaatatatcggtgtgaggatgtttatgattttggtctcactcatttcacctgcctcagtgtctgtatatatatctcttgagagtaaagttccaaagcatttatgcacgtaaatgcaaacaaggtttaaattcatcaattcaaacttgattcacatcaataaaataagagcatacatgcgatggccgatcagagcaaatgaggcgcgcgatggagaaaacaaaaataaaacataagtggggagatggaactgcgcggtgcggatgagggggcctcagccactgggccatccccagccatgcacctgggccttatccacagatcccctggcccattaggattggcctctgcatgtgaaatttaccattatagtgtaaaaatggcactaaatggctcttctgctgaagtttagccttcttttctgaacctgtttattacgtgggtgatacgaaaac

SEQ ID NO: 99058 - DNA, 765 bp, Oryza sativa
atcgatataaatatgagaaatgttagagcaatcatatgggggagtaccgtcttacagtacagtattagactcagtttattgttgatatagcagaggatccacatcccctattcttttttttagataatgacatcccctattcttctgaagcagaggatcaaatccttcaatctaaacagttactatttttatttttatttttatagagactagaaaaaatacctgtacgttgtaacgggtgaaggctatgttaatcttattattgctatactgtttagttaatgtgaaatttactgtggaaattcgcttagagatatattttttaagaaactagcaaaaatgtccgtgcgttgcaacgggtgaaaaaattctaacgataatttatttttttcatacataaccatgtcaatgataatgtttgtatagattgtttatagctaagacaatcaaaaagttggaacatcttcaatgtaatggcccaacctcaacgatgacaaccttaccgatgcctgctttacctaaaataattggattatccacgtgacagcatatatataatctaaaatactctttcaatcttattcttgcaaccaataataggattaatcagatactacattacctcgcatggtcaagtctacacaaaatagagtcactatgcactcttctctaaataacaattaaaaatatgtttatttttcagtattatttctatatcatatgttatcagaaatattagctatacttaacaaaaatagtctaata

SEQ ID NO: 99059 - DNA, 683 bp, Oryza sativa
cacggtttacccttcaaataaattttctaaaaggataacatttatcaaaatttcgccaaaacatacatcatgtctctcatacaactactctctccgtttcataatgtaagactttctaacattgcctacattcatatagatgctaatgaatctagacattattatatatatagattcattaacatctatataaatgtggataatgctagaaagtcttacattgtgaaacggaggaattacaagataatctaaaaaaaagaaaaccatatagcacagtgcagttaatctaaaagtgcaatataatctaaaagtttgacgacataagtgcagttgcatatgaacacttgcttgcgtacgtgcatggttggtttgagcgctgtgaacgcgatttgtcaacttcaacttcaaattaggggactaaacgaggaacaaatcaagcccacgagacgacacatacagtaatccaaaatccaaagtcaatcacaaggccggccagatcatcaccgctgtcgtagtcgtcagtcgacgtaaatcgttctctccattttctgcaggctgcagcttcgcctcttcttccttttttgtagactgcagcctagatgaagtggacatgcatcaatagaacggacaagagcaaaagttttgaaattcgaaccattcttctgcaaaacacctcaagcttt

SEQ ID NO: 99060 - DNA, 525 bp, Oryza sativa
agaagccttgacaagcaaagataatatcactcgcactttatgaatcctttcgccggagacgaagaagatggccaacaccaatgcaagaagctcgccagagaagaactgggcggccggcgcaaccttcttcttcttgggctagaggacaagtctccaaacccgagcaaatcagcggaactcctagttgtaggcgttgaaggggaacccagcaagtacaagagaccccgatcgatgagaatgccggtgaagtcctccatggccgcaagccgggacaagaagagcgaaaatgccggtggccttcttgagccgcacaacgaacgtgattaacccgactatgggagagacccaactaagctaaagctatacctattaaaggagaagccggacaccctcccctcttactggcgaccggagagccgccggattccgaaaggaagaggacatgaagaagcactagtatgaaatcgtccatctatgacgttttgctcgtgacgctatataatttcgtattgaacagagcatatc

SEQ ID NO: 99061 - DNA, 639 bp, Oryza sativa
aaagtttggaaccaattgtgtatttactttagatactttgcaatagattgatattctcgtagtactatataaactttagatggatcgatgtgttttgtgatccatgttgcagctgggtgtgtatttatggtggttgggggtgggtgggggggtaagaaaaccatgcatggatgcacggtgctgcatggatatcgttggccggctttttcgttcggagctcttgtacaattgctataaatagatgcaagatggtgattatattgttattttatattgttaggtgccaaattccgctggttgataagtaaaaacctcgggaaagagggtgatgatgcaccgagagtagtattgatctagagattcattacaatggcctcgggtgtacatatttacacccatggatagatactagtccttgtaggacaagaaagaaacttttctaaagttaaaacggaaacataaagtccttattggacactaaacacactttcctaaagataaaagaaaactaacaaactattcctaattaatagataacttgccatgttgtatccttcttgaactcggtcacttctggataagcttcctttaattcgattaatttccttaaccgaatatagcaggaatccgactattggc

SEQ ID NO: 99062 - DNA, 633 bp, Oryza sativa
attcctgcagccctgttttctaattagtcattgattaaagggttaattggatccatgccactgcaaatgcctcaaacaaattgacgccactctttttcactttatcagatagatacctcggcttcccaataatagtgaaaccggagggctatcggataacggcctcacttctataaccaaatttgacactctccgtgatctttcaatggatcgcgaaaatactccatatagcaatcctattttccataggaactttaaaaataactcactgtcagcacacataacaactgcaaactaaccatatacttgctatggtggctgggaatatttcccgatgtatgaaagtatgaaacactgcaatacatggcattcatttatataaattaaaaatatacttgtttgcagagaactttgatttgtatgactactatcattttcttcgcctgtagatgaatcctgcaacttgtaagtgcatttggtcctactctgtgcttttaaccataagataaaccttaatcagaaatcccaactactgatttccttcagaagtgcataaaaacttgtgagtgggttcggttgcattgagaaattgacttctaatgcgacttgcatgcagcaaaactgcccaaactt

SEQ ID NO: 99063 - DNA, 558 bp, Oryza sativa
tatggaagaatcttctcccatcgaacgtccgacgtcccaaaaaaaaatcagacggtattccggtgaccaacgagtgaaacatcaaattatatatgactagtaatatacccgtgctaacgcaacggtgatatttagtagagtaaaatggacgggcggctcttaaacttgtagaggtgtatcatctaggtccctaaactcttaaaatgcatatccaagtatcagaacttgtcatagtatgttctctaggtcccaaatcgctacaaccttctggatcctacatgatactgatgtggcatgccatacgtgcatgacatggcataattttgactgacaaatgagacccatttaaaaaaaattctttttctttttttcttctttcttctcttttatttttcctttcttctcctttctctatgacccaagcagaagaaagaaaaaaaaaagaagaatgagaagaaaaccaaaaaaaagaaaaagaaaaagaaaagaagaaaaaaaagacccatcatgtccatgtggcatgccacattagtgccacataggatcttagaggggctg

SEQ ID NO: 99064 - DNA, 1018 bp, Oryza sativa
atttttcatggcgtcaacttatttttttctctggcggccatacgtgaaaaccaccagtggaattataacaagggttgggggctaatggccagcagcgaaaatggatcgtccttggtggccaggttaagagggccgccagcaaaaatagaggtatttttgcaagtggtgctcttaagatgcagccagtaaaaaaaaactattttttactggcggggtgttgggagcctcgcttgcaaaaatcgtgggagggaataaacatcacgtgctccctctttttttcctcgacccctcagatccaacccttctctctttctttctttctttctttctttctttatctctctctctctagctagtagcagcgaaggggtgcagcggcggcggtcaatgatggcggcgctcggcggcagcggcagcacgacttggccatgcttggcggaggcaaggagagccacgtagtggaggtcggcagcaccggaggggaggcggcggtgtgcttccgtccaggacgcgaccacgacgacgagacggtcgcactgtagggagaagctacggtggcccggctctcccctccctcctagatttggctggagggcaggggtggctcggtccggatctagcgatcgtgggtcgtgagggtgcagattcggcagcagcaggtcacgggggcacggatccggcggcgacgagtcacgggggcgtggatccggcgacagtgggttgcggcggcgcgaatccgatggcggcgggtgacgatggcatggatctggtggcaacgacttcctctcggctatggtttccccttggcatatatcctcctccatagcggcaaaggagacgggtggcgatagtgtaggggatagatctgactggggtggtgttcgataccactggatccgcctccacggcggcgaagatgaggggcggtgaaggaggtagatcaggcagcggtggtcctctggaccacggccgttgatcctgcaggccgaccgctgtcgtcgaccctaccctaccctca

SEQ ID NO: 99065 - DNA, 620 bp, Oryza sativa
ccctaccacacggtcatcaccgccggcgacagctattccttgcttgcgctgaggtctgctcgtcgtcgggtgtgttcatgtagggaaaaggaggatgtaggaacactcagaaaagtaagaatggaaaaggaataggaggcgctgacatgtggatcctacatgttgattcagcatgttagactaagtcaatgagccatgtcagcaagaatcgctttcaaaaccaccgagtgattttgtatcagttttaacaatttggggttcaagatatacggttaaaggttacaaattagattagacctatatttgagggagtcaaagtggacttattctcacctagcaacacttgagtttcccaactcaatcctctcgttttctacgtgcacgtttttcaaactgctaaatgatgtattttttgcaaaaaaaaaaacctataccaaagttgctttcaaaattatattgatccatttttaaaaagaaaataactaatacttatttaatcacgccgctaatggaccgctccattttatgtgcaggaggatttgttcccaactgcatctaccgaatgcattcttattttgacaggtaaccagaaaggcaacaagcccggcctgctcctggcc

SEQ ID NO: 99066 - DNA, 720 bp, Oryza sativa
ctagggttacataaatttatggcagcatattcaggattttattccaatagcgagtttgaagtttgtgcatcatgtttcgtgtctatgctaagttcacaccaatggtaagtttgaagtatggttcatctcttttctatcgagggtactacatgatgttgtttggagattgaagatttttatggaggacactacggaacgggtgcccgatttttggagaaaaaaattgggccccctaagcatgcatgcaatcttttcttctgggaaacctccacatgcatgcacgcagtcatttcttctcttccacatgtgaggtacatgcaaacttctcccatccccttgtctcttctcccatactcttaattagcaaattataaaccattttttcttatgaaatacttatccaatttgtgattcaattgcaccattgaatttgttgcaattaaatctttacaaagagatctcacatgattatattttggagaaataaaacatatgtaattatattactaattgaaacatttttattataagtgggacattgatttgtgacctctaaaacaatacaaaatatacattgaaatattgaaagaacaatacgtgcaagatcctaaatgatctagtgaaacatctgctgaaatgtccaaaaaataccacgtgtaaaatttcaaatgagctagtaaaatacccagtgaaacatcacaaaatacatgctgaaacatc

SEQ ID NO: 99067 - DNA, 565 bp, Oryza sativa
ctttatacgacccgtttaaattctaacggtccttatgggcctcaacgtctatccaagacgagcatgatcaacaaaatatatattttcctctggtttcatcttcctcatcaatggtgacttctgttcatagcacacctaattggatcaaattaaacaccacatccgaattccaaaaatcaactaggatgagccacatgatcaacaaaataatagcctttgggttcacacgaagacaaaatagctagaaaaaatgtgagccattggatagagggagtagtaatactttgtgaagtttcctcggcctactaagaaaaaaaatagttaagttgtgaatactccctctatactcataaagggagtcgtttaggacagcggcacggtctccaaaacacaactttgatttcttgtttctataaaaatatttattgaaaagtgatatatgtatacttttataaaagtatttttcaagacaaatctattcatataatttttatattttcaaactcaacaatttgagagttatttatgatttatattcccaatatttgacttaaacattgtccta

SEQ ID NO: 99068 - DNA, 506 bp, Oryza sativa
  unsure (1)..(506): unsure at all n locations
cttttgtgctctattaagctgaaacgaaaacaggtaaggaaaaagacaataattagtgcacccaatgtattagcattaaaacagtagttacttaattgtaatgcaaggacatctgaaaacaaataccagattaaacagatggggctaatttggaaattattttggacacaatatttggtctggaaactaattttaatgcataatatgagctaatactaaaatactatgttaaacttagacaagtgtaggtccttctaataaagataaggctcgtagatagtgtccggaattggggatgggaagaaaccgacagagaagtatctaagtcatcccttctctctaagttttcccctttttttaaagtttttttttttaaaaacccccccccccccccaaaaacaacagggctaagacaatattaataggaaagcaccatttctggaacacatgcagtgattatacactangggctnncnnnnnnnnnntgagnntactaccccttaaaa

SEQ ID NO: 99069 - DNA, 510 bp, Oryza sativa
  unsure (1)..(510): unsure at all n locations
tttcatgcctcccggcccgatctcggtcgatcatctgtcaatattgcttgatttctgaatttccattatgcaaacaagaatgtattttataacctgttgctatctagttacatgcacagttgtacctgtacaatccaactctctctcggccgtacgtgtctccttctgttatttttcctgtacattgctccgtatgaaagtaaatttaaatctcaatttaatgacataatttttagcaaataaaattcatttcatattatactaggttttggtcaaatgttttaaatgttgaatcttacaatgtgtacgcgtcttatattatgggatggagggagtaagaattaagctaaattaatttttttaaaaaaaaaaaaaattttgggagaaaaaaaaaaattttttaatatgatgtttaaagcaaatttatataaaaatatttttaaaaacataccatttattagtttaggaaacttgtgcntggnaaagatgaaataaaagataaaatgatgt

SEQ ID NO: 99070 - DNA, 1558 bp, Oryza sativa
  unsure (1)..(1558): unsure at all n locations
cccaagcattctataggggtcagattttgcaccaacatttaattcaagcaaggtcacacctcaaaaacccagtacacgaaacatatacaagcaagtaacactttaagtacatgcttaaaaaaaccccccccaccaaaaaaagggggggccaaattcccaaaantaatggcttcccaatttgccgtatgttcttactctgcttccatttgccgtatgttcttactcttcacttcgtctgattcttctaatttccttttccttttcattttggaacctttgattctcctaatttcatccccccagttaagcttcgctgccaaagcagtcttgttaaaagcatggataatcttagagtccctagcaggatcaaaaatatatgtagtcctctccaaatgtaccccgtcgacaagctattagcttcccatgactgatgattcgctcattgtcaatagtacgtctccccaaagccatcttctcgaaatccatggcatctccacagtaactttcaaatggatgcagaatcctggtcccttcaaagtcacaataacagcaacaagcttttttttaacagatcaattatattgaaccggctttgaaagaaagcccaacaaacaaacagagtcttataaaaaaagaccaaaaatagaaaaacacagctcaaacacaggctgtttttcccttgaagcacaggtacatgcaaacatccacacacactactccagacctagatgcaaaagagcaccaactgaactacatagctacaaatcttcaggcaatcgatctgccttcagttgtcccattttctccagcagacgatcacgccattcttccaagataccatgctcctcccattttagcatgatacatcatttctgaacaaaagacagagttttgtaaacaatatgcaaagggtatttaatcaacacattttcaaaaacccaatcgttcctaaccaaccgcaatgcccaacacacagtagccagaagcaccacccaaaccctatttattttcttccccttaaccaaatccaaaccctcactgatattacttggtcttttatccaagccaagagcatccctaatgacacaacacgcaaaactagctaaagggcacataaaaaggatatagttcgaggtttctttttttaccacacagcttacacaactcatctccccctctccacttccttttaaccaattgagtagcataaggtagtcttcctattcctgccatatacaagaaatgcttgatcttttgaggaattttactcttccaaatactcatcatttcagaatctttcacacctccaaaagttatcaatctatacatcgatctcacattaaagatcttgttgctggtataaggccaaaccactctatttgctcccccatccaaattatattcatttaaaaggcctctcaacctaattaaatcttgacctctgttatcatccaaattccttctaaactccaaattccaagtctcattctcccataaatcactcacagtcgcttcttgatgataatttatgtcaaacaactcagaaaaaacaaacttt

SEQ ID NO: 99071 - DNA, 615 bp, Oryza sativa
tggcgtgtgctcttgcatggtaatgccgttaaatgatgttgattccaatttgattaaaatgtagtattatatacgtcaactgtaacatgtaacacatgcctccgtgatgtgccccttgtgcttgctgtgacaagtacggggttctgatttaaaattacgacaatggcgatataatgggcttaataatctgtaaaatacggtcagctttgttttgcctggtaattctattgttgtgggaagtgtgggcctgctaactcagagttatgctatggattgccaatatgtagaaaatgcatctttctattctactgtagtataatgtggcatgtttttatcactgtagtctgcactctgcaaccacttgatctttaggaactgaatggttacagtttcttgtgtatgtccttatattagagcaaataattttcaacgtagatttaataaatcttctgatagaattagtaccaacttgttgtagactcaaggcatgctgcatttttcataggttgttgtgacggtatgtaattcatagttttcatagatttaatatttcttctgatagaattttttgaactgcttatgcactgactaacccagttttccattttcataggt

SEQ ID NO: 99072 - DNA, 519 bp, Oryza sativa
ctagtcctcaactgattaaatagcttcctttatttgatgatataattcaatctcaagaagaatttttcttcttgcttatagcattgacatagatagtatgaaattgatttccttgcagaaaaaataaaacaaatgtagatcagtatgagaaacatagagtggcgacaacgtttggcgtgtcattgcttaggagaactttccttgtgcagaaatgcttgttgacagactcctctgttggctcgaggccttctgcttccgcactgaagctcttcttacctaggttgatgaggataaggcttgggagttttgggtacaatatggaggtcatatgggctttgatgtaaaaaaaagatacaaaaataaaagcaagtctgatgacaagatcacatcctgcagatatgtatgttcaaatgagggtcgacgaacagaggacaaaagagatcatctcactaggtatcctagagctgaaactagaactgactgtaaagtacgcatgggtctcataataaatcgagaggt

SEQ ID NO: 99073 - DNA, 510 bp, Oryza sativa
atgatatgtcatcggcacctagccgattggctatcatttatagatttaaccacgaattctttgtttctatttcttgttgattacaggatcaaatcaactggcacgctcatacattcgaaggagagctttggacctgcactggagttaagcagatctctctggcctcgtgttttctatcaacacgcttttggcacgcccagtgggaccgattagaagtcagcaagcaattcttctgtcgcgtcccaaaacgaccctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaaagaaaaaccctaaaaagtctttttccccccctccccctcttg

SEQ ID NO: 99074 - DNA, 585 bp, Oryza sativa
ataacgcaagaacataaaaaaatgtataaataggatgttgtataggattctaaaccataaaaataccagaagtagatttcataaaactacgtatacttcgattcaaactatcataaaactatatttaagatgttgatcacaaaactatatatttagcgtaaaatttctcacaaaactatatatttaagatggagtgtcacaaaaataaagaataagtagcaattttgattatcataaaactaaaggtttgggcaatttaatcacaacactataattttatagctccaatataacgatagtgctaggatttaagttctagaatatgtagttttgtgataacttcaatattaaatatatagcttgtgataattttgtcattaaatctgtagttttgtgatttatctgtaatttttgcaataagttaatcaaaatatgtagttttataaaatttattcaaatactaggggtagtgtatctgagtaatttacaggaaatctaacactggaactttgtggaactaaagagagagagtgaaagttcgttggacttctcaaaggaaatgaaaacatgagataggaccacaat

SEQ ID NO: 99075 - DNA, 658 bp, Oryza sativa
aaaaaagattagtcaagtaatgaatggctaaccgttatgaaatttagtgatgacaatgtttacctggggtatgacagcagggaatagatctgtcatatacattgtggccaattgatgaaatagatgcaacttccattcaccccaccatctgtcaaagttcctgctcctgaatcctgctaactcaatattgtcgatactgcctaagggaggtccttggaggttaagcagtgtaacaccctgaaaattcaaccgacaaaatcaaaactctaaaaattcggattttcaaaaactttttaaattaattgcatcatgccgatcttattcgtctattttatctggatttgatctcgaagattattaatcgtgagtaaagaatagttaaataggaataaaccgtaaaaacaaaattggtaaaatacatacaaattaaaataaagattaggtggggatagaaataaataaaatattatcgcgaccatatttggatcaattaaatttaaatacgatggaataagaattaaccctaattaaaactcaaataaattatataaaaataaaacatgagtaatattaatctagggtgagttcattagttgagataacacaaatattgagtaaaatgcatatgtgcaaaaatttggaattgtggaaccaaatt

SEQ ID NO: 99076 - DNA, 850 bp, Oryza sativa
ttcaatctccttacgctcacggcgttcggctaatcttagcttggctttttctagtttaaattgatgttgctcaagataagcggctggagttaggacatcggccagttcttcaggaattagaacttgaactttgtgcaatcgtgtcctaatcgatccacagtcgaccactaagctatccatagaagaggcttctagccgacgcgagatatcttcaagtgttttctttgcatcgtcagataagggagctagagctttgcttgaagtatcttcttctgcctcatcaagataatctttgatatcaaaagaaaagagatcggctagagcctgcaggtataagtttagaaagtttgagagctaagtcaatatagtcgatctaaattcttgcatcaaagaaagacttactgggatagcaggagcagccggttgttcttcttccacaatatgatgactccccacagtcgatggagttcagtcactcgatgattgttgtacaggagaagaaggaggaggaggaggctgtaaacagacaagtgttagacaaaatcggctgaaatcaactagtaaaattgagagtgtcttactggtggagctggtttgagaattggtgctgccgatttcttctttatagcagttttcttcttctgcaactacaaaacctatgagtagtcggctgaaaaataatgattacaaaagagtttgcaaggaaagatgttttactctgaagaagtgagtgggggcagaaggagttgaaggtatctgcttaggcgaagccgatggtgttttttcagtatcacttacttcggctgcagcctgatcaacattgtcctcaatatcttcttcatccagagct

SEQ ID NO: 99077 - DNA, 1001 bp, Oryza sativa
aatcactaggtgatactatatacaagcatcagtgcatcaccgaatacataattaaaaacactaggttttggaaaattgacagacctatatatctctaataacgctttgagtttttgactcttgagtgacgtggaggttttactatccatactctttttgggattttgatcttaattttgtcccaaaaaatttagggtggaaatagaagtgaaagagactggagtactagcaaaagcgactccggagacttcatatctatcggtatacagagcataactatttgaacatatgtaggtggatatgacattgttattccccaatttctccacggaactgccactctctaacttccaacttttccgtcacatcaaatgtttatacacatgcatgaagtattaaatgtggataaaaaaataattacacagttttttttttgagggaaggcactgtaggggaagcccccacagttaaataactttattatagaaaaaaattacaaaagatataaccaattcaaaagggaccgtctctcagaaacatttaatctaaaaactaaaagggaaagatcactcttaaagagagctttccaagaagaaattgagggtgctaaattctggaaaatcagggagttcctctgtttccaaatattccaggctgcataaagaattttctccacaaagtgcgtagacctataagaattcattgcctgatacagcatatctgtgaaggcaagagaaatatcccagacaattccaaactgtgcccagcaatcagcactaaaaggacattgaaaaaatagatgaaaggtggtttctcttgcacaggttgagcaaaggacacaagttagatctgaattattgggagggcaatgccttctgtcaagcatgtcataagtattgagtcggaagccatccaaaaactttaaccttcatagcgcacttactcttccagatccaagctagataactaggcgcatgtatatgcatgaaattaatgtcata

SEQ ID NO: 99078 - DNA, 532 bp, Oryza sativa
taatatttttggagtactgaaataatgaaaataactaaaattttaaataaaatataatagaaaatttgaatttttctgtattatgttggaaacaaaatctaacataatttcagttcaaagtatacaaccctaaactacaacttgggagcgataaaagtcttattttctaatatattttctcattgagaaaaacatttaccgctaaactgtagtttcatactgcaatactatatacacacaaataaatgctaaactgtagtttcatactgcaatactatatacacacaaataaatcaatatttcaacatattcagctcataattatatgtagtcatattaggcatatttttaatagaaaatatcttcaattaatatatcctaaaattcataaagacatatatattatacaaaagaaaattgttacttagagtttagaaagtacaaaattaagttatgctaaatattaaaaaaaagaaacgcgttatgtacaaatgatatatagtttcatatatattttttcttataaaaccaa

SEQ ID NO: 99079 - DNA, 598 bp, Oryza sativa
ttcttgtctgcatagccattgaatgcattatcaaatcaaaaaagaatatatttgtgtggttgtgcagctcgtgatagcttccacccaaaagcccgctcacagataaccaatcggtacacataacagcaacagctagacacagctcctgacgaagtaagaaaaccgtcgatgtcttttcatagggtgccgacaaaggcttgaaagtaggagactagacaaaactctaaaatgacatgatgcaattctttctaccaaattcaattacgacaagctgtttccaatttctcacagctgatcacccaacagatactgatacattgaaatgaatagcagtctgttgtaatagatgcaagggattaaaccaaaaaagtttacaattatcttactacattatggtaattctgttaagtcagttgtcactttgtcaatagtaacaggtgatccaataaaaaagttccaagtagagtttgcctatttaaggtgggagtacgaacaaaggattttcctggcacgactttctctagactctactacactactctaaatataaatgtctgtaatgctaggcaacttggtagtctgctcttttttgttttgg

SEQ ID NO: 99080 - DNA, 722 bp, Oryza sativa
aatttacttttttatgaatgtaaatattccactacatcggaaatctagtggtgcggtgtacgcgtgaatgcctttggccttgtccaggcactacatatccttccagctgtcctacatcatcctgtagctgcagctgcagtcccacattgctcagtagatccacccctggccaccacatgtccttacatctaatatgttaatttcttctaaaaggatagcattgatgatagaaagcgctgtcacgccatcattgggcaagcaaaccagcttatagcagttaattggtgaaaaacattcaactccattcctttctccaaagataaaaatagaagtacttagatgccacatgtgtctgttatgattctaaatagtactccactatttagtagtataaatacaggaaaaggtttccattataagtttattataacatcaacacatggacttaaaatcttagagcagctgaagcatggcattaactctgcccatgatacagggcaaaccaccatgtgcatcactagtacttctctagtgtcgattctcaggatttagatatgcacatgttatgttttcttaccagtgcttgtatatatacggtaagcatctttgcacttcactctgagttaaggacatataatcatttatctgtgtcagattcgatcattttccctgcagttaggaggtcctttgcatcatagagccatgccaaggttggtgtggtt

SEQ ID NO: 99081 - DNA, 928 bp, Oryza sativa
ggttagtattaaatgtctgcaaacttaagtgtggtattcatatggtgctccatactactactatatcattttctctgaaatcttaaatggccgtttcagtgatgctataaccagacagtttccttccaatgatctacattattttgttgctgcaggcctaggtctcctccagctcaaccaatcattgcttcatgcttcctttctaattaaacatacaagaaaagacctttcattttttcctttattagtagtagtacttagtaccgttaattagaagcttgcacatcaatgtggctacctcctgggtacatccaccacactacaccttttcataacaccctgtcttggccatggcttgcataattaagtataccactctaaacaggctaagctaaactaaccctgatgtgattagcaactactgaaaggtggaccaaatacatactacctccgtactcgtaaaggaagttgtttaggacagtgacacggtctccaaaacacaactttgatttcttgtttctataaaaatatttattgaaaagtgatatatgtatacttttatgaaagtatttttcaagacaaatatattcatataatttttacattttcaaacacaacaacttgagagttattcatgatttatattcccaagttttgacttaaacattgtcctaaactttgttcttttctattgataatgtttgctcatatgttggtttgcgtgttgcaggtatttttatcactgcacatataattgcacagagataggatgcacataacctcatagagacatactgattctttgattggcttcattttttgggtgtcacctgttgcctgcaagggaatttttggtcttggtgatatatacgatttgtccctatacagttctactagttgaatcaaacattcattctttctatatctg

SEQ ID NO: 99082 - DNA, 564 bp, Oryza sativa
cccaaaatctgacctgcgcgacctacgcgttctcggtagccgcctcgggatgggggtccttgccggagtccagcacgagcgggagggacgccggcgacctcctaaccgagccccttcttgggtcatgtcaggacaagaacgagaagatgaccggcgagggcaaggacttcagcgagatgaggaatagtgcagcggactctgatccacttcagcaatcggaggtattcaacaatgttttcttgagttcttgattgtgcattcaacttctttctcttgagttcttagttgtgcattcgtcgggtcggtatcttgagttcttgattatgcattcaagactgttcaaggagtctctgcattctgacactttttgcattctgaaacgattgtctctttcttctaaaaaaattgcattatgaaacacctgttctgaaatgattgtgcctatttggtcctttgcagattaaggagtcgtccctttttggaaaatgcaaagaactcctcaattatggttttcttggaggtcctgccctcctaccccatctaggctctggactgaggaaaaca

SEQ ID NO: 99083 - DNA, 632 bp, Oryza sativa
agataacttattaatgtatgattagactttaaaattttttattccatcttttatatagaatgtttttactaaaactcattgtatatataggagtctaaaaaacatatgctaaaatatcaagatgaaatctacgtctcaatcagaaaatattatggccttagtccgtggaagtaattgaactccattagatatgccacgattgatttagcagtgcatgtcgtttagtttccataggaatacattaggccagttaaccgggcaccagagcaggagaagacaaatgcagaatggtgaactggagtacatgagtaatactcctgtagtgtacgctgtgtattgttaaaagcggcgtatagaaggaacgttgatctatgattattagagcaggtacaattaatagcagactacaaaccagttataaatatattttaaaaagataaaagaagagagagaagagcagcgggctatagatttatagccagctgtagcatgggctccaagatacatgtgcgtatgataggaaaaactatgtaatcattgtgtactatatgttataggttactattgtattagttagccattcaattttctatagatgatgtagagcatgtggctggatactattaaacttg

SEQ ID NO: 99084 - DNA, 518 bp, Oryza sativa
tgaaagaggcaggtttgatcggaagacacagagcatttcaacagtcggtggcagaactgaagacagtctttttttttttttttgatggcgaactgaagacagtcaagagcagaggaagcagatgaagaaatggttttcagttcaattgaatggatgagtggatagagcgagaccatgggccggtatgcggcgccatacatgggctgaatctccggcccacacagcacagcccacaagtcacagcgaactctccgaccgttgggggtcggaaaagaattctccgagcccctactgggtccaagacaaccgttggatggaggcgtacgtgcggctaggatcaaaagcttgtaatgtaggcccattagaattgctgcccggcacggcccaacccaacgccgcgcataggaataagttcactttgtgaccctcaaaagtagtcgaaatctaatctataatcctaaaccacaaaacaagatttctcgacccctaactctcaaaaccggtgcaatttgactccc

SEQ ID NO: 99085 - DNA, 705 bp, Oryza sativa
gctagtctcggtgagcgggtgggccacacggcggtcactggcaggtgggaccgggatggcagagagggagagccgttgcttgaaaacgtttgcaaaagtgggggaatccaatgagtggcagagtatagagccagccgttggtgtatgcttttctttctctttctttctttcattcttttttttttttgcagcactgtatttctgtatgtgtcctgaattcctgatgcaaatgtattaggcatactctccggcctcaattctcccaacgtcaagtatttgtcatcacagttcatttgatgttgatgttttagctatcccagcgccaaaaatttttcactcgagggagtaatttagttcattgattaataaatttcaagtaaattttacaaaactatataattaaaaatgggtatcataaatcaacaaatttagcgtgaaatttatcacaaagctataaatttaaaacatcatatcacaactacatatttaataataaagttgtcaaacaactgcagattttagagtctatatccatagcactattgagattatcaaagttatagttttgtgataaaaccaatgttaaatctatatgtttctattatgattccttaaatatatagttttgtgataaattttcttatatacactttcttaaatctgtagtttcttaattctgtaaattgtgatagattgttcaaaggg

SEQ ID NO: 99086 - DNA, 1297 bp, Oryza sativa
ctcatgtgcggacaattcaaatccgtcagctactacgcgttggtttgtgctttgattggctcaccatctcttctacttctgtatgtcttttgcctcgctgaaaatctcagctgctattgagctcccaattgtgccactgacaggtacatgtaactgttcttaacgacattgacgcgctcacgcgcatgcgccgctgcactggacacgcattgcacgctgccgcttgctttctatggacttcagttaaagcttgagcgtatggctgaagaggagtaagagaaagtcagaaagattttatctcgacttgttagcacgtttttccaaattattaaacttacctatcaaatggtatgtttcgttgaaaattgtctttgctttaaaatatcaaataaatctatttttcatgtttaaaatagggagaatagctaatatggtcactaaagtttcgctcctgggtcattttagttcttaatattttatattgtccaaacaagtcctttaaatttgtcatgtgggctaatatagtccttggtcccaccaaaatcgccacatggacatgccatgtcaccttcctatgcaaaatctatatgatttgtccaatttacccttacgcataggaaaataaaaaacaaaaggaaaaagttaaaaaaaatatatggtatatgcaagagcaaaaatatacctcaaaatggtgaaaaaaggaagtattttttcctatggttatgtctaattcacccttatatttatttttctatgatatacgtaagggtaaattggacaatttatttagattttgcatgaatgatgacatggcatatccatatgatggttttggtggacccaaagactattctaggttttatgacaaaggttaaggatttatttagaccatttaaaaggttagggactaaactgatcctacagagaaactttagggactaaagtagctattatctctttaaaataattaaaacttaggacctgttcagatagatatcatttcaaaccataccaatttttggtaaaattgtgaaaatatgtgcatctatttagtttcttactaaactctgataaataagtaagaaatcctactaaaactttggcaatattgtcaaattgccaaaaatttggcaataccaaaatttggtaaggtttattttggtataatccgaagagaccattaattattcatgcactatagttcaactttaacctgttttttccacagcggttttaaactgttcaaccagcattttgccaggatatttgacaccctctcaaggatgtgaggttggta

SEQ ID NO: 99087 - DNA, 1054 bp, Oryza sativa
atgatgtgagtgctctctgtttctctctctgacctaagctctctcagggtctcagctcttcaacctagctagtactccatctgtctcataagttttcgcttttactatttgaccacttgtcttattcaaaaaattttgtaattatttttttttgacttactttattatctaaagtattttaagcataacttttcgttttttatatttgcacaaatttttttgaataaaacgagtggtcaaacagtgcaagcaaaaactcaaaatcccttatattataggacggaggaagtacttgtttccaagcttcctgcattgtacactataatattctagaaccatagtcttttattactactatcctagcccaaaaatataataacatagaattagactaaatacattttaatactacgaatctggataaagtagtatagatttgtactacttaaatatgtcctgtcctttctatgctgttatattgtggacaaagggagtagctagtaggtacgcaaaccatttacatcatcacattaaaatgggaactagttttaccatgcatgttaactttactctccggacctctagaacatatgttttccttttcattagttctcctaccaattttgacattgttagtagcatgttttgcgattaaatcacaaactataaatacatagaaatgtttcgttgcaacatgcatatatgtggaggtgagccatgcatgcgacccataacaatgacacaatgccaatacctttgtcccaaagtgtattaggttgtgttcgttaccggtggttgaaagcaaatttctcatacatgaaaaatggaacggtctaatagcacttggttaattcggtattagctttaaaaacttaaaattagattaattaatatgctcttttaaagtatttttttataaaaaccatactatttaacaatttaagaaacgtgcgtgcgaaaaacgtaagagtgttgcaaagaacgcaaccttattgcattgccgagtgtagtggcactcggcatcgatgtccttgagtgtaaaatgtcaggatct

SEQ ID NO: 99088 - DNA, 687 bp, Oryza sativa
agtcaggcagcaatgtagcataaatggcatgtgctttaatgtcatatcgtcgccgcataaatgtgacataattggactgttctatacatgtgtggaatgagttgatgagaccttgatgattttcagggggagtgttaagtacttgacaataaacctagctataagaattttcctctgcaaatgttggaaatatattagcactagcatagtggtggtgatttttcctacaaatagaataaagctcccacttgggtttgtatttggagagtctttggattaagtctgtaaacctgagtttatttgagttacaaagcagatccatcaatattggtggaattcaatttctctttatttctgagcagcacacgtagtaattctttaaaagggtggaagttgcataaactgctaatttacttagtttcgtgggaataaattttcaggtcataacatattaaatcagtcagcagtaagagaaaagttctgtatattggatcatcaccatctctaactgactagaatcaacacaaacatccttgcagtaactattttttttaccagttcttaacctgttgttggcggtatctaccttaggttatactctacctaaggtaatgaattagttttatcatttcaaaaattgctggataccctctaatgttaaataattcacttcaaggagagctatat

SEQ ID NO: 99089 - DNA, 1034 bp, Oryza sativa
ctgagctacagagactactagattgatgagtcctagcaaaagtggaacacagtgtcatagtgtgcatggtcctagaaggaaaacttcattgtgttgatatatactctttccttttctttaatactaattaatactagataataccgttaacttttacatacacgtttgattattttgatcttattagaaaaaagctagcgataatttcaccggttgatttgaccaaatggcacaataattttctgacacgtgtcataagagactgttaacaaccaaccatcaactacacaaaacaataagttgacatacacccactaaaaattgaaacagtcatccagcgaaacgcaatgcaaacacaatacgttctgacaaactcaaaatttagggatgatatgtttcatcataaaccaactctcatcacagtcagaactcaaaatttagggatgatatgtttcatcataaaccaactctcatcacaacagaatttagggataatatgtatcatcataaaccaactcagatatagaaagaatgaatgtttgattcaactagtagaactgtatagggacaaatcgtatatatcaccaagaccaaaaattcccttgcaggcaacaggtgacacccaaaaaatgaagccaatcaaagaatcagtatgtctctatgaggttatgtgcatcctatctctgtgcaattatatgtgcagtgataaaaatacctgcaacacgcaaaccaacatatgagcaaacattatcaatagaaaagaacaaagtttaggacaatgtttaagtcaaaacttgggaatataaatcatgaataactctcaagttgttgtgtttgaaaatgtaaaaattatatgaatatatttgtcttgaaaaatactttcataaaagtatacatatatcacttttcaataaatatttttatagaaacaagaaatcaaagttgtgttttggagaccgtgtcactgtcctaaacaacttcctttacgagtacggaggtagtatgtatttggtccacctttcagtagttgctaa

SEQ ID NO: 99090 - DNA, 556 bp, Oryza sativa
acttaattactattccctccgtcatacaatataagagattttaagtttttgtttgccacgtttaaccactcgtcttattcaattttttttacaaatataaaaaacgaaaagttgtgctcaaagtactgtagataataaagtaagtcacaaataaaataaataataatttcaaaattttatgaataagacgagtggtcaaacgttgcaagcaaaaaacttaaaatcccttatattatgggacggagggagtaagtgttaaaatatgtgtgtttttctgtaacttcaaccataaaacataaaacatttagttttctgaaatttactaatgatagtatgaatcgagaaaaaaaaagtatgtgaattgggtggcaaatttctccaatttcaccgtcaccgcctcattctttccgatcctccgcgccgcgctgctcggtgctccgccgccgccgccgccgccgcggttcaccgcaacgagcatactaccgcctctcttcctcgtcgtgccctagtgggaactgggaacccccgccgcgcccagctggtaagcgtcgcgctc

SEQ ID NO: 99091 - DNA, 603 bp, Oryza sativa
tatttttattatcttagtttggatgtcaatccattaacccattaactttgactaaaaatctaaaatctgcttcggaaatgttgctgcgaagtggctgtcgtttagattagttcatgaagagctaccaagtaccaagtgagattcgctcgctttggcttacttagttgtaacaaaccaatttaaaagacgaattggtgaaaattggagcattcgaggcagtaatatgtgaaatttgagattgatttggaggcggtgtgtgcattgttagcattacaaaaccagttgtaaagacaaacaggagaatctaagacaggaatgtgtgaatttttttttagattttatagtctttttcaatcctcatgctggacaatcaacaagaatgtgtgaaaatattttattcaaagagttctaactcatgctggacggtaaactttagttagaaaatagtgatggactcgtatttcctgccaaaatcactatatagaaaccatatgtcaaaatctgtcaaaactaggaactacatgcttcacattgttatcaacataatgaatgagcaagcaagatgtcaatctcaaactgaatgaatgacacaagcaagcgatc

SEQ ID NO: 99092 - DNA, 1099 bp, Oryza sativa
  unsure (1)..(1099): unsure at all n locations
ggaggcggaggcggaggaggacggggtgagcgcgagggacggggaaggcgagtggcggcggcgggagcgcggggtgcccagggcagcgggggagtggcggaggggaggcggggatgagggcggcgaggacggcggcggcggcgcggtgatgcgggtcatcgccgccgacgaggtcgagtgcttgccgccggagaaagagaaatgcggggtttggggtttgggatggcaggtcaggcctacttgtccatgggccttagaaacaaataagtgggcttttgggcttttgaagggaagtgaaccggtccagccagtaatggcatgacatgtgggacctacctgtcgggctgttccactacctccgtccaaaaatattatattttgagatgcttctaaaaatacattttttgaaacatactacagcgcagacgctcacaacttacgcacactcacccctatgaatacacgtacacatatctttcccctacgggcactttcaaaagatgagaaaattgcttatagacattagtatattaccataaaaattatatacgcgtatgtaaagcttttattagtattttagtaacatcaggtatttgttgctacttcctccgtttcacaatgtaagataattgcnctatttttgtatttcaggcatgcatggtggatcctgaccataaaacagaactggatcttgacacagaatttctgacaccaatgtctttgcgaaagctaccgagaaagctcactcttacagcacataatacatgcaaaggcacatgtatatgtgtggctggcaatttacaaaatagaatgattttgtagtgaccatctacaaatgaatcgagccattggctaccgcttacatcaattcagagacttgtttattgataagaggaacaagccgttgtaaaatactatatgcctgccgcatctactttatgacacaagaccgtgatgatagttaaatgtacttctgtatagaaagttgcttgggatgttcgacgtgtgctggtgcatgaaaaatctttattttttttgggtaacttctgaaacaaacctattggtttttttttacaggtgaacacaacgccaatcatgt

SEQ ID NO: 99093 - DNA, 720 bp, Oryza sativa
ggggtgtgacactgatatatttgctacacgtgttgtgatttttttccatgacatttgaaagtggcagcatcttgcattggcctttttctgtattttactttatttacattggtttgtgcctctcttcagcattattattcaaggtcgatcagcagttcatcctaccgatatggaagttgatgataaccaaaataaagatgaaagcgctgaaggatacaacatggaggatggaccttccagtcacaacaaactaaatccgttaagtgcagatggtctagtaggaaacagtcttcctaattggcatacatacaatgtgcaaacacctgatctgaatgatatgctattgaacaatgatgggaatgcaggaccatcagcttcatactatcaacctagtcccttcccttgtgatgagcctgcatcaccagagtttgtaagtgcccaggccccggctacacctggcctaatggaagagactgttccttccagagtgcatgaaagtcctgttctgagtccacagcgaaaagcttcaccatcaagcaatgatgaaactgcaaagacagctgaaaatgctaatgatcttgtgggtgctgagacgactgaacttgcattgacaaagcctgtgcaaattgaatcttctggtgctgtacaggagattgattccttgagtcaacaatgtgcaactgaggaattgccaccccaagctgaaacctcaaacttgga

SEQ ID NO: 99094 - DNA, 1093 bp, Oryza sativa
  unsure (1)..(1093): unsure at all n locations
attatcatgcattccatctatatacatatcatgtagtatggccgcaaataaanaatgcgagtgcaagatactcaaaatctttgattaaatcgtctcatgaatacgcatgatatagtaataaagggagttaagcatatgcatgggaaaaaaggaagaaagagaaaaatgaaaaaagggatgggaggcgtacgaacccgcgcacgtaggtacgcacctatgctgaggtgggaccctgtagtatttagtttattctaagatcaatttaatctaacggtttataatattggacctaccgatttaagtggaaagtaagtaatagatactttgattttttttcttataatttctaatatttgccctaatttattagagcaccacgtggtagcttgagagcattttaaggaattttaaatgactaattagaatattaactgcgcaatatatatgtatgggacatatggtagtatttagcttcgtccatgtttatatacatgtatagagaaattaattttgtggctagcaagccattagatgtctaattaatagaaattaattttgacacatatttacaattgttcagagtaactcttacatattcaatttacgacttcgatgatccgttgatcaccaatttactaatcaccatgacttgcatgaaaaaaaatgtagtaaggtttaggatagatgaaattgatgaattatataatttatgtgatagctatttgagggtataaacgaatgaattgctaaaaagttataatgttgtttaaagaagacaccatttagaaacttagaaagcatgcaaacaaaaatccaaaatatggaatcgggaaaaaaaacagagtgccttaaactccatttatcacccttgtcgtagtaagagttctatggatattcgtcaatattacgctcacatttataacataatgattcctttcacctgtacgaatagatagtacaaaatccaaatacgacataacacaaatacattacaattattatgtaatcaattcttggtttcaacttaaatagagctaattagtgttgagaaaaacataacccatggtacttaattattctctcgctacatcac

SEQ ID NO: 99095 - DNA, 686 bp, Oryza sativa
tttatatttcaataatataagtgtctgcgtatacgcgcgggccaccttcctagtttaaataaagaacttagcccctcagataaagatttaaactcaggaccttaagttgctactcagcttactacaaccactagagtatatgcctttgggtaaactgctactgcaaagatgcaggaggagtagatgggttgagatagaagtgtgtataataagcgaaaagagcaaacgggatatatgatgaaaccacgtcggccagtttgatcgtccatcaattggtggcaaaaaatgtgcctgcctgcaaacgctgcaactacgcctgcatgcttgtcggggtaaacgcaaggtgttcttcttcacgccggctgcaactacacctcttgcattcttgttactacaaactgttcacagaccaatacaggtataggagtagtatacaagaagtagaactagatactcctactccactgatgtaaacaaaaccatactccactccattgcctgtcattagcactagtagattctcataacactagcagttcagtagtaccattgcctgtcagcgaaaatattggagtactcgcagtactccaattgagagaatagagtactggagtactttgtcgcgtccttgcgtctgtactagtactgtttgtagtactctgaacaagaaaaacggaagcctgcac

SEQ ID NO: 99096 - DNA, 595 bp, Oryza sativa
cggcgacacggtaaaatggcccgaacagggagcagacaatcgtgaggtgtggggcctgttcttgtggttgtggccaccgcgagggctcgaagaccacgacgacgggtgcaaacattggcaatggtgactcagcaggctaacccagagagatgggcccggtcaacttgccatgtaagtgaaaataggggattatagtgccatgggactcaatgtgcgcaggtttgtgccccgggccggcacaagacaagccggaactccggaagctggtgagcccaacctgctcctgtttctgggcccagaaagtttgtcatgggcctggcctaacataaactgctttgcgatccaagcccaatacatggatgcaggccgtaacagagtaacgctgcccccgttctgcagttcaagtggggtcagtgtacaaaccagcgaagctggatttcttacattttagccattgtacacatgttttttacaaacaaacctctggaataaaaacttattctaaaaatacacatgttttttacgcttggttaaatttcttgaggtcaacgacactaatgttgatactctcatcttttatggtagctaagtcgac

SEQ ID NO: 99097 - DNA, 706 bp, Oryza sativa
ggatgattttcttaagtttggggttagacttgtttgatgtacagggcaaaaaccgcgattcaaatctgggccggatcactagtatagattgcggcccagactgcatatggactaaaaatcttccaaaaaaaaaaaaaacagcacgagctgcgctatcttggtttggttcaaacagcacgatgattttagtggctttgttggcgcgagttgggtggtttcccgcgctcgtagcgtggcaatgttgcagcgtgacgagtcaaccaaaaatagcttgggggtctcgaatcgtaccgcactttagccgcaaacggccgaccgactcgactcctccctccatttcgactcggggctccggccggcctcttcttcttccggtgagccaccgacaattcgattcttacatttcgtgatcgatcgattgatttcgtgttgtaatcttgcgtgatcgatcatggtgtgtcaattaatggcaagggcgtggtcatggagccccagcccggctcgccggagaccgccgagctgcccgcgcctatggtgctagagccgctacggccgccgtcagatgaggcggcggcggaggaggagaggccggcgttaagcctgataggcaatcatcttcatcgtcttcgtcgtcgtcgtccgagtagcagaaggaggtgtccaaggacgtcacggtagagtccagagtcgtcgtcccgtcggtggt

SEQ ID NO: 99098 - DNA, 749 bp, Oryza sativa
tatatgtttagtttgttaactaatcacatagttgggaggttcacctaattaggtgcatctattcgatgcaccatattctttatcttttcgccctttacagtcttcgtcttcactactcggcaggccttggcatgaaaagtttgaagcattcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattatccccaaatcatacaatcaataagatactcggcggattcatccccggacaggagtagggtattacttcttgaataagaaggcctgaacctatataaatcctttgtctccaaacccattcacttctccagcttgatagccaccccttttcttattgccgaaatctagtttcgacagtatctctctacttttgacttgttgcatgtgtgtgctgtgctgtgctgtggcagttactaatacggtcgccgtacagtgcacggaagacgtcacgtgcatgc

SEQ ID NO: 99099 - DNA, 1095 bp, Oryza sativa
tgctacaccgtttattaaaaataattgtctccctcccttcccatacgcatgcacgccagcgacgactaccgaacgggagaggtggtggcagaggcggagagggtggagcgggagggtgtggtggctgattgtcaaccaccatggcgttgcagacacgctcgttaccttcgtcgacatcaaacgcccatgtcgcacactctgctgcggtgttctcgctgtctcatactgcgtcggcaccgccatgctgttggcgttttcccttgatgactacctgactgatgcctgcatggagacggtctacactccatcctgcaccttggtgtgctgctcgggagctattgtttgtacacaccttcgggcgccgacctttccctttgcttcttccccgtgacggttggttggtctgcaatggcgttgtcgtagcgattcttggacggccacaatagccacgtcctacttgcagtagctcaccatcgacgacacgtgggctcgtatcctgaggcgatgtcgctgctcggatttgacatcgtggagaaaggggaggacgactgcagtggccgctctacctgctcaccatgtgctgcttatgtgtcaaggtgtgggctggagcggaccgtgctcgcggctgtgcaaatccggcagctcagcgaaggatccatgctgcggcggagaaggaagagaccgggagattggccgctgctcctttcccgtgggccaccgcacgtcgctcctcttccacaggtcaccgtgcgccgctacctcttctcccgtcggccgcctgcgtgacgcgccctgtcccctcgccgatgaagagccggaggaaatggaggtagagaggggagatgtggaggaagtgggactcactaactattttttaaccttattagtatttgcctgacatgtgggtccagatattttgttttattttttaaattgttaaattttacttcatgtgccacgtaaatgcaatgtcagatgaagaccgagtcaaattagccatgtagataccacgtcagctgaaaccgcccttcaagccgtcttaagacttgttagagcaggtacaatagatgcttcaagccggtgatagctgtccac

SEQ ID NO: 99100 - DNA, 558 bp, Oryza sativa
ggtgccatggagctccttttcgttactgttcacttgttcagggacattgcacaaattatgagcattagattatatgcctatgattttggtcagtaatagctagttcttgcatgctcctcgttttgttatggttgcaatgttactcgagccgtaagagcaggaagagaggaaaaacaaatatacacgcaaaaatgtagcatctttgtttgcttttaatgttaattaagaacggaagcccctacgctacagcttccaattagtgcttatcaacgcaatgacaacgagaatctctcttatgttgctcctatttgttaagcaatgtcggtggaggtttcaccgaggggaagcaatacctcttggttaattgctggttctgattgattattcattatactattgtttcaaataggattgacaaatccaagtgggctaaatatgtgtcctgtgttatattaccagcaacaccagactgcgaaccatatatggctctgcatctgaatctgaataaggagatgaagacaagccggcgctcataacatacccggatgtagctctaaa

SEQ ID NO: 99101 - DNA, 1932 bp, Oryza sativa
cctctccaaggcgcgcgtcgcgcggggggcgtttgcacgtgaaacgcgagtacgtggaggtggagagagcggaagacgatgggatcgtggatggcgtgcggcgcgcccgggacacgtacgccgcgcgcgcgggggaccagcatatgccggcgtggtactgagtcgagaccgacacgatcacacgagtgtccgccgcatgctcgcagttactagtgccacccaacccaacccaacccaacccactgggtgtacgtcatggcccaggggttggttaggccgtttcctcggcccagcaaatctcattgctcacaattgtgggccgtccacgcatgggagcatatgctaacgggccgacttggtgctaagatttttttttttgagcgattgagcataataaaatttgatgctgtccaattgttgaaggataacagattaaacattgctttacgaatgacatcatatcaaaatttggtagtttcgaaacacttccaaattttaatttgaaggtatccaagtaaatacatccactatatcaaaaatttggcatcaccaaagcttaccaaaatttgataaattggcaacaaagggcatgttcatattgtagctaaaataaacctaaacaagttttgccaatgccaaaattttggtaagatggtaatattgccaaaattttggcagaatttcttatgtattgaccaaatttggcagcagactaaacatagacatattttttggcaactatgctaaaagaatgataggtttgcaatactatttttgaaaactaaaataccacaaagcatatatatttaagctgaatgttccatatatccatggattaagtaatagagtgatcatttttcgctaacacgcaaaatgattgcacatcaatatatcagaagaaaagagttatacttacacaacgcaatcagccagaccgacttatgccaggggaagggagaatagcaaaatataaaactgaagcttaaaaaactactgcggcggctaaacctaaactccaagcagcgggaagggccgagccacgctacactcccaacaaatcccaaaaaacggcaacgccgactaaagaacacatatagttaatagagttatcataaaactacatgtttaaacgccaatttttaatcacaataatacaatatttgtaactcaacatcacaatagtattagcaatttgacctttaaaattctagttttatgataggtttatcaaaataaataaaatatttatagttttgtagattttactctaagacttttctttttagctgccatctagtaatgctgatgtcattgctaccgtcaagcaatttttttccccgagacatgtcattgattatgtcactgtaatggtcacacattgtagtatactcctatatgctgtactcccatgaaaagtcatgagacggcctgtgattggatctttcattatactttgtcaaataggcgagaggaaattcaatcctttcttcttcggacaatctacattggatatacatgttcatatccgtacattcgaaattcagggccaatttggattgctaccctactaaaatttgcagtagtataccaaacacctctattaaaactctacctatgccataaatttggattggcctataaactagtatcatatgggcaaattttggcttcaatccaaataaacattttcaactctaccctaccaatattttggtagtaccaaaacttgcccaagatttggtactaccaaaattttggtagggcatcaatccaaacatgccctcattttgtactttgcatctagatgtctcatctcaggagtagaagattccaagtttcacagataagaatgtcgttgtgaaccgctgcagcatccatgactatactgtatatgcaataactgtgtcacaataatttgatagtaatctgtat

SEQ ID NO: 99102 - DNA, 681 bp, Oryza sativa
attcttacatttggagaatggacgaagtattatatattaacatatacgtagcaacctaatactcaagatgaagtggtactagtctaattaatcaattctgagtattacgtaggtggctacatttttgcacatggagagcagagaaaaatgacttctccttttactgtttgaaagttatttttagcctcagcgtttcgcttattcatatgtttatccacaccgcttattagaaaaagaaatatggtaatacttttacatacacgtctttagcgatttaaaatatctaaaagtaagtgatgtaaaattaactacgataacactacaaaactagcttcaaaattaatctttaaaatttaaaattttgactaagcatcagtgaaacaatgagaccctttatatggttatcatatctcttttaaggttgtgttcagattaagacttcgcacggatgtttttcaaacggttaaacattttatagaaagatatacatagaagttacttttaaaaatccatgttaatttattttattttttaaaattataataattaaatataacatcaaccatactaatgatccacctaaatttaggtatttttttaattttctttttccttctctcgaacgcatccagactctactactgctgttcgatacagggatagatgtcctaaaaggtaagc

SEQ ID NO: 99103 - DNA, 650 bp, Oryza sativa
aaaaggatgtgaacttgcctgattatctcaaaaactatgctgaagatgttgaaatttagtggatcagaagaaattgacttcctttctgttatgcatgccaggaatgtgaacattgctaaacaagaaagcttgttaacggtaaaattcctccacagtgctctgctaatcgagtttgtctttttatctgtcaagggctggttatcagcattggcagtgagaaatgaagcatcggaaggaaggtacctgcaagcaagttgattatctgttaacaaggagtaggaaacatgctgttccacataaaacatgttgtatgctgcctacttttcatttaaacccttgtcagaagttctgtcctatttgttcaaagtagtctcactttctctattcaacagtagttatttagatgcagatttgaagttcataactactatttcggtgacgtataaaatcgataaaacctagcaagctgcagtggtcatgaatgcatgtgtttagtaatcttcaaagttataaatgatgaagctatcaaattttccaacagtttctcctgataatttgttatgttcctgtaataactaatctaagtgttctactgatttagttaaattcattagaagacagggtttggaggagatactaacatgacgact

SEQ ID NO: 99104 - DNA, 699 bp, Oryza sativa
ttttttttactgatgaaggatgtgaaaagaagttttatgaaagattttagaagatattttgtcatttattggatttgatggattgtagcactctaacaaaagtcaaacggatgatgttttcttgaagatgtaccgtggtaatttttttgtgaaagtttaggctccctaagccaaacggcatatttgcaaatgaaaaataatttacgaataaaacttttatatacgcgttcttaacgatctaaaagcaaaggctggaaaataaacttcgatgagaaaaccccaaaatcaactccaaatttaaagttaaaaatttaaattttggctaataagtataagcataaactaaaagatggggctgttagaatgttataatttgagagtataggaagattgtagtgatcgcggaagagatggcaactatcaaagcccaaaattttcgggccaattgttgtcttcactcttcaaccttcatccatgagttcctgataatttcatgttttttatgttgagtttgtttgactggattttacctcagtttgatgtggtccgaataattccatatttttggatattgactttgtttggctgggttccccccctctctctctctctctctccgtctctccgatcattggatagagatggagggttttaccttattttaatatgtgagttgtgtgttcacacttgcaactgatg

SEQ ID NO: 99105 - DNA, 919 bp, Oryza sativa
ttaagtgatactattgtgcactctctgcatttgtatttcctcgagtagttagtgtagattaactcaaaatcatatcctagcctaatgtttcatatttataagatgaaatctatatataatagatcactggccataactaagattaatataagttcatatataactaacggccctatcgtttggcttaatgggaaataatccaaacagtatatttgatatatatatattcttaacgatctaaaaccaaatgctgaaaaaataaattttgattaaagaaaaaccttaaaatcaactccgaatttaaggttgaaattttaaattttgattgataagtataaacgtaagaaaaagatgaggctgtaagtttcagagttatatctatcaattgtttatcctagagagaatatactccttttgtcttcaaatacttgtcgttggatagcgtattcatcctcactttgacagtccgttatactggccaatattgacagttatttgaaaacggaagaagtattatttgcgcgtggaattaatactggccatggaagtggatttttaaatttgcagtatatgtgtaaagtcctaataaataaggatggtgattggaatgatcctacgagacaagactgtgaccctgatgcaggggccttatatatatggtccttgttcttttggctcctcatcatgcatgagcggtgttaagctatgtaacatgttgttttcgtaaaacgtccatttttcaaatttaatcgaaattaacccaagttatcttcaaggagagcaacccgtgtgattggcgtttgatttgaaataactcgggtgaaaacggttgatgcagattaaaactaacacgtagacaccaatattaatatgtcactctcgatttcgttggctgggatcagagattgtgtacagtaaa

SEQ ID NO: 99106 - DNA, 2229 bp, Oryza sativa
agacggtgacatacgagaaattttacagtactaatgaaatttgtaaaagtttagtatataagataaaattttacaccataagatacaatattttttatacattctcgataacaataaaattactcgggtgatggatagatgatagcacgcttctcaaactattaaacgatactatttatcaagtttgtattaactccatcccaaaataagtacagccgtggatattcgtgtacaaagtttaaccgtccatcttaattaaaaaattatgaatttttttaaaaaagtcacacataaagtactatccatattttatcatctaataataataatactaatataaaagagttttaaataagacaacgttgacataaacagtgcaaaattgcacttagatcatgtttgagggagtttctaactattgcagtttctcttagaatcagaaactcctccaaaatttttggtccagattctgagaagccgtagttgttgaattcaaaaaataaagtagaatccagaagcttcgaaacctagctttttcatattctcaaaagtttggctaccagtaatctgcttcttagaaatcttaagcttcatagatagaactttattttatttcagtatgaagggagtaataagtaaaacttaatttattatatactaatatttttttcgttttatgtgtgtcgatttaatctttcatcttcatcatttcaaacagcatgtggtcagatccgtgtcttcaatgttgagcagggaatccattgatgaaccaggcaaccaaagattgcgcaggacccagaccagcgcggtgctcactgtaccagcggcctgctactctcatcattgatgtgtgtttaagttgtactgccacacacaactcaactgtgcaagtacaacgctcaccgacgtaggcatggtgtacttaacaactttttcttccaacttccaacttttccgtcacatcgtttcaatttcaattaaacttacaattttagcgtgaactaaacacacccgtacacatggcccttgtttagtttcaaactttttcttcaaacttccaacttttccatcacatcaaaactttcctgcaaacataaatttccaacttgtccatcatatagttctaatttcaaccaaacttccaatttgaatgtgaactaaacacagcataaacacactgtcgaggggatatatttggatccatccaaccggccggagaaggatgggcagctaaaaataaaatgttgtgaaaaaacaattggtacggccatttatgttgccgttaatatggttaaggggagcaatctgtcatgtatcgatgatagtacatgttgttgatgtattagtcgttcactaacgcatgattctgttattaactgttactccctccatcccataatataaagaattttgaagtgatgtgacgtatcctaatacaacgtatttggatatgctctctgttcagattcgtcgtacttccaaaatcccttatattataggacggagagagcaacagttactccctccgcaaaaaaaatcccaacatagttaaagatgagacaatctagtactctagttgaagagaattaaccgtgcaattgtatgattttcgggtccggtttttcttataaactagatcaattctcttcttctaaatataaaagctagaacaaagttctgcctcggtttcaaaaaaaaataatctagtacgataagtctgaacagatgggatgtctaaattcatcttactagactctatcacatcccaattaggttagtttttttgcgataaagggagtagatcgttcgtttttggagaaacgatcgtatagtcagcgtcattacaaggtactagagctactagagcgttactctgttctctagtatttgatgcacgattacgaatgttatgtttgttgagatatttttttaagtatatactactattataatagttaatgtcatacatatatgtatgttctattgaaatatatttacctctcataaaggcaaactactactgcgttaatatatttgtaggttcattaaatttctgtccaattcctattaatcacccgtgttcatattaccctcactgtcaacatccgtattccatcaaacacgacaccgagaaaaccaaaagtacaccagatatagctcataaaacctctggtaattctccgattaaatcaaagaaagaaggagtattttggattaaaaccttgatcg

SEQ ID NO: 99107 - DNA, 1298 bp, Oryza sativa
ctcctcgtgtcagtgtctttgctcggtgggattaacgtcattacatggagatatttatggcgaagacaactggatgattgtatataaatgtaccatatcatactggatgatgtatataaatgtaccatatcataaagccatgatatttttttaaaaaggaaaaggaaaatccatgcctggtacaggtgaaatttaatccatgttcagagtttttttattttaataatgttttctttggaacacatgaatctttactaattatgcattttacttcgtgaatacgcgtcaattttgtcattagtagatgaacattgagcatacttttttttatgcacgatccaattatttaacatcacaaatttgtatttttaagcactttacaacatgaacacataaatagcctttgcacatgtgttttttctcataaagatcaaaatccacctcagttttggttagcatatttttcaaactactaaacggtgtgtttagaaaaaaaaaattctaagtagaaatcgctttaaaatatcaaatatatatatatatatatatattattgttaagtttgtaacaaccaaaatttaatcgatgagtaaattgcattgccggtacatgaacttgtcgggtgggtgcaatttagtgcgcgaacttgcaaaatgctcgttttgatgcataaacttgtctggtgcatgtggaggaaggcaaaaaggacactacatgtctaatcttattgatttagaagcagattagaatgctatgtaaacatatatatgagaaggttgctattagacatacacctcttcaataaaaaatataatatgatatagtgataggagaaaaggattaaaaaattagaaatatataaaattcatcatttctgtgatgaaggataaagtagagaccaaatttataaatattgtatttcttatgcatactcactacacgtacgcacgtcagatcctaatcaacattagcttcataaaattaacactgctaagttattttggtcctcgttcgcacgaactagaattgaaacgaacattttacaagtttatgtactaaattgcacccacccaataagtttatgtaccgctaatacaatttactcttaatcaatcatatggtgatgacttaaatatcacatgaaacaagcgcatatgggctgtggcgctgggcaaactcggccgaagtagccctgatgacagtcgggcccaccggagactggaccaccggaccacacgatcggtgatcccccactagttgttcctagacgagctaaagtcaaaactgcaatttgaatt

SEQ ID NO: 99108 - DNA, 822 bp, Oryza sativa
acatttagagcaagtacttataataaggccctagatagctctttggttaatttgctctggaaacatagagagatcaaagagaggaatcgtacttaatttttttttaacggagcgcaaaagactcgccggatatattagaaggaataaaattcaaaaacataaccttctctaaaaaaagaagaggataagaaaaaacaacagcagcatgaaggggtgtatttggttgtcagccacacattaccacaactaagattatgcacgttgcagcagtcacaaaagtgtggtagctagacaaattactagtcacaaagtgtgataaagttgataagaaaatatttgagctatggtatatggacattctattgaactaaacacatggctaacaaattgtgacaactaaaagtgtggtgtggcaaaatacagtcgtgaatcaaacacccccatagtatgtgttccttgttgctttattaagtataatacaagagtttccacaaggttataatccaaacgatcatatgtatacacgtctttcaacatcagaatttaggatctgtttttactgaatatcaagaagagtagatttaaatggagagaaaaaaaagactcataaacgtcttgtattttttttcctactactatagtatatgccatgatgctgcctgcccaccacagccattttcagttgaccattagaaatgtaatctgagaatatatcatgcagtgtacgtaaagcaaacaataacatcatagaagacattttgctggagaaaatatacggaactcttttggtttgaaacaccaaagaagatcaaggacaggcaa

SEQ ID NO: 99109 - DNA, 723 bp, Oryza sativa
tcagaatgtagaactatgtattgtaatggtgaatttatgaaaaacgatgtatttgcatatattgtataactatgtcttcttcatcgcaattcaattcccagcatttacttataaatcgctaagaacacatgtataaaaaggtttactacaatatttttttttatcattgataaaccgttatggtttataatcagcataagcaaaacgatgagcttgcattgttgtgatttcaacaatcctcctctgtgagtggtttgtttggtattaccagctttttggttagtattaaatgtctgcaaacttaggtgtggtattcatatggtgctccatactactactatatcattttctctgaaatcttaaatggccgtttcagtgatgctataaccagacagtttccttccaatgatctacattattttgttgctgcaggcctaggtctcctccagctcaaccaatcattgcttcatgcttcctttctaattaaacatacaagaaaagacctttcattttttcctttattagtagtagtacttagtaccgttaattagaagcttgcacatcaatgtggctacctcctgggtacatccaccacactacaccttttcataacaccctgtcttggccatggcttgcataattaagtataccactctaaacaggtaagctaaactaaccctgatgtgattagcaactactgaaaggtggaccaaatacatacta

SEQ ID NO: 99110 - DNA, 2682 bp, Oryza sativa
tcagtcctcctgtggttagataacagtaattaataagcctgaagcaatatgttggacatgttttcatgtttcatgaacatggaagcatgaaccaaaatgctcttgccatgcacagcgccatgtgagaaggcaccttgattttaaggccactcagcattgtttgttctgatctaagcatggataccacggttacagcaaaccttgtacatgtgggggtgtttgcaactgccaataacacagaaacatgagaaccttatgcaactaatggtcgttattcagctgcatgtgatgagatacgaggaatttttttgctcatgttttctttctaattgtgtcggatgtgtttgtgcctcagtttctgcattctgaagagaaattcagggagatatacacacatggttttacagaagaaagatacaggggcacatgacacttaatctgatattcatgcattagctgatgtttcatgtgtgtgtaggaccaattagggcttaattatagcagcaaactaacagtcatgtgagaagatatcaaggtttcagattatgcctggcaaacgttagatagctgctccatttctgaaaatggcagaggtactaattataacgacatatacaatagtcgatatctttcgtcagtactatatatatgctctgcaagataagctctatgacaaaatgctttttcatggttgaaaagaagtgcaaacataaaccaaatgtgttgatagagtcttaaagaaaaactaaatgtgctgataccattcatccgaccagatcgttggccacattttgtgcgatcttgctgtcgtaaggatgcccagctagctaaccgctcctgtcaaatgctgatgaacaggtagcacatgcaattagataatgacgcgtcagcgctgttgatacgatggctgcatgcagaggaggagatatatatggattaagatcacagatcactcctgctgtcattagaattctgaggtttgatgaattgcttaatactccgatccaagctatactgaatattacgtatactgatcatgatcatgatcatagcacactcatgtatggatgcagacatagtggccatactgtccaatcatccgtatgacagagatctatatatgcatcaaggtttttaggatcttcacgttttgctgtcttgtctggctggcccgtagctgatgctcgtgtccagaaataagcaggcagagaaacagttcgtcagaatgggcagcatagtattttttttttctccaacgcgcgaaaaccttacatgctcgtatatattaacaatttaacagaagaaaaaacttttacaactgcgaccaactgacacaatcataggaggttataagggaaagggggaaaaattaatcaggcatgaagctaatatcaaagggcaaattaatctagctagctactacagctagcaccagcatgagcaaatatacaacagggttgcattaactgatcgatcagctagctcccctcatggtgatcatagagatgacgacgaagacgcagtgtggatcgatatgaaggagagatcagcttgcagctgcagctatgcaagctcactgaggctttcatcggatggcctaatcaatcaaagaaaaagctaaattttaaattttcaaacttaattttaatattgattttgagatattttcaacgtaacttctttttcagcattgacttttaagtcaccaagaacacatatataaaagttttatctataaatttatttctattttctaataagccgttagaaaaagggcttgacagttgtacgagacgacggcaacggcaccgtacgccgtcacggctgcgatatgaatccacggcaagtgatccgatgcatgcatgtgttgcagggatgcaattgcggcagtgcctgccttgtggtggggacgtgatgctgttggatcatcgatggatggatcgagcaggctgcaggcagatcggcaggcggtgtcgtcgatgcgtcatgcacggccggtccgtccgtcgacatgcatggagattggagacgacagccgacagcaaggccatgactgcaacccattaatgtataactccgggtttcctggtattcatcgtgccagtggaggaagcagatatatctaacgttagtattaccgtaactaacgtgtacagtaggccctatcattctcggcctcatatgttaaccatcacgtcagagaaaagttacattagaggatctaaatccccgatgagtgggtgttttaattgctccctgttgatatgtctcaccagttatgttttccttttgagaaaaacaatgaaaatgttgagattcataacgtacgcaccctctcaccctataaaaacacacatgtaaacctcatccttatgagcacatttaaaaaactgggctagcaaatcttgagattaacaaataagtcactacgttgcttaccactgaaaaaaaataaatgcgagtacccgtatcaaatcttacttggactcgaatgggttagttccaccataaaaaatctaatcaactaaatcataagaaatctaatctgttgagctacgctcatctcaaacatttaatttctaacacctaatatgcacaaacacacacaatattacatgcgcttatcaatatacccttaaaacacagtaaaaaaatattacttcctccgtttcacaatgtaag

SEQ ID NO: 99111 - DNA, 673 bp, Oryza sativa
aaacactggataagggactctaacccttttttttttcaaaagctattttaatacctccctctatctcacaaacaatactccattttgtacaatttaaaatttctcccacgaaaacttcacttctagggcttacaacttacaaccaatcacactaaatcatgcgcattgaactagagcctaggaaaatataaccagagatcccactattaatttttctgagaattgctagaaattaaatcttcatggatctgataattttttttttcaaaacacaaattaattactatctccgtcgcaaaataagaacttatagagctggatacatgtattaagaaaacagatagaacaatatggaagaatattgtgattggttaagaaataaagatacgttgaatgattaaggattgtgattagttggatatatgatgttggtaaacatactcctgttcagattcgtagtattatgtgtcttatccggataaaatctcttatacgttgagacatatgagtatattttagaataaattctaaaagcttgaagatgttatattttgaaacggagtgattaaattagttaattagttaataatcccattgagaaatggcatttcattttccatgggtgaccaccaccaccaccacctccctctaccccgccctgaaatctgaataa

SEQ ID NO: 99112 - DNA, 677 bp, Oryza sativa
tatttcctaattgtatttctatatggactctatactctacttctaatatttcttatttttaattccgaattttagttatttcctaattgtatttctatatggactctagtctcctcttctaatattctttatttcttaattcctaatttcaactatttctaaattgtatttctatatggactctagtctcctcttctaatattccttattttttaattccgaatttcaactatttttaaattgtatttctatatagactctagtctcctcttttaatattccttattttttaattatgaatttcagctatttctaaattgtattactatatggactctgccttttctttttctctgattaatgtgagaatttctaggtcatgagagcgaacgtggaggctccttttttttctgaattttagttagttttaaattcctataaggactctatactctacttctaatatttcttattttttaattccgaaatttctattttttttcttaattatatttctatatggactctatactctacttctaatattccttatttttaattcaaaatttctattatttcctaattgtatttctatatggactctatactctacttctaatattccttatttttagttccgaatttctataatttcctaattgcatttctatatggac

SEQ ID NO: 99113 - DNA, 1045 bp, Oryza sativa
aaaggaaaaaatgacttgtgacagaagaagactgctttgttgtcattgaaattatcttatcttatatgcacaggcagacagatttcttgctacagcattataaattggatgagaagaatgggagtgcgcatgcacaagaagaatgggagatttcacggcaagttggctttggcgtacaaatggtccatacttcatagaattacagaaggtcagaagctctccttttcttatagggctgtcagctctctgcctagactcaagcttgagctaagcctatttcacctttgagctttttaagcaagctcgtccatataagtagtacaacgaatattttaatgacaacctctttataagtataagtattttccatgtaatcacactaataaaaagtagaaaaatgactaagataaatatatgatgccaatacatgctaatttattgtgtagataggtgctaatatatatttatctattagcttatcaagttaacaagatgaataaataataaaagctatacacagtaagatttggtaggacctcgagctcgccccggtaaaactcgtaagctttggcttaggctttgggtctttagctaaactcaaatcgagcttgattttttttttggacagctttactttcttaccggaattgagctccataacgatagaagccacaacgaatttatgttcaaatcatcacctaacgatagaagccacaacgaatttatgttcaaatcatcacctagttaagatggattgtagttgaatttgcatgtttatgaagtgacatattatatattgatctatcctactaaattttttaaaatttttgatgactttttaagtaacatgtaaaaaaatggatgaattgagttttccggattgtagctttataagttgtaacacgacaaacgcacttttttaatcttcaaacacttctcactatcttaatataatttggcagaaaaaaaagaatttatgttcaaatttatatccagatcaggcggtgtacaatggtgtttttgctctggaagtatgcaccctgtt

SEQ ID NO: 99114 - DNA, 9388 bp, Oryza sativa
atgctaacacctaacacccaccctgatgcatcacaacttgactttttttgtcctcatgatttttttattgacaataagaacccaaaaatccatagcaaaaacaatccattcatcaaacattaatatataaaatcggggtactcgatcgcatatcccattccgaagactaaacacacccgaactatttatttctaaaagagagagagaaaaaataatctctaccttttcgcggaactatttacgacgacgtggcgtctccctggatcatcatcaatggctaaagctaagcatttttctaatgcaaaaaaaaacatacacatacatgtccccccattttccctttgctttcatgatttaattggacctgtacacacacacatacatacattatattacactcttctgtacgctctgccactacattcccgaggcatctagatacatgggcagagactctcaagtatttttgatagaatattttagatgggatttgataagccgaattcaatatttggacattgataagctacctagctgaagctgaagctgaagaggaggcaatgcccatgacttattgacatatgcgatggcgggggataattacggcgaaaagcggcgagatccgcgggagatctcggtcgttcgtggctaatcaagtcgccggttgggaggaggaagtaggaggtacgcggcctcggcgtcgcgcggcaccccgcggcgcggcgaggggcggggcgtgggcgacgtgggcgaacggaggccacgccgcggggcgcgcggcgcggcgcggcgcgacgtggccggcggccgcgcgcggttgcggttgctttgaggatttaattgggtggggaaggggtggtcgtggaaggatcgcggccgtcggcgtcaaccgcgtggatggatggatggatggatggatgacgtgtagcgacccttgatgctggccgttttgggggtgggggtgggggtggtcacgaccgacctcagtgtcagtgtcactgtgtttttctgccatttaaataggagatgccttgatcattccaaaagtccacattttcttttattccttttattcaagcctttttttttggggggaggggggggggaagtgttgggtttttttttctttaagataattcttcaagttggtgctgcatatttgcgtgcaaatgtattcgtgcgtatgtaaatgtaccatatccatctcattaaaaaactcaatcatagatacgaatctggacacatgtttcatagtgaggattgactttttttttattgtatttttttacaatgttccatttgaccttcccaatccatcttgagcaaatcttagccgtggattatttgatgtttatttttcgtaaaaatatattaattcttttcattagcaaatcatagaaaagaggcaagtagctacatatacatctaatcagaaaattctctttgccaagtgttttatgttctatatccttacgacatacaatatcacctgtaacgtctgaattatctgaaccgatccttttctttatgtcatacgaaaaacagacacaccatcacacacgtacgcggggagcagaaaagcttccccgcgggggaattattggtcatggttgtggctgatcgagctatctgtagcttaagtagctatagcttagggttgacaagatataacattagccattaaaatccgaaaacgaaaggagaaaagaaaatataaaataggggcatgcatgaagagagaggccctttgaccctgcgttgaacactgttacggtggatgcatccgtgcggttggagagatctcgccgcagtggttgcgccgttgccgtcagtcataacgccgttgacatcttctccctcttctccttcttcctcttctgtacagtggtacggtcacaagtgaacattccgtgcactgatcattgaaagctgcatctttgcagattaaataattatataaaacataggggcctatagggagctactcactcccattttaaatatactaacttttaatcataatgtttgactattaggttttttctaaaaagaacagtataaataggcttaaaaaggattataataacagaaaccgtcataacataatagataataattatatcgattttctaataaaaatataataataaagtatcaataatatcgtatatttaaaaacaaagatagtagtacttccttcgtttcatattataaggttttctagcattgtccatattcatataaatgttaatatctatatgtgtctagattcattaacatctatataaatgtgagcaatgctagaaaataaaatagaggaagtagtacttttgctactatcacaagctagggaggagggacccaactgaccaaactgggagcatgtggcctcctctctctccactgaaactaaacgaactctggttgattaattaattcatctgggtaccatgtgtgtaggcgtggcaccactaatctccttgattagttgattaattaattgattattaagcaaccgtacgtgtatctctctatatatgatcattgtcttggttgtttggtaattaatcctcctttgcttgttcagctgcacctctttctacctagctagctgcttctttttggtgaaaaagacgtacttttttagcttctggggatatgtaacagaagagagaattgcatgccttcaagaaactaccttaattaggtaaaaaaaatatctcttctctggagtattaattaattactgcaaattactccatccattattttctaatatttcataacataacacacacacacacacacacacacacacacacacacacacacacatatatatatatatatatatatatatatatatatagtatgtaattaactagcatctcctcgtcctccaaattcgtattttaatcctccactaatctcattggttgcatgtatttttaatggggtgatttaaattataggagacgataataattctttcttgatctttgatttagtggttgtatcgtactccttccatccctaaatgtttgacgccgttgtcttttttaaacatgtttgaccgtttgtctattcaaaaaatttaagtaattatttttttcctatcatttaattcattgttaaatatacttttatgtatacatatagttttacatatttcacaaaagtttttgaataagacgaacggtcaaacatgtttagaaaagttaacggcgttaaacatttagggaatgagggagtataattagtaccaaagggacagttttctgacgcaaaaaattaattagctagccacaatatgtaaagaaaattaaccctcagatgtatacattttaacagataaaaaaaatatacaagaaattaacaggcgacaaatttagtgatcattgactcgatatagttaacttgcatatatatcaacttgcagacaacacaaagccttcatgaataatttgtacgaatacagttaatacagagagaggcgagattttttgggcatcttttcttttcaataatagataaaattaaggtatttcgagttaatatggatcgagtagccatcgacgatatctctctgttctcacctgatgttcctgccagccagacgcaataatacatcaattaattcggtgagatcgatcgatcgatgtgcaggtttcgctagctccgatcgacgaccaaattattagtgtaagaaatcaactaattaattaaacaaattgcgcgtgcgtgcgtggcaaagagaaaaaaatggaaggtacgctacgttcgtcgtcaatttaattatttaatcgtgggagatgggttgtgtgtgtatcttgagctagattaattagctaaaatagcttagcttaacgctgatgagtgacactgacagcgagagagggagtgtgtgtgtgtgaggtcgacgctgctgacttgctgacggcgatggccggccgcgtcgatcgatcgatcgataatcgtcgacatggcggatcgccagccagccaaacccctaattaacgttattaaccattgctataacttctccgatcctcaataaattatccgtgaaagcaaacggtgaaagcattttcatcccctcgttttttcatataactaattaagtcttatctgtttcagtttaagattattgtaatatagattattgagccagattactgtaaactgaattataataatacgacatagaataaactggtagctgttagctacccaataattaaaaaacacctttagagcggattaccatattgtagtaatctggcttatagattatactaatctatcataataagctatttgtttgtttcagtttacttcttattatccagactataataatcctgagttgaatcatacacgaccttaaatagtcatcaaattttttttaagaaaataaaaagatatattaatataaaatatgtcattttactaacacataagttaaatctaacttctacaggttgtaatagaaataacaaatataactgtgaatgtacgtaaactatttttattttatttttttttgaacttgtagaaatagaatttaacattacatgtttatagtgatttttttaaaaaaactgtatgactatttagttgttgacttgtaagaactacataggatgaccctcgaaaatccatttcccaagcaaagcggagcgttcggtcattgattcgatcgatctccatttctctccgatgagctcgtcgacgtcgacgccaacgacccattacatatgtacagccgcagctgctcgccgacgtcgacgtcgccgtcgccgtcgccgtcgcgggtacaaatcgatcggattcaacgtggttggctccaatcgatcgatcgatcgatcgatcgatcgatgagcagctaggtgactgagtgatcagtgatgagtagcttaagtgtgtgtgattagcgagtgaaaattaggcgggaattggattgaccagatcgccgaaagaggcgggcacgcacgcacgcatgcatgcacgccacgaggtcgtcgtcttcgtcgtcgacgacgactcctcgtcgtcgccgtcgtggcgtgcactgatcggccgccgccggcggccgaccgcgcggcggcggcggggggagcagagtgcagtgtagcgggatgggttacatccctgtcagagctaggattaagttaagcagcttaggtatataggctataggctatagctaaggtacttactttattttagccctttttggactgagaatatttaggctcgaatccaaccatcaaattaaaatgtggctttaattaatttctttagtgatgatagaacaatgcagtagtgcatcatgtgcatgcatgtttggaactttgaattggatttggatgagaattgaagaattcgagaagagatatatcgagcatgtgttagtgcgtatgtacggcttcctggaaacttggaccggttcttgcttgctgatatacatgctctgtgctttccacgtatgtggaaatggacccagggcttttgcactttcggtatggaattaagttgtcaatcacaaggatgtgtcaatatatatatgcatgtgcttttcccctccaaaacaataataatgtagcttgtagatcgataagatatgcgtgtttttattttagatagataatggaaataaaaagatgggcatctttttttaaaaaaaaaattacaatcaattgttacatcgttcgtaacttagctaggcaataacatcaccgataagatatcctgttgttaaacctccatcgaatggttagcaaagaacaagctaggactctatgcaaagcgtgaatgcgtcataaaaaaaagtaactgagatttgacaccaattagtataataaatttgaacaacctcacgtcttttaagtgtaatgcgcgtgttaatgaaaagtaaaccggaaaacaaattggctaaatatatgttaaatttgggcatgaattttgttagcttaatcgcttgtcaattttgacttaaatgctaacattattgaccgctacatttttaggaaatacccaaaaatgattccatatatacatgtatgaattttcctagaattttttgtgaaaatttttagttggtgtacacggtgcgtacacgcgagagcctgtgtgcataggatacgtatatatatataacattttagacgaaggagggtcagatctatcagtagtggttaaccctctcatctcacagtgtaaacacgagtattgaagggaaaaaaatgttcaacaaaagggcaattaataattttgttcgtcattgccttaatttctttcctgaaatgtgtgattgccttttccttaaccggtatgcatttcctttttagatagttaacagaaatagcaaactcttcccgaaaccaggcccccaacttctaactttccatcacatcacatctaaaacttttctacacacataaactttcaactttttttttccaaaacttccaactgtttttagaaactaaacaccgcctatgcttacaacgtacacatatatacgagtttaggcataggatttgtttggagagctcaaacttttaaatttaactctaagaactgagtcagaaacaaagttgagcagtctaattaaactcaatttcatctctctaattcattttataagagtatttttaacttattagttttacttattttgatgtagctaaaactgtttggctagactcaagctgaactctagttaagcacgtatgcgaccgagcacacgcaagtgatgttttcctaacttgttctaagcccaattaatccaggcatccagctagctaagctaagctaaggtagctaggtgtattgctgtacaccatgcaaattaagcacgaatgcatgtgtcccatacgtaagagacactagttggactgcttgcttgcatcgcatcatgcacaggtcggtcagctgctcgcgttgcatgcgcagctgctttctgcgtcgtcgtcgtcgtcgtcgcgtctccacctggggatcggaggaggaggaccactcgtacgtactccctccttccctgaataaatgtttgacgttgttaacttttttaaataagtttgaccgttcgtcttattcaaaaatttttgtgaaatgtgtaaaactatatgtatatataaaagtatatttaataattacttaatcttttttaataaaataaatgatcaaacatttttaaaaaagtcaacggtggtgtcaaatattttaggatggagggagtagtcgccgtcccagccacacacatggcgcgcgcctccccctcgccagctgccggcgacgaccaccgtaccacgtcgacgtcgcccgtcgccgccgcacgagagagatcgagagagaatcgatcgatatgattaattgcatatgatcattgcctcatcggcacaatgacacgtacggatgagagatgcatgcatatatacatggtcaataatatcagcacgttgatccgtcagagatctttgcaaatatcgcgagccatgccggccggccggccggcgccggagaagatgcgtgcgttgcatgtgtagcacggtggcgtcgtacgtcggcgatcgatcgcattctgcaggatctttttccgactgtctgaagctatctatctctgcaagtcttatacatttgacacctgtacatgtacatgaatgtacacagatcagtaatctaattaaagtgtgactttgctagctgctcatcgatcgatcgatcgatcccgtccgtatctcacatttggttgtgaggctaatagctaaggtagcaacgtacacagatcttcgtatcaaaaatgctagcttagctaggggcgtcgcttgtagatctacgaacaccgtcctgtatatatctgtagaactctttttccagcctagctagctggacacgaataatttaattcttgcctgaccaacttaattaatttcgtccaaccagccgacacatgtagatccatccatcaatccgaactactgcctccattttatattataaattattttaattttttatagttaatcatttttaagtttgattaaatttatattaaaaatatatatattaatatttttaacaccacaatttggtgtttaaattttactaattttttttataaactaagtttgattaagaaaaaaaattcaaagcgacacaatatgaaacagagaaagtacattgcagtatttagtagtaatgtgtagctagttacgtgtggttggtttacttgcaagctttggtcactgcaacggcaacacaaatgctggaaaaaggcagctaaaggctttcaagtgtttgaaactaaacgtgatcacgcattgaccgaagctgaaagtgatcagatttggagattttcgttcgtgtcccgttaatttcttcttcagacaagaagaaaaccctcaattaattaaaggcgcacgccgccgtgccggccggcgatggagaccgccgcgccggcttgccggaaggagcagcgacatgcatggggccggagctccaacgacggcgaaagctttcggcctctcgcctttttccaaaatgataggtcagttttctcaatttccaggggaggaggacgacgacgacatgttggtagtgttcgatatggagaggtataatacctgaagcttcttggtgccttcagagagagataaaaaaaaaagggtgtcttcttcaattttttcttttcgagttaagtgttcatgaattgaaactgcggtggtggtgtttgaaactgatgaagatgaagtttaagttagcacacgtaaaacgagaaaacttaactcgaggtaattagtttagtggcaaatggatatattcgatattttaaagcaacttttacgtagaaaatttttacacggaacgcaccgtttagtagtttgaaaaacgtgctaacggaaaccgaggtaaaatctgtaacttagtgagaaaaagaacagggcgaaactattcgatgattcttgttcatgcaacaagaacttgtatcagtttttgctacgtcagaaattcaggaaaagaatcaaagggatgcattggaacaaagctggaatactaggtagctgatcatctttgtctgaattaaacaaggaactggaaaaaggagatgagaaggaactataacagcaaacggcgatccgatgattgcgtcgaatatgttctgctctttcctctgccttttttctgcattggtcatcagtatgcatgaacgtcctcatcagctagatatgaatggatggatgcattccaacacgtcatgcagagcaagttgctttgaaagacggaaaaaaaaaagaagtgttttttccttgggcttagttcgtcacaagagattccttggttcttgccaatctgatggcatatcttttatgatgtatatttcttt

SEQ ID NO: 99115 - DNA, 2243 bp, Oryza sativa
tttttttaaaaaaaatatatatctctttttttttatagtatattcaggccatgcatgcgtgtggctgtatcctcatcacattctagttgtcacacactatctcaagctcttgaataaatgaatagtgctactacttggatctgctcatctgacagaggattgaatgcatgtctccaagagggcaatagatgcaaagatgttgatgtagtatctttttaattaaactatgccagataattcaacaggggagaaattcttgcagtacctgaaagttgaaactcttatctctgtctctgaactgagccattgacaatttcatggatcaatcaaccctgcatgcttgtgagtacaaaactttatcccttcaatcatgtaaaccagattcagaagtcacctctgtcccaaacaagtcaaagtgcactgcactgcaaaggattctgtgctaactggactttgacagggttgcaatgctttcagagttcatagcaacggaaatgcaatatgagggacagcttttcttcgctgcagaaactagtttctttattcagcaagtaggagtacatggtacatgattgttcagacaattacatgtaatgtgtgaacactagagttacaacaacattgcagcaaaatttgatgctacagactaatataattactcactaccaaaggtttcataaataatagtggcatgctgtactctactttgacctcagagcaagcctatgtaaagctagatactcctagtacaacaaatgctaaggtccaagtgatgtttttcacattggcaacacccttcagctctgaactgttctacttacagttacagtaatacagtcaacactgtatatgcagccaacctcctgcaagaagcagatgatcctaacatcctgaacttatctacaagaattaaggagagttgcaaaattaacttcacacagtatcatctctggtggacgaatcatgaattagcatgcccttttccgagtttctataaccctttgcatggcatagtggcacctataaagcaatagcatcaattattttagtccagaaaaatacaccactgaaaaatactagcaccataaccaaataattatgcataagatccttgtaacgaaacaagcattgatctataattttctactgacaattatgattatattgattgaccgaaacagagtaatctgaaaccagtgtaatttcaatccagctgatatacaatggtttactctgaaggtattcttagtatgaatggcacagaaatacaacccttaaagctaacgagtttcaacataatatggtttgagcagagttctcaagatatacctccatggaagatgatcaaggaacatacgaggtgtaacaacaaggtccataaaatcttgtcgattggctataaatgctttgtaactcttgttcttgcgactcttgtgtcgagtcacaggtgtcttctgaaatggagaggtatgattctttactggaacaagatgaataacgagaccaggcagatacacctccggtgattgtccttcaggcaaacttattgtacgcagatcattaggatcaatcgagagttttgtgccatcatttgaatgaggtagcctgtattccctgctacattcattcagatcatcttcagaagacttcccatttccgcatgcattactaggttctccaaaatgaggaacatccagaacactgcaggaagcagccatgcagttccctctatcaccaagaatattcattctagatctgctccccaactcatagttgattgctgctgtggagctcactcgatattttggagtatttaccaagcaagatatcgctttaccaaggaggaatacaccacctctaattgtgtgcattagattatttccgtggatttgatcatttcttagctttgcctcattgactatctgaagagcaccagtagactgacgatgatctgcaacatttcgattgtatcccttcgtcctcacgatcccagcaactagttttccaactttggcggaattcggcaaagcatcctttgagagagctctcacagcagcagcacgtaatctaattattgaattcatggataaccgggcagaaaattcatcattgtggacaatactgtgattgatgggcacttagttagaaaatcacatgactggtatatatgaacaaataaataaatgaacaataggttcataggtatgacaagttcagtatcacctggtaacaaactgtgaaca

SEQ ID NO: 99116 - DNA, 766 bp, Oryza sativa
cgccgcgcacgccgtcgcccaccgcaccgtggccagcacgccgccggccatggcgcgcggcggcgcgacacgtcgacgcggaggcttgaccggaggacgaggtgggcccacactgtcagtgagcagcgcgggggtcagcagccttggttagactcgcagttgagactgatcgatttgctctctctctacgtaaaggccggaaaattctcgagttcacgcggttattctagaatggggtcactggtatgtgggccatgcacagtacaggtagtggcgttttcccggtgggcccacctgtcagtgatagtggagttaaggagggtgggaggggttcggcggtagtggttggcacgttgggttcgcgtggttctagaacgaggcctttttacccggtttttatattctttttttctgtgagcgaaacctagtttttaattaattaattataattgcgatgggccgactcatgaagaacctgcgggccgcgcgcgcatggccttgctgggcccgttgaagtggtttgctggggaaaaagtacttggattacctcaactatcgcccaagtatgattcatatcctccaaacacagaaccgggtatatcgactcctccaactatcaaaactagtgcaaacaatatccctcggtagttttggaggtggttttggttgacgtggcgtctacatggtggttttgaccgagtctttgtcctacgtggcacttacgtggcattagaataaaaacaaaaaaaagttatgtgggacccat

SEQ ID NO: 99117 - DNA, 694 bp, Oryza sativa
aacaagaacacacacaacagtaatctctctctggtgatatctgtagctttatggggggaaggagaagtggaggttaagatagggggagagtgtgtgtttttatcttggtaattgcaccccttgcctccctcccatccgcctaaaactttgaccgtcaaagctaacccctctctctctctctctctctgattaagcaaatgcaggggctctgttcaaactgaactaagctagctaggtgtctctttttttttacagttcagtttcacactgatgcagagtgtgattaggctgattaattactacttttactgcatgcatggccggtcagtaaattaaccccccatgggtagtacagtatttatgaatacgtctaatcataagttgaggagactggccggctggccggaacagagaaaagggcagttaacagttaatctcgaccgtcagaattcagaagtttgatgatctcagccgtcagaagttataccgtacgtagtctacactgcgcaacaagtgtgtggtgtacttcaaccattgtacatctgctacaacatcaacgagaacactgaaaacaaccttgtatatatatagttgtgctatatatatttacgtggaaacatatcttatgcatacaaacttctcgtatttactcggtgtatattagcctaagcaaattttaggcaaaaaatctagg

SEQ ID NO: 99118 - DNA, 3707 bp, Oryza sativa
ttttttttatgagggactaaagtttaattagtccctttcactccctttcactcaaacactcgctgagctgtttgaaggctactcctatacgcgcgtaaacggctcagtgatcaatcttctccttttcgcccataaaaaataaacctaatacgaaatataatattatcttaattaattagtacttctaatatgaaatataatattatctaattagtactataaatttagacagtgccacataccgtattagattatttctaatgaaaccaagggagtagctcgttcagagcagatacaataacagtttagccagctgtaaatatattttaataaaataaaagatgagagagaagagcagcgggctatagatctgtagctagctacaacgcgaactacaagatgcaatgtgtatatgacatgtgagatcatatattaataatatagtaagcaattattgtatgaattggttattaaattagtaccgttaaacttgctctcagtcgtctctgtcagtgataaccgcagctatcacctatcctacctagctaggactgcacattttttgtatatcatcagatctgcatactctctcgacatttttcatcgtcatcttaattcttcctcaactgttttcttttacaactttcttctggcagatcgaccatgcaggtggtctcatcctattcctattttctgtacatgatcagttctcatgcatgcaccaatgcatagaattagtctagctagctatagcagttaatttatgcgaattcagctttgaattactgctgcaagtcgctcaaactagctgtagtttctctacgtcgtttgcgttgtttcagttcgcttcaatgaccatgatcagatcagtgatgctgctgcatgcatatgatcagagatcagttaattagcatcaattacctctcacgtgaccttggcctcttgctagcgtaggccgatctaggggaaaaaagaaatcctagcccaatgcatacatataacatatgtgaaaagaaacttttgaaaaagaaaaaaactcatttttaatatattaaaatgcacatttgattattcattgatatttttcaacttcttttatatttaggatattataaaaattataagttggatcacccatacaaaaattacgtcactgcttgctagctaaattaactccaaatccaaaatgagatatgaatgatcgagactatagctatatatatgcatagtttttccatcgttgcttgaggaacgcacacaaacgacaaagctaacgaggatgcggttcttgttcagtttcagtttggtggtcaacgccaccagtaagctggtcctacagtttctgtttttattccttcatttttattttattatttttgataggtaggtgggctcatccaaatcctaggccttgtatagagcaaggagcatatgctataagttagctataagcacatgcaggccactactacaataacaatttttttcgtttagtcaatacgaagggtctgcgaatgcgaaaatcgcacttaagccgcccgcacgggaaaataaaaaatcgaaacaaaaaaaaaagaaaatcgaaaccaaaaccctaaccctaatccagttgccgccgccgcccgcccccgtcgccgacggtctcccagacgccggatctgccacccgctcccatcaccgacggtctcccagacatcggatccgctgcccgctcctgtcaccgacgccggatccgccgcccccatgccttcccaccgccgacgacgggaggggagccgaagggagagggaggggaggggccgcgtgccgccggatccgccgcccccatgcctccccaccgccgacgacgccaccatcctctccagccgtcgtccccatggttgccggccgaagacccccctcccctccgccagatctgcaaggggagggaggggccgcgcgccgccgctgtcgctgtcgctattgccgccggatctgcaaggggaggggtggcgagccggtggcctcccactcgcaccatgcgctcaaagaggaggggaggagaggaggaaaggaaaaggtagagagagatgagaggaggagtgaataataaaaggaaaaagtagagagagtaggtgaaattttgaagtgtgtggaagggaatacatttttgcgtgcggttaattaagacatccgcctgcaaaaatagtctcatttttgcgtgccgttcacttaatatgtccatttgtgaaaatcaattttttcgtgcagtcctcttaaatggaccgcactagaaaatgagctgattttttcgtgcggatcgagttaccgcccgcccgcaatctaaaagtgtccctgtccaggaaaatcgtttttgtagtagtgtgtgaagaaagcaggagaagaaagagagaaaaaaagcggactacaaatttgaaagcagctgtgacacaggctttaagatattgtgcatgtatgaaatgtatgccaagtagtattaatggtgcaatatattttatataaaatattgtatgaatagactattaaagtggatatagatgatgtattaatttttagaggtagtagtggactatactattaagagcatgtacaataacagactataagctagctataaacatattttaaggagataacagattagagataagagcagcgggctacagatttgtagctagctgcagcatggactccaagacacatgtgtgtatgacaggtgggaccagacattaattacgtagtacatgtttatatgtaattattgtatgaattggctattaaattgactataaatgatctggagccaatagttattgctaaacttgctcctaggaaagctttatgcggcttctttcaaaagctctgactcttccaaacagtctaggttctcattggttgcccatatttcttaataggccaaaacagcttgtgagggaataaaaaataatttataggtaaaatttttatatatgtgttcttcgcgatttaaaaggtaattctaacgctaaaaatatcttaaaatcaatttcaaaattaagtttgaaaatttaaattttaactttagatttggtttattagggtaacgaatggggctggtagattctaacttctataaagctatagaatttagaaaataaaaggttaataaatcagtttctctactaattaggtgatgattctcgaaatgttaaggtcccctaaacaggacgcgtccttcctgcatatactagttgtactcctacaaactgtgtgtgtatatgtcacgtactcacgtgcctccgcgagtacagtacagcccagcaaaacacgatcggttagcatcttcctccaaatgggccgcacgtttcggcccatcaatacgggcctcataccaacaaacggaaaaagtatactttgactccctcaactatcacccgagtatgattgatgccctccaaccacaaaacgttgtatatcgactcctccaactaacaaaattggtgtaaacaatgtccctcggtggtttttgagatggttttgggtgacgtggcgcctacgtggcggtcttgactgagtctttgtcctacgtagcattagagtaaaaacaaaaataaaaaaaatatgtgggacccatatggcattcacaaaaaatgtattgtgagacccacatgtcatcctccatctccttcccttcttcctccctctctctctcccttatctctctgttg

SEQ ID NO: 99119 - DNA, 659 bp, Oryza sativa
agttagtcagcattacatgcccaggtgagtgctttgtggtggagatgaagggttggaaggaaccacggcctcttcagcttgacatagacagcaagagcattaaggacgtggaatcttttacaactggaatgatcagtaaagagctcatcgcaggtccagatccacccatagttccatcttcatcaagcttgaggtcattgacccctgactctattgaaggaaaatccactcttcatcactatattaaagttttccatgagtactacgtggagtatgggcataaggtaagaaactgtcaccatgatactttgcatataactcttatcatattcacatatttccagacctcagaacatgtcatttgtcattgttggtgaatggttagcggcaactagaattaataggacctgcagatgcccaaatccccaaacctattagctataaatgtaccatcactaatcagatgagaataaatgggagtataggcaaacataatgatcaagatattattttaatgattcttaggttttcattgagctcaggaacatggggattacctgaagacagaaattgaggacaagcagaaacgcttgcaagcagtgaagcaatcacttctatccatagaagccaaagaccaagatataaacaaccggataaat

SEQ ID NO: 99120 - DNA, 722 bp, Oryza sativa
aggcccaagcccaacaatctccatgatccgattgcttttacagttcatcagccatcgctatcgcaaattcgcgagtgctccgccgcgcgtacggtctgtcgtgtgtgtggttctcttgtccactccaatggatttctggtggatcagaggaaggcgacgacgccattgtggaatcgcgtgcttagctcgacacctggtggagctgctacgcaaaggagcaccttctcatcgtgttcttctcctcgaggtgtttcaggctccgaaggtacaggattcttcaggttgatctaccgataatcggagtgattcttctccttcttgttgactgtttatcgttctttgttgcgtgcttcattgcaacagcacgtgctggaaggagaggaaggaagttgtgatgctctgtgattctctgggaggtttcttggctccattagccgtactcggggtgatgtgatgctgatgttgtatgggcacctcgaagatgtggtatcttttccatgaggtttatgagctgctgcatgctgcgcccaagtgccaacactgtccggctcactgttgaggagactcttcagaagagggttcatgcatgcaaggtgtttgttgttggttcccaaaggaggagggtgaggaattgggtggtgtttgccaagaggaggaggaggagtagcaagaggcagcgttgatggaagagttggttcttcgatgcatgggtctggcctgat

SEQ ID NO: 99121 - DNA, 693 bp, Oryza sativa
ccgttgaaatcaacggccgggcaattctcaggtagagccacaccgatctattatactccttccgtcccaaaaaaatcaacctgaacgaaaatatgatctctttacaatgaatctacacagaagtcacatgttagttttttttttacgaaggaagtaagtttttaattgtcacgcaaggttagttccacctcgcgcgaccgcaagcgagtcgtcccgtgagccgccgtcgccatcgtcctggtaagtcgtcggcgacggcaagtctctgccgctgatggtgcttgtcgcgcagtgcgacgcgacacgaagttagcatcagctgcagcgaaattgagaaacgggaacatgttttacataaccaaaccgatcagttcaacccatattgcgttatgggctggtccaagtgaagctcgtagtgatttcctttttttgggccaagaactcgacggctcgacaaatggatagttgggcccatctggtgaacgggctggtgctagagtactagtggaaatcttttttcgaaacttgtgagctaagaatcaaattcgtgtagtaaaggtctaacctcacaattgtccatggcagcataatgcataaccttacaagttattatccatagcacatcagttacattacatacagattttaggcctgttcactttgatgcaaaaaaaaaccttactaaattttagc

SEQ ID NO: 99122 - DNA, 667 bp, Oryza sativa
ctcgtggtatggtttttcagttggctatattttgattcatggccaccaatattagttcttacgatactgtttgttccggcaaatcttctgctttagtaattactccctccgtccttaaaaaaactcaaactatcctcttagtacaatgaatctagaccacccataaatctagtttttttttgggggacccaggggtaactggcaataacagttttaaaatgttaccccaacatccccggagtaatcactgaacaagaatagggatggaaggcaacactgttgcattgcttagaagctaatgctcactgatttcgttttctaaccacaaaactcctgtaacagagaaaccgcagagctaaatgtttctacctgaacattaatcttccccaaaacaagaatacgaatatacgatgaataagaaagcacgctcatcttctctgaaccttctgacgcggcagctcggtgttcgctagctatggcgccttcctcgctggctttgcaagcaaccaatggtgaaaggaggaaggaaggcgaaagggtgtgttttgcaacaaatggtaagcagatcgcaaccgaagattgcaacaaagcaaagacgtgctcaaatcttaatgacaccttagcgttggagaacaatgcaatacaagcatgacaccttagcgttgga

SEQ ID NO: 99123 - DNA, 864 bp, Oryza sativa
ctatgcatttttatgaatttaatgagacttgaatggacttaatcggagctcggatgaattagatataatttttagaagattatctgtgtttattactataacaaaaagtccttaaataatttatcgcgcaataaatcccagggctggcgtcatctaaggggggggcggctgcgccgacaggtgggccccgcttgtcagcggctcaagagagagagggggcgccggcacgtgggccccactggcagtggcacaaggcgggagggggtgcggctggcaggcgggtcccaccggccgcggctccaaagggggggtggcgcctggctcggctcggctccgagccgaccggccggccatggggcagcggcgcgcgtggagctggcggcggcacacggttatcggcggcggcgcgggagtcggaggcaacggctggaagcggcggcgtgggaggcggcggcgtcggccgaaggcgacggcgagtgcgtggagaggggcggcgcaaacgagagagaggggaaaagggaggagaggggatcctcaccggcgagcacggcggccggcgcgaaggatgaaggcggcggcgatgacccaacgagcggaggggcagacgggcggcgattgcacctacggaggaaaatggagaggaattaggggttgggaggaagccacggcagctagcgtggccggccggagatgggaagggcggcgaaattcaccggcgcacggagagagaggcgttccggcggcaggattggatggggatgcggcggccgaggtagctttggcggcggagaagctaacggcggcggcggattggctcggcggcggcgctagaggagatcggcgcgggcgcggtagaaggcatgc

SEQ ID NO: 99124 - DNA, 874 bp, Oryza sativa
agatgcagagatcagttggccaaactcaagaagatctccacgagcccacgcatctcttcttgaacacagagtatccggatattgttatactataatatgtcattgcactttcagttcaaatttggtaaagatgcaggttcgaagaatatatgtactctactaagcattttgattcctaagatgacaactcaatatgttgattcctcgtgcgtattggaacacaagaaagaatatcataatcttgcctctttcttttgcatatatggctttaagttaagtcacaacgaatgccaaattttagtagtaaaggcagttcatctatggagacaatagaggtagcagaagtgtgcaaatatagttcttcatgatgtaaggtctacagcaagtagtacaatcgctaattattacgtaatttgctatttgtgttcatgaaagtacatatgcatcgagtagaaatttaaatgagtggaccaaatactaaaagagcgcacggaaaaatatttggttgtgctcacccttgacaactcgcttcatctcagagaagtagtgctcagctctcctagcgagattttctttaatatacactgcaagaaaagagtgtgatggaatgtattcagattcaaaatatggtacaagtaagaaaatattttaagagagagaattcaaatgacaaccttctgagcctcgtatatggctgggttaactgtgttagaagaaaacaaaatggtatcaaccttaaattttagagttggtcataacaaaaagtacatataaatagtttaccattacgaagaatacttgatgcatcttcacagcctgaagcactgggaattcaaacaacaaaatgataattgaaattgggtatgttctgaac

SEQ ID NO: 99125 - DNA, 877 bp, Oryza sativa
agcgacgatcccgtgggacgaccgcgagaccatcaagttcgccagctccaaaacgtggaaccgcgacggtcccgtggcgccaaaacgcagaaccgcggtggccagccatttcggcactgcgtagtactgtttgtacaccgttttgatactgttcaagggctgtttggaactgttcatgcgctggtgccgcgtctccattgtgcggaacggagactggaattgtgtaaaacagtaccgaaacagtgtcgggtacagtgtcacgtagtaaaaatatgctggtgccacggttccgcacgccagcgctgcggaagtgagccggttccgcgttcccggctctggtcccgcagcctcgttccgcgcgagcgcctcggccgtctgctcggcgccgccacctcgtgctttagttgcgctcccgcggaaccgacccgcggattagggatattttcacaaattcttcactctagcgtatgtaaacgtaatttttttataaaaaaatagatattttcaaattttattccgtgttataccttagtttcatgctccttcacaacttttagccctcaaggtttatcctaaaatataacaacttgttcatcaacgttctcttcttaataaatcacaatcctccatcatttaattttctcacctacctccacttttcaaccaatcacaacattcttctatttaattctatctattttattaatacatgtgttcaaccttaaaaatctttatattctgtaacggggaacggagggagtagttaagaaacataagttggacttttcctatgtttccaaactaccatgtctcagcccctctattccagatttctaaccctttgcttgtaacattggtgggctaagcttatgcgcta

SEQ ID NO: 99126 - DNA, 759 bp, Oryza sativa
ggtgtttaattcactactgcgaatttgagatcacgtgcagttatactagggactgcaagacaagaactgcatgtgatcttggtcatctatttttcttatggagggtttgaagctacaacacaggagctacagtaaatatgcagtatttcttttgtttgaatagtatctttgattatctgcccgtttgatttacatccaatggtcctagtgtgactgcaaggtccagtgtcacgccacattttgttaatctttaccactatattttataggttcaggtcgatccatatgtaagtgtcaaatacaactgtgagtctgtgacttcgattagtcatgaatgtttgtttgtggacggtcgaccaacattttgctaacgaggtgtacttgcttgttcgttgccatgtttgtatcgtgccacgggttgccctgaatatacatactatgctacaaccaaaacgcgacgggttcaattgacagatcagccaaacctttgttggcaaccttgtatggcttggacgatcgagccatgcggcctgcgatctccagctgtccgttcttgccatgcgcgggaggagcgggcgggaaccgtacgacgacgtggcatgcggtgtccggttcggcactcggcagcacagcggcatcgatcggctgagacacgtggtgatgggcgcggatagcatgcatcgacacggatcgtgggccctgcggagggcgcgtgggacggatctgggacgtgcgtctctatccggttgggccgcacgg

SEQ ID NO: 99127 - DNA, 695 bp, Oryza sativa
agctgctggtcgcctggtcggtcgtcccctcgatcgatcggtagaattagccgcctcgtgggttgggtttgtcacggacggtttctttctttcgccggcagcgacgggcgacggcgaccggggcgggcatgcatgcatgtggcgcgcgcgtgctgtacgtacatggcggtggtttcgatcggttcatagtacgtaccactgctgcagaaaacacgattttttacgtacgaggatgtctatagattacatgcagactgtaactattaaaatcgacgtccatttttaaatacgatttcataagaggtttatatacaaaaatctatttttcacttatggacggatctcttgagacaccgcatgccaaaacaagcttattttcgtaggcgggtctgttaaacggccacgtttttatatgctggcctataaaaaaacccgcctataaatatgacattcctactctattccctttcaatatgttcaaaattgtaagtcatcgtccttatctcctcgccttctctatgtcacctctcattttttcataccctctcaccttatctctctccccactcatttttctctcctctcccacttcctcctccactggcgggcgggtggtgtggcggcggtgggtagtaggtgcggcagcagcgggcgggaggctccttagctcctcctcctccaccgcctggcaagaa

SEQ ID NO: 99128 - DNA, 2130 bp, Oryza sativa
ctttgcaatggcgatcaggagagctgtgatcatttgttgctgggttgccctttcacgaataggatctggggtctgctgagaacgtggctaggaactcctttccccctgcctggcgatgacgactgggagttcgcggactggtggattaaaaccagactctgttttagacgggctacaggggcgcttttgactccctttgtatcctcatctgctggttcgtgtggtgagaacgaaacctcaggatctttgaacaaaaggcgagaacggcagcggagctcttcagtgatattaagaatgaagttgcagtgtggagggagaccaacattttgagagaagtcggctaaagagcccgctggtggcggattgttttgttttcctttcttttcggtttctctcgactgtttaatgtcgatttgtaaatgttttcaaacccttccttcaaatcttaatacaatttgggcggcctgccttgggccgtcccagctaaaatgaggcctgccttcattcagaatagaaaccaaacaaacacagcatgtaattcaaataacaagaagagagtgcacttcgatatccttattttgtttagttgtttttcagatatatggtttccttcccaagctatcacctactgtactaaacattctccgagaaatgaaacggcattagagaaattttccaccagggattttgtctcttttgagaaaatttctcagtgagggtcgctctccagctatgcacttgctatgtcatactttattccctactgtgttaagcatgctttgtaatctcactgcacggatcattttgtttcgagaaaagaaatcacccagaggcctaggttaagaccctggaaaataataactaaagaaaaggttatcggtagatcacttaatataattacatttagatatttggctcggatatttctgtatagcactgtactgcttggaaatcattagaaaatttaattatgtgtcgctgtcaagaatcgtatctttcatttgaccagaatcttgagccattatttgctttggttaatgcttttcctttgtacaggccttgtctcgaatggggactctttggatatgccatggttggatgtcgcaggtgtcagggtccacctgacctcaatttgtctgtatagcagggcaacatatatacctgtctattccaagttccaacaggatatatatcagttgatcatgtgatgctagaataatcttccttctttccaattcactgtaatgcaaaacttctgattttctgaagcagctgttgctatatatacatgcataacaagagctcaagtatacagtcgcaaactctgttgttattctgtggtttcagcaagtaaaactgtaacactgtaaactgcagaagttcgatgcgacaagtggttcaatacatcttcgtctactacccgtcttgaaaatgatccatccatccctgctgcatcctgattgcttcagatggtggctacctgcccgcctgcctgccattggtgtcgcactaacttcaccagtttagggttatagttacttaaaaaaaattggaagtttgaagaaagttgagagttttgcactaacttcaccagttcagggtgttagtttctgaaaaaagttagaagtttgaagaaagttgagagtttggaaaaaagttgaaagttagtgttaatttctgaaaaaagttggaagtttaaagaaagttaggagtttagaaaaaaagttgaaagtttatgtgtgtaggaaagtttttgatgtaatatgatgtgatggaaagttaggaatatggaagaaactaaacacggcctgttcagatgcaaatatcatggtgatccctcccatgggcttgcaacgaagtttacgcggtctctgatgaaactcgttggcgagattggctggtttgattggcgagattggctggtttgatggtgtccctacgtgtaagttcgcatgtttctcacggccatctctttcacactcacagtcacaggacccggaaaggcaacgcttttgtttctttagcacggagcaatccccgccgcggacgcaccgcacatggttgatttttttaaaattttttgaatcatttaacttttattttaaaaataaattatttctaaacttattt

SEQ ID NO: 99129 - DNA, 507 bp, Oryza sativa
ccgcaagtttagaatgcacagttttaacgttttaagcgggtatatagctctacagatcaaaaggttctaaacggggcaatttgtccattaattgttggacatggacgccctcatggatattggagtcaaccgtgtgggttcgttttcgttttctccggtactggtgtcttcgtcagatcaaggcgtgtcacacacatactggattactggtgtacagtactccagaagacacgccacgtacgatcaaatagtaataaagcaactcattagaaaaacaacgtcaacgacgggacaaatataccagtgacgtcgtatgttgtgcaaccagccagcttattattaagagtatgaccgtaagctagctataaacacattttgagaagataaaaaagaagagagaagaacaatgggctacatatttgtagccagctgcagcacagactccaagttacatatgtatatgacaggtgagaccagatattaattatgtaatactccctatgtttc

SEQ ID NO: 99130 - DNA, 2641 bp, Oryza sativa
aaacaatagattggtctgcatagttttttatttaacacgaattttcattacgatatatgataatgcacgatgacacaattcatctaatcaacgacggatcttttcgtcaaaaacaggaaattgtacagagctatctagggattacaaataatattaaaacagatctgcaggaagaatacagaataatacttcaccaggttgtagcatccaccataagggagttttttttttaaggattaaaatctgtatggagttgtttatagtatttattaaggaagctggataagagcagtacaataatggactataagctaactataaacatattttaaaattttaaagagataaaagaagagagtgaggagcagacaactgcagcacgaactctaatacgtaatgtgtatgataggtgggaccatttattaatagtgtagtaagcaactattgtataaattggttatagatgatttaaagttagttgttgcctatgttattaaacttgttataatgcgtattaatcggcggtttggccggcttggcgcgtatagttcaacaggtagtaagataaacatattataaattaaagctagctactagctagctgatacgatgaaatgtctaatcgacgaactaatctatggatcacacgcaatttgtatataaaattaatgtttgaagaactccgtgtgactacacaaaacctcatgtagatacgattttgtagagctaatttttaaaaagaatttaaaatcaatagttctaaagtgtagagataattttcagaggcactgcaaatattgcctaaaacacttttaattaatctctcgacacttttatcataatttattaaatttattttgtagatgcactttttagtactttcaaatttgcatggtatataaaggtattttttttagacattctaatctttatagaggcacttataagaattttaatctatgctaattaactagataaaagtaacatggaggacatatgtataagtaataatatgaggttgagataattagaccattcaagttggaaatggtatatttaagaggtctggagtttaaggattcgtaagtgcaaaggaagtcacattggtttgctacggttggcatagatacattctgtaaaatgcctcttcatttatagagataattcactataggatatttataaggtatttttgaaaatgtctctatagtattgtagagacagttaaaaagtgtctctatagtatctgtaccaccactacttttgaactttttctaaattagtccctgatattttttttgatgttatgtaatagtctaatatttgtttgaatcaagtggacacaatatattcaaataagcaaacaaagaatactagcatatttgataaaaaaatgttgtctatgacatattattatatattttattttactcatagcaaagcattggcattttgctacttagagaaatgtctctacaagatagtttgttggctgtgtttttgctatttactttctagtataatgccgaagtaattagataagtaagtttctaccagaagcatataacagcaaaaatgcatgtgcaacaatatatttgctgttttttatctattattttttgtacataatatgtggaaaacattttacagattaagctatagcttcaaattaataacatcatatagattctaagaaaagcactaattattttttgttgcttctaaacaataaaggtgaaatatatgcctgttaagtagctatctgactgaatttatggttaggtggcaatgatgttaagcatgtgaagacaaagtcatgtgcctcctaataaaaaagatagagtagatagtacaacaggacaaattcatgtcatctagcgagttgaattacttgctttggtgagttttttcatgcgcaagtatctcccaggaaacaaagattcggatcttctccgctgttgtttagcctctacatgtatactgtttattagttgcaagtttattttagatcaagtaaacatgagccaaatcgtagcgtgcatatgcataagaaaattactagtaactcagaaagacgactagcttttggtcactgctttgtactgttttttgggctataacctgcatcttgtaaaatatatgtaatcaaactctgaactaatcttgtaaaattggttgcctatcatcatcgatgtggtcctctacatcaccctatcatatacagatttgatgtggtctcctctatctcgttccgaaccatagaaaaaaaatcaagaaaaaatatattatgtgcattaatttcccctctctgtagttttggtctttgttttcccctctttggctccttggttgtcgtcattgttttgtcagtttatctttacttcttcagtaccaattttgcatccacttcagcacccctgctgtagcattttttttgtcatcttgctctgctgaaagcttcatctacagacctactgtttcatatcgctggagattttcagtaaagcttgttgctttacacggtttacctcatactgcttccactgaatcagtgcttctgttataggcaagagaatcaaatgtccaagaaagaagcaaccatttttcatgtgattctcctaatgtaaccaagtgcaaacaa

SEQ ID NO: 99131 - DNA, 1982 bp, Oryza sativa
gacgacaacgtgcggggaccgcgacgggggctcccctcccccctccctcctagatctggtcggaggagggagggggaggccggcggcggtggcgatgacgacgcccggcgcggctcccctccctcccctcccagatccggccggaggagggcggcggcggcgagctgcgcccgtgattttttttttgttcgttgaatggtgcccgcctgcgaaaattgatgatttttatagttgttgggctgcaggcggtccaacctcctgcctgcaaaaatcacttttctagtagtgacacatcccagctagccacgccttctctctctcgtaaattgcactttacatcatgttatcttaaaacaaatttcacttaatactataatacatcatcaaacctacataaatttcttaaaacatttaaaatgaacgttcagcctcatcttttcgtttattcttatgcttatcagcaaaaatttaaattttcaaccttaaatttgaagctgattttggagattttcatcgaagtttattttttagtctttgcttttagatcgctgagaacatgtatataaaaaattattcacaaattactttttgtttgcaaatatgctgtttgatttattccatgaataaggcaaaagatggagcccattgtgaaatatggtcgcgccaaatgacacgccctttttagcatgttcttacacatatgaacgtagaaatttcaaaagattttggtacgattaggacaacttcattaaattgttcatttaacatgtagatttatttaattaaaaatcattatattttaatctatttatggcatagctattaaaaagtgtttttatgtaagtctacattatttcaaatgtacttattttataaatattaattattaagccttatcttcagctaaataagccatggtctttaaaaataagtttttcaaaatggacatttttaaataacgaccgtactcttttttacataaaatataccaatcgaatttatgattaaaaaatatttttcctctgttcaaaatataagtatacaaagtttatatctaaatatagcaattgagtatctactcccttatcttaaccaatcataatatttctcttatttaactttccttttactcgcctagtttatatttggttttcagccaagaactatataataagtggctataccttttgtttaagtaaagacaggattttatccattatctaaaaaattcacctagtttattaatacctatacccaatttcaaacaattttatagaccttataacgatggggcatttctcaccaaagtagaactaacaaaaaaaaacaaactattctactccaaccccggaaactttatttctagcaattctcatgcaaattagtacttgcgagaaatacccacgatgtccttatcaatttttgaattccaattaaatatgtatatatatacctttgtttggttggctaaaaaatgttcttataagggagtacgtaacaaatcttttagtatttaattgttttttacttgacaccgcctatatattaatctttaatattttacatattgtaaaatattttacatgtaaaatataactatatcatttgcatccatcaaaacatcacaatttaaaagttatttctgaccatcggttgtcaattaaaaagaggaaaggagggagaaattggcaaaagtgaagcatttattaattctctttgttattttatttgtcgatacttatcaactggacattagtcagtgcaaagaggcaagtaaagtaatgagttttctagagattctaatagatatatgtgcacgagacatcataagagcttatatctgattgacacgtggcaaaattttggagatgtttagctaattttttaggctgccacgtggctagttcaattttagtatccagcaacaacatttgagataaacaacattagttttttttaattatgttttaagtaaattaaag

SEQ ID NO: 99132 - DNA, 602 bp, Oryza sativa
caaatctggtgtcaaaaagaagaacaggcaggcaaactaaaaaaaggcaagatccaattagcttgttttgtgtatgggtattgatttgtgcttccatcctccttgattccttttaatatggtgctcggagtatgcttttagattgttttgagattatgggcctcagagtatgacgaatgctgctcacaagagagctaaaaattttcgtagtaggtttcatgtctgtacccgtgatatattattaagcatcttaattaatagggtattaataacctccctaaagtcattggtttgttgtgccatatcatctataatcaaattgccatgcttcaattttcaacgatgttttatttcagctttgtttttgacgaaaagctaattggtctctggtattgattctgtgtgccgaacgtgctagtctggaacttgaatttgtcttgtgatcgtgcgattgtgcgatggatattccttctctttctgtgtatcgtatgcttcgcactttctactttgaagtttgaaccattggatcagttcgagtttccttctccattgaatgactacgaatttgtttaaatatttgcattccatcttctgcattataa

SEQ ID NO: 99133 - DNA, 509 bp, Oryza sativa
tgattaatacctatacttatcaacaaaacaactcaaatttaactttatttgacaatccatgattacatacctaactaattatatgtatggatgctatatacctagaatcaaaatctaacaaaaacaagttcaaattcagttcaaacttgctttaaactagtagtaaagtagttaatgttaatacctaagtaattgaaaaagtttcatactcatttgaattgggtatatactcaatttcaacaatggtgcccgggcacctatggacaccaaacaaatttactatatatatatatgtacgtatgtatgttcgttcttagcgatctaaaagcaaaggctgaaaaataaacttcgataaaaaaccctcaaaattaactccaaatttaaagttgaaaacgctggaagcggtcgagggttgccggatggtcgctccacgcaggaacgacgacggggacgacgacgacagagctggttgcgccccacgacgccgatcttggcgtgcggctctcctg

SEQ ID NO: 99134 - DNA, 529 bp, Oryza sativa
ataatcttggtgttataccttctagtaaaaatgttgttttagatgatgtaattaatgatttgaaatgtgtagaaaataataggataagcgaatatgcttgttcttctattaatcaagtttgtacccctaatgttgatactgagtcattagatgaccagttggaggataattttttactacaacatttatgtagtgaaattatggaagaggtcatggattttagtgaggactgtgagaatagtcttaaaaacactttaaatcctatggcatcttctcctaactctaagaaaaagagtaaaagggggaaaaataagaaaaataataaaaatagtttcaaatgaagggaatcttttggaattgtgatgggtttaaggaccaaaaaaacataagtttatttctgacttgaccaaggaacatcagcttgactttatagcattgtctgagacggttaagaaagaatttactctagctgcacttaaaaatctttgtgctggtaaggagtttttgtggcattgtaaacctcccagag

SEQ ID NO: 99135 - DNA, 1526 bp, Oryza sativa
gaacgagcacaaggtgagccccttccttttcgcttcttggtgggctctcgagtaaaatgaagtaatgagcctttcttatatcttgcttctgaatatggcaattgataaaatcttcgatatggatcagtgtatttacatctgctgggtagaatttatatatgcttctgttactattgtagtaatttcatagattttccctcataactgtatgtgaccgataaacttcatcaaccactagctaatttagcttgtgtgcttccttgctaaatgctaaccatcgtcaatggaggaaatcggttcaattgaacttgtaatctgctcgtaaacatgcttactgttacatctgcaatcataatacagatggaattaatcataaatcgtcttttttaattgtgttctcatggttaacattctaacagaaactacctggtaccatttttccagtcctttggtgaatgtggatataccagttacagctttttgacattcacattagagttttcttaacatagagttaaaacttaaaccaaaattttaggcgttgcttgtacatccacctagattggacaggtgcatgttgtcagagggggtggggatggcttgccactttccatcttggttggaggctactcatccctctaaggcgcatcaagtgaaaatgcagagcacaaaagaacgaggaattacaaccaggagcatgtaatattcctaggggaaaactggagctcaaagcagataagattggttaacagtataggcatgccaaatctgtgtttcgcactggggcctggcagcagtaggttttataacatagggcctgtcaccaagcattcttactgagattttgggtttctgtttcttttttattcgatgcattattcttctttatgttgctttgctacaattttttagttgattgacaatgacatctttatcacataggctcaaatttggacggagaaagcatcacgatatcgatctacagtctggaaagttagcaacaaacgcccaggttagcgatccgcagtgtaacatcctgcctatatttaagaccattcggttttttttttcctctagaattcaaggacccttcagtattctgtttttctggtatctccggcttgcatttgtctcctgcttctgtttttctgttcttttcaagtatcttgggcttgtgaaggttaaagaaagaaaaagaaaaaaaatttctactgtttctggggctgacatattgttttgttgcaggatacaatgctagtgactcagattcagatgattccaaggaaacaggcaaacaatcacatgttactggaaaggtaagtttcatgtcccatgtgccactgtgatccacaacagtctccattttctggcgtcttgtagttaaccattatagttccagatgtctgattgttgagaaacaatctttgtttcggttcatagatgtcctgcacatttgggttagctcaccacgtatagaccatttagttgcacaatgaagaatttaggatttcatgtgattgattgct

SEQ ID NO: 99136 - DNA, 549 bp, Oryza sativa
gacatcctcaaatacaaagcacttccctagttagatgtaggttagacttcccgttcgagaaactcttttttctacctgccctcaatttatgcacgagtaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggctcgggtgctttgaagcatttgttgctatctaaattccatttaaggtcgtaccttatcgcccagcatcatcttattctctatttgtattccctccatctttcagatacggatgtagccttggatgtgcccgtgcccaatgaagaggaaagagcgcaacatgaaacgtaagtacaaaagtaccggacaccca

SEQ ID NO: 99137 - DNA, 526 bp, Oryza sativa
tgttttctttgatttgtatatgacttttggttgcgacattcctgacaaaggactacactaacaagtaaccacgctttaggaaaaacaatttcatcttgtattttattcctttggggactaatagacgacatgtctacattattgtcatttttctttgaaagtcaatatataatttgacaccttttccgcccaaagaataaatactactacaaaattttctcatttcggctgcgacctgaattaaatttccaatggatacaggccggaagcttactgatctgcgataattaatcctcatcacgacatcgtagccaggcgtctctgtacaaatattgatcagcaatgtcgtgagcaacttacgacctcggcccttccgacaaactcttgtcttttttcttccgctccctccgtcctagaaaaacaagttttggatgtaacacattctaatactacaaaattagatatacttctgtacaaatttattgtactaagatatgtcacattcaggttctagaaattttttttt

SEQ ID NO: 99138 - DNA, 614 bp, Oryza sativa
taaggccttttctttatagtaaaaacacatttaatcttctaaaattcatatctaattcatccgagctccgattaagtccattcaagtctcagtaaattcataaaaatgcgtagaatccattaaaaatggttttgtttcctgtttcatagacttatagtgtgttttgcttgtgttctttgtttgtcgcgtagatttcggccgtttcgtcgatccgcggttcctcgaaacgttgctatggtctcatcagtgcgagagcaaggcaagttatgcattacgattgatcatattgtacccaatttacaaatgtctcgcatttctattaaatattgcattgttttacaatatcatgtgggatgggtcctactactcagccatatcttgtttaccttatgccattgataacttgggtattaaaatgcttagatgttggtttagggaatgcttagccatgcttagttcaactagtacacaatgggggaatcacattaatgtatagactttgattattggcaatagctttggattagtgccaccgcaagggtgttagttaattaaaatacactacatggtgtgctgtgggtgcatgggtttactagtcgtgcccatggcgatta

SEQ ID NO: 99139 - DNA, 629 bp, Oryza sativa
cgctttgtagaaaaattctatatgaaagttgtttttaaaaaatcatattaatttattttttaggaaaaaatagttattaattaattaattatgtaataatatatatttcgttttgcgtgtcgggaggagggcagcacctaactcatgctcctactagtttttgttatatttcttgttcattgaattttctcatagaaagggacattatgcttgatctggtggtgtttggatcagggacttaactttagtctctatatttagacactaatttagagtattaaatatagactacttacaaaactaattatataaatgaaagctaatttgtgagacaaattttttaagcctaattaatccatgattagcctatgtgatgctaccgtaaacattctctaatgctaaagttcttggatccaaacaccacctagcatgcataggacgaggcatttaattttacttataacgagacgtgccaaaaaatgatatccacataacggcataaaactaaacagctgcatatgaatgtaaagactaaataaaataattgcaccaaatcttaagtttttaaatgcatttttggaaaagcttactactggtactactattcttgtactcatatgtggagttgt

SEQ ID NO: 99140 - DNA, 553 bp, Oryza sativa
atctgagttgccgaggacagtgaggactgaggagtggccttcttttgagttttaacagtcggaagctgcaccgtactacggtaatgtacaagtacacggggtagaagcactagtgagcagtacaaccatcagaaaatgtctccgttcaaccgtggtgaaagtcgtcggtgagccttaatctaccgctttcaccgttacacttactaagtgcgttcactgatcagagtggacgtacaccgtgaccggctggccagtctgtgcaatacacgctgcgttgcacttcgatccgctgttagcctgttattaaggctgttactaccgttagtagtaaaacttgttgactgatggtactatgcttttttgtccggcctgtcttaattacccaggccttctctgaaacttgacgatttctcggcccagactgacagcaatggtcaaagtaggacgacgtggacgtaatggtcgctacggagtgattaatttggaggtagactagccagagagctctccgcgccggttgctccggcccggctcgcctataaaattcacccgc

SEQ ID NO: 99141 - DNA, 701 bp, Oryza sativa
  unsure (1)..(701): unsure at all n locations
gtgctgagggtgcgtacatacttttntattgtaaagcaaactagctcctgccccatccagtgctaccgatcgggggaattttgagatagagaatttgactgtaacaaacctattgaaaacatatacctcctgcgaatctttctcacgcttgacctcaaagagtttgtgcttatataacgcatcccagggggggatcccaacaatgctcctgctgcacaacgttaggggcacaaaaagcaatgcagtgacttatccttccttttaaatgtctcttgactcattctacattatgctgaatgacataggcagttgttggatctggatgctaatacgattcacatttggactgctaatcatgttttaagaccaagccagaactcaaagggttattccctacaatctttctttgtgtgcacggctgccaaaacgtaatcccaatgttctctcattgtgattcatgatatttggtcccaccgggacagattgcaaaacctgagtttccttattagccataaaggagattactgattctatgcttcaatcgctatctcctaacgttttagcccctccatactgaattacaacattgaactctccttaacaagaacttggtctaatttgcctgtcgatgtattaaatgttcgtggaactcctctagataataattcatccatgtgatcagattatgcctcaaccccccg

SEQ ID NO: 99142 - DNA, 562 bp, Oryza sativa
attcgtttttgttttggaaacgtcccgaaaatccggtgcgtgcaaacggcgtgagtcccggataagttacgcgcgacttatccggttcggttacgcacagtagagatcgtgcgggcgccctgatcaagagacccttctctatataaccgacagccgtcttcacgcaatatatgcgaaaatcattctagggtttgcctcctagactactccatcccgctcgccggcgtgcatcagcgatcgggagagcaggtctccgaaacctctgcctttgacgtcctgcaccgggagaaggcgacaataaggtttttgggaagcgcttcgcgcgactgctccctgttcgttcgcgacggctcgccttcctcttcgctcgcgtgtttcgttccttcgtagacacctgcgaaaagtttcgaccaagcagccggtcttttcgtcacctcggtacgtgttcaatatgttgcgcatttttgatctgttaatgttattctgcgtagttcacatgtgtagatctaatgatgcgttcatgctagttttcatctgtaatgtcatgatttatttatggaat

SEQ ID NO: 99143 - DNA, 508 bp, Oryza sativa
tctacctaaaatgatactatagataccatagaattgagtgtccactaaccggagtcttgtttattctaaggcgaacaaggaaataataacaataacaataataatcaggtcgatacacaagaaatgagcatgactaaatataacaagattactcagaactttaattacagcgataatgccattcttaaaataaacataattatataatctgatatgcaatagtggcaaacgaggacactacttgcctcattgccttctataaacacctgatctaactgccatgagtagcagatctaccgaaactgcaacgtatacacgaccaacggataagaataggctttactctactaaactcacgtaacaagcaaaaacaaagtacacatatggtctcttgactactgaggaacaaatatagacttgaacgggccaaagccgagtacaaatggccatggtatggccataagaattgatatagctgttaaatggatatttgccaatgtcttcattt

SEQ ID NO: 99144 - DNA, 688 bp, Oryza sativa
  unsure (1)..(688): unsure at all n locations
atttctgatatgagttggggttgggttggttaggtggtttgaattacctgactttgaaagctttgctgatgcgttaggtggctatcttcttcttctattgggggccacttggtcagtcatatatgcggcaaacagtagtaccgaatctgtggcttctctctcagttttcagcatttttgcttgcgcaatcgaaacttgtcagtttgtagcatctttgatttaatttgttgaattagtctatagtacttgtgctttatttaagcctatattagccaggtgttctttcctccaattgtctgacgcaaatttcctcatattttacatggtataaatctatctggtgaaggtgatacttcgtcccatgcatagggataatcacaaattcaaaaattcatcgccaaattaaaccaccatggtaccaaataatccacccaaattgatatcacanatgaccccaaatatacagaatgaacangatatgatncaagtaacaaacaccatcagacaaaaagatggtgctcaacacatncactcaacacantaattaagtacacaatanatactggagtagtatatatgaactagtgatatacacaatacacacagcacatcatatggcatgatcaccatgcatgcatgatcgatgaaccaccatgcttgctcatcagaagcacatgtcgaggaggca

SEQ ID NO: 99145 - DNA, 537 bp, Oryza sativa
attattaataaaaaaaataaaaaaatcgattgatgttactagatttatcattaaacaaaatattataatatgtaactctttttatttagaatatatatagatgtatgtcgaagaccatatcaaagttaaaaataagtgttctgagacggaggaatatattgcatataggacgtcgtacttatcagcaaagaaatgaaatggatggacggtgatcacgtgttgaccagacctgacacaaactcacattcattactgttacgcgtctccacgtgcctcctctccctccaccggacctcatatcatatttccttcccttagtcgccattttcttcccatatccacgcgccacgtggacttcctgacgacggccggcgacacgtgaacccagaaccttccccaacgatctcattctcttgctgtcttgcgtgttcatgctgccccgcgggcgttgagtttcttctctacttcctccgtcaccaacgacccatgcatatctatctgatctccacgacgcgcctaagcaatccatctccatct

SEQ ID NO: 99146 - DNA, 683 bp, Oryza sativa
taaaaacgttattatgtttgtttatggaaactgagcttctctaattgatctgaatttgttattccaacaatgaccattgatctgataagatagtactagcaaaagaaacatgtaatatgtctattccagtactttgggacatgcctgacaatattggtatatgatacagtgtaaataaatacgaagaaattgttctcacacataacggaaatgtgtatatacaagcttagcaagaaatatggaatcaacaatactatcaccaaataatctaatttccttacactatatacaaatttaagcaaaccatttcttaagcaaaatgagaaaaagatcaaaccgttcgagcacggtacgaaactgacactgggacccacacgtcagccgttgggcgcttgcctgagcctgtcgagcgccgtggtgttcgaccgcggcggcgccccgtgcgcgtgcgcgtgctccaccagccgtctcgggaactgcggcatcgccatggcctccgacatgacgctcacgtcgtccatccacggcgcggcggcggcggcgtcctcgccgccgtacagagactcgccggtggcggcggcggccaccccgcccacggcgcgcagcgtccgccacgccacgtcccgccgcaccccgccgccggggccctccgcgacgcgccggagcacctcgccggcgcccgc

SEQ ID NO: 99147 - DNA, 1432 bp, Oryza sativa
ttcttacaaaaatgctttttaacaaaaaaaatcctttttaaatacagtcccaaaaaaattacgctcatattcgcacgcgcaaatcacccatacgattatgatgggttgaaaactcaaagggggataataaggcggtgtttagattaggggtaaaaaaaatttagcttgtcgtatcgaatagacggacacatatttaaagtattaagcgtagactaataataaaataaattacagatttcgcctatgaactgcgagacgaatttattaagcataattaatccatcattagcaaatggttacggtagtattatactgtcaaatcatgtagcaattaggcttaaaagattcgtctcacaatttacacgcaggctgtgtaattagttatttttcgtttatatttaatactccatacatgtatcaaacattcgatgtgacagggtgaaaaattttgccagtggatctatacaggccctaagttgcacaccataacgaggctaaccaatcaagttacgttcactttgttttagacagaattttggttcactagcaaatggtaaatttcatctaagataagggaacatgcaaatttatgtgatatcgtgacttgttgcaacttccaaaaataccttccagtaacataatgcaacagctaggccttgttcgtattatgacgtaaagttttttttttcataactggaaactgagaaacctccattattccatatatattctactagcagctgggcaaaaattaaaaaatagaaataaaaactagcagttgcttctgtccgtaaacgaattgttgtgcacgagctctttgatagcgatagaatttagcgacagctgaggctgagcttatggcatggaaggcacgtcctgggagaaaagcatcaaagaatccatatgatccaaacaaaatcggtcaaacaattcccttcgattttaaactagctttgccttttttaaatttctcgatctccttttggccactttttgcgagtggagtgatggctcaaaactgcaaagtatgcttacacttaactacttaagctgtgtctttgcgacaggatcaggttacaggcaaagaatccaggcaagcaaagcacacacaggcgcacggcgatctgctttgcagtgatcttttgtaaggcaagatcgacacatctatatactactagcctctaaggtaatcttttggcgctaccacatcattaagtcggaacaagatccttcgccctaaggctgtgtttttttaaaaaaaacgtagtacaatagtatgtgctcataaaattaggcggcatatcttgagattaataaagtcactttatatgtcttgatgtcaacgagtacgtcgtgaaaaaaaaactagttgtaaatgtgagcacttatgtcaagtctacttgaacatgggtaaaaaacccgtgtttggtat

SEQ ID NO: 99148 - DNA, 601 bp, Oryza sativa
taagtaccaacgcataaaataagagtcactgatgttgaggtttaattattttaaacttgaccaatgaatttatataatattttaaaacaatttttatatagaaaattttctcacaaaatgtatagtttagtattaaaaaatgtgctaaaaaaccaaggtaaaatgtgtaactcaatgggtcatacttcattatccgagccaattaggattatgaatgcctacaactggttacaattaatttattattatgctgttgattacgcgcagttacgtgctggatttatagtctttgcttatgtcaaatgggggatttacgcaagtagctgttgtgtggaacggttcgatgagctgagatgtggtgaagacattgccagagtgccaagagttgacctcttctggagaagtgaagagtcgaaggaagaaggaatggtattgccttaaattctacttctaggcttttggaatataaggattttatagggttccacatgaactctgttttatttacatgtaatttgggaaaagaatgatgcattcaaaatgaggactagctttggtaacagcgctttaaacagtttgtttgtcaaagtttatccaatga

SEQ ID NO: 99149 - DNA, 554 bp, Oryza sativa
tgaactcatttctaccatgtaagtgacactagctagggaatttagtttggaactttggatgagaagcaaaacactgggggaatatcgacttaatcgatacatatctcattgattacactgaccaaaggaatcctaacatttttgctctaaagtgcgctaaacagagaaaaaggcaccaacagaccacaaccaaaaccaattgtatgcaccaggtatcctcgacttttctggtgcacatgatgtcttgtgcctgacaaggaggcttgtgatttccaggcaagcagtggctgacggtgagctaaagattctggtatgtcacttagattcagcatatgttctcggtcaccatcagtgcaatcccatctgagtctcgccaccccacctgccccaatgggacgggcaattgtgcaaccaggtttcagtactaaacttaactgtagtcgcttttgaaaatcttgattgacaacgtactggaccttgatgcacatttggtaccgtatgctttggagtagagcaatgtgctgccatgtgatgtgatggagcagctgggcagt

SEQ ID NO: 99150 - DNA, 1238 bp, Oryza sativa
  unsure (1)..(1238): unsure at all n locations
ccgctgttgatgactacacattgaggcagcaccgaagccagctaccagtaggttgggcgaccgtgtcctgaacttcacctctgccgtcttctctattgacacctattaatatttacaaaaaaattaggctgtgtttagtttttgaaattggggagaagtttgaggaaagttgatagtttagaaaaaaaattaggagtatgtgtgtgtaggaaagttttggatgcgatgtgatgtgatggaaagttaggagttgggggagaaatttggtgtgaactaaacagagccttagttgataaaaaaacgtattaatcttcctcactcgaatcatgtgctatactggctcagccactgcatggcagctgcaagcgctgcaccaaactcctcccatgcacattttgttattgggttcaggtctagcctgccccttttcatggcccccttttggaaaaagtacaccgaaggtccctgaacttgtcatcgagttaccaaaacgtcctcaaaccgcaaaaccagacatcgggggtcccctaactatcaaaaccgggtcagtgttggtcccaggacagtattgtgtccggttttgtcctacgtggcgcattgaccacggtcttcaacgctgagtcagcagggcggtagttaggatataatgggcgaaatgttttgcacgcggttaggttattcccattcccccaaaccctaacgaacaagaaccaaccgngctgcngcngcggccgcaattaccttgatagcggtggccagcggcgggccgaaattttcagctcgatgagcgaccgcttgtcgtctacccgtaagtcgaaagcatttccccggccttattgggtttggtccgcttggatttcaaccccccagtgatgtgccgatgcctgtccaccaccaaagccgggnaggttgttcttttggagccccgaccacacttggtcgccggtttacaaggccacaacctcttggaagtgagggatcttggttttcaaagtggattttaggtttggcttttagggtttgacgaggggttcttttttccaccggggggtgggattttgggttttatccacgggccgccctaaaatcttttctaggatctcttatatgattctcggcaccggtgatatttttgggtgggcgaaccaatgttgccaaaggcgctttccactcgcgtaatagggcgaacacctcacaaataataatctcctcttctgggtgttgggaaaacgcacatt

SEQ ID NO: 99151 - DNA, 1141 bp, Oryza sativa
  unsure (1)..(1141): unsure at all n locations
tggccctgnnnnatgatgcccttttgaaaggccggaggacgtgaccgattcatcgaacttgggcaatgtgacagcgaagtttgttggacaacattttagccaaggtgtttgtttgctacccctacaaacaatatgacagcgtaattttggtgttgtaactttgtaactccgtaccgcataacggccatcagtaatcaccagccaactgatcgaggccaaaatcacaacgtactccttgttgtacacatgccagttcccacgcctaagagactacgagatgtcgagattgttgtcatttctcaaaaaaggatgtcgagatggtacagcactctggcagaagacgcaggacggcggcaggagccaccgcgaaaaggccgggcccaaattggcagcttacgtacgccactagcccactactgcccaaattgcacgcatgtgtggttgtgagcaacgaacctctgaccggtttttttttttaatatcaaagaggcaacagcctccgattagaaggataggcacatcacatagccagtttgacaggacagccccatggggatagaagatctcattatgcttggctcgtactagtataatgtatttcatccatctaaaaaatctaatcctaaaggatgtatctggacataaatattgttcaaatacatatttataattggttttgtttgacagaggagtaaaaattaaaacccaacaaacaatgtattaggcattttatgggtgaaggtctttaattaaaatcttaaagcacaaatggggaagtctggatgggccttttggcgcgtttctaccacgggttaaatatgcatccacatattttgccctccaaaaaatcttgaggatcgcgggacctccctctattttcaaatggattgcgaacacagaacttctttcgcattttggtgaacactccgccctcttataaaaaaatctgtgaaatgtttaaaaatatttgtttcctttatatataagggatttttattagaaattcaccgggttggggaaaaataacactctctccacattttgaaaaaagaatggtggaaacctcttttaaagaagaggtgtaaaatatttaaaagaggggacaacctccaatattgtgttttattggaccaataaaaag

SEQ ID NO: 99152 - DNA, 1584 bp, Oryza sativa
  unsure (1)..(1584): unsure at all n locations
aactgaattgactccncttgaaannncnnnnnnnnagctaaactcacatattatcagtacagtgtagcaatgcactgtggagtaccacgcaccttaagaagtagaagtgcataattaatcgttttatttttagtgagtacgtagttgtcgtcatgtcatcatgtggtcgtcctttcataagggaaacaagatgagtaataaagcagcgtacttgtgtggaattccttcttcccgtccagacacgtaagtgttcggctgtcgccgtcaacccatcagagaagggagagagaggttcgttcagtctttgttcagaagttctagaatgttcaaagagtagccacgcatgtttgaagaagcattagatcgatcgatacagggccttgtttacttcctaattttttttccctaaaaacatcacatcgaatatttagacacatatatagagcattaaatatagataaaaataaaaactaatcgtacagttagagggtaaatcgtgagacgaatcttttgagtctaattagtccacgattagccataagtgctacagtaacccacatgtgctaatgatggattaattaggctcaaaagattcatctcgcggtttctaggcgagttatgaaattaatttttttattcgtgttcgaaaactccttccaatatccggtcaaacatccgatgtgacacccaaaaattttcttttcgtgaactaaacaaggccatagtgggagatgtaaactttctcacaaaataggccattcacgtcagtggctaaataggttgtagccatccaatccaaccccctcatggtaaaattatcacataggtcctttgacaaagttctcccagtatatcccgacttcgacatttttaataatggagcggagccaagccaagccggagtaaaaacaactttcattcaaaatagagtaacttttattttaaaagaaaaccaaactaaagcaacctagacacaaaaccaacttaaaagagcttttttttcaatataatcgccactatggctcactagaaagcaaggggtcttaaatcgggccttgcgacatcgagggcaagtatatttaaatatccgtgtataaattaaaccagtttcaatgccctaaagatggcatgacactcttgaatcctaaacagaggcaccgaatcgccccttctcttcttggcttatctagctctgcctctaccccactgtctcccctttcccaacattgtcgctgctgccactaccacaatcactgcctcgtagagtggccataccaaacgagtagtgaaggagatactaggtaggaggtgaaaaaaagtccacaagtgtgaaatgaacggtggaggcaatgggaggttgtggtgacaacatcataaatagggaaggagagagaaagaccgtgtgtccgggagatgggaatggtgggagagggaggtatgtcgaggtggagttggtgcctatagcaaggatggggatggggaggaggtggtggtggagacttgaggagaccacatcggtagtgtaggcaggaggggaggagatgatgatgtaagaggnntgccantcgatnntcaaggnttcaa

SEQ ID NO: 99153 - DNA, 1466 bp, Oryza sativa
atggccttgatttgcttgtagcgtctgttgggagatggcaaaaaagaaattcggcagccgcttctctcgtcgcctccccagcccggtggccaccgccgaccgtgcctggcccttcgctgccagcctcgctggcagccgcccgctggccccgccaccgtgcacaggccgccaccgtgccccgctcactcctcgccggtgcttcgattattcctatataaaaggataagactctaagactagagagaatgaggaataggaagataaggagaggataagagtgtgagagagagaggaggaataggagatagaaatttttgaggataagtgcaaggaattatatatggtatattgatttttagtctcagttgttaacaccaaccggaattaaagatgtacataaactttagtcccggttaggaacaacaaccgggactaaagttaggatctttagtccactggggacctgacagcctctaacacgaggtggaacaaccgggacttgcataaaatttttgaataagacgagtggtcaaatgttggttaaaaagtcaacggcgtcatacattaaaattaaaataaagtaggatggagggagtataattctttttccgcttcatcaatacgaagcctcatattatcgtgggggttgtttaacaaaaaaagaagtaaaatttgtgcgaaatgcagcggcacgcggtcgtgccggcgactagtacgtacgtacttcccgtgagtaggcatgaatcatcatgactcgcgggtcgcacgcaaagttcaccgcaatttcatccgcacacatacgcacgtatacgtgttttctccgtccggtttggtactggctaaccttgatcaggaatttggattaatatttcggccacactggagatcgtctcttgaattcggcctcatctctggtgcagtttatgcgaaatgcactagccagctactccctccgtccaaaaatagaacaaatctaatactaaaaaatcaatctagtatagacgtgacacatcctagtacaataaatcgggatatacctctgtccagattcattgtactgaatatatcacatccattactggattgtttttttccggaggaaatagctagcttcagatttggtctagttgaaacccgaccaagccacgtttacgttccgtccggtgccacgacaccaattgttaagttggcaccccaaccacgtttgggttccgctccgttacaacatatcgggaacaattttatttgtcggtattggacaatgcctatccccttcaggctttttaagactttgggtggggctggttggttatttcgctttcttaaaaaatcaaaactttttctgttttttgttatacctaccttatttttccagaggctttttatttcacagaactttagaaacatattgttgtcttttatattttggcacaatatttataaaaaacccggcgcttatacacacg

SEQ ID NO: 99154 - DNA, 1317 bp, Oryza sativa
  unsure (1)..(1317): unsure at all n locations
cacaccccaccttctcgttcctntctccctttctttcttgcatcttccctctccttccttctctatataccctanttatactcccnnnttcccccnnacnatccccccctntcccncncccaggcagcccatgattgcacctctttcaaccccgcacagatacatggatgttaagcgcaatattgttggttgaattcaacagaagggagctagtgcntctattgtttttccatatgcaagccaacatgtaaatttctgcagaaacatccagtcagggagcaaatggtcctgaaataattggatttgcaccattaagagaatagcaaatgaagttgcacaccattaagtctcaattaagtaacatagatagccaaatcagtatggcatcacaacttaagtcttacatcacagataagcaagccaaatagtatggcatcacagaaatagttggctgtctagtatctgccattacatcacacacagatatagttggctaaatgcagtctgccattacatcacacacataaatagttggcttaaaagtctgccattacatcagagagcatgtttcaacataacatgacacacagaaatgggcacattcagagcttcttggtttcccatggaagaagaatgagagctcctccagctttcttctttggcagattttttgtaggctcttcagttgagacagacacaattgccttaccagatgtcagcctcacagatgcagttgtggagcttttggaatggggaactattgcttgcagatcaacttgaacagatacaccatgttctgtgcaaactttggcacttgcaacaaccctgaccatctcctggcttttcattggtgcnnnnnnnnnnnnnnnnnnnnnnnnnnnnnnnnnnnnnnnnnnnnnnnnnnnnaattccccctaaatgaggcggtttaccaattacttggccgcggtttaccaacgtcgtgaactgggaaaacccctggcggtaccccaacctaaataccttggagaacattcccctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaagaaaaccccctccccctgttttggaagttccacagggatatttttacaccccgggccacggaggggatacccctgccacaggcacactgtgtgcaaaaaaaataccccgaacttataccggggctattttggattaaatgtgcccttaaccacccattggccacgggccgcgctctctttgggaaaagagctattct

SEQ ID NO: 99155 - DNA, 1304 bp, Oryza sativa
  unsure (1)..(1304): unsure at all n locations
catggnaataagacccgtgcttacgacgcncccgncattggcgacgnnttctttcttccgcttggtcgggcatgggaggggaggatgccggaggcggatgcgagctccggggtctctcatggccaccttgctcctgaccagcaccgagttggtcaccccctgcacgttgttgttcacgtagatgttgatgctgcagcagcagctgccgctcgccgccactgacatggtcgcccccgtgctccggttgctccgctcggaggagcaatcgtctgcaacacccatcgccggcgaggtaggccggtcggaacggacggaaggttgatttctgaagctggagaaaacaagatctgcaacctgcagggatgcagtgcagcagcagtttcagttatatttggcatagttagtacgttgctgcatcaccaagaaaagcatagcatatgctactacgagcacagctggggaatcacactttgcctctgcggttgggctactccccaggctccagcaatggatgtcaagaaagagcgggttaattacatgtcgctttgcgcttatctttgtatagcgtcctaacatgacataggcacatagcaaatcaacggtcatttttgtgttctattgttgaataagctgcgcgatagaaggcccatttcagttgtcaatgatattactgggctggactgtggatttggagaaggtcagaaggctataagaaaacgccagcccattctgctcttctagtcctttctttccccttcacgacgttaagaacattgtcgttttttattcaaactttgaagcatcgccagtaaaatctcgaagcatcacacgaataaaaataaaaaagaacactttgaagcaccaccagtaaaagtttggagcatcaccagtagattaagctcatgcgaagtgcaaactagggtcggcacaacattaatatactttggatccacatctgtaaataaaacacgaggctatcgactcaaatacttagtactcacatgctgcagtcatacgggccgaacggctagctgatactaccagtaaaccgtgttcaacggaaggtagtactaatgcgttaggatgagggcaagcaagttgaacttaattaatcacagtactctacattttctcaattcatccgtgcacacattttatacttgaattcaaacagaaccaaacacacagcagcaaacatttgaactaaaaccaaaccaaacggtacatacatatgattacgaacgtcgatacagagaacagaagtttacatacggagagtgttgtaacaaacagtgtctactctg

SEQ ID NO: 99156 - DNA, 1258 bp, Oryza sativa
  unsure (1)..(1258): unsure at all n locations
ttttttttttaaaaaaaaaatatggcgctgctcaaaaaacccacccttttccaatattttaaaaaaccaaattccgcgccgtagacataataaagccccaggcagggcaacccttatttgggggacctttaattgagagtggggaaaatcggccccccctttttgggagatttaaaacttgcctggccgggaaaaatggaagttcaccatggtctggcctggataggattgcattaaaaataccccggcccccaattttgtaatggggaattttttcccaggccaaaggggcatggtatttattaggttaaaaaaacccccttaaaaggtttccatggagggcccgggaccctttctttgtcacaatattaaacggttggaggtctgttctaaccaaaatttgccgttctgggctacttgagccccagtaaagcaccacaacgcagtagaaaacaatctactccagtaagaattagagaccatcttattatctggtaataaccattgtcaaagtggtgaagaataaggccccacctttttccccactctcacaaacaaacattgtggatgccgtaaaaatctgaccactacattgcagatatatatgctctaagcattcttatgtatgagtgcaatacaaaatgctgccactggtctagcattgttacgaagtttacagtccacctagctacttatggtctccatactatctactctctcagtttcaattttacttgtcgtttcaatttacttgttctagtattcaaaattttgtcaaaatatttatcattttcatattccaaagcactttaaagatgtttttccctactattcatcaatatatccatactaatactactcctcacattattttaggtaaaattggttaggatttaattaacttagcatacctcctgtttaatttgagatttatgtataacgataaataaattgaaatgaagggaatactaattaacggactagagagatatcttcatggatggatgtttttttctgaaacaaattcatggatggatgtggattattcgtgctacccacggttggttggtccctttcataattaaggagcttaactctctctatatatagtcgcagttcttactattacattaccacttctttatagggattttctaagatccatgttttactttagactatgtgtatatatgatgacaatatattggtgcgtgattgttcttcngggnnncgtccattgcagcgcaatcaatgcgct

SEQ ID NO: 99157 - DNA, 4499 bp, Oryza sativa
  unsure (1)..(4499): unsure at all n locations
tattcctaatagtaagggatcatatatgctacacaggggaatctagatttcaatcacctgaaattttacaaaatttcagtcacttttttgctgccactagatgtgcaacctacggttgatagcccttcacttcagtcctgtcttctcagcccagatattcttaacttgtgaaatttctatacatgtgttgtgtaattcctatacatgtattgtaatctttgtgtactagtggttcgctagagcagaccgacagttgggatcacttcctaacttacaaaattgttcagagaagttggtcaacaaattgcacagaacaaacatttgcatgataagtccatacagttcaaaaaagctatttcaagtttgataagttggaattgttgccccactaattcatgccattaatttgcctgcatggataaaagtttccaaacctcgtatagtgctccacatcaactggagttccaaaaacatcttctacacaagagaaatatcacttacaggtagctaaatttagacatgttcccaagctccaggggaatgtctcacagtaagtttgtttccctttaaatacctgaacaaaaaaggagccaggaagtcttatagaagaaagtacatttcaggaccctaatgcttatggacagaaacaagcatacaaatatttctctaagtccacaaaacataagatccaatatgtacatttagtaaatgaacaatttgcagaaatttcagataaaataaacaaaactgatatatttgaatttggtttcctcaataatagcagatgtcatgtattagaattgcacaaggatatgaactgcaacaaaatgaaaacaggagcaacagattgagaaggagaacttggaaaccaaaataatttgttcatgtcattgtcaaatatcaacatctgatataaacactgcatcacatgcattgaagctcaaaacatgacttcttatcatcaggtacacttaccgagatccctatttatctttcaagacacgatcaccaggttttagcacctcttccttcactgactgactggtcactagctttttaacgacccaacttctcaagctctttaagctgaaaccataatcacagacagctatcaaaaatagcattgctaggcattgacaaacgatagagattcataaaaataatgaacagtatgagcatctgaacctacgcttataactccaaagaatataaacccataataaacttttggtactaatatacaggtatatgtacataatacttgtgttggtataaagtagttgcatagttgtatgcccaacaggattacttgtcaatactgaagactagtattattacaaaatggaacagcgtggccatgacaacttcaaattgcagtactacaattatatgtgtctctacacttttcagaacaacaaagaaactggaattaaattgcactactaggtttgcacttggggtactagataaagcagagagaaaaaaaaaagggagagcccacattagatacaagggccattgatgaacaacgcagcatttggactatggaagcagaacagcattaagtctgaatcaacaaatctaggatcagatcagccacacgataaaattaggataatagggggaaaaaggtgtttccaggtgctcaaacatcactgcacagtttcttttttttaaaaaaataaaataggcctactaaaattaagccaagaagtttcggaaaccctgcataatccaagcatcactacatgcatgcccagatcaaggggtcgaagtgatccatatccaaagtgattagaagaaactgacaatacgattgagcatagttggtactagaaacgaggtggggggagtaaaccttactgctcaccgtcatcgatcgatttgcttccggatgtccggctccctgggctgaggtccccatggctcggagagtcggagcggaggcagctcccgcctcctccgttccaagctcttctttccttcccactgcctgaagtcggaggcggaggcggcctcgccgacggccgccgcctcgccgggaggagaaggggactggggaggcccgggtggagacgaggaggatgcagatggtttcgagcttcgactgaggtgtgactctctgagggttaggcgcacggatcttgatgacagatgtgtgtaagattgggttatttcgttttgggagtatcacaggcctgttcactttaatacaattttcaacattaccaaattttgataaaattgttaaaaaaaatagctacatttaggttcgtgccaaattttggtaactatataagaaatcctgcaaaaattttagcaagttgccgaaattgccaaaattttggcaataccaaaatttggtaattttttttttcgtcaaagtgaacaggccctaaaaaccaccgcaaacttttttaagttaaaaactataacactagtataattgtattgtaattatattgtaactatattgtaactacataccatatagtttatataaaacttgcatttaactacggtttgattagataacaatgaaatcttatgtataatatgtgtgaaaaaaattttcttacaatttattttatggacaaatctctcgagacgatacgatggtcataaatctgaaagttttgggaccagaaaatttgtgaaagttttctagcaaatccgtttttttttaacatgggtggcgcagttgagataagctggacatatttttcggaaacttcaatcttaactaaaagtattgatgaggtagagaatatcaaggatgtaaaatatcatgtttttcttgtatatatattattattttccgtcggagctgtagaagaatgctgatcgagaaaacaggaataaagtgatccaaccacatcacataatgccacggaaggtaaatcagaataacaaatcactcaataacgtacctgaccctgataaagccaactggcattacacacaacaacaaacggctacaacatttacaactaagacaaaagccgtcgatcgagctacgaaaacaagtctgttattttccaagaaataagaaatccttccaaatagcgttaagaacttgtaccgggggatatgaaaaatttttgaaatacgtgcgcgttgtgctccttctaaatcttaccaacaaacaagaacgaccgcaacatcaacgtctttttgcttcccatagttcttcctcatcaccggccaccattcaaacacacatcattgtggctattcggtcatggccagcgagaagcagcgaatcatagcgtagccccctcacgaactcgggcttgcacggcaccagctccaggtccccagcgaaagattcatggtaagtcttcagaactccaggtctccaaatctaagaaacagcacaagattcagaagcaggatgaatccacaaacactggcatacctgaatatgctgaaaatggatgcatataaacaaaattacgataactctagggaaatatattgggggaaattataaaaaaatgtatcagggagcacacctttgtttggttcacttggtggaaagaagtatgcaccacctattggttatcagatgctacacagaaccccatatcctttgggtcagaggtagaaatatactcccctccatattttaatgtatgaccnncnnggcttnnttncnnntntttttcttcttttcttctttnttcntttttttctcctttttccctcttcctctctttctcccttctttncctcccctcttcttcctcttttctcttttccctntccgcttttctctcctttcttntccctttccttctttggcttttcccctctctccctcctcccttttctctctttctctttccgtttcctccctctctctttctccctgtggtttcttcgcttgccttgcctgtgtcgcttttccgtctttttctccgctttgtgtctcgctctctttttttttctcccttcttcgcgtctctccggcctggctgtttcttgttgtctttttcttgctctctcctctctcctcttttttttctcctcctcttctntgcctggtctcgtttcctctgctgctggggcctcgctgcctcttcctcctcgtgcgttctttctcccgggcgctgctctgtcgccgtgcttgttctcgctctgcttcctttgctcgcttcttctttcctcctgcgggcttattctcctcctctccttcgtgtccgctcgccggtttctcttttcctcctcctccttcttctcgctcgttcctctttctactggggccttcttatcgtgttccgtgtcgtgtttatatcttcgctcctcattataactccagcctctctactttaaaaatctatgtctgatcgtttacacctcgcggttcttctatactcatcagctctgctctattatgtcactcctctcctccgcgtcttctngtccatatctcgtcctctctttactatattcgctcgtggcatatacttacttaaggtcacgcttgctcattatcg

SEQ ID NO: 99158 - DNA, 1136 bp, Oryza sativa
  unsure (1)..(1136): unsure at all n locations
cctgcctttccccaaaatttctttcgcctgtcccccttatcttnnaaatttatacctttcctaattccaattcccaattctnaaattaaaggcctaacttttaaatgagaaatttccaacccccccaaaaataacggggcagggcggcctgtcacgtggcggggcagcggcgctcaagcgacaaaaaaagaggggtttttttttgggaacaaaaaagagggggggggggggggccaaggcaccgttcgccggtgccaacgggctggaaggcgacgagaaaaccgcttgcagaattcctattgtttctttttctaaataattaatgattcattgaatctgtgttatttgatctgtgatgtatttgtgatgtaatttttttagaatttgtgatgtgaatattttgatttgtgatgttgttactttgatttaaggatgtagggagcaactcgatttggaatttgtgatgattttggtgagatttgtgtgaaatcaatatgcaaagaacaatgaaaaaaaagaagaatagggaccagagacgtggtgctatcctctttagtcccggttggtaaaaccaactgggactaaagatacatctttactcccgagtatttgaatcgggactaaagatagcgatttttagtcccggattccctctcccgatttgttacccgggactacaaagggttacaaactaggagagatgagggtttctccagtaatggaaggagaggatgagagagaagatggatctcccccgctcagacctgccagcatagccaacttataaattaaggtcagaactactgccacaagaggacaatcatctgtagaaaaggttggtaggatttcatggcacctctagggagccatcgtcgccagtaattaaatgggatgttattttcaatagaagggttgcaccagtgagggaaaggaagccacaacaatgccctcgggaggttgcggcgcccgaaaacgtcattagtactgtcagccctgacaggttgggctttcgccccaaacttcccgccctcgcatgccattgcttccctgttgttaccatcagccgccataatcccaccacctttacagcgtagtcgtcagccntctcgaggnggtgttcaagaantcatgggata

SEQ ID NO: 99159 - DNA, 1708 bp, Oryza sativa
  unsure (1)..(1708): unsure at all n locations
ttctacaaatttggtaaacttaaagatgtttgattaagaacataaatcaaacgacttataatacgaaacggacgaagtagctagctagcaggctatatattgatctactagctacctctgtttttttagtaatcgacagtaaataatattgaataaacacccaaaatttaaccactaatttttttccttcagaatttataaaaacatgtgattctgcaccactgcattaaaataaaattcaaaatgattctaacagtatgtgctttagtgtacaaaatagaataaattagtgttcataaaagtttggataggagaatcctctgttttcaaatagtcagtgatttataattaatgcaagtgttaagatttccattgtgaaaaatatcattttgttggttgtagaaacaatgcagtgaggcaggcaatataaaggcgggtgtgtatgcacgtgtatattcatatatatacacatatatatacatatatatatatatacacacacatatacatatatatacacacacacatatatatatatatatagaggatacccatatgggactccatggtgtccgggctccaaggtataaaacacacaaattctcttaaatttttaaaaatttttaaattgtgagtatatacctatgtatatgaatttgattcatacaaatacctaacaacaaaacaactcaaactcaactttatttcacaattcattattacatacctaacgaattatatgtttggatgttatatacctagaaccaaaatctaataaaaaaaaaagttcaaactcagttcaaacttgtttgaacttgttagtaaagaagttaatgttcacatctaaacatttaaaaaaatttcatactcattcaaattgggtatatacgtaatttgaatcttggagcccatactccatgtagcaccagttaatttacctatgtgtatatatatgtgtatatatatatatatatatgtatatatatatatatgtatgtatgtatatatatatataaataagttagatataaagttgcatgtattattgtaatacttatataagttatattatagttatagtatagttagatataaatttgaaagtttctcctatttagataataactgaagccgtgatgataatatgcatgcatttaccaatagtgatatgatgtgaaattatgaaattattagctataggtctatatctagctagccacttggtgcaccaccgtgtcaaactcaaattctcgatgatatacttatctcctgtcttcactagattttgggtgtccacttggtctccaaactgctccataaattatataccattattttctgttatatattagaaaaaaaccgagttcataatatacggttacagtttcgcgggacaaaattttatatatgatttttatatgtccaatctaattatttagaaacattgttgctactcaaagttttaaaagtgtgactaattgatgagatatccaaaccgaagtatttgtactggtaggtagtaatattggggcaggacatcgcacaagttggtacttnatgctntgcgggttttcacagngngctctcatnngttctctgngggggggggggangagaaatnnanagcacgnaaacaagaaggcgacggagttatnnagaaaannnggattgatgtttaaatataataatattactctaaagcggggcg

SEQ ID NO: 99160 - DNA, 616 bp, Oryza sativa
  unsure (1)..(616): unsure at all n locations
gacgtgnnnccgtagatcctctctcaaatggactcagcccaattaaaattcaatacaaaacccaattaacatccacacatctgatagcccaattcagcgacgtgtttactcagtacatgaccatatcctatgtagcaaaataagcaaccacaagtcactaatgaacataaaagtcactcgccaaaacagaagtcgcatggctaaatagtcatttacattcgctaaccaaaccaagtcacgtgtcgaaatgacaccaatcaaaagacagccatctccatcatgaatcagcaaatcgacatgaagaggatagagaaacctgcattgcatgataagtagaagaaataatagtaaatgaaacttgttacatattgagcagacacctaacaaacacacggaatgagtgaggaatagtaaaattcatgagttaggcatagcacaataagaagacgtagacataacaaattcagttgtacatgatttacctctatacatgatttaaaaacataattcagtacactgagtgattgagatatctaaagagtagncttgcatcaatttacccctttggggaatttaaaaacccccttttttaaccccccaaaaaaaaccccccccc

SEQ ID NO: 99161 - DNA, 705 bp, Oryza sativa
  unsure (1)..(705): unsure at all n locations
tgtgctnnngnatcgtcggccgncgtgtgatggatacagtatcagtgcttcttttcccgatcaaaaccaggagatcaagaacgaaacataacaataaagcggaggtaggcctaatgcggaccatggattaatttgtttaggtagatcatggatgtggctcatagaaaagaattcagaatctctggatctccagatattgtttctccagactggcaccaaaggtccaaaggcatggatgaccgggcatgcgaacagcgcgtgacaggagacgatcgaggatgcttcatgatagatcaacgttgtcacctaggaatcaacgacacagcacagcttgattatggtgggtcgccgccgtcgtcgcagaccatatgcagccaggtcgatggatcgacgcccaggaagtgccgcgatggacgatggcaccaggtccagaagcaagatcgacgcatcaaaaaccaaaatgtttgcaagtcgtttttgggaatgaatgctctgctgctatggagactttaacagggaaacaaaagggaaactcttcatctgcaataaaagcatataaaattggaaggattaaaccgtcgccgggtagatccgatggatcaacaccgtcacctggtaatcacggtagcaatggcctgttgattggtcgaccacctctcaaaccttgcgatggatttacttggaagaaaacggcgccagggccag

SEQ ID NO: 99162 - DNA, 519 bp, Oryza sativa
  unsure (1)..(519): unsure at all n locations
ttcttataggccccgttgtgtttatgtgggtttttgggcccgcacaatttaagaacaactttaccccattttatatcttagagtaaaatttgtaaacccctcttttccagagagaatagaggggcaatttctcggaaaggcaagggtgaaaacaaaaaggcctagaggaattttcgagggatacgccgggaccctttaaggcctgcggtgtttgccacctttgacttgagaggcgatatttgtaattttggcaggggtcccaagctatcttaaatgacaattaacggacctgttacgttgtagggccttttgttggccttttgataacaggtgaattcgggcgttacgtcttaatcctgtgagaacctgtataaccgcatatgagtaggttattcctgcttntccaaacggatatacctagttggttatttaagtaacgaaggaacggcattagcgcacaatggtcaaacctcctctcaccggagcgttgcgttactcatttagtccagtgggctctcg

SEQ ID NO: 99163 - DNA, 1468 bp, Oryza sativa
tactctatgttcaggtaacaagtttcgtgtttttacatatatatcgatgtacaactaacagtattatatatgattaacctattttacttgggtgttgcttgttagtctgctgctaacatacaaaagcaattaaatgtgtagtaactgaaaaggtggtgagtcatgggatagaggatatgtggcacacaaactatatagtagcatacaaaattaataaagtattaacatacaaagcttgttagctatctgctaacatataagagtaataaagtagcaagtacgtggagtataagttatatagctaggaccacaataaacattacatgatctatacatggcaatgcatgtgaaccatgcacttactgcaagcggcaatccagagtatatgcgtggacaaccttggtattaggtagctaattaccaaaataagatagctgcttgcgttacacaatttacaaaagacatgctagaatttaaagtaaaatacaaagaggtctagcaggaaaggagccgaaagtttgcttagtttgctagcaagggatcaagtacttatctaccattccattgacccatgcatatgttaattagtattggctggaagcaagctagtatatatagtattagcatgccttgacgatgaacgcctatattaaagtaaataaaagcaaaacaaattcctccatacatcatgcatgcatctagagctaactgtccatcgatcatctagctagcttagagatagatcagtatggcacgtcaattcagcataaagatacatctgtatggtatatgagaagacaaacatatggctgtatatatggttcaattaacaagcaaatcaagataaaacaaaactacattgctttattttggttgtctttagcagagagtagtgtggaatgcaaggtttggccttgtgagccccacagatattaaagctacccgtttcattgaaaaagatacacgcaaatcaaacccacaagaaactaataaacttttttctttcttcaaatctcttttgttttccttctcaacattatagatgtctagagaaatctgacccttttgggcctatataaaccatcctaccttgcctagcatgttcatcctcacatcatattgtgttcatcctcataccaccaaccaattagtgccagtagcacatttctgcagttgtagttcaagtaaggtgatgcacctcctagcttattattcttgcacttactactatatattggtttttgtattggtactgtaaatagtattgctttgagaaaaatgttattatgtttgcaatcaagctagctatctctttctgtgggactgtaagatcatctatgatattttcatctttttgcttattgttaaactagaaaactaagaaaagatagtaacaaagtgtatgtgcttaatatttaggtatatcattcagagcaacaaagggaagcaatgaagcaaactttggatg

SEQ ID NO: 99164 - DNA, 686 bp, Oryza sativa
tttccatccttgccacaagaaaagttcccattgatggcacccacacccattgtgaatagatcaatgttgtttatcaataatatagcaaggggtctgggcttacaaggaaacaatatcaatgcagttgccaacaataatatcctagacaatattgttggttgtagtagccctgcggttcttgcaagtatgatgaatcctgctttacttgggccttcaggggcaccactaaatcctccaaactcccaatcctacaactgcacaatggatataattaactccaatgatgcttgtggttccaataatagtagcgtaattgttgcaaatcaagcaaatattgctccctctggccatttttatcccattgcccttcagtcctcatgctcgacgttcttacatagtaacaacaatgacacgattactgctatactggagggtgtagatattagcgacatcatgcatgttacaagtgatgttgatgctgctacaaaggtttttagtggccaagaagaacaacatgagaaagaaactaatgttgagtggcatcatcaaaatgagatatatgaaagtattgatataagaatcatcaatgctactactagagatggtaataaatgtagtattagctgggatgaattgggaatggccgatgattcgttgctagataattttttggagggctgcaggaa

SEQ ID NO: 99165 - DNA, 1891 bp, Oryza sativa
attggtgtaatccccgcttattcctttgtcaggagcactctcatccttcagcgacacgaaattgatacaactagagattcaatcgagagtcaatctgagggtgaggggaattttatttgatcctacctagtctatcatcagaggtacagttttttgtccgctcatggcttgccttggctttcccttcctgatgctttacattgacatgtcattctggacatagacacttacgaagtagtttgcaacaggaacaaatcatatctacagttcaacaccctgagctaccacaaaactaaaactcaacccttgactatgaaatgggcgcctttctatctcatcaacctccgtaaccacagtactaccagtgaaatcggctctttccttcgaaccacctcgtttttctgacgtatgttgcatgcatgtatatccacatgatcacacggtcacacctaacccactaaacatatatattcggccacattgtttctttaacataagcaatgggggagcgtattctatgcacacagaccctcgcgtgtacacatcgtgtacaccaactaaaaattatcacaaaaaattctaagaaaattcatacatgtactttcaatactattacatctacgtgcaaagtcgcatcttcaaattcattctacatagagaataacaaaaaagataaaattctgacaaaactgcaaccttaaaactgtcagattttttgtttttttgttacggctaaaatataatgaatttgacgttaagattttaaccctaggtgtaatacaattgaaagtatgtgtataattttttctagattttttttgacattttttagttggtgtgcacgtgtgtacacgtgagggcctgtgtgtataggatatgttgccaagcaaaggttacttaacatgaaactattctaaactctggagagaacattccccgttctttgcacaccatccaaatggttataacaaaattaaaaaaaaaatcaacaagatagattaatatgtgatacatcacttcacaaacatgcaagctcaaatttaacttctacaagttacgacaaaaaaacaaatttaactgtgaatatattttaactagccatagtttttcaattttattgtgtgacatacaaacgaggggatgtccccacaaaagtttagaattcactcccgtttcttaactcctactcccttagtcccaaaagagtagcattcaatatttatcgaaacaatcggaggtgtttttttccctcgagagttgttccctcatttttcattacatttaaaaagttatcaaaaattaattaaataatccattgacaatatgtattgcttcacaaaggacctaacaaattctttagggggttaagtgttccaatacaatagtttgagggtctaaaatgaaatatttccttgagatgattgatgcaaaatattgtacttacgtagcagcattagttttcgctatgatagtaattcgtccgtaggttattaatcctgagccatcagtatttgaatttgtcttcgtcaggacactgaaatgcgcatatatatatacgtactagaacgtctctatatatagctttggtttactatacattaggttgatgtgccagacgaacgaacagcgtttagtaaatttcctacttgactttgtctgtgttctatattgacagcatgtttaattactctttaaaagtcttgacagcaatgaatggtcaacaaggaaccgaatttcatacttcaattgttgatcgtaaggaattaaccagtgtgccagtgcgtagtttgattcgcaaaagtaaccacaataattaactaacactactagaaaaagcatttttacagacgtggtttttttcagacggacatgacccttgaagccaaataac

SEQ ID NO: 99166 - DNA, 1273 bp, Oryza sativa
  unsure (1)..(1273): unsure at all n locations
agcgtgnttttgaaactcgaatacactctgctgattctgtaatcctgctgaatgtaaggactagacttgtcccacaatttggtgcagagtgctgcgatgaagacaagcaggatcactggaatgatgaatactccgatatatctagtgttgatcagaagtaggactgcataatctgccatcactagggaagcagcggtgatgtaagtctccaagccaagaaacttgctcatggtagagtgcatcatccttatgtacacgccagtaacaaataaaagcatgcaagcttgagtattctatagtgnnccctannnnctgncgccagtgngntnnnnnnccnnccccacccccccttnntccccctctcttttcctctccttcttcttttctgtttccccccttccttctcctttttttttttcanatacaccgtcaatctttttttttgcaactctcagacgagagaaaatttttttttactggccgaaaatatgggaaatggcaacccacttaacctttgctccgtaacaccggatctggtttttcttgtgaccgaagctttcacatttttttacaaatttgcgacaccttccttggcttatctgtacgggaaactggacatttgtggaaaccaagggtttgaactcttaccacaccatttgtccttcttggggcgatatctttatggggacaccgttgcaacacaacaaaaaaatttgtgccactgaaattcctctttcaaaagaatttaacgacccctctttttcaatggggggccaatcttttgctcttttatttaaaattaaaaccatgggtttttacacttcctaaacccttgacaataaagcaccaaccaaaccgctgtattttaccttctaccgctcgtaaatggaacccccctaagcgctagtgttaactccgggtataaaaattcaataaaaatgtttttccttattgtaccccccaacaccctttcgaaattttccgcgttaaaatttaaccatattccataatccttcccgccacagaataaaaaaaaccacccccctgtacttgttttcctcttataaaactctcccaccttgccctaaaaaaaggcacaagcgccttttttggcgtctcatttctcccaaaccaaatttgttattctgccaacatattttcttatttgtggggcttttttgtggaacacgcgngtnancatctattatatattatatatatataaaaacaactctctccccacctcctcatgccatttattcacgttctcctc

SEQ ID NO: 99167 - DNA, 531 bp, Oryza sativa
  unsure (1)..(531): unsure at all n locations
aaaagccgtggacttttcccaatacctacggccggggggatacccactccgggggtaggaagattcccctcccagctgccctggggagcacaaacccccccgtttaaaccggacccggcgcggctttattccgggaaaaactggcccgggagtcccaccccggggaaaacacgagcgttttctccatggggaacgccccaggggtaaccagtcttggcggaaggcggggttttgtcgagcgtggccctaaaaggacctaaaacccgggggccaaccctcgggttaccctctaaaaccaaaatttgggaattcgggccctgcccgaggcgcgaacacttttataaaaaaggtcgggcgggcccttggcctccggaaaaaaaacacccgcggggtgagggggcggnttttctctgcaccccgcnagaatataccccccacaaaaaaagcgccctcaaaaaaaacctctgggacttttttatcgggcgggagccgccttggggtaagaaaaaatacctttaggggtcttgtgcc

SEQ ID NO: 99168 - DNA, 706 bp, Oryza sativa
  unsure (1)..(706): unsure at all n locations
ggagtattncgtcngntatggnctcacccgnnnnnnnnnnnnnnnnnnnnnnnnnnnnnnnnnttataaatcgtatgaaatcatgaatttagattgttgattcaagcttaattgtaaaatctttggttcatggttatactttaatgcatgcttgttatattatagatggatttatcttctttttattgcaacacatgacttttaatgggaggtagtgacttcttttttgagagattagaggggtgagagatgagctgcttactttgtcaatgaaaagcgctcaggttttgttcaatatttccccgaagaaatacaaaaatcatgtctttgtaagcatcatgtgttgttcctcttttctcactgctcacggaggtgcctaaactgcctaacaaggtggcaaactggtccctagtgcctaaacaccaagccaccaaggcagtggtggtttggtgggagtgtggtggtacttagctcctacctcctaggcactgtttgtttttcttatattcaaataatgttctagaactagatgtgacaatgttacaagagtaacaatagttttacttgcaggcacatttatatatatgaaaaggatatgctcattcttgctctttgtccacctgtcttagtttcgaaccattgaagaaacaatgagcttgtgttcgtatttcagggcccaaaaaagggctaaacagaacgatgctgg

SEQ ID NO: 99169 - DNA, 537 bp, Oryza sativa
aggcagctctgttcacacttcacaccaagctaataatggtctaacctctccttttgggctcctcccttttaagtctcttgcgataaggcagcacctgggttttcaatgtattcgcacttcagccatcagccgccaacctttttgctcttgttcttctctctctgcaatgagatgccaacttgtagaaagttacagccactgcaagtctccgattgaccatgaatgcgagattgacaggcataaaattcagaattttatagatgctaacactgggtttactataccacttgatattgaatattgcagtgtcattaaaactggttcctaagataggctatcggcgagatgaaacctttgataggagctaaaccttaaaaaagaacttggcagatagttttcaagatatagatatttcattaagtaaataaaagcatatagtcaagacaaatcttccatgttatttttctcttatttaaggatgatctttcatgttggcgtagcagaataatgcagcatgttatcatactaatgtgaaaa

SEQ ID NO: 99170 - DNA, 530 bp, Oryza sativa
ccccaaatggttgcttgcacacgcataaagttaattcttcttttgcctttttgtgttagtacactaatgctagtaagatcattgctgtcaatttcatggtatgcttgtgagaccagtaactttaaatctctcatgtcatgtcctcacatgggcatttcggaaccaggatatcactggattaattcacacaaaaggagagcccgctatgtcaaataatttgtgaatacaacatgacatgttcttcactatctaaaagtaatggctttaaaaataaacttctatgaaaaaccccccaaaatcaactctaaatttaaggttgaaaattcaaattggttgataagcataagcgaaaagatgaggttgtaatttgtttgagatccatttttttaacactattaaatggcaagttcagcttattgtgctggattgcaacctgaaatccgactgcatgttcggcccaaagacagtcttgtgctttctatggcctatggacatgaattaggctgtgcccaacatgaggagcagcagca

SEQ ID NO: 99171 - DNA, 776 bp, Oryza sativa
  unsure (1)..(776): unsure at all n locations
cgcgtttgaanatcgattcgcttctactgcaagtagctcatcacagtagaattaaaaaatatttgtgggacccattagtcattaaaaaaaaagtgggcccagtcacacgtttgttttttatcagaagccgactatctggcctgtggctgtatctttacaggcgctaaactggcgcttaagccaatactgcccctaggacttatggtacaaagcttctctgactgaacggggtaaaacattgaggcaaagtgatggcacacacagggcgtataacgacacaccaggcgatgcacgatcgatgcgagggggtacaagcagtgatattattggggtctagccttgcagaaaacagcatatataagccactgagatgtccaaaggcattttataatgaccatcctagagttacacaccgttattaatgagggccgcgaaccctcacgaacctgtcttaattcaaggcctacgatgatttagatcgaactggccacccggccctgggtctgaggtcgtcgcaaggcaacccaggccaacaatttacgattttagttggtcagcaaattttaacaatttaacactgacttgggttcattcgcttgcgtcaggcatatatcggaggcgcggctattttaatagactatcctatgctcagaggtgttcatttttgcccacaagacacatgcttctcacgtgtaaccacgtgacaattaccgggacggcatacagacggaaaacgtgatattacttcccaaccggtcctaactattaacaaaaag

SEQ ID NO: 99172 - DNA, 782 bp, Oryza sativa
agaggtagctcgctctaacagacggtacagtagttcatcactctatatatatgctttattgacttgttattcctcaaatagctttaattgctcattgtgaaaagagaataaaaaatatgaaaaaatgaataccgaatccttggaaaaagtcttgacgacagggacgtacccggaataaaagagaaaaatatgagcaaaaaggctcaagaaaaagaaaaagttaaaaaaattctcttggttgttttgtgctaaaggttatttgagaaagagtgataaatgcaataggtatatatgtttagtgtttatttttcaacctatgtgcttattaagatgttgcattataaatcgtatgaaatcatgaatttagattgttgattcaagcttaattgtaaaatctttggttcatggttatactttaatgcatgcttgttatattatagatggatttatcttctttttattgcaacacatgacttgatatgctatatgtatgctaagctcttgaacattaatgaacataattcctattcttgatgaaatcattggtaaaagggggagaagtaatgtgaaaattttttgatttttggagaagcaaggcgaatttttggagagttgttgagaagagcatgttttttgttcaattgaggatttctttctttttaaaaaggggggaaaagtttctttttgattttttgagcacgatgtgtacattttgtacgagtgtgctttttacacttttgttttatttttgcaaacaccaaaacattttttatgggttttgc

SEQ ID NO: 99173 - DNA, 731 bp, Oryza sativa
  unsure (1)..(731): unsure at all n locations
aaaaaatggactaatagatgtgtcagatggcacagnagctcatcataatctggctagtccagatcctctgtttttaatggatgtcaatttgcttctagcaaaaaggaaacatgaaatgaaaagaaaagaagcacaaaattatgctactccttcatgttaaacatactagtgatttcaatggcacaatgttaattcttgaattattatcacagtaactctagatggcagcaattatatttgggcccatacacaagaagattccaggggcgccagtatcatcgccagcatctaaagcgcatgcctagggccatttggaccatgagaaacgtgttgggctcaaatgtgacttccattcatgaaatttagaccggtccattaatcatctaaacccaattgtgggcccaaactgccatgcttgtgacacatacaccatatgaactagtcggtgcgatcacaatggattcactagtatgaatttaagtacatgcttcactgattaagtaggcgacattatgtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtaccccgggtactataaggataaagctcgggcctctgttgcaaagcactaccgtactt

SEQ ID NO: 99174 - DNA, 632 bp, Oryza sativa
  unsure (1)..(632): unsure at all n locations
cacgcgcgctagtnattcctnnnnnnnnnnnnnnnnnnnnnnnnnnnnnnnnnnnnnnnnnnnntagaatgtcaaagaaagaacacatataactataagcatgactgaagaaaaacatgatgcatgctccaggctaagtatagttcatgtcattgtagtatcaaaaggaattaaacatctatactgcagactgtagtaagaagtttctagggtacacaataggagacctacaaagcatggctgacaagacaatgtgagtaccaacaagcacaaaataatgtgatcctgtggtttacatgttgttacattatcgactaccaagtaaaaacacagaattaaaaggagaattctcaattgtcgttgatgcgaaatataagtagaaaatttggctgcgatttcatagctgggatagtatgaagcagaatgtccaagtgacaatctggtatgaacaaggatattctgtaactggacgcaacacataataaactagagagatttggagcaccaatttttgtgattggataagtacggaatagactctggaacaacttttccagagttggataatgtacaatgttctactagtctcatagcagtaacaccagttcactgaataatgagtctttcacaaa

SEQ ID NO: 99175 - DNA, 722 bp, Oryza sativa
  unsure (1)..(722): unsure at all n locations
acgcaggnctgaaatgcctattctcnnnnnnnnnnnnnnnnnnnnnnnnnnnnnnnnnnnnnnnnnnnnnnnnnnnnnctcctcattcaccagtacaattaattttgtcattacggccagcatatgtcgagattacgaagttacacacaacgcaatcgcccagaccgacttatgttaggagaagggagaaaaagcaaaagaaacttagagaaactacggcggctaaaaacagactccaagcgggggaaggcaccgagccatgctacactcccaacaaatccccagaaacagcgacgccagctaaatgccacatatggctctatgaatggatggactccagaaccactgagactaaagagagagtggatcaaggaagcacccgtgtcaaatatattgacgtgcaatccttttgcgcattcgtgaaaaaaatattatgaagttatcaaggaagcacccgtgttaaatttataatttaaatccaagtagattgattccaccacaaggaatctaaccagttgagatacgctcacttcattaaaaaaaaactgtacaatttacaagacaagtgtaaatattaagaacaaagggagtatgatttatttatgtacaacaataattatcgaattacttgtatacatgtgcgccgactggtttcgatataatcctaccatctccaacataaatatttaatgtttatgataatgtttggtcaagcttttaat

SEQ ID NO: 99176 - DNA, 707 bp, Oryza sativa
  unsure (1)..(707): unsure at all n locations
taagcctgggccaggnntaccttgncaannnnnnnnnnnnnnnnnnnnnnnnnnnnnnnnnnnnnnnnnnnnnnnnnnnnnnnncatttatataatgtttactaattatggattaattaagctttaaaaaatttatttcgcgaattagctttcatttatataattagttttgtaagtagtctatatttagtactttaaattaaattagtttctaaatacatggactaatccaaacaccacgtaagactatggagagcaaaacaggctcttcctggtttgtgaaccaagcagttcaagaatcaatgaaattagctaagcaggaaaatactatttccttgctaattgtagaagaatcaatgaaatgagctaagcagaaaatacgttccgttgaatttttactttcaaaatatggatatttctgaggatgggagtctttgggtaagatgagaagtttagatgaaaggtaacttgcattaaatagtgctagaaccgcttatattttaataaatatattttttaagtactaggcgtagttatatttattttggaatagatggaatatcagtgttagatgcatacacatatttccagctcaccaaaacaaaaacctaggtagtgttaaagccgttaagctagttgttgggcgttggggctgatactgctatcatttatagagtggataatctaggccacccgtcagacgaaat

SEQ ID NO: 99177 - DNA, 713 bp, Oryza sativa
  unsure (1)..(713): unsure at all n locations
cgccggcgtggccgcgctagtgaanccnctaatgatanccgctcacgnanacnnnnnnnnnnnnnnnnnnnnnnnnnnnnnnnaattctattattccttttagcgaatgatttttaattcgggatgaatttatcaggacgtgacacctacacaatcttacatgctaagtctagttacaaatctaataatcttatattaaaactataataatcttatattaaaactaagtctaagtgtcgtatattaaatctaatagtcttaattgcattacaaatattacaatcatatatataattacggcacttgcctgcgcgaattccttcgagggctagctaccactccggcttgagggacgacgacgacaacgtattttctgcaacatacaaaaagatgtattgggataaacgcgaagtaacatatattatatttgacgttcacgtttcgttcacgatccgtcacgttcgcgttctcgttaaggtcacgtttcattcacctacgctcggtcgtcacgttcactcacctacatatattgcatttcacgctcacgttaggtcatgttcacgttcacgctcggtgacgttcgatcacgctcgctcggtcacgataactagtattttaacattaaattctcactaacgttccggggctccgtcatggtcttgcacatgcccgtttgcgaggtctcggacactatccgtaggtgaatgacaaat

SEQ ID NO: 99178 - DNA, 1220 bp, Oryza sativa
  unsure (1)..(1220): unsure at all n locations
atgctgcattgtattcgatagacnatctcnnnnnagannngnggaatnnggtaccccatcaacatacatgtatctgtgtggtactatactgatagtaccactgaatttgtttttcccgtgccacgatctattcctacagaagaacaaataacacaaggtagattatttactaccccgatgcaactgatcataaagcaactaactagtcctatgaagaaagcaaagataaacgatctacttcttatacggaaactgaaaatccgtttgatccgaagcactgctgcaaatatgcaatctaagccattaacaccaaccattttctggacagcaactgaaatcatgaagtgaagtattgaagagatgttatggcagatcaaacaattgcaagtacactgcacacatggacgaaacatcacagactgaagtaaccggacaatcaacaactgtcatatctgaagttcagaactggctcaaagaaaaaagttgctatgaaacaactagtatgaagaaagagaagagaaacaatctgcatgtttcccagcagcaatttgagaagcccattaaaaattcagctaacttatggaaaagtgaatagataataaagttatgaaatgtgtgggagccattgaaaattcagctaactccatcttggactgctagcaagcaactgaaagcagggtgcagaagcaaattcagcttcactgtaaaatccatttgatgcaaaacatgcttctatcaggaaaaataagcactgaaaattacacattccattactattgactgcaatatcattgctgcatagatgtaattcatcagaccacactgcatttctgctacaaaaggagaatttactaggtagctccagcatagtagcaactgtaccaaccgacaattatcacaccaatcttgacggaaacatcaaactgttgactgaaactacactatagcacatttcagacaggtgaaactaacatgagcactctcaggggagaagccaagccagcggtgagtagttcaacgggccttgctccggcaagaacttgtccatgctgctacccgccgncgccgccgtccacttgccgttgtctctgcaggggtattctggggaatcgggagccaagaacgataacccctcacggtagagtctcccatcatccaagaagtagacgccctcgttgaactcagcgtccgggtagttgttcttgctgtacgatctggag

SEQ ID NO: 99179 - DNA, 716 bp, Oryza sativa
  unsure (1)..(716): unsure at all n locations
cacagacaagtttgaatgttcacaaatcaagaaaatgcagtgtggtgtttcaaaaccttgtgtaaaaaagaagcaaaatggtactccttcggccaaaaaaaaaattcaaccaaaagaaatttctccctcctaagcaaataaatctgaataaaaatagtccaaattattggtaataagagggacccccgaactcttcttagggtggatttttttttagacggagggagaaaatagtagtagggattaaaagggtttccatgttttgggaatgtggatctggaataaatttgtacaaatatatggttagtgaattcaagtaataaatgggggggggggggaaattttgcctcgcaacagtgaaaggctggaagcttagaacaagaaatggaggagaaagatagacagggaagaatttcctgctttaattaacccccttttcttcttcttcttctgagaaatatttacactttcatccctctggttttctgctaaaaaaaagacccaaagccatactcaccaagagggattttcttttcagtgtacagtgacacccaatttgaggtttcatttcagccccagagagaaagaggcagccaagaaaaaatattctgctctcaggcccaaacaatgttggaaatcaagggcgaaggggtacgaacttcctcaantctnnnnntcntnnnttgtgagggtttctagggtaaaccaaggaagtg

SEQ ID NO: 99180 - DNA, 716 bp, Oryza sativa
  unsure (1)..(716): unsure at all n locations
gcgtccaggtganctgctgtcacanccacnnnnnnnnnnnnnnnnnnnnnnnnnnnnnnnagttggaggttctaagataagctgtaactggacctcagtcactcactacactattctgtgctcacttctagccattgtggagtaatattgtactagatcatcagtgttctttcagaaaatgtgcagccgtgcatgctgatctgaacaatcctgaaggctgaagccaccaaatgtgtaaaccccccacctttatctgtcactactcactagtgcatttagtacttaattgcgtgattagggcgggggaacactgcacttaatggcatgattagtggtagtaattaagtagatcaccatcatcatcatcatcatggtgtccatattggagagagcctatggggagccaggcttttcaacggccctggaaacaaggcggcatgtccccccaggagtccaatcctgtctccaacggcaacagctaacgtcgctctccagtctccacacaccaattaatccccccttaccctacaaacctttccatgggccatggatgatgatatactcatatgcacccccaaccaaattaaccaacgtctcctcgacgtatatacctctccgccgatggaataaccaacccccaaccatgacatgttgtgtcacgccctcttgttcccctcacgttttttcggaacgcgcanaataattacacgtcattc

SEQ ID NO: 99181 - DNA, 686 bp, Oryza sativa
  unsure (1)..(686): unsure at all n locations
cggtggnattgtataacttcatgcnnnnnnnnnnnnnnnnnnnnnnnnnnnnnnnnnnnnnnnnnnnnnnnnnnnnnntacatgtaaaagcaccatgtaatgggctccgcttcgttaatacatcttgccgggctcaaactgataccagtataggctctgagctagcccattaaatcaggtgagcgccaaacgaccattgggccaaccgctctatggtgcgtatccgccacaccacatgctggttaaaatccttgttagaacttacaataaaacaacaatttactttgttgaggtctttcatctcaagatgctgttagcattcatacactggacagtagtgcccgatccatatctgcaccgtacggggaacatatcgcataaaaaccctgacagcgaacaacagaatttcgcagagtgactaagtccggacaatctaatgaacaacagccccatcctttcttcatgttcaggaacgcatacaaaccccatcaactactcctgcgaataaatgcacattgactctaccgggtaacatgcacgcatgtaacgctaggtcaatccctgaacacaaatcatgatgagacagtcgcggcagtgattccactacagctcgcggtgtgggcttttgcatgttgtcctcgagctcctacggccacttttatgcggtgagggtgcgtacgaggttt

SEQ ID NO: 99182 - DNA, 1174 bp, Oryza sativa
agaaaaagaaggaaaactaagtaattaagaataataagacgatacatacacggtggtagaagatgatgcatccgcaattcgtagaaaacaagaacagcagcgataaacaaatgattgtacaacacaacatagttcaaagagatcaataataatagagcaggaaagcagaatagaaaaagaagactagcagactgatgggcagtgagcctggatgcaaaacagacaagtatacggcagtggtccactgatcaatacgaccaataagcccacggagaacagggaagtgatcataaacatgaagcaagcagagtaagaaaagaagacccactaagaaaaacaactcgcactacggagaagggggcccgacgccgcaggctccccaggccccgaggaaacccgggcgccggctccacgccggcgccggcaagcgccgagcgcccggacgcgcccgtccgacgcgcgggacaggccgacgcgagagaccggccgcccgatgggaccaaactggcacctgtcacacactgtgacctgtcacggtgtgtgaccggtcacagaccggtcagatcgcgggttaggtggcaacaggcggcctgacacacgcctcgccccgtcccgtcggaatgatgagagcctccaggcactcgtccctagccggagccggcgtgctaactcctggagttggcacgtcagtcccggccagattcatgccaggcttcatcgcaaccattacaaggaagtcattgtatgaagaagggcagatgtgcggcatgctaaactgacgcgtggtggacaagaatgaccggtctgtgactggtctgacgccggtcacgtcatcggcagacaaccgtgctcccacgctgcatctacttccggcgaagtggaggcgagtgacggcgctgggcctcactcaaggacaagctgtgatttagcttccaagcgaaggcgcgagccaagtttttggtcaagatagggtgggtccccacccaaaagaagagtaggtagaagtggtgcatgtggtatccccgtgagatataaaacgaggaccttgccccaccgaaaaggatgatggggaacgaaaaagggaggggggactctgagacgaccttgagaatacctgagctcgtataggaaaaaaagaggaaagagggttctagaacctgaactcttttgctct

SEQ ID NO: 99183 - DNA, 677 bp, Oryza sativa
  unsure (1)..(677): unsure at all n locations
atttgatgactatcgtatnnnnnnnnnnnnnnnnnnnnnnnnnnnnnnnnnnnnnnnnnnnnnnnnnnnnnnnnnaatctcacgtgtacattacattctaagtcaagatttaaccgcagtccacaaactggagcgcgtgttcctcgtatcctgaggggcatgacatcttannnnnnnnnnnnnnnnnnnnnnnnnnnnnnnnnnnnnnnnnnnnatccgattacacctggtacaatcataaataccctctggtatccatatataatccgatctaagagaattatactgtctccagacggcgacatagctatgaggcccataccgatcgaccttacctacatataatcagtctgtatggctaatatacacaccctatcacggcgatttaagcccctattacctatttacaacccccagacggatcacttaacacatcagctcaaaaataaacgatccgttagctgtatcctattccttcggttctcgcttatccatctatccgcggctagctttaaaccatcggctgcctatagcgngatcaaataatgttgtacggtaccacacccctaagagactttattacctgcactggaactaaagagatccccaggcttatagaggttctcaccctctgatgttacgtccacgggacttattacgagcccttgatccatttg

SEQ ID NO: 99184 - DNA, 958 bp, Oryza sativa
  unsure (1)..(958): unsure at all n locations
tggggtcnnnttttatatatnnnnnnnnnnnnnnnnnnnnnnnnnnnnnnnnnnnnnnnnnnnnnnnnnnnnnnnnnnnnnnaacttcaaaaagcagaaaattaaaggcaaagctacgtaaattacattagttgaggcttagacttaaaagaatatggcagctggtaattcgtattttatcgggtgaagctaaatgaccaatggtctagtcgtccaatggtacgaatccgcgacaacaaattctggtttaatttcttctaggaatttaaaatatttttatttttctctttttttatgttttttctttcatgtttatgttttttttctcctactagagtgtagcgcccgttccgtcgtggcgcctagcgggaaaattatctcctaaaaaccctaattgcgaaatttgtttcttcgcttgttgtctagtgtccgtgccatctcaagatctcaatccccgatctatcgtcgagttcaattccgaatccaaatccttccaaatcattcctccgcaaaagtccattttgcctcccccggggtcgatgggccgaatcccgctctgaccagactcttgccgggctctggaggctgaacattgtagctatcctgctatgtgttactccttcacacacatatccaccagaacacaagagtagggtattacacttctcatcgggccgaacctgtctacattcgcccggtctcgtgcacttgctctctcgcgaacattctacagatcaatcgtgggctaataacctcacttagcgtaccctgacgaaccggcaaaggggggcctgtgcggtcttcccgtgaggagctacacgcttccgccggtatattaccattcttcaagggtcttatgagcattttttcttttgaacccacgcgcgtgcgtgatttgagacactccactttatcttctcggcttagttggaggatggcgccttattgtgcccttgaa

SEQ ID NO: 99185 - DNA, 913 bp, Oryza sativa
  unsure (1)..(913): unsure at all n locations
ctcgttgnngtgannnccagtttanaccgnacaanncnnnnnnnnnnnnnnnnnnnnnnnnnnnnnnnnnnnnnnnnntgggagttgaccttgagcttcgctagattttattttccgctgcagttttcttcatggtgagggctaagtgcctcttaagtaaatatttatcgttttaattaatttgatgaatctgtatattaaattgtcagtttgtgtacctcggctgattcctggacgaggattttatgcacaaataagttcggaaattactagtgaattttcgggcgtgacagcgacgtagcctgcacgaatccacgccgcggcgtagcttacgcccgtcgtcgcctcccgaagtcgccgacgaaatctccgccgaaatcgccggacgagacgatgaggaaaaaggcaaaaagcaaaatgaatctctcacacactctctctctctagtctgattcagacaatctctctctccggtgcggatttcaaaatttgaatagtgtatgtgggtcccaccattaacacactctcacaaaaaaatctctctctgtcggcaacacaaagtgggtcccacaaaaatgtaaaaaaaaaaagaagcccatttagcccacgtatggaagcccgaacttacaataatcaaaagcccacatacaaaagaaaacaaaagtctagatagcacgaatctcaaacaaaatccaagggaccaaaaaacgaatgatacagcctaacaaaaacatgcgatagccatatagcctttccgataaaaaattggttaacattttttctttcccctaaatttgtgcaacttctgttgtatgttggttgatatgcagagatgagactatatcagcattattattataagttgttaactagttgtagtgatggatatgggcataaagaagcaagttatatg

SEQ ID NO: 99186 - DNA, 1396 bp, Oryza sativa
  unsure (1)..(1396): unsure at all n locations
cgttattcccctccctttcaaaaatattaagcattttttttttctaggattcaaaattataccataatataaatatttttgggacattgattttagtatatgaaaatccatgtattttcaaccaatcagaagcttaggaagagaaccaaagccattcaaaatttaaattttgagtaatgagacgaataaaaagaatatttctcatcaaccttaatctttgttaaacaaatcataaagcttatattttagaacggagagagtaggtggaccgatgcacatacaaacccgccattaagttgattggatgaacatgaacagcacgagaggaacatttcatttctggtcacatttgagcagctactcgctttcagatcaaatcttccattaatttcctgttccttgtggtttctcagtgggggcatctagtctcagtcgctgacgagccaatgcatcgaatgggcgagcatgattagattattggggggacagtggtgcccattgcgaagtgactaatgttcatgatattcgatcgagcaaccctggagtaccttctactcctactatactatccactgatccacagctattagctagctgctcagatgattggaagagtccaagaaaaactgtaatgcctttaacatcggtcaatcagagatggttggagtggattgggactgacaaagagacattatccgtcagcaatctacattgccaattttcttttcaggcctgaagatgagacatgcattagtcacagagaagattttcaggatttcactagtccttgacagtttttgacagttactagatgcaaaccacttactccctccgtcacataaaaaacagttgccggcaacaaatatagatagagctatcaatttttggctacgaatataatttgttcttttttaggaaggagagtataagcatgaatatgaataactaacagtaagatgactagaacctagatgtccatgctgcatttaagtccaggtgtttgcgtctgggctctaagctacttttcttggtgcagatgcatgctttgcaacttcttcctccttgagctttaggaaagaaaaagaaaagcttaattgtatactataagcaagaacacgttcggttcagatccattttgattcctgagatctcgcagagcgagatttgtcatccggtttatcgatccaaagtgggcgttttcccactaatcttttcatcatcttcttctttctgaacctgttgacatcactcacatatatttttttaaaattttaatgctatataagcgtcacgtggcatgaagaccagatcaacannnnnnnnnnnnnnnnnnnnnnnnnnnnnnnnnnnnnnnnnnnnnnnnnnnnnnnagcaaggggttctaaatnnnagcacg

SEQ ID NO: 99187 - DNA, 724 bp, Oryza sativa
agccgctgaagtttcatagagtggtagatatcttatataatctaaaccaacgtcgatatctaacctaatcggctaccctctgttaacagatgttagccgattgtgggttagatggtgatattgctagagattatgtaagatatatgataactcgatgaattacataaacaagattagagtatcataaagatgtaagcactaatcccgagaacgcaagccgtcataacaagttttacctcttgttgaagatcgaaaccgatgcagctcaacccgaaagtaagaactcgtcgaaataaaacaaaagcaaaagggtggcgatgcgccgaaattgtattgaacgtgtgtgttaattgattacatggggttcggggtctatttatacccgaaaattacaaactatgtccatatcggacacgactcttatctctaacaaaatctaagataccataagtctttgcgacagacttttacccaaacatatctttaaggaaattacataaaatattttaattaatagatacaattgccttctcaggactctatccatgtgcggcaattatcttgaagcacctcaattcaacccgatgtcatacaccaagtcgtattgtcggaatcggctgcatcggcttacctagtccgactcagacccagccgatcctaatcgtagccgatctggactccagccgaattttggtttggttctaaaatggaactccgccttcgg

SEQ ID NO: 99188 - DNA, 1182 bp, Oryza sativa
  unsure (1)..(1182): unsure at all n locations
catgatgncaattggatnacactganattcggcctcccannnnacnnnnnnnnnnnnnnnnnnnnnnnnnnnnnnntgttagttgatttttagataatactgcaattagtcgataataagaacctgtcaaagatttattgaaaaagacctgtgaaagaaaaagaaagagaaaaacaagcaagctccaattaatcacctgttgttccactcaagtttgtgcaattcattcagtccattataacccttgtagcaccgggagctaacttcacgagttatatcatatacctataagaatggagtagaagctagtcagtgcctcagtggcataatacaaaatataatgcagaatgaattcatcatgtaggctcaggaacaattgatccctcctctttttttccctatgttttcttgttaccatttaccatgcatgtacttctcaagctacctacctagccttttgacaagtaaaaaaaaaatgaaaaaggtaatctggtatatctcttcacatactaatccgtattggtgatggaggaattcacaaattataaaggtaatctggtccttaagcattattgacggcacgattccgttggctacctcctcgactgtgtggtactaaatgctgacataagtagtcttcaaaattgaaaaggagtagtgattcataattcactcatattcagtaaaaaaaagtaataattcattcatatttttaacaccatgtatcacccaagtagcaactccttccattcccgaatattttaaaaaatgttagattctcttatgatggaaaattgtgtgattatatttttcacataaggtaatttgataatataatatattttgaattgttttataaattaattaacggaaaaagattagtcaaagtttgattgtgaatagtgtttggtgacaagtttttgggaacggagggagtatcaaggctagattgcattcaacaaacgtctacgagtccaactaagctgtcactattagttgctttgctctctgcagaagttaggttcagtacttgtaatggctggtctgcatacattgcaagagtttttacagtcgaataatactattcttcctacattaaaaaaagaagaagaagaaaaggtgggacgttccaagcagaaagactgagctatggaaagtcaagtgcagattgatggtgatact

SEQ ID NO: 99189 - DNA, 695 bp, Oryza sativa
  unsure (1)..(695): unsure at all n locations
tttgantttgatatacnnnnnnnnnnnnnnnnnnnnnnnnnnnnnnnnnnnnnnnnnnnnnnnnnnnnnnnnnnnnnnnattctgatcgcaagggtgcatcaacccggctttttccacaaaacgcaaatgtaaacacattggaacaaagtaatttgcatgtgtgtactagttgcgacccctgtccttcgataacccagccaaccgaccttgacacttcaaaattccatatggtttggtgatcaacttaaactgaggtgcaactctgggtagagaagagatatccatggctggatgattacccctaggaggttctagcggactgtcatttgccaaaagcgatgcgtcattttctgtgctctcttgatggaaagccgcagacgtactactagaacccctgagaatatatctaggtcctagcatctgatgacagtgatgagtattcatagaacgtggatactgcagattaaaagcagttccatcttcctcagggcgaactgatctagcccttggagagcttagctagatgatgacaagtcatctatgaagaaagatgcacgcgcgtgctctgtaatagcggactatgatactatcatccaatatggtcggtatgcatagaaaattgttcagacaccaaatgagtacttggccccacttaacagcatgaagctactaaaattccgaatatacatggcgg

SEQ ID NO: 99190 - DNA, 703 bp, Oryza sativa
  unsure (1)..(703): unsure at all n locations
tttgantttcgatatcnnnnnnnnnnnnnnnnnnnnnnnnnnnnnnnnnnnnnnnnnnnnnnnnnnnnnnnnnnnnnnnaaaccttttatgggtcaatgaaaaccactgcaattgttatcacgccttattatgctgagcgtggttccaggaataacacctatataggtgtcgatctctatttgagagctcagtaagaaacaccagtgctcttacgacacattggccatattggaacgggcacacctcaaataaggccgtgccatcacccgtggtgatctggttataacctatgcctacacaagcaaaaaggtggacagacaatggttttggcgcaagctggcctctaccaattttcgtgtaccaagagatgccatgtggcgttttgcctaaacgaactttacaatgcgggcagaatattgtggaccataatactcgactctagtggtcagtttcgataatcgagctcctatacttgaaaaggggggaacagagggccattgcatcaagtgagataatgatatgttcaagagtggtagatatgaccgacacaatttgattcatgagagcagaccaaggccgaatatctttgttttgaggtaagtaaccccaaaatagtggtcattgaggcttttcatcacattgttggaccaatgaagtggagccattactaacacatggctaacccactgcgtgcagaaaagg

SEQ ID NO: 99191 - DNA, 1220 bp, Oryza sativa
aggtggcttcaggcagtaataaaccggtgggtgaatgccttacaacggagtcagggatgttttgattcttcctttggcggaagacaatgttgggggacatatcccgggttgttattaacacattgctgcacaagcggtatgacttccaagaaccaatcggtgcttgtggcgtcccggatggctcaagatcaacggaatcacagcgttcgacagccaatcggtaatgccggatctagtcaattccatcattccaaattgcagtgaaaacgaaaagagtaaatttcataaaactacagatattataaccaaactatcacaaaactacatatttaaggaattatatcacaaaattacacatttagcaccaaatttagcacaaaactacatattaaagatgaagtgttacaaaactacacgtttagttattaaattatcataaaactaaaggtttagaaccaatttaatcacaaagtaataatgtttatagctccaccataacaatggtgctagggatttaaactccaaaagttatagttttgtgataagttcaatattaaatatgtatttttgtcacacctaacttaaaatctgcagttttgtgataaatttgatgctaaatgtgtagttttatgatacaactccttaaatctgtagttttgtgataatttggtcaaaatacctgtagttttgtaaaatttactcaaacgaaaaggaatcgccaatactatggttgtgtttgcaaacccatgttcccaacccctctccctcgtttttcgcgcgcacgtttttaaactattaaacggtgtgttttttgcaaaaaatttctatatgaaagttgcttaaaaaaatcaaattaatccattttttttaaaaaaattagctaatatttaattaatcatgtgttaaaaagccgctccgttttgcgtgcaggagggatgagttcccatcctgcacttgcaaacacaccctataaccattcatattttcaacacataaaacaggtccatcaaaaccacacgaagttttctaataatacctcacaaataccccatatactttatccaatctttacccatttagtactgtcggtgacatgggaccgggggtatcgtgactagaagcttgggcagccgcggtcacccacgtggcctgaccccctcgggggggtcgggcccgagggtgacatggccacccctccctctgtctccccgaggggttgg

SEQ ID NO: 99192 - DNA, 661 bp, Oryza sativa
  unsure (1)..(661): unsure at all n locations
ccgcgttttgtatcttcctgnnnnnnnnnnnnnnnnnnnnnnnnnnnnnnnnnnnnnnncaaatggtaattttttgggaatagaaaggtcatgttgctccgtgcaaataatttcatacacatgtggttgctattattgtaaaacttttagttttttttaaagatatttttcaaatttttagtgcactgtccaaatagtttcatacctgcacatgatgtaattaattatccttggttattaatgagaaatatattgattatcagatcaaacgagagttcaatcgagccaattgataggaggctcttcactgagggcatctaaaaggtggcagaagtagagcacgctccggttgctcagttgtattttgtatgtccagaatgtgaaaataggcgaagtagctgtaggagacaatgtacttgtaagttgtaactctacagatgtgagagcattctgctgacgaaggacgagcagctgatgactcatcctttgctcatacagatcaaatatccaggaaaggattcccttttctgttctccatgtttaaacctagggttatgagattgctgaatgtaatgttcaaaagcaggggactccccaaagttcaggggtaaatcttgcctggcgattaaccggacaagagattcccgagcaaccatgggag

SEQ ID NO: 99193 - DNA, 619 bp, Oryza sativa
  unsure (1)..(619): unsure at all n locations
atgagtatgtgtcaaccgttgaggacgtcaatcagatatcagtcaaatgactttgatagcagtgatgctttacacctttggtcaggaagccgctacactaatctgcaatagaaaaaagaaagaaagaaaaagaaaacatagcaaggcatttggaacttaaatttagttagcattatgtgaataaaatttagcagttatataagctatttacatgattgttcgttaagatccaaaacttttttgcttgttttagctgcagatatgcactttagcaagtatattgtagttagtttcagtcgaatattgatgttgttcctgagctatcaatgccatgccataatattggaattgaataaaacaaaaccagagaaactaattgattaaaaaaaaaagagtagagcacatttattctgagaacgctccttcactttgaccacaactcttacttcttctaaattgagtaggggaacaaagaaattggaaatccagcagcttaggaatttcatcatggcagcacatacacagagtcacagatcatnnnnnnnnnnnnnnnnnnnnnnnnnnnnnnnnnnnnnnnnnnnnnnnnnnnnnnnnnngagagtctacatnnnnnaaccca

SEQ ID NO: 99194 - DNA, 529 bp, Oryza sativa
acatgtgatgactgagccacttgcactataagacaaatagatttaggtttaattggatccattccgtcgacttcatattcggcaacgccctctctctctacgaggtacacacattgcttctttctcttggttgcatacacatttcctccatgaacattatagcagggaattgcatgcaacccgggtgattaggttgaaggtttgttgctaaccaagatagataatttaattagcgcctgaaatcgagtcaaacaggaaatctatgctcaatcctgtgtgtcagtgtccagtgctacagcccaaatgcacaacagatacaccgtgtcagtaaacactggcccgcagctttctgacagggcactggcctactgtggcacctactacaatgcaccacactggagtcacacagaagaaagaattctactatcgaccactgttaaaactcacagggttacagtagaggcaaaccactattatcggccacattagccccccgatcttgtgactggccctactacagctacacgaa

SEQ ID NO: 99195 - DNA, 1030 bp, Oryza sativa
tttatcagttttaccgaatttttacaattgggccaaatagcatttcgtgatttttcaaccttcatttttatcagcataatcaccatattaaactaatgccaatttcaaatctcaatgtcaaccacttgtttcatccaactcaatattacataaaagttcaatatctcatacagcacaaccaaaagagccaattcatatgaactcacaaatttcttaacatgttacagtaaaaaagtaataaaattacatccaagattcccaataattctagtattaactcattgtaaaaagattagttcagtaaacaaaatagtttagctcacacaatcatgcacaaattcaggaacacattcaagatatgttttaaactcaagactatctcagttcaatgtttctctcatcatcagacaacaaaatgaagatttcagataatagatcattgttgatttgttcaatgtctcaaaatagaatataatgaaactagttacagtgaacttgtattacaaatatatagagtgaacactacaatttcaattgaaaatacatgtaactacaaagaaacaatgtaaaattcatatgaaatcatgatctaatgcagtttcaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaagtgccatcagatattataagaaaaagtgccatcagatagtttgttccataagtaaattttaactggaattacagtagcattatactcaaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaa

SEQ ID NO: 99196 - DNA, 737 bp, Oryza sativa
  unsure (1)..(737): unsure at all n locations
cgcgtgattgaanattgtatctcnnnnnnnnnnnnnnnnnnnnnnnnnnnnnnnnnnnnnnnnnnnnnnnnnnnnnnncatatcatatggaattacaacggggaattgagatacctgttgccatgttcactcctatgattataggatcaactatgaggggcttgtgagtgcttccacataccagtcacgatgcagtaaaatgaatggttaacgcgtcactgcactgtggttcatgatgtatcttgccggcgaaatcctccccaatgtccatatctttaccaccaaaatgctggtacaattgttaggcattagctatgatttcaagagctacacccttcggacttggactggacgccaacaatgtctagtcacgcatgagccatagcttaagagagcaagcacttccgacatgagtaagtgttcacagggacaggactagatgcggtctacacgacccatggcattaaccgcacctgaagaattgtttaagcgagagaactggtcgtcgaatatacagttaaagttgaggttgtgtagtcccacaatccctgttctgagaacgctaaactgtgaccataagacggtataaattctatgcgaatggcccttgaagatcatctaagatcatctctatccgtaggaaactatatatggcactacaaaacattgatgccaaaaggcagagccgatgggcttcagtttatgaaaatggggggcaaatgcatattgaggataac

SEQ ID NO: 99197 - DNA, 531 bp, Oryza sativa
tcaccggtgatgttctggctatcagccatgcctacacaggcaaaaatgcagacaaacacagctagcgccgcaagctgaccagtgccaatctccatgaaccaagagatcccaaatggcttcttgactaaatgaactttagagtccggcaagaatattgtgttctctatgactttactctagcagtcattctcgataatcaagttcccatagttgaaaatgggggaacagagttcgcatgcatcaggtgagataatcatttgcttcagattcctagaaatgaccaccacaagttgcttcaagaaagagatcaatggccgaatctccttctcagcaatcaagaaaccccaaattgttggcaagtagccagttcataatcttgctccacaaaaaagtgcagtttttaccagcgcttgcctaccaactacttgatgaaatgctcaaatgacaaaatggcaagcacagctagccttcagggctgcaaacgcaaatagaaaggggaaaagatgccatcaaagtcataaacgtgctaat

SEQ ID NO: 99198 - DNA, 1814 bp, Oryza sativa
  unsure (1)..(1814): unsure at all n locations
ggttaacaccaacaccaaaggggaacagtgggaatcagggggaaaccctaatcttcaattcaattcattttcttttcaagggggagggactataaaaatatttaaatagagcaggggtgagtacttttgtactcagcaagtcacggaaattagggtgtttaatgcaggttggaagagaggcaaaggtgttttgaaattttttggtttgaaatcatttggaatccataaagtgattattttctttttaagttggggtcaaaaagagacttgcgtctcaaatcgacttaagagatgcttttaaacagctcaattggaaatgtaccgacctcccgggtcagatcattacttctcagctccacaacagcatgtagcatgctaaataggagatggaaatgaacaaaaaaggaaaaaaaacaaaaaggaaagccattggaataatcttgcgcaatcgacggtgcgacacctccacaacagcagcagacaccgagtcggctcgccgaagagcagccttgtcgcctcgctaaatcgccgccgcgtcgccggagacgatgagaacgagacgacgaaatcgtcaacctctccttctataactctctctctctctccgtcggcaaaaggagcacaactagcggagcaaaacaacaacgaatcgagcagcaagctaacaaatgaagctggagaagaatcaaaacatactcaccggagaaaaggaggaggaggagctcgaggacaagatggagaagcccacaccgcaaactctagtggaatcactgccgcgactgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagagcttttcttgtttaaaaatccttaaattataaattgttgtttaaaaggaataattagaaatgatcttaaaagagaagatctaatttgctaaatctcaatataaaattgggttagataaaattttgttaaatactttacttgattctatagttcctagatttttctgggatttatttgagccaaggaagtatttttaatcaatggaatatcatttcatgaataatttaaatagaaaaatgtttttaaatcctccttttggctttgggccgaaagccggcccaaaacctctctctttctctctccctccctggcccaagtcggcccgcaaccaagccaccgctctcctctctctctctctcccgctgacaggtgggccccacctgtcgggcccgtcttcctcctcgcgccgctgccggccgaaaccctagccgccgccgctttccaatccggtcgatcctttccgtttccggtgaaatcgtttgaggggaaataatctcctcgatctcctcttccttttctcttatagaaacttcggtcaattacgtttggaaatcgacggatttgagctcgattcggatcgacttttctccggggtcccgnattcctcgagttannggnggtgngtcccaggagntgtcatcacactgggggggggggagggaatagaaacacagaggtagttcatatttaaatatttacaaanancagattgggatacgnagaccattatcacaagtttagtatcagagtacagtcg

SEQ ID NO: 99199 - DNA, 1408 bp, Oryza sativa
gttaggctgcaaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagattcttactcggattcctatcaaacatgtttatttttggacctttgagtgtttatcactcggcccttcttgtattttttgtccttgatatattcaagttgagaagcagtcggctgggtatcttactaagtaccattcgtgcttcgctataaaaccactcggttcttgactatatgtttagtttttcaactaatcacatactcgggggctacacctaattaggtgcatctactcgatgcaccatgttttattttcgcccttcacagtttttaatttttagcactcggcaagctggagcaagttgaattgaagcactcggactactgtttttttgtttcgagaaggctattttgtcaactgcgaaggtctcgggggctactgtggagattatggataccccatatctacatgacggttgtaatttagtcggatatacggtactaaatatagatggaatatctctatgaagattcgggttaggttctaaacttgtatgtcaaggaaatacccgggatcttagtcggttacgattgtattttatctataatcccatattctattaggatatggactgtattttgtaaagcggactcctttccctatataagagggtccgtgtgcctcttggggggcgattccttttccattttatacaatcaataacacactcggcggaatcatccccggataggagtagggtattacttcttgaataagaaggcctgaacctgtataaaatttcttatctccaaacccatccactttcctagcttgatagccacccccttttattattgtcgaaatcttgcttcgacaaaagtaattaaggccatcgcagaaatatattagtctagcccatgctacattaattgatcacgttggttttacccaacagcacggtatagataaatcataaatggtctatataattatatagattatatgtatgcttgttatctcgttatatttgttcagctaaaagatttctagaaccgccaatcgtaatattatagcatcactggcagaattgaaatattcacccccaaaattttgtttttggcttcttaatctgaaaataggaagtgaaaaaaataatctcttcaagaaaaaactttaatttaatttgaaaaactaaaagtgagctattctgttaaactaccaaaaaaggctcgcttcccctcgtatcagacaatttcagggtagggaactccaaaatcatgcaaaagaataaagtatctggt

SEQ ID NO: 99200 - DNA, 641 bp, Oryza sativa
ttctgtggtttaagtgatgtatatgcaatgtgctatgtgaagtgaatttgtattcaggaaaaacaatgcagaaaaaaaatgtgatgtttcagatgggaaaaaaaaaggggttttgggcccccaaaaaaatttggggtttggggccaaaaatttggggttgggcccttgggtggagaattaaaggcaatggttatatttcaattctgaattttggatgaagtttttaactttcttatgtttgcaatgaacaaataatgtgcatatccatcagtctctgttgaatctgttcagttacacatgcatggctcagaataatacacgtgcacatcaaacagtagaacttcttcaaagttcagacaaaatgacagtagagcattgcaaaatttaaacagaatgagaaattgaagctataatcagtaattgcattctgagaatatgtagccagaacaggaagatgtagttaatgcctggattcagtttggcattacaaaataaaagatgccagccatttcttcgataattataaaaggagacatggtagccataatcagattgacactatcatttgtcattacaaaagaaagtactgatagctttttagcctaggttttaagcaggtttatcagcaattctacttttgg

SEQ ID NO: 99201 - DNA, 630 bp, Oryza sativa
cggccgaaattttcaaataactgccccctaattatatgctaatcacatggtggtgcattaattaagcggcagcatgctaattacacaatggtacacgagtgtgttgcggcgcgccctcgctgaagatttttcggaatgcatttgcaccctcacgaccagcgagttcttgcatactagcctcacccgtgatatagtgcatgtgcagaataggatagaataaaagggagatgcatttcacgattctattactgcctctctttttttaattcaagctgcacatgactaaaaaccaatgcagccattaacggaaggtagaaaacatctgcagtatgttccaatgaagcccacagcagataataaacaatgattcaaagcaatgaattccacaagatcgaaaatattttcatgtccctgaccgcctgctggagaattctaaaatggtgtggtggggttttgaaacccaattttcttttccaaaagggggaaattaaaaaaaaaaatttggggaaaaccccaaaagggttttccccccccctttttttctttactccttttatggagctggtggttgtgatgatgtgttctgacatgcctctttactcctttttatggagctggtggttgtgatga

SEQ ID NO: 99202 - DNA, 533 bp, Oryza sativa
ctcttccgacaagccggccggcgggctggggcaaaggcccgccggggcgaggcgggagaggaggatgaggcggacgacgaggcggcggctgcgatgcgggagaaggcgagggcggcagcggctgcgacgacgagacggcggctgcgatgcaggagaagactacggctatggcgacggcggctgcgatgcgggataaggcgagggcgataaaaactttctagattataacattttctaaacaacaaatattaataacacctaaatttagcaaatcattcaatgaggggaaaaaaaatcagaaaatcaaccatcagccaaaattagcatgtggcttgcctcccccacctccattccccaccaccaccttcctctctccatgcagcaccccccacctcctcgcctcccacacatcgctcccgcgcattcccaccgcccgcctccctccctccatctgccgccgaggagttccccgatcgcgcgcgcgcgtagcgtagcgtagcctaggcggcggcggccggggccggaggggggga

SEQ ID NO: 99203 - DNA, 611 bp, Oryza sativa
gtagtaaataaagataaagattagatatccaagggataattgttatttgatgaaattactatcatggcttggttggagagttaaaacttactaaaaggtatgggataaatttggttactattttatcataatatccgataacatgaacataatattttgttagcgcttaccatctatcaggcggatctacagtgttaccactggtgtcagaagacagcgatgacattcgacaaaagctatgtttaaattgcttgtctatatattataacactatattctaaatataattagcatgctatgataacgatagacacgttaggactctagatccaccactacatctatgtgaccttctgtataatttgcgttgatgattgctttgtgcataaaaaccatcaatgataattatagagaaggtcacgatggttttgttgtgaaattcttgaagaaatcatatatggtttgttgataacgtgaaatcaggctgggtctgctgaattttattgagttcccatatccagattggcccttttcaacttcctcaattttccccatcaattggtttggtttggtttaatgaagcgggtaatctccactcggcccagggggga

SEQ ID NO: 99204 - DNA, 601 bp, Oryza sativa
ggcgaattcgagctcggtacccaaccaatcatgtgcatcttgattgagagaacccttttcttccatattgggcacccactctatacctgacctagacctagcacatgcccagagctggtttttcagattttcacctttgaagtgaacttgaaagttggagtagaggtgtctaacacaaaacctgtgttctgagtctagaaaaatttgctgcacagctggaatcaaaccctgcaatcaagcacaaaccaagaacaacaattaacacaaaacagtttggtgacatttagaagaaataaatcaagagcttagagaactaccttctgcttgtctatcattattgtccaaggataagtattatcaatgcctagatcttccttcagggtctgtagaaaccacctccaagagcttagagattcagtctcaacaacagctaatggtataggatatacgcaatcatttggatcaattccaacagctgtcaaaatctaaccaccaaattttgtctttatgtggcacccatccaaacaaataaaaggtctgcagcactttaagaacccttttttgcatgcgtcaagtgacatatacaaagggattcttcaaa

SEQ ID NO: 99205 - DNA, 605 bp, Oryza sativa
aaaacctgtccacagcctgtccaacatagagttgatgcgttcttttgagcttcaatgattgattctcttaatttgcagacgaaggcactaaaaattgaaattaaacacaagcaaagaaaagatggattacctgcactccgagcttatctattcccactcatttctactaaagatctttctactatgttctctctattggcatccaaaaatatttctatgtattttgccactcttacattagtatccttttgccatctccattcgggtgatgattggttgacttccattgttgggccccatcgtttcgcttttttttctagtaagccaaaacggcttattagaaaataaaaatgaatttataggtaaaacttttatatatatgttcttgtgacttaaaagtcaatgctgaaagaaactacgttgaaaatatcttaaaataaatttcaaaattaagtttgaaaattcaaattttaggttttttctttggcttattaggccatccgatgagagccgttgcctccaaaggccatttgttcttgtacatgtgcaaaattaacacaacacatatggaaaaggttagatatcatcattgaaatgttcttaaa

SEQ ID NO: 99206 - DNA, 743 bp, Oryza sativa
agagaaaaaaaaaggaaaaaacccaaacataaagagaaccaaaaaaagcgggagaaaacgagaaacaaaaaaacggaaaaaccctcccgcgcggcgcgccgtccgccgccccctctccgcacgtgacacgtgtccaatcgcgcgcgatagggcgcgtgtgactggccgcaatcagcgtttttgcacgcacaagtgatcttagagggtgtttggatacagagactagactttaatccctaccacatcggatgtttgacactaattacaaaactaattgcacagatggagactaatttatgatacgaatatattaaatctaattaatctataattaacacatatttactttatcactatattagtatcaaattagcccttatagtactagaaagggaaaattacaaaaaccaccccaaatatcactctaggtttgagatgcctccctgtaagaagaagatttgttgtaaattcccacctcctaatttaccttggcttgatttaggcaccttctctctacacatgcgtgattcccggagcatctcgtggcgaaattatccaagttcggctcgtcgtgattagggatggcaacgggtgcatacccatcgggttcccttgccccatacctacacccgcgacgtctaaatattcccacttaaatacccacacccatcacgggtagaaaatcttccccatacccatacccgtgcgggtaacgggtatccaacgggtaggggatcctctag

SEQ ID NO: 99207 - DNA, 656 bp, Oryza sativa
cacatgagcatgcatggaattttttttccaatttttttaataagaaaaaggccacatgacctgcttttatagaaagctagcccagcatggcaaccggacaactggctttaccctaatacacagttgcacccacttcatttaccattactggttgtgccctgattatttgccactggcggtgattttgggtatgtttggatccttcgcccagctagcctagctcagaaataggcatgaaaatggatcgaatgcggtcggaaactagctctattatcatatttgttttcataatttttttcgaaatcggaaatccatatatgaaaacgaaatcgaatattatctcactcatacgaagcgaaacaaataacaaataaggtgacgagtattaatcggaatataaaaacccctcactactacacaaacgatttttgtgtacgagacgctatgatttttgcaaacggaccataatttgccgcgtcggtattttcgcatatgactccttaagacgccaaaatgagctcatttttacatgtggatcacttcacatggaaaaattattttttctatacggacgtcttaaggagccgtatatgaaaataaaatttaaaaatttaaaactagtttatctcactcatatgaactccaaattagatgat

SEQ ID NO: 99208 - DNA, 663 bp, Oryza sativa
gtaggaaaaagaaagaactaggaagaagcatggatatgatattggtgaaaattgtccatccacatgaaaacaaaattcctaaggggtaattatgattgtcctttgtttaaacatgcaagatataggtattttggtagcgacctaacgaatagtataattttagtacgagatttcttatacttttacattagcgtccaaaagttaatgttgaaaaaattaattctaaagttatgttctaaatttcaaatttgactacactcaaataagcaagatcctgtgataaggaaaaggtaaatttaagaaaaccatgttgtactcctattgtgaccctattaagaccgtttgtgatacagcgtgtgtcctctcattcaaatttcccttcacatcagcgtcagtcatgcctgtgaccctcttaagaccgtttgtgatacagcatgtgtcctctcattcaaacttcccttcacatcagcgtcagtcatacctccctgaagagggtctcagtcaaaacacacgatcaactccaccttttgttccttttgtacacctatacgtatgtatatattttgcatgcaaatgtataaactttatatgtgtatataaagtttatatataaacatatgtataccaagtacgcacacataaagtgtatttatgtatgaactt

SEQ ID NO: 99209 - DNA, 547 bp, Oryza sativa
agatgcaatatttcatcaaaccactcttcctacgttgatgaggctattgcaactatggcacatggggagcttaagaagaaagtattgcctagtgtcacaccatcttcaccaaatcccacatatgtagttgcacaaagtaaaaagatcagggagtgcttcaattgtggtgagatgggacaccttatgcgtgattgtcgtgctccacacaagcctagttatgggagaggaagatatggtgataagggcggggcaagaggtggaagaggtcatgcgggtagaggtaacagaggtagaggctatgagtatagaggtgatcacaaagctaatgtagtcactcttgaagagggttcttctagacctacaaatgttgatgttgccaaccttgttcattccacttcacataactcaaaccaagcatttatgtccatcaatagatctctttcaaattggatactagactcgggtgtatccagacatgtcacgggtatgtgtggagaatttgcatcatataaaccatacccatttacatgaaaagaaagaattcaaa

SEQ ID NO: 99210 - DNA, 530 bp, Oryza sativa
taggacctctggttcaacatgccgcaacatatcttgcagatcaaaatcaatatctgcatcgtctatactagagtcaccgcattccgggatggttccctgggacatgtcttcgattataatattttacgcatcaccaaagcagaaatcatcagcctcttcgatacgaccaccgacttccccgtgaaaagtctatatctcgtagagagaatcccttatatgccactagaattcgaccagctcccttatatgccactcaaaattagcttctcccttatatgccactagatcaagattttccacccttttatgccactcctaccactatagtgttagttgactgttagtcaaaggttagtttttttcgtaaatgactaatatgccctctcaactaaaaaatgtgtaaacttcaaaaaaatcataactaatttattttaaatcctctgtgagtgaacaaaattttgtcaggaccagtgaaaaatgctctttatattaaaaatattggtggaaaactgcatggttcatacttacat

SEQ ID NO: 99211 - DNA, 577 bp, Oryza sativa
cagcaaactagccccccacctgttttcttgcaacggcaacagccaaagctcgccaaatcctagggccacactcctatgcttcttcaaccagtgcgccttgttgcatgcgctagcttccacatgtcctgctccctctggtcacagtgagcccgtgagtccctgtattgccttcctgaccgccgtctcatgcagtgcgtttgagtccctctcaagaagctggtacagcgtgagtccgtcgtcccggcccttcaccgttggctaccgagcatgagccatcggccttccatcgcatccacgacgacggtgcgccacactcgtgttaggcagtgtgtgtgttgtggcccaaaaggcccatgtctcgatctgcctgcatatgtatgaagtaagcaattgacagagggtgtgaagcttcaagagaatcaatcacaaatgtctgcatggcatcagagctgggtcgccagcgaccgcgtcgacactaaaccttagctgccgtcggttatggccagataagcggggcgcacagacggtgtacttaggggtggccagaaaaagaccgggtaccgagctcgaattcggc

SEQ ID NO: 99212 - DNA, 594 bp, Oryza sativa
tgttgaatgaacgggcagaagaaaaagagatgctctcttgtctctctgatattattcaagcataattaacaagtgaggtcatcgttttcctttgcacaatctcgtctatccaacatatctcttgtgttaagtctgtccctaaataaaagccaagcaaaaacttttattttcattacacattttgttttccagatccagacaaaaggccttggcacatgcacatttgagtatgtgagcttataaaacctcttagctatgtatttatcagagttccagatgaaagaccattcatcaccattaccgttctgcaaagagagagaggaccattcctcctctagaacattgaattctccataagcttggggtgctcaatggcagtaagaaacaatcctcaagaggagtagaacccatttgcttaacagagataagtttatctaaagcaaccatatataaagatggaaaagcattgcttcttatcttatcattccaaatgtcatcccagaaaagagctgaagatccagtcctgatatggcagtttgagattcccctaaagacatcagatagagccactatatccctccaccaaaaagatcc

SEQ ID NO: 99213 - DNA, 634 bp, Oryza sativa
tccccgtcggggaatagcacaaatgaaatgttgccgagagagttttttttttttcatgcgatctcccgagaaaaaaaaagaaaaaaaaaacgtctttgctttcgtcgtccgttcgtgtccgttccggcgtgcgaaaaaaaatctggggatggcaccgcggaaacgtcgccccgggctgggcgtttttgtcgtggaaaacgtacgctctcgctcgcggcgacgcgacggctcggctgcaaatatccacagtagcatgcattcattctgcaaatgggagtagcgtgtgtgtgtgtgtgtgttttttgtgacgctgcgtcgttctggctgggatgaacaaatatccgagattcttttgcaatggtggcagtgactgactgactgactgactatgttagttgaagacgttgctgctagggagagagcattggaaaccatggaaaaggggcgtctgtttgttgtgttttcgcggaattggtggttttcacattgttttaaaggtgtcatggagtgggaacatacttgtatgagttattgatgtgtagggggtgtttggcataactcgagatctaaagagtttttaactatgaatacaaatcaatagatctggatctacaattatatgaatactttttga

SEQ ID NO: 99214 - DNA, 632 bp, Oryza sativa
atacgttttggtgtggatggtaatactttgtaattagaggggtatttttaaatgtagctaatgatggtttaccttgtttcttggcctgttatttaaggtttagggtacgtgttcatgttgggttcacttatttcgtgccggttagatgtagtaccgcatttgattttttaagtaattttcattttattttaataacgtataagttgttaaaacgtaacgtcaaaaccataaattagatccactttaatttacgaatacaaatacaagctaataacttatcaacttcttacaatctcatcttttcgcttttatttatactaattagtatgtttactaggtgaaaccccgcgcgttactgcgggacttcaatatgataataataagtaaaaataatatgtaatatagctaaacaatataaacttacataagcactaaaatcaatttatgtgatatggcttatttagagaagagagaaataatattaaccaagtgaggatgaacttgtataggtatataagatattataaaaaataatgaaaatatatattgaaatattatgtgaattatgtgggatgatgatttaacatgctttcattttaaaagctctaaaatgtaataaattttaaattaga

SEQ ID NO: 99215 - DNA, 617 bp, Oryza sativa
ctatagggcgaattcgagctcggtacccatgtagcggcaatttaaaattccaatcaaatttgttataaatatcaaataatatttctgaaggaagggttatttgtttttactatgctttacactggtcatctaaacattggtgtttgatgaatatgtgcccatgtaggctcacacgtggcggtaaagcgtccgggttatccgaccagcggagcagctgggcccactgtcagcctcacgagggtgttttcctctctgctaatcgtctgggctggaacaaggctgatggcctgattgattgctgctgttcgagcagcttttgactggacacaggcaaacgttgctgaagagttcaaagatgtgttgtgttttctttttaatttcctgaatagtgaatagtactgtagcatattgatattgatttctacaacccacgcaccagtgctgatttcatgtaacaacaatctgtaatttgtacgtcttttgatttgatgaataataaatttgatgcgtgtttgtttccttcaccttaatatcgacggttgagaaccggttttcttgatcgtccattcaggtcgaaaagtcgaattgatcttgtatttttgtattgcaatatgata

SEQ ID NO: 99216 - DNA, 671 bp, Oryza sativa
aatgtgttgctccttgcaaagttgtcttaataatataataaattatttatttttgtagttggagatatcgagaacactaattagcctagtatacttagcgttttatttaactattatagaaaaacgaaaaaataaattattttgaaagttttaaaatatgagtagaatttgaagctgaaagtttgaaattttgaattgaaaattttaaaatttggctagaggtttttaaagttttgaattaatacttttaattttgagttcaaagttttcaagttagagttgaaagtttcaaatttgaaagttagtcgcacagatcaatttgtgtatgagtaactaacgttggactaagtcaacgcttaatagaagctaaaatttaaattttcaaccttaaatttgaagttaattttagggttttttcatcgaagtttattattcaacctttacttttagattgctaagagcaagtatataaaagttgtatttatgaattatttttcgtttacaaatatgttgttaattagcttattccacaaatagcaaaacaatggggccatacgggcaatactaccaacggactaatcgaattataccgggcggccccaaattttgagaatgggtattcgaaatggaagggggtaaaaaaaaatttacaacacgcgagcataatattt

SEQ ID NO: 99217 - DNA, 540 bp, Oryza sativa
tataattatatgtacctatcacgaataatgagagaacttgcccttttaaagcttagatcacttgaaaaaaagtaatgttgagaactctggattactttgtgccttactggacttgctggacttgtgggaatctactgtactgccacaactatatggaatacgagaaattttttttaaaaaaaaagttcctacattcccgtaaatgaaggaaatgaattcccttgagcaaaggtaggattcacgttcatctaaatacaaacattctagtgttagttcatgaaatttcaatcgtctccaactggcacattggcacatttctatcatgcttactgataataaagtccattgccaccaaaaagatgcatgcctgaactgtcataggctcatagctcctaattagcgataacacaacatggaagaaatctgagcatataatatttacagatggcagcaacagctgctgagatcatgtaagatgtgagaaagatatgaacagattgattcttaacttcttcctggctaacactttagccagatact

SEQ ID NO: 99218 - DNA, 530 bp, Oryza sativa
agaaatataagagtttagatagtaatataatttataaataactaaaattcggacaaaaaagtaagaaacattaaattaagaggccaagtagaacatatttagagattaattaaatttggagtaaaaaataaaataaatttcgaatttaataaataaaaaagttcatgtaggaatacaatttagaaacaactgaaaatcgtaacaaaaaataagaaatattgaaagaatagttcatgttgaacacatacaagattaataaaaatttaaaataaaaaatagaagaaaataataaattagcaaaaaaatataatagttcagctaagaataaaatttttaaataactaaaatttgaataaaaataagaattattgaaataagagaaaatttaaaacacaaacaagattaattaaaagctataataaaaaataaaataaattccgaaactagaagaataatatgagaattaagtagaaatacagtttagaaataactgaaatttaaaataaaaaataaatattgaatgaataatg

SEQ ID NO: 99219 - DNA, 592 bp, Oryza sativa
cacttgatgctagctcaagatcgatcagataaacatcgagatctgatacgcattgaatcatcaatctagcacatcagcatgtaatgcaaaagtacgtgcttcaaactagggtagcccactcatggagaaggttgatgattgtgtatcgggttcgggccgctaggaacatcatgcatgattctgactcgagacgagctaagtggatgatggggaggagggtggtcattgtgtatcgggttcgggccgctaggaacatcatgcatgatcccaacacggttgccgcgagaaccggccgccgccaccaggacgttgccgtcgtcaccatctgccgtgccggagaaggaaggcggtggacgcgctgccgccacggccgccaccgccacggcgaacaccagagccatgaagagaaggcagcgccggcgctgggcgtgggtggtcgccatgagctacgaattcttgaagcttttgttatgatagtggctatatgcttgtgagaatggatgatttgctacggtggaatgccggcccgttatttataggcgggcgtggctgtgggaaggcgtactgattatttgcctacacatggtaagat

SEQ ID NO: 99220 - DNA, 780 bp, Oryza sativa
tcatagtatcattgttaattaatcgttttactttgtgtgaatcaccttgaagtatcatttcttttaaatacatgtatatcaaataagcatcgagtttgtggtggtggtagctagatctagagtcgtggttcacttatccaccctaggggtgaaatcagatggatacggtcagatcatggcatttccgcatcataacccatatttttctttaaattcgaaactaggtatgagtaatgttagataacatatcactcacccagctattatcctatattatttcctctaaattggattcgggaacagatatctatttgtatctctaattcattgatattaaatatagtgatgcaattaaaatgttaaaaaagatacatcaagtaaaatagtgattaatcaatcttttatcatgttttaggtgaatttataatagattttcatatatattttataatatgggacatacaagtggatacaactcttctcctattttaacccttttttttacagattcaggttcgaactcggatagtaccgagtatcctatttactatttcatattcttcccgcaagcctcgggtaaggtgggtggtcggaaatacccatccaattttcacccctaatccacccccaactcgatacatcaaggaaaagaaatatacatattatatgtgaactcgtaaaatagtgattaatcaatcttttatcatgtttgtaggtgaatttatattagattttcatatatattttataatatgggacatacgagtggatacaactctt

SEQ ID NO: 99221 - DNA, 593 bp, Oryza sativa
caaaactataggtttatagttcaaatccctaacactactattttgttggagttacaaaagttttatgttgaaattagtattaaatttatagttttgtgatactatattttaaatttgtacttgcacgataacttgatgctaaacttgtatttttatgatacaccctatcaaatatatagttttaatttaattggatcaaaatagttttatataatttactcaaattataagtttacgatattataaagtatacttaagttttaaggataaatatatgcattatatttgtgtttccaaactacttctaactattttaaaatgcatcaatagtcaaaatttaaaatatttattaaaatttcaaacgacatatctatatacttatgggcagagaccggagagacaattatagacttgcgagtccaacattaccatcaatttttgtaggaggacttagatctatcttgtagtactatgattttcttcttttaaggaaagggggaaaaatgatgtcttaattattcttctcagacacattattattccacctactttggcctaaaaaataccctttgccaaacagaaagcacatcgat

SEQ ID NO: 99222 - DNA, 715 bp, Oryza sativa
tatatatatatatatatatatatatataggacgcccagatagggctccatggtgcccgggcaccactgcatctgccgttggatcacattctcatctagttgatcggtacatgtatatttgattaacgggttcacccgttaagtacatttgatttggaaattgacagcgtgtgcagcatgcaaaatatttagtaacgtctttaatactaggtttggtaattgacagcgtgtgcatgcatgcaaaatatttaggagtatcaatttagcgtatttaatacctttccatcaacagttcacggccgttatttggtttctaaatatttgtcaccataatcatggatttgcggtttatttggcaacaaatataatgcggtttattagggtatatgaaaatctaagtatacttctacgatgtagtatatatggaaatgttatcctgctgttattttgaaaataattatagaaggaaaccgaggtaccctaagtacaccatggacgatgtaattggaatataagtatatatggaggctaagtatatggtatgcttatgtacacctagctaaattagtgcgttttgcactttccagattcagaaaatgtttactcatttatgtaatgtaatggctatgtatacacgggttattttttctatatacttagctaacttgttaagtatacaaagttttaaattacgttaatttaattatattatgaat

SEQ ID NO: 99223 - DNA, 850 bp, Oryza sativa
attatttcctctaaattggattcgggaacagatatctatttgtatctctaattcattgatattaaatatagtgatgcaattaaaatgttaaaaaagatacatcaagtaaaatagtgattaatcaatcttttatcatgttttaggtgaatttataatagattttcatatatattttataatatgggacatacaagtggatacaactcttctcctattttaacccttttttttacagattcaggttcgaactcggatagtaccgagtatcctatttactatttcatattcttcccgcaagcctcgggtaaggtgggtggtcggaaatacccatccaattttcacccctaatccacccccaactcgatacatcaaggaaaagaaatatacatattatatgtgaactcgtaaaatagtgattaatcaatcttttatcatgtttgtaggtgaatttatattagattttcatatatattttataatatgggacatacgagtggatacaactcttctcctattttaacccaattttttttacaaattcgggttcaaacttggatagtaccgagtatcctattttctatctcatattcttcccgcaagcctcaagtaaggtgggtggtcggaaatacctatccaattttcacccctaatccaccccgcaactccaccaaccacctacatttatgcacacacagtgctctttcaacggtaaggactcctttaggttgaagggattttcattaaaggaaatctagatgaatccaatcaatgacaaaatatctatataagtcatttggtgtgtaggattacttcaaaggaaaaacctataaaaagaaagttccttcacatt

SEQ ID NO: 99224 - DNA, 502 bp, Oryza sativa
cagctcatgtgaggtttaatatctccaaaggattctccattattctcgtcaacttgaaatctcacagcaagcaatattttttgctcatgaagtaaaaaacaaattattggtgtaccatcgatgtcagttgccaagaaaacctgtaggaaattggagtcatttccaaaacatatcaaagaaaatgatggtggtaaaataattgcaaagtatgaacaagtaaagggaaacaatcccatacaaaaaagggaaacaacagagacagatataaattatgtttaaacggagtttgattatcttattacgcaaatttcataggggtacactagcgtcaggctcatggaaggcctctaagtcatcatgaacactccctacaaaaaaaaaaagtaaagcttcactaatgcccatttggtaaagtccttcaactggcacggagcacatttgacaattgcagaagagagggggaaaggatcaccattgtcctattgtacctagaattcatcta

SEQ ID NO: 99225 - DNA, 511 bp, Oryza sativa
cgggatatagattaggaagaaaaggacaaacaagatggcacttcccatatggaaaaaagcccttcgtgtctcaatttataaaaggggaattcaaagtagcggcaagaaggtccacatttattcgttctatcgaaaactgaaaccacgacggtccagctttaatttgcgtagcagataaaactgaaacatccatcgattgtactactactacaagtttggtgggcagagagagcacctctaatcaattaatttacatttgggcattatatacatatatttgtttacggctgggcgcactattactatcattagtcaatcagatagatgctcgatgtggacaaatttgcgagaacgctgcgagtgagatggctatcgttcagctgagagagctcaaacaaaccttgagcagggacatccccaccttgtgatgagctggatagaaaactattcggatcagcgaccaaggtatcaataggagacggacacaaagtgagcttttgagaatcaaact

SEQ ID NO: 99226 - DNA, 657 bp, Oryza sativa
tggtcggaaatacccatccaattttcacccctaatccaccccccaactcgatacatcaagaaaaagaaatatccatataatatgtgaactcgtaaaatagtgattaatcaatcttttatcatgtttgtaggtgaattgatattagattttcatatatattttataatatgggacatacgagtggatacaactcttctcctattttaacccaattttttttacaaattcgggttcaaacttggatagtaccgagtatcctattttctatctcatattcttcccgcaagcctcaagtaaggtgggtggtcggaaatacctatccaattttcacccctaatccaccccgcaactccaccaaccacttacatttatgcacacacagtgctctttcaacggtaaggactcctttaggttgaagggattttcattaaaggaaatctagatgaatccaatcaatgacaaaatatctatataagtcatttggtgtgtaggattacttcaaaggaaaaacgtataaaaggaaagttccttcacattttgaggaattttagcatgatgtctaacctcatttttcaaattcctttgggacttccaatgcatcctctctctttctctttctctttctattttctctctaacatgtcaacatataattct

SEQ ID NO: 99227 - DNA, 537 bp, Oryza sativa
cgtttatgagttctaaagtcaaatatgaattatatgatccatcgtataaaagtctcgtagtcacatatgtcaagcattttcttaattttgctatagaagtaactcaaaatagttaatggtgtggttttataaaactataaaaacataatacctagggttatgtgttacgtgtcaaaacatatgtgggtttgtgcaattaagactatgatacattggttttatgaaatttactctcaattttattatgtttggagcattattttttttaaaaaaaagtagtgaagagttataccaataaccttgactaaaaatcatcaattaaaaagttattagattatactttaaaattctaagtgtatgctcaacaaacatgtatgggtgggttttctgaaactttagaaacataatacatggttatgtaccaccaatcataatatttgaggttttatgtaactttgactatacacacatgaaatttactcatttctttattgggatggttcaaaacaacaagattgttccgtttttcttttataa

SEQ ID NO: 99228 - DNA, 627 bp, Oryza sativa
aaggaggacgagcaggcgaggacacgagctgacgcctgacggtcacagacgccacagcccacaggcacagagcaacaaagcgggcagtgcagtgcagtggagtgcgtgcgtgaccgtgccgaggcggacgcgaggtgggcgttataaaattgggttgagagtgttcaaacaaaagcggcccacgtccgtatcagtggtaatcggaccaagagagagagaaaaaaaagtgtgcctagtggagtcgtggagaatgcgagaatgtttgcggctggggagattcttttacatggaccaccacatgtcggtcgagctgaggagccgcggtaaaaaatgactttagaaccgggtcgtttacgcgttttgatgcttcttcactcgtgtggagtgtactttaccatgtttagacaggctcattagcgacatattctatcctgggctcctggttttcatttgggtagatgctttgcttgagaaaacagtcgcttaaatgcttgagaaaaccctttctggttcaggagcttgggcccattctcccagtagtagtaggaggagggggtccatggagtccacggccatgcgctcttgcagcaagcgaaagcgagggtagcgcgccggttaccgaggcgg

SEQ ID NO: 99229 - DNA, 531 bp, Oryza sativa
ttaatattcaggcagaggcatatggatcactgggagatgattgcaagctagtcccaattgctataaaaaccatgcatgacatgggtaatggccattctgtgcaggtgtttggtacacaagaaccaactacccctcactagtttcctagacttggtcctgtgttggagtgtgcacaaatcacacctaaactggacatcgattaattggttaagttcttaagtttccagcctagttttgttgactatgctggaccttgatgtactttggatgtctcagttgcttccagtgagctttgagctcgcatgagaatgattcgtatcaaattaagtgcttgtttttctaccatggtagacgagttctgtctggttctggtaattgtgacgtatggcttaggttatatgcagaattgaattattgaatatcgctaaacggactatactggaaattttattgatttgattcttccaaattaccaagccacgacatagtatatatagctagtgaaaatgaccagaaaattgaatacaccct

SEQ ID NO: 99230 - DNA, 610 bp, Oryza sativa
tgagtcatgcaaagctacaaaaatgcatcgatctattcccaactaatggtacacgcacttgcacttggaaagtgagttgggaatgcattatttttactgtaggaatgactgtagaaggggataacgattcttttgtaagacacgcggcacgatcagatttgttatggtaacgagacagatctggtttgttttttttttttaatcttgaatcttgacgagctactaaaagattagcttggcttgcctggctcggcgagccaatgtgagctatattgctagtgttttttttaaagggaaaattacaaaaaccaccccaaatatcactctgagtttaagatgcctccccataagaagatttgttgcaaatccccacctcctaattcatcttgatttgatttaagcacattctctccacatatgcgtgattcccgattcatcggcggcaatttcggattttaggatgacgaaacgacacgggtcggcctcgatcttcgtctttccggtctcgcaagtcgtagtcgcgggcagacaaagcgacgcgcaaatgtgcacgcgcctttgccgctgatcggtgattgcattatcgcacgcgattgaacttttgttggct

SEQ ID NO: 99231 - DNA, 778 bp, Oryza sativa
cagccatgaagaaaagtatcactcatcgatgcattattgacagttggaaattttctttgtaaaaagcaattttgatacttttgtcaattgttagatactcgctcagttgtcttgattttcttttttctaactagcaaaaaaaatgcatgtgtattacaatacaattttcacgtttgatcaaatccttgctaaattaaacgacaaactaaaacaagacaaaaaaaacaatggtaaaacaaagtcggaaatcgtatatagcattgaacacgattgttgcatttgtttcatacatcatcacatgaataatcccttatatacatcttttcatagccttataaattgatcgggtggttattccataaattggcacacttgtattttgctatacctcatcgatcaaagattgaaattttgattattcaattagtgatatttttaactataaattatatgcatttacaaagtaacaaacttgccacatatacacctaaacaatggtaatttcttatatttattagaagagaaatctggaagagaaaaaaaggaaaaaaagagaaaatgaggagaaaagagaggagattggaaggagtgggagaagatcaagatgatggagagaaaagaaaacgaggaaaaacgaaaagaaggaagaaaaaaaaacacctaggggggcacgagggatggggcagagggatgaattaaatttgaaaatatgtattttttattttttttgcgtttatatacatgcatggaaaacatttgcacaaatatacctcatccg

SEQ ID NO: 99232 - DNA, 616 bp, Oryza sativa
tcatcgatgcattattgacagtgggaaattttctttgtaaaaagcaattttgatacttttgtcaatcgttagatactcgctcagttgtcttgattttcttttttctaactagcaaaaaaaatgcatgtgtattacaatacaattttcacgtttgatcaaatccttgctaaattaaacgaccaactaaaacaagacaaaaaaaacaatggggaaacaaagtcggaaatcgtatatagcattgaacacgattgtcgcatttggttcatacatcatcacatgaataatcccttatatacatcttttcataagcttataaattgatcgggtgggtattccataaaatggcacacttgtattttgctatacctcatcgatcaaaagattgaaatttgattattcaattagtgatatttttaactataaattatatgcacttacaaagtaacaaacttggcacatatacacctaaacaaagggaatttcttatatttattaaaagaaaaatctggaagagaaaaaagggaaaaaagagaaaatgaggagaaaagaaaggagactggaaggagggggagaagatcaggatgattgagagaaaagaaaccggggaaaacggaaa

SEQ ID NO: 99233 - DNA, 585 bp, Oryza sativa
cacgcacatgataaattaacagtacgactaactaggggcaaatctctttatttatttattactcacgcaaaacatattgtatggtacctgattaataattataataagcatctgtgatacatgcatatctatctaagagattttacggtcctcgagaaggtacggagggataccaaattttatatttccgatactatataaggtacgaagatttgtaaaaaatactcaagaactataaaatttctctatataattaaatttcctaattaataaccacttggaattgagcatgatggaatcatctcaattaattaaccgtcttcttggtcggtgtgcggccttgtaaaggactgggcatgttgtgcaacgggttcgatccggtgggaaccagacgctccgtcacggccaccgtgggctcgtcggcggcggccggaggagtcggcgcgccgttgtgcacggggctcggcccgctgctggggacatcgtgcctcatcacagccgccatcttcttctccacggcggcgggacgacgaacatctcgcgccgccgcggccgtcgtcgtcgccacgaacaccagcagcacca

SEQ ID NO: 99234 - DNA, 814 bp, Oryza sativa
tccccgttgtgcggaggtgtatttgtgcaaatgttttccattcatgtatataaacacaaaatattaaaaaaattgaaaaaagaggtatattttcaaatttaattccagagggatggtgtgggacagttggattggactaggagggagtgtgtaatagttattttactcacgacgaattggatacgggtgacatacaaccaacacaaacatggatgacgtaccaaaattccagcgaaaacatcttcgattttttaatagtaaagattaatcatttttaagtattactaagtttatataagaatatagtaacatttataatatcaaattagtttcattaaagactaacatttgatactatgtttgttgggtgttgtacatatggctaagattttttttaataaatttagtcaaacttcttttaactttcaaggctatttggtagaatatgaaacaaagggagtatttcatggttgtttggtaggccgtagattcataagtcctcatccaaagtagcacgagtcgaaccaaaaacaccatcagatctgaaatggagtggagtagagatgggagcggatcagaattgtatgtgaggggtagagcgaccttagcccgtactacatattattaatgaaagtgttaaatgtgaaattagagagaggtattagagcagtctaaggcagttcatggcctccccgaggcttttagaagtaaagcatctatgaaaaccaataaggatgtctatggttccataactttctctcttctatttagcattatagtgttaattctttcttcaatgagcattttttcttag

SEQ ID NO: 99235 - DNA, 510 bp, Oryza sativa
  unsure (1)..(510): unsure at all n locations
ctgtcacattgtctaaaaggcgtaatacaattcagattattgtctattacggtttgaatagtctttaatncctttataacgttttttnnttgtttctccatcaacatcccccaccccccncnnaaagggtagaccatcncattncngcangccngcnngnngactctagaggatccccactcctttctgatacctggtataggctggtacctggtaccttgtacctagtacctgagtaccagttggtacctggtatccgataccctggtatcgagctggtacctaggtatcagaccatagtacctgggtactaggcgtgatacctcaagagagagtaaacgagacgccgccattggccatctagtacctgggcatcctgacttcgcttgaggcaaagagacgccgccgccggccaccgcggctgctgctcacgcacggggcaagaccacggcggcgcagcacgtggcaacacggcacctggaccacaccttcgagaagctcacgtcggtg

SEQ ID NO: 99236 - DNA, 511 bp, Oryza sativa
ttacgagccgcaactctgtggttccatccagcaatttatactgcctttagtttgtagttagcaaatctcaattgcgtccaaatattttgtgttcttaattctgaaagaaagctgtatattaagatttattttgtttctcaaaattgaccaatttccctgctttgggatcctaattcattggtaattctgcagagtagagcaagtgcaggaccaggtttttttgtggtcaatggcactatacccgtatgaggcatcttgcttttttttctcttttttgactagcagcagagctatctatattgtagaaataggaatggcattgttctgcagttgttagttttggtcttgactgcaatttgagatgtggtcgtagcaaagttgctaaggtttattttgcctatgctatctcgcagcagctatgagcctatgcagatttattccatgtggtccatgtttgttgatctctattctagtttaaaggtgatttgagctctgttgcagtttactaata

SEQ ID NO: 99237 - DNA, 513 bp, Oryza sativa
  unsure (1)..(513): unsure at all n locations
acggcctttgatgatctcatcctttatgccngcccgtcgactctagaggatccccagttaaaaaagtttatgttttagttgtggctataagacaacgagcaaccaatgtcaattaatttcatgtaatatactaaatgcataataacttcattactaaaataactccaggttcctgactaaaatagctcatagattcatgagagattccactaccagtccataataaggttgctataaaaattgtccctgcaaaaataattaataaaactgtcgtgcataaaataaatgtaagggcaaaattgccttttcacttgcctactgttgacgaaaaatccgcgctcggccgatggtgccgaaactgtgttatcgacgaacacaacgacctagaagatctgcttagcttccgcgcatgtctaaaatattgatgagatacaggcgtgctagtcagtttgatcctgctactgacatatgtaaatagtagatcaataagttgatcggctgacaagccaatgg

SEQ ID NO: 99238 - DNA, 724 bp, Oryza sativa
  unsure (1)..(724): unsure at all n locations
ttctaatatattagaagatttgtttattaggtaaaataagttaattctctaatatatcatagcacgtagttagtaatagacagctcanttcggcttgttttagacccgagtggcattcgtccaaaaaaattaaaaaagtcctcgagtttaggcgtttagaaagttttgagtcacccctaaatgattgaacttgtttacctgtaaacttttaagttgcacttggaaattttgccatgactttaaaaagaaaagaagaaggacctatgaaaaatggttcaatttcaccgtgaaataaaaagggtccatgagaaaggtctagaaagcaccctcgatcaacttggcccaacctagcaacttccgatccaaagctgatcatatcagagaccgtcggcctggctaggcccaaaaacagcaccgatttgaagatggtattcgcagcccatgtccggcccgttcttcttcttctccttgtttttttaaagtaaatttcagaaaagagactatctaataaacgtttgcaagttttttgggtgaaaaactttcaaatgtaaagtagtgtaaaacatgaggttttctggaatttgccctcttttttttttctgttgcggaataaataagggagctcttcattgtctgtcttatccatatgggcatggcttcacaattgggtaccgagctcgaattcgcccatagtagtcgtgtctacaatnggaaacaaggccgc

SEQ ID NO: 99239 - DNA, 636 bp, Oryza sativa
aaaacaaaaacgaatacaggaagactactgcccgtcaaaagctggaattggttagatactttccaaaatctggattttttttctcggaaacagaaatgcatttagatttttttttctcaaaaacgaaaacgaatatagtaaggctaatattcgttggaaaccagaatcggttgcaagctttccaaaaacgaatttgtattttttttctcacaaacataaacaaattatttttatgtagctgattagcttgatcattctctactttagatgctcagatttgtacacagtactgaggtggttagttgaatggatttttttttctaccaatgctttagatatgcttttctcttggctaataactattttttattagaccatgccgtactgactaatatatagttcttgcttattgcaattttcatgaaaagtaaagtgtaaaactagttatatattattaaatgataaaaataggaatttaatttattgtttaaaaaaaatagtgaggcacatctcttcgctaaagaagaagcgacaacccttttttcatatcccgataaatattagtacaatattcgctcgatttatatcatcagatcatatatggttgtaactacggttttatttcaattcgatgcc

SEQ ID NO: 99240 - DNA, 564 bp, Oryza sativa
catactttcgatcggcgactacgtcctccgatgagttcaaagctaagcagggcgaaacaaactctcaccaaaatgggaaggaccttacacgatcacacaagtcttgcggccaggcgcattcaaaatcgcagaaggcgacggtcgcgaattagcaaattcttggaacattgaccaactacgtaaattctatgtatgagtcaatatcatccgtacctgtaagacaccttacagtatcaataaagcctattcttaggcccatattacaatcaaactgttttcacccgatgatcccttaccctaatgacacctagcgttgaaacctatcctcatgtccctttacgccgtcttaacaaggcctccgaggaacctaagggatcttcggctggggacgcccagagccaataaggccttgtcagatcctatagagacgaaagaccatgtaagatctggtcgtgtaagagttctcgccgtgcgtattaaccaagctgcgaaatcggaaattaactttccaacttcacggctgggggctaggatcagagcttattcaaccaaggcaggtcaaag

SEQ ID NO: 99241 - DNA, 650 bp, Oryza sativa
agcttgagcctttgtgattgtgtacacgtttgaattagcgcgaattcgagctcggtacccaatgctaggcttgcttcagttactgtgcaacatcagagcattactatctaagattgactcgggtattctagtcccccaaatcgctcacgttgaaaaagaaaagattgggcttccattttctaacaatgcccataggaacaaagaaattccacaaggaacccagctacattcctagacccaaatatgacaccattcctattttagccccaagaatgtgaaatgtaatcctacaagctacaagcgagcgtcttcacataagatatacagtacaatcctacaagctacaagtttatacaccagcagaagctttgggatccatctagttgaatctgttcttaaaggctaatcagcaaccagagtgaatgacaaatcacatccaaggtaactacacgggtggattggggatgataattcaaataagcatgtaaatccacgaataccatacactcagaaagacaaaaaagataacacattctgacgaatcacgagctgtaagcagtcaagaagcacttccagtcatccaggcatcacaacaaaatattgagatgtgctaatgcaaacaagacaaccttaaaaatggataaccaatt

SEQ ID NO: 99242 - DNA, 1519 bp, Oryza sativa
catatcataggagtttagcataatataaatgaaacatatgctaattaaagtaaaaacgatctataaatatagatgtaactagtttattattacagtacgattgtgattcataaatgtaaaaacaccgaatggctgcttatttgaccgatggctggcaaccatatcacaccatcagagagttgattttcggctggtacttgcatgttgcctcatgtttgctattcagacggtgggcgagtcacatttctcatcactaggatgagaatttatcatcactatgacgagaaatgatcaacttaggagcctccacctccctcttgacatctttacggtctgtatctatctcctacgaaaaaaaaacaagtggaaaatgttaagagcaggagtgacaaatccagaactggagctgaacgtgaaccaaaaatatattaaaataaattacctgtgaatcattgggcttcgtttcatcgtctattaacatctgcgccttttggagatatgcattctcctcttgaagaccatactcattgactagggccgtccaagtatcttcaaaatcacttgctgtgcgtgcatgatataagttgtgtagttctgacttcgtaccaaataatatgtgccaacggcagcgtgggtgatcatacttctgcagcgactgatcgatcttatcgctccgggcaccagtgttcatcttgtccatagctactggcaatataggtataaattccagaatactaagaagaggtcaacatatatgagaagtacatatacgtacagataagttggagccatacctggaacagaaatgtgttgttggtgagaaccagagagagcaccagaagtgagcagagtcgtattgttctgctctttatatgttgcaattgtgtctccgttggaaggaatgaaaaaattaatatcattaccaagtataaagatcttatttatggtaatatttatagctattacgaccgataggttacataatataatttgttaccgtcaacatggatcgatccagtcagaattgggtatcaattgattaatttagtaaccaactagtgatttcggtactaattggccatagtcaacgggatagagagagagtgaaaaaatgcacgtctgaataccacaagattaatgacataatctgtacttttataggtgtacatgtacacataggtttatgagtgacagagcgaacacgtatacatgtatatcccacaagatgaatgacataattatgaaatagaaaacatatccgaatttaattaaaaacttgtccaagtgcaacacgcaagatatgggaatatttttacaagattgtatttaaaaacaacgatagacttgcttctatacaccaacaccacacgttgatgcatagtgaccagctaacttgcatttcgtgcacaccttgatcaatttgttcttcgatgtgttctccggatttgtggggcatccagttctatagtgcccgttcagatgacagttcgaacaaatgcgcttttttcggactccacca

SEQ ID NO: 99243 - DNA, 539 bp, Oryza sativa
acttaaagagtttatcacacgcatgctgctgccaatggaagatgtcaacgtagacgaacacaagtcatgcacgatcaagactctctcggcaccggccgaggtgtccataaatccatgtatatatatgcccatacttctacgcgtttgaccccaaaattacggcaattacgaagggccccgtgtttaagtacagtactaactaccccagtatccgacgccataagaaatacgtataaaaatataatttttagtaatgtatatgctcgactcgagtataaaaattctaatcaggacggtggttcatataggagtattaggcaggcaggaacgcacgtcgttttcatggaagcagaaaattcggcttgcttgtgatgcaaattctcaaaccagccaccgctttatatgtttgacttaaactctgtgctaagacttttggactcaagtgagtagtatcagtttatattagtactagtcaataatatatggaatcaaagaagatgatgttgcgaagaaagtacaggacgaaaaaagggctgcag

SEQ ID NO: 99244 - DNA, 564 bp, Oryza sativa
ttgtttgcgagaaacacggtacataagcagatgctttgcataaatatgcacattcacccgtataaatgcacatgacgtgtgaaaaatcatgagacaatgtaggttatatttgttactctacaaacttttttttaacgttactccacaaacttgctcgacatagggagggagaaaaataataataaatcgtaataataatggtactggaaaaaaagaagaaagcctatgatgcattgggctattgcattcagtaggaggtggatgggctgggcttaaagccttaaatgcaattgaggttctagtgacttactgtggaattaggttaaactgtatactgccgccgtttcatgcattgtccatatttatatagatgttaatgaatctagacacacatatatgaatgtggacaatactagaatgacttacattatgaaacggggggaatatcattttctttgatacaaatttaaataattacaaaaatatcgtgacaagaatttaaaatataacaaaggttgtgatattgtttaggtcattaagtataaataaaaaagaacaaaaaag

SEQ ID NO: 99245 - DNA, 1008 bp, Oryza sativa
tcctgcagccctgtggtttctgtaactatgaccataatacccttggttacctgaatttactctaaaatcagttatgatttgaataagggtgagattttatgaaacacttggacaataaaacatgtgcttgtgtaccacaagacataatacgtatgatttatataagtcatagtacatatggttttgagagaccagcagcaaccgatttcatatttgagagatgaatgaactgataccacaattgagagaccaaatatggactattttatattttagttgaaactatattccaaagagtttctgggtcttgcaatttggtgaaacaatatgaaatataagcacaatcaacaaataccatgatatttatctacatgcattccgatattgaatttgagtttcataaaacccacttggatagtgttctcgcaacattcccacttgaatttgagtttcataaattcttatcctaacaacttttaaaacatgccactacaaacatttaaaacctagctgttagtgaaatataacagaactagaaaatcaacgcaccctttggcgcgtttgctaattagcctgcgtgtgtagctgtaataattatttaaatatttacaatgctctaacatatcgtagtgaaatttattgaccctttttttaagaaaatcggaatcctatttttcaataaagtttatgaattttcaatacaattcgtgttttgctgcaatttgtgttttatctaacttatacgatctaaaaaattagaacataatatttttttttcaacagaagttttatcaacaatagctagcatagtctattttatgttttactagaaaaaaatgcctgtgcattgcaacgggtgaagtcaattttaatcttattattattgttatatggtttagttaagatgaaattcaccgtgggagttcgcttggatatatgtatttttagaaaatcatgagctgcagttaggagtccgatcgtctcaagttagcatgcgagtttttttaa

SEQ ID NO: 99246 - DNA, 887 bp, Oryza sativa
tttagaatacactctgttggattgagatccaaacctccaaagttggtaacaaaatccagtaattctttataaaagctactcctatgctacaatgaaattcattcaatttaccgttaaactgaaaattgccaacaaagttgaaaagaaaaaaatggataaactcgaccaaccaaacaacatcttttgtatacaacatcatatgatacaacaaccaaataacatatcagctcatataggctaaactaatgcagataaccaaataaggccaattacataagcttagagttggttacgattagcttagatggggatacgagctaggctaaggttgttcgagcaaccaaacacacccttgtagaggtggatatacctatggacatatctgaagcgatcaaaattaccgaaaatatagtagttagagcatgtgcaatagcttattttagttggttctaataataaacacgtcaaatacaagatgattgggaagaaagagagggtaaagagagataaaagcgagcgctagattaagcaccagctaagcatagcctctcatgtctgcatgcagtgttgcttaatccaaagagcctacgatgacacactagtggctggttacattacacaaataaaaagtagtactctaggacattacatagaggtacttatacatagagagaatctaagagaatgccaatgacaaacactgaagtcatataaaataccatcaaatagtgcgagttacatgaaatgtcatcgcataagcgactttgtcccagaaatattatcatacaagcaaatttgtcctagaaatgctatcgccgttagggtcccgtccatcccacgccattaaatgtacttttcattatatagcacttactggagggatgacc

SEQ ID NO: 99247 - DNA, 740 bp, Oryza sativa
  unsure (1)..(740): unsure at all n locations
gttgatttcgnnnncttgttgaacacatctactatgggcgaattcgagctcggtaccctagggaatcgcatttaacaaagaccacctgaaaaatcaattaacccaaattaccttaaaagatatgaacaaaattccagctaatgcattatcatagagtattttgcaactcacttcgcagaattgttgacaaatacatacttttgctgtcataataaatctgtgaagaaataactatattttaagggaaaaaattaacgataaaagtatatttaggactacgggagtatatatattacaccttttgtcggtttatagacactgagggaaagaacacattaggaaaagtcttaaaagaatatttgcaattccatgtaagtgggaaaggaaaaagggaaacaaaagcatttgcaaaaggggaatgcttgtgctcaaaaggatgagtggattatcttatctctgccgtttcatcatgtcatgaggtggcattctagtgattattgcgaccgntactggctctttcattgtcttctttcattgactcccttnntattagttaggtattgaggcgtcntcaagtaacanaaaaagaaattaaagataaaatagntattcaccagctggnaatatatatattaataccaaatatttattcttgaagccaaagattacgcgcctaacgagnncaggcgacgtgcattatgtaggctcatgataaatgcngatgagaatacagatgacaa

SEQ ID NO: 99248 - DNA, 2579 bp, Oryza sativa
gccgcctcgcccgcccgctcgctcctgcgtccgccgcctccacacgcgcaagaccaatccggtggagggtggttggatgcttatccattccctcaagggtataacggtaaattgatatttcataaatcattttttttattttcatttgttttttaacccaaaaatgtggcgcccacctaacgggagttaaaactgatggcaaacggctgattcgttttcaaaaagtgggggtaaaattgcaaaccctaaaaagtaagggtaaaatagtagttgaggttgaaagtgagggcatggatgcaattgtcctttaaaattttatgattgtattgtacaaatgaatagtccgcattaacgtgtggggtatcaattagtagttcatgaagaaagcaaccagtaccttccgagaaattaccattataacaataaataaatacttgaattacaaaggcctttttgacaagtggccccattacacaattccataatttttttaaaacctgtcttcatgttattattgtatactagaaaattagtgcgccagccggtgtgctcgctttatagcccttgtatatttattttattaaagtagtgaaaatttcacaaaattttatagaaatcagtttaatttccttgaaaatgatgcaaaaaatcatacattcaaatatttttgttgaatggaattttgattttcaatttaaaatagcatatcattgttgagaaatcctcaagttttctctcctttttccatccatgctatttatggttcttttcttcaaactgattaaattgtctactaatgataaaataggtggtgataattttaaaaaaaattgaagtgttgatttttttaaggaagctacaatgttcatcattccttggaaccaagtagtttaatgcatagacttgatacaaatgtttgccattacggctaattattttgttagtaggtgacatatctactgttgttcaatcttagtatatatatgtacggtctcttggaggtgtttaagataggtgtgtatgtttttataagagcgagtttacgcgaatttatatgagcgtatgcgtttaaactatggcttttaaaaaaaatgcgtttaaactatggcttttaaaaaaaaagtttaaatgtactgtagaatttgtgtccattaaatcttgtcctctgcctaataaatatcttaagaacatagccctattaacataacatatgataccgtaggtatttgctccttctcatagtcgatccttccagattctcctctctgcagcagcagtgactgtgttataccctaactgtctcacaagacatactgctgctcagtctcgttttttcttaatatgcttttgggatttatttgccaagagcctgatgacacgttggccgacaccgtcagcattaaaaataaaggctagaaaatcagcgtgcctttagaaaacacctgtgcaaattgtttcagtgtgttattaagaagcagaaattttgcaaatgtttatggaattagtacaatttccttaaaatttgaaaatcctaaattagtcttttcttaggtattacttagtattcatttgttgcgtataattataatcgaattgtttattaaatgatactcaacaatgaagtgtctcataaaataggtatgagactttttaaagtgttctagaggttttatttgcaaatttatgcttgatgggtggaattcatgccataaaacctacaacccgtcccaaaataagatcatcttcgtctccttccatttatctcaaaataattttatttttgagtaattattgcattggagtttgtgaaagcaagagacaaacatattgaaaagtacataaaatgggaaatatttgcattagaatataataaagtgggatatcaatccttttcttttgtattggtatgtgtggaatgggtgaaaataaatttattttgagacggaggaagtatttccatgccataatatataaaatctacgattgatgatgctacagtactctaatcaacttgtatgtgggctcttgatataattgctttgggtctatctatactattggtgacatatatttgaatctacaacaatcagatctgaactctgcatcttacaagttgatgactgatgagattataaccatattgatcacaacataaatcatgggtgagctatgataaacttcaaatgattaaaatccacaacataaattaaattacattaatataattacactgtagttgtaactacaatgtaactatggtgtaaaacactataaatactagtaacatctttgtgttggaataaatgggctagtcccaatttaattcaattaaaatctcaaggacccacaataaatgttagagataataataccaccttggagattaaaagtggagtatctcaacttaaatagggagttattggagattccctgttgaccaattgaggtgggggacggacagccacacgcgtgcgcgcgagccagccggggtgtggcgaggcgggcggttgcagacatacgagagaagattgatctcgatctggcctactccactctcggtttggtttactcccacactc

SEQ ID NO: 99249 - DNA, 512 bp, Oryza sativa
  unsure (1)..(512): unsure at all n locations
gatgggntttgttgtacacctgcttggtaccctcttattttatctctagaatttaagtttatcatgcaaagatatctacaggattaaattgttccaaaagccttacaattattcaattagcttgttccaaacaatatatttttctcattgcccatgcccacgacgagttgtatgcagatttggatcgaaccagaggctcccaaacaacttgaaccgatgttcagcaagctgaagtccctcgttctgacaggaattttccgtgggtgcgacctctcgtggacattgttcttcctccaagcagcgccggttttggaggaatttatactcgaggtaactaaacatatgcatgctttgtcaaatctcatctaacggcacagttttttttcgtctgaaaatcactctaatatgcatatatatatatatatatatatatatatatatatgaacttctgcaggtggacaaacctttagatgccaaggcaccgagtgatatttatggcgaaatgccgaag

SEQ ID NO: 99250 - DNA, 631 bp, Oryza sativa
  unsure (1)..(631): unsure at all n locations
tgggcttttaaatctcattcttgctgccngcaggtcgactctagaggatccccatatatatctgcgtggaacacatcctataaaaatatttcagttctgtggactaaaattgagattgcccccaaggggatgccagaacgacgtcttcaagaagagaagcgacggaagaccgccgccgccgtccgttgggactcaaaggagccaagactgagctttcaccaggcaaacgccctcaggaggtgagacagcacgacaatgccctcaggagggtgatcatcgttgtcggtccggccgaggccggactaggttttcacccgccgctcaccacctacgaatccacggctgacgcaccaaagctccaccaccacactagcgtcatagcctaaacttctggttagcatacaagatattctacaaagcagaaccaaaattttcatttcttgatcctatcgtcatttgtataagcaagttccaatgatcaaatcctggttctgttgaaaccacagcagttcagttcacaaacgtcagaggctgcttacaagcttcctggaacaacaataatgtaaactatgcaaaatcagcagaaaacctttttcttccttgaaaatggttggtaaaacgaaattcactg

SEQ ID NO: 99251 - DNA, 526 bp, Oryza sativa
ccggccatttaattgccattcgagctcggtacccgatcatgaccactactcctctcaaccgcgtcttggagattaattaacgcaaaaatgatgatgatgatgatacgaaatagtagtgcttaattttgttgtgttgctatgcgttggtcaacttctccccaagtattctgtggcggatttgtttaggaatagtgcagtgcaggtgctatctggtgcccactttttttttcttttttttttgtcctgaaagaagctaatggctttggaatattgatcattgagtagcattgcagcattgttttggttcacatattgctcaactgaaatgctttgttcatcctctcaagaaaaaacaaaagaaaagaaaataagagagaggcttgttctcacaaaagacaatctgcctttcctcgcggctttcttagatcactttgtttctggggggctatatattaagtttcttagatcacttcatctttgataatccaaggcaccttgcgtcagatacttgtatactacaataata

SEQ ID NO: 99252 - DNA, 618 bp, Oryza sativa
  unsure (1)..(618): unsure at all n locations
cggcgccattgtgtttgacatnctcggtacccatcctgtttataaatatggatctgacaaataagtagcaccatcatgttggatgttgaaattatcaagcttgctcttttttattgtacttaatattttaccatttgggttggggcagggggtctaccagggaagccgcactctctcaactggttgatgcttttgaaagcttcattcttcatggtcttgtggagaacaagtaagctaatactttcaccagtcaatcttacagttgcatctagagataatagttacttagttgtcagcaatatggatattatatagtactagtgattattggaaacatgaaagacttatatgacaatcaagtccaacctagtcagatgtcagactaacacacttctcagtgaagatggactatatattaattcattctgttccattgtgaggacgtgttactgactttattttttccctctttcgaagatatgccaccctgctgagtctgttcaacagttcgataaagaagggatctacaaaagaggcttgtttagcatcccgtgccattggtatgtgccctgtaacactaaatactcatttccgttcattgcagctattgtttactca

SEQ ID NO: 99253 - DNA, 719 bp, Oryza sativa
  unsure (1)..(719): unsure at all n locations
gtggcncttgatttgtatttcctatgctcgcatgcctgcatgtcgactctagaggatccccaacacgtggccaacaaaattgaaatcatacttcagccataaaagagaataagcttgctacacttttagacaaaaaggttttcacctcgccgagcctgctgccctccgtcgccgagctttccctcgtcaacctgcggttcacgtcgccggcgctcgcgtccctcctcggccgctgcaccggcctggaggagctcggaatgtaccagtccgacgcggggttcggcgcggtgttggacgtggggcacgcgcggctgaggcgcctcgccgtgcacgccgtggacgaggccatgtacaagaaactgcgggtgtcgtcggcgccgaggctggagcgcgtcgtcgtcgccaactggttctgccgctacgcccccgtctcgttcggccacgtcccgtgcctcagggagctgcacttgaagaacaaagccgtttactaccaggaaccagtaagactaagcaaaatgttggccagcacaccgcacctcgagtctctgacattggggttctcatcttggagggtaagcatctaatgcaacatcagtcaccctacttcattcattaaaagaaggcaatcaactttttttatagtgtaagtttcgtaaaactgcagatactttcncactncagatttaagaagggtaccaagacgagttcaaaaaccactg

SEQ ID NO: 99254 - DNA, 649 bp, Oryza sativa
attttaagcacaaaaaaaaacaattgatgtgatatggcttaatgagagaagataaaaatatcattaactaattgaggatgaactatataggtatataagatattattaaaaataatgaagatatatattaacatattatttaaattatgtgagatgatgatttaacatgcttgtattttaaagctctaaaatttaataaattataaaattatagataatatagcatgtttgcatgatatttaaatgtaataactgttagtcgacgatgatgtagcatctttgcatgttaagctttaagagttagtgggttataactttatagtaagagagaataaggtgttgcaacataaatacagagtattgaagagagtagattttaaactcttaaagggatgttccttgttgtttgcatgtgatatatcactttacaaacatgcaagctaaaaatcaacttctaaaagttgcaaaaaaaactacagctagttaacgtatattgacaattaaatttgtttttttaaattgcgatatgtagaagttaaatttaacttgtatgtttgtggattgatatatcatatattaatctatctcgtcgatttttattttatttctttatacccattgagtagctgcaacaacgagtgaatatccc

SEQ ID NO: 99255 - DNA, 618 bp, Oryza sativa
gtgacactatagaatactcaagcttatgatttttctagaaatggtttctgagctcatgatatcaccccatcacctaatcctctgagagaactggcattcctcatccttctcttgtgttattcgtcaacctgttataaatatgttttcatagtgcgccactgattagtttctcttaacaactcttgttgtcctatactgtacagcatcaaagctctaagtatttaattagctgattaagtagtagttaatgaggagagaaactaatctgtcaacgacaggccggtcattccttcaaaagatagcaaaggtcttagcctgcaatagtcaacaaaacttgatctggtttcttggaccaactacgtacatgaacacaaaactattgacagatcttttcactactccatatcagatattagtactccatccgtttcataatgtaagttattttagcatttcccatattcatatggaggttagtgaatctatatagatatatatgtctagattcactaacctctatatgaatgtggaaaatgctagaatgacttatattatgaaacggagagagtagtatatatggagaaaataaatggtccctagctttagcttaacccaaat

SEQ ID NO: 99256 - DNA, 660 bp, Oryza sativa
  unsure (1)..(660): unsure at all n locations
ttttgattcaaaggggccctaactttgaaaaaggcagtacacttgacaattgacatcaccagtacatcaacacaaattgaaatgtaccgaagaacatgtaatgaaatgtgagatgcagtcatgagcatgtatgcaagtatgtaatgacaagtgtagcaagtaattgatcagagtgtaaattgcaccagatatcctcagctttgtttcaatgtcctacttaggttcaccaatagtactattcagatctttcatggccttaaagtcgcacttgaggcaattgttagtttttggatgccatgtctcatcacagacaagattagcaatagttgcaacaataccatcagagcatccaacatttatcagacagcatttggaagttatgcctaacatgcttttaccagctagaattctgacgatggtaaacttatattatctgcagctacacaaaatttatttgttcattctatatattgataaagctctttgcacagntactggtattttctctcgtccttctcttcatcaattacaccatttagaccttctagcgccattgcagcatattgaacatgccttaaaagggctcataaattttttttcgtaccctttcgcacgcattgttttctcttttttagaaaacatgaaatnccggtgttgtcg

SEQ ID NO: 99257 - DNA, 561 bp, Oryza sativa
  unsure (1)..(561): unsure at all n locations
atcctatgcacattttggtgaaaagttagccagaggtctaaccacttggaacatttcctctgagcctatctctctcatctgattcttgcgtttttcctgtggtccaatcaaacggccattcatgtgtttttcctatgttttacaatcttctgttttaaaattgtattcctatcctgtgttttttctattactctgttttttcattcctacgattcaaatggacctaatttcagataggtaaagatggagtagtacttcctatatatttattactcactcggtttcatatataagatgctttaattttctctaagttaatttttctaagtttaatgagtttataaaaatataataattcttacaacaccaaattatatctattaaatataacacttaatatatttgatagtatctttgtttggtataaaaatattattatgtttttatataaatgtaattgaatataaagaattttgactttaaaaagatcaaatcaaagtgtagtacaacanagagagagatagagttgtatgatcctaatatggctgantcgcgtgtatt

SEQ ID NO: 99258 - DNA, 625 bp, Oryza sativa
atttacagaaataatctatcggcgcaaaaaattacagaaataggccctgccgccctagtggagggcgacaagctgacgtggcaaaccgcggctcgacaacgccgtctgccgccgtctgcgaaaattgcatttagcctagggcggcaaggggctaaatgcatttttcgcaggcctaaagagcatttggctcatacttttttgcatcggggtcccttgccgccctagatgcaaaaagtaccagccaaaaagtactaggcctaggctggcggcaagggttttcgagcaaaaaaaaacctccctctcccgtctgtcgtcaccgcccgtctattccccgtttgccacgtcagcttgccgccctagtggagcgcggcagggtctatttatataattttttgcgccgatggattatttctgtaaatattcaagaaaaaacatttaaaacgataaaaatttcgaagtgtcgtcgtgcaaagactggaagacttgtcggcccgggaagttgccacaactatttggagtgaggctgtcaaacgaacttggtttaaaaaaacagattgcatacttcattccagttgcaaccccctatttacccacaggcctttactactaactggaccggaataat

SEQ ID NO: 99259 - DNA, 805 bp, Oryza sativa
tcttgtggtgttcggagtcgtgcagctacacatacgaaagaaattgtgggacatggacttacatatgtaccatcctaatccaaatcaaaaacgggatgaactaatcaaactgaagagtgggcttgctagttgtacatggtagaatcagacttcatcgatgacaaacggaagtttgccaaaaaaaccaactaaaaaccaactcaaacacatatggtgtacaatttcagatctgcaactatgacgaccttaggcatgtatatgatgactccaagtatagagatggaggagggggtaatggatgaggatgatgactttggtgggtcaaaactatgataggcagaaaagaccttggtatgcttgatatagttttgttaaagggcttcgatcacaaacattaaatcctaatcaatgttttacatattagtattccccttacaacacacgtgtatttttctagtaattgtaataagaaaaatgatatccatgatgactttatcaatctcgagatatgtcggtccagttttttggagatagatgtacgtgcgtgcgttgataggaatgtgcacattggaagtgtccccgcttgtaatgtctttataaaggggaaaaacgcaaaatctatttcgagaggcatatcgatttagacttaacgagcgacacagacaattacgtgagaagtactagtagcgtgacagacatgcatgcaagtagtttttgctattaggttgtgcatattttttttcttcttatgaaattttctcttaaactactcatctgatctacgatccgattataccattgtgtt

SEQ ID NO: 99260 - DNA, 1742 bp, Oryza sativa
agggttgtattcactcggacccttatacatagttacatataagttacagtataattacactacgattgtactatatttatatttttcaatttttaagaataaatttgtcgacaattgtataagagcaggtacaatagcagactattcgccagctacaaccatattttaatgagataaaagatgagagagaagagtagcgggctacatatctgtagccagctgcagcacggactccaagacgtaatgtgtgtatgacaggtgggaccatatactaatagtatagtaagcatctattgtatgaattggctattacattggctatagataaattggagctagtagtgggctatactattaaacttgctctaagtaatcccataggagattagccccttcttttctagtagtttgcattagtatggacttggcctcacaacaccaattaactagtagttgctaaatggtagaataagggtttcgtctccaagaaaaaatgaaaacaatttatgctgcagtgaagcgcatgcatgaacaaaatgaagcaaaacaaatagaatagagcaagcattgattttagtaagaactcataaaccaactaatagcacccaaatactttcaagttagtgtatatattgtgccatgaaaattcatgtgaaaacagatagctttgaccgattagcgcattgccatactactatgctcccagatagagtagtgacatccaacaaactagcaataagatgaagctatgaatgaaagcctatggaatacaacttcatatatcaataaactaataataggccatcgctaagctggacgtaggtttattactcaaaggaaacaccaaacatgtacaaaaaccttcttgagtctaattggtatcccctcaggagggatggcaaacaaacatgacctaaatatcaagtttcgtattgccaagattttcattaacgacaaaaggaaagtaaagtttccgtaccacctctattgcattcgctcctatgttttattgactactaatatccttgtcgatcgctataatggaatgattatttttagattatggaatataattaggtgggttgtgttgtcctcataagtccatctctattgtgaatataatatctatctccataatgacaccaacgtctagagttgagtcctcctatcactgagagcagcaacaatgtagtttgatcatgtgtgaggacaatgggatgcatggtccctccaaccaaggtgataagttatctacaccgctagagggccatagatttggttgtggctttgtgcactatgctcatcattttgagtatcagtttttgcatttatttaaattatgccaatttgcaggatgcaacatttgcatcctctccacgtgtgtgtttatagttccaacttgtttattttgtagtcatgtacatatttttttactgtaattattatatacaaattataaatttaggatttatgacgcatttcattcgatgttgttgcaaagcatcaaccctataccaatactgaggattacttgtacccatattagaatgtgataatgcattcgatgtttgtacacgttggcaacacaaacatagccaaggggtcatgcatgtagttctctttttttttgtgtcacttctttttttctccgtgaaagcgttttctttttttttccagtgattatctcgtcgcatacgatgtttttcacgaaattttttattgtattttataaattgaatctg

SEQ ID NO: 99261 - DNA, 549 bp, Oryza sativa
atagcatgttatcatgagatttttttaaattacatatacaagttatacatagttacatataagttacagtataattacactacgattgtactatatttatatttttcaatttttaagaataaatttgtcgacaattgtataagagcaggtacaatagcagactattcgccagctacaaccatattttaatgagataaaagatgagagagaagagtagcgggctacatatctgtagccagctgcagcacggactccaagacgtaatgtgtgtatgacaggtgggaccatatactaatagtatagtaagcatctattgtatgaattggctattacattggctatagataaattggagctagtagtgggctatactattaaacttgctctaagtaatcccataggagattagccccttcttttctagtagtttgcattagtatggacttggcctcacaacaccaattaactagtagttgctaaatggtagaataagggtttcgtctccaagaaaaaatgaaaacaatttatgctgcagtgaagcgcatgcat

SEQ ID NO: 99262 - DNA, 504 bp, Oryza sativa
tctgtagccctagccatagacgatggcggacttgagcatctggagtgccttggcggatgcgtcgggatccaccttcgtgaactgaatgatttgacaacttgttggccacctccctttcctcgccaacgatattggtgaccaagaactcgaccatcctggtagcatcgattctctccgccagccactccctcccagcgaaacgggtgatctcagcaccgagctttgtagctcgaagtgagcacatgtgtgcaataaatataatggtgtaattgaatctcaacatatgaataattaactaggagaaagaaccatttgaagattactactccctccctttcagactataagtcattttgactttggtcaaagttaaactgctctaagtttaactaagtttgtagaaaataataataatatttttaacccaagaaaaatatattatgaaaatatattcaattatagatttaaatgaactaatttggtgttgtaaatattaatatattt

SEQ ID NO: 99263 - DNA, 2276 bp, Oryza sativa
actagggagaccaatatggaaacaatccgagtagtacttgtcgtttccatatagaacctactcgtccttccttatccggaacttcttttatatattctatatatgaggtatgattccgtataagacttggtatatggtggaccccgccgagtttagtcgattactattgggtatgtggtatccataaccatgacactaatattctctaaatttttcacatttcctattgcaactccgaattcgtaaaaaaaattaatgtatttttgagatttggcaaaaaatgccatatttatcatcataaggttaaacaactgttatatggcattcaagcgtcgtagcgatcgtgtcgaccatatgacctggaatggtacaggctagcttagtagttctttcttaatggctttatcctgcgggcttaaggacttccgcgaatcccgtgagcgtgggctagcgatgagggttgccattgttgcggaatccgattagatgatgtggatcgccgttgttgcgggatccgatgattcgccgttgttgcgggaatcacccgcagagataattgccagataggattgatgaaaagcttgtgaccttagtcttgccggcatacaccatgaagtgtgcttaggcgctggcgtggtggcggtgtagcgcgggcgttaaaatgtttaaggtgtctatgggtacagcgacacacctctgcagagtgtatgaattgtgatatgtcactccctatttcgggtagaaattacgaacgcggtaggaaaggaatctatcggaggttctaatacctgtggtgccttatatgtagtagattttataattacttaatgtaagcttttactacactgttttatgaacatgcataaaatttcttgttggattatgggatttggagatatatgtattatgcaggtggattatgggcttatattatttggattgctatagttggacttgttgagtaccattcgtactcatcccctatatattattccttgtagtgttgagctaacaattaggtgaagagaggattctacaaaattgatcaagtgttgcatacctctacatcaaattactgttgaaggtgatgaagatctataagagcaaggtactgttagtgctattattttggtaaaaactaatttcttatggtttctatttaatgggtttcgctacaattgtttctgctatgctactctggtgtgcccatttcttggtaagttggttcttactaaggaatgagccgtagaccggtattctacctcggaagtggaatacgagggtcgctacacaaggtaacaaaaggctgagtacaataagcataagaatagggaaaggaaaaggaaactggactggaataagaatagtgctcggctcgtcgtactgttgacggtccttaaatcataatatttgaccgtcaataccagcatataatagaataaaatgtggtatccaacttagtggtagggattattactaatcatttccactagtattggtgaagtatgtgtatgtaggtattttgaaaagaaaacacatccgtcaagcgacaaactgcacctccgcgcattcaggacgcatttacacggattggaggctccataagtcaattaaacaactccaaatgggcccaactatcatgccaatgggctgagggcctcaaaattagtgtccacgatgaaaaacgggttgaacggagccgtcccgggttcagccgaactgttcggccgaaccactttggtggctgttcatcgccatcctttacatggacagtcctgatttcatcccaatgacggttgcgtggtagtttggtcgtttcccatacctgtaaccgtcatatggaggctataaatagagctcctctcattcattcacaacacacaactttgagctaaattacaagaggctctattgtatcttttgtatattagaataaggtagagagtgaggaaaagctctggaggagtgcccggaagtttggcactcatctgacttctaccttgacgagtgtagctttctaggaggaattctggaggagtatcgaagctgtcggtacactctgctctaggttcggagaacttcttctataaagtaagcattcgtgttcctttcttatgttatttaaatactttgtttaagtaagatatatttccatctttgcgggttcattgtttagtattcatactaagtgctctagtactaggactctggataaagaaggaagttcctgtacaagtattagagtagtaattaataacttagatgtgatgtctagg

SEQ ID NO: 99264 - DNA, 2028 bp, Oryza sativa
aaaggagtgatatcctcatcagtgtatgcatattaatacatctttcaattctatgaaaataactgtggaaagtgaaaatatcaagttgcttaggttttactaggctagccacgttctagcaggcatactttccttcttgtacattttttcattaatacttcttagaaatctttatttttcaaatcaagctatcaaccttctaatatttgtaatgtattgatttatgccctcaaataatgcttattaattaacttaatttcatctatcatgactcctaatcagtggcggaggaaaaaaaatgaggtgtggcggtgtcgctggtgtggccgcagagaaaggaaaaaaacaatctcaatgcactatattatatgacgcaacattgtcccatcatgacgcaatctcaaacatgacaacaaacactagtcataagttcataaatcatccatttgccaaaagtgtaaataaaagaggcactgaaaaatacctcaagattccagctgtcagctcctcctcctcctcctcctcctcctcctccatctctactgcagcatttccgcttgcatgagtacttgcgcttgcagagccccggttccaaactcttcaaatctgcaaaacaaattacacaaatgcaattttagtatcaaatttgtatacatcaaagttcaaaccaacaaaaataatgttctgaaattgtcaaaatttgaagaatatgtacctctttgtgaaactgtcaaatctgaaattgtcaaactgttgattgcactcctcggttgctcacagctcacttgctcttcttgctgcctgccccgcgcctgcctgcctggccagccgctgcgcctctgctccacgccgctgcctcgcggcgccgcggcgccttgccgatcgctgctacctcgtgccgccgctccacacgaccgagccccaccctgccgccctgcgctgcggccccgagcctcaccccgtcgccgttggccatagtccgcactcctcagcgccgcaccgccgccgctcgcctgttcgatggggattggggagatggattggggaattggggaattggggaaattcgtgatagggtttcatcattcatggtcaaaaggtccatttacacaaaaacaagaccaatgggcctaattggttggcctggttcgctctctcgcgccgcgttcttgctctccctctctcgatcgtgttggtgcggcgtactgggaactgggaaggaggacgagccagggggagggggggaggtcgcgggaggatcaaggtatggcgagtgtcacacctcaccatacaagtcctccgcccctgctcctaatgcttacccgtgaagtttcatctatcatcactcctaatgcttacccttgaaagccccgcttgggattttccttgttgtgtcatttttttctagatttttaaaataaagttaagagcaggcactcacacacgcacaatcatccttacgaatgcacgcacaccccacctttacaagcactttcagaagactggctcggtatatcttgagatcgacgaaatcgtcatgaatggcttgttgtcaatcgtcatggatggggttgaggacgatggcggcggcggctcccgagtccttctgccgcggaaggggtcgaggacgatggcggctcccgagccctcccactgaggacgggagaaggtcgacgacaacggcagatctcgaaccctcctgccatggatggggtcacagacaatgatgatggctcctgagccctcccgctgagaatgggaggaggtcgacgacggcaacggtgactgtggtggctcccaagccctcccaccacggaggtgatcgatgacagtggcagcgatagtgatggaggatgatgagcgtcggagagagagcgagactggggagagagaggggtaggggaaagagaaggaaggggagggaggtgaaaaaaatggaactggcaactaggttccacgtgtagttagggctaatggagatttttgataaatattgtgacggagtgacatgtttcaatttccctaaat

SEQ ID NO: 99265 - DNA, 1836 bp, Oryza sativa
aatgcacgtctttcttaaaacaaccataaagccaaaataaacgtacatacatctaatatataccggtggaaaaaaaatgacggtttttgaaattggattttctacaattgataaaatatactaatttacacatataaccaaatatatgttgttaaactagatctataatataaatacaaaatatccaatcagcactctttaaacgttctatcttttaattattttaaaattagctatccaatttacgatcatgttgtattttttagttaaatataacagatgatgttaaatacgtcaaaacacatgagaccgacatgtaataataatattatgataagtatttaaataatttccatcatattttcgggtgataaatatcactcgacgaatataaaacactaatttaaatgtacatattgaaaaaaccaacaaaaagaacacaaactttttcacgtagatctgatttgaaagtgttttttggtttttttataactatttgatagtatttgagaagtgagccagacgtgaaaatattatcaaaatatttatggccaatgaacttaccgtaacagagccccttaatccatcgtgagatttatggccatacatacatgtattttctctttggcaaatagttttgacaaataaacaatcacataacatgtgcaattaactatttatgatatattttcttatagttgaggaattcctcggtgtcagttattacacgaaacatgtctaaaatgaagtcaaataattttttaaaaatatcatccacacaaacattcgtaacaaaaattcaagcaacattaaacaaggtgtccgcatatatcaagggtccattaaacttcctataaacgctatcaagccaccatgtggctcctacaaatgctcctaagccgccaggtgtcgctctaataaattagataagtctaagaaatttcgataaaaaaaggaaaatatcctgccattaatttttattaattttcagttaatacggtggatccatcattttacattgttagatctatgtatgttaaaagaaaatgtcaagtacgtacacaactctccctcctttgttcacacgaacataggagtacacgtctctccacccctctcttcttccttctttctatttatagtagcaaaattatatatataaaaacacagtaactaaataaagagaatatcttataatatattcgattttaatttgaactatatttaccatattttggcatgtacatatataaaaatatcatttgacataaactcctttatatcacaactaaatagtaataaaatattataaaaataacatatatcatgctattgtaaatgatctactattatctctcctgctcactttcttatccatattttctagccagcagctcagtacataaacaatataaaatgctatattaactatctatgatatactaatagtccattaaactccttacaaacactctcaatctgtcatatagtgttctacaaacactcctaagacgtcatgtggcgctcaaataaactagaatatcctagaaattatgataaaaaattaaaactattgattttcctttaaataggtgaacccaataattgtaactactacatctcacagaaataaattcggtacccccatctcaacccctaccatatgtgtgcacgcatgcacgtacgtacctactccttccaccatcctactcacctctaggatccaactctcatcttctattttctagctaacacataattaatgtataaaaaataataatagctaaatacatgtacttttctcagtttatttgatttggtggggtattaataaac

SEQ ID NO: 99266 - DNA, 2082 bp, Oryza sativa
  unsure (1)..(2082): unsure at all n locations
gcgcgcattgaatgcgattctagctcggnacccccatcaggcccacacacgtaagaagcgtcatccacatcgtgcaaatataaagaattaattatcaaaaacaaacataatctttttataattgttcatatcgccgatgcttataatcatctcgtgtgctttggataaatcgtaaatatcaaacttcagccacccttcaatacccggtgcaacgcacgggtattttgctagtttttatagataaatatattaatatttacaacaccaaattagttcatttaaatctataattgaatatattttcataatatatttttcttgggttaaaaatattattattattttctacaaacttagttaaacttagagcagtttaactttgaccaaagtcaaaatgacttatagtctgaaagggagggagtagtaatcttcaaatggttctttctcctagttaattattcatatgttgagattcaattacaccattatatttattgcacacatgtgctcacttcgagctacaaagctcggtgctgagatcacccgtttcgctgggagggagtggctggcggagagaatcgatgctaccaggatggtcgagttcttggtcaccaatatcgttggcgaggaaagggaggtggccaacaagttgtcaaatcattcagttcacgaaggtggatcccgacgcatccgccaaggcactccagatgctcaagtccgccatcgtctatggctagggctacgctatgctttgccagggcaatagatgaggttgtatcatgggtgtgagaaatatgatgaaggatggcctcgatgctgcccaggccatgctgttggatggtgtcacttggccaaggggggtgcactggagaaggagggtgacagtgaggtgaatttgacaagcactacgtcttagtccatgagcgtcaataggagatagaaggaagaggtggtacgactagaggcaagaaggatatttctcctctagctttcatgatggtagtcggacatgtcatgtcacgtgggaaaagtggcaagggactatggatgcttttccattggcaaaaatttatgaataaaggcaaatgtggcatttgaagaattggcaagggtggcaaataattaaattctcttttgcagagacgtggagagagataccgctttctccgtttcctactcgctgcatcactcatccaagcacagtgagcccaaaaataacattgggccaatgaacccgagcccggcctagccgtccctcgtgcgggcgattgtcacgccttgattttttttcaaggatttaaacttatctaataaaccatttttagaatttatattcatgtgtaaatttattgacaagggaagtaaataagggaaataaaatttccttaataaatcatggttagtgttacttttcttaaattctccatgcctgaaaatactccttggattttctcaaaattcccatatctcaatagctaatttgaaaatacaaacatcattacagtagtaatcatcaaagtgaaaaccgctaaattgtcaaccactcatgcccgctcactgctccttctccccacctatcgttgcttctcacagctagatccggcaaaggtaagcttggagtagcccagatctacgatctgcgagctcagcactgcacgttgtagccaccaaagcaggcaatggtcccttcaagctcgggcagctagaaggctgggcgagcattgacggcaatggcgatgcctacgacgatcgtgcagcaacggagaggagactacaacgacgactcaagaggagtcaaggaagcaaataagggaggtgggatgcatccccgcctcgctcaccatttacaacctcgcatcccgacgttcgtccacgcaactgcatgcacttagtcaggtgagaagtgaagctcaatttgagcaattccctcttgtcttgctagtcagacgattttcgtacatgtagagcttatccctacaggccatgctagcactaccaaaaaattgatacaacaaaaattgatttcaaacaaaaaagcccataaaccaaacctacatggcctataggataagatctttgtgc

SEQ ID NO: 99267 - DNA, 1044 bp, Oryza sativa
  unsure (1)..(1044): unsure at all n locations
caacaagagagtcacagattattgtccaatgttttcgccaagggataggaaacattttcattgttcgccgctgagcctcgccatgttatgtccaatgcatcaagacaggctctctgatgaaaggatcgacaatggtccgcgaggctgttggtgacaggcgggtccctacagggcgtttggactaatattcacaaaaagatacatagcagctatttgtttctctcacttccaaaacttataaactcattacatctataaaaacccaccagattctatgtagatcataagatctctagagtccatatagatgcataagttataaatacatggcatgtggcatgataaaagaagtatttatagatgtgtccaaatacgactcgatacatgattatgcacattttagtctccctaaggaagactatgtagtatagtaccattatttgtctttaacgcagactctgtataagaatccgtcactctgtttctacaaaactctatatatatgtttatgtcaatctctctatatttattgattcaaatgcatatcaatgtgtatatatatatatatatatatatatatatatatatatatatatatatatatatatatgaagcaattaaaaagagggctagcagaatggtagaaaaatacagttattaccaataaaattttgtcgagatgtcttcataatgcaccctcaattaaaaataggaaatcccttgctttaatttcattttgttttgttagatcttatttatgaaacaatctaatacgcatgcccgcgcgtatgcgcgggctttcttcctattttatatacatgtgggcagtgttagaaagtcaaacgttatgaggcggagggcttattttagnnnngnnnnnnnnnnnnnnnnncgnnnntnnnnnnnnnnnnnnnngnnggtnctagagatctgcaatcatgctctgggnnnnaggnnnggcaggtccctttcattttcntnacagannnncggacagatcgaggaaaagaataactatcatatataccatttcttttccgtttc

SEQ ID NO: 99268 - DNA, 1587 bp, Oryza sativa
gtgttcattaggacgaatgcttgcatgccgcggtcgactctagaggatccccatatagatgttaattaatctagatatatatgtgtgtatagattcattaacatctatctatctatctattatatactaaaagtccattaaacttcctaaaaacgctctcaaaccgcatggcaatatctaatcttaccgttgatttttacttaaattggtggtcccaatattttagaccattagattagatttgttattaaaaatactaatatttttctcatttatacatacacaggataaatatatccgcacgtatgtacgattaaagagaaacaaagcttacctacaaatgtacgattaagaagacgtacttatgggaaaaaaagataaagcaggaaaaacatatgtacctctaacacatcaacgatctttaaaataagattttctacaattaataaaatatattgcttttaaaaatatctatgatctataaaataagattttctaccgttaataaaatatattattttaaaaatttacgtaaatatacgtagttaaactagatctataatataaatataaaatgtccaatgaatgctctttgaacattgggattattttaaaattatatatccacatagcactatctattattgccattgattttcatctaaattggtggctctggtattttagaccattacatctattaaaaaaaagtaatacatttatcatgtatccatataaaaaaatgtatccgcatgtacgtacgcgcgtacttacttaagaaaacaatagagcaaaaaaaaaatataagcacgtctaataccagtgggaaaaatcgacggtctttaaagtaggattttctacgaatagtaaactgtacaaatttatgcaaatatacacagttgaactagatctataaatataaatataaatacaaactatccaatcaactctatttgcacattacgcctttgaaattattttaaaattatatatccacatagcactatatacttaaattgatcctgatattttcgaccattagattagatctatattattaaagaaaagtaatattttttcctcctatatgcttatacatgagaaatatatccgtatgcaagtatgattagcttacctgctgttcacaataagaaaaaaaaacatatgcacgtacttactaaaacaaccataaagccaaaataaacgtacatacatctaatatataccggtggaaaaaaaatgacggtttttgaaattggattttctacaattgataaaatatactaatttacacatataaccaaatatatgttgttaaactagatctataatataaatacaaaatatccaatcagcactctttaaacgttctatcttttaattattttaaaattagctatccaatttacgatcatgttgtattttttagttaaatataacagatgatgttaaatacgtcaaaacacatgagaccgacatgtaataataatattatgataagtatttaaataatttccatcatattttcgggtgataaatatcactcgacgaatataaaacactaatttaaatgtacatattgaaaaa

SEQ ID NO: 99269 - DNA, 608 bp, Oryza sativa
aaggccttgaaagaagaatgttcagactccaaaaccattaacatcgtttcgaactttagacgatatattagagaatccaatttaacagcacaattttttggagcaatgcagcatagagttgggctgaaataaacagctgttacaagctcaaattacaaagcaaaaattgctcaaattatgcggatgacgagatccagtaaaaaacaaccaaaggatttaaaattcatcctatggaaataaatctctattttaaatgactaaacaaccttttcagatttttaacaaataccaaatctaccctatcatatactgatactgatagtatatacttacggtaccgtaaaagttctctagttaaaagggcaagggccaactcgagggtatttgaggcctaattcttggccgtcattgctattgtatcaaattacttcaactcctgtaagctttaattcgttcccagcatgctcccacctaattattgaccacttatccgctctctcgctcctacgaccaacaatgatcacttgctcaccaccttttatcaccttttatctctactatgaatgtttattcatggtttcttttgaactgtataaaactagtcacaa

SEQ ID NO: 99270 - DNA, 1362 bp, Oryza sativa
  unsure (1)..(1362): unsure at all n locations
gcgaacatgcgcgggccactttactaaaattaggatgggttaaatttgtattatgaatctttataatgtgaaagtgattattttaaaaggtaatagtctgaattacaccctttaaactataataaaagtgtggatgcgaattgttccggttatatctaaactcgtctatcaccatcattcgctaacatatgagttaatatattttttgttttgttttttcacctatgcatgttcatgggtaatatacgatggaataatctataatgttaataattagcatatcattatatagatgggaatgatataattaaaaagatataatgtggttacatgcgacattttcgatgctatatatctatgtttttcctggcaaatattaagtacatatttttttcctctttttttgacaaatattttttctctcagtgtaggtgtgcgtatgcctatttttatgatgggtgtccgcatgtttatatatgcgctcgagattgcctttaacattaatagtaaaaaaaatgctttcaagaaaattggcgaaatggcgtgtaacggtgctgtgcagcgtggcttcttcaacagccttgccaggagtggtcgctactcatatacacaatttgtggaaaatctcagagctgcaaagaaagaaagagaaaactacttgatggggctgatcgtatacacactttctttttttcctttataacatctgttgtgtacgtacatagtgagggattacttgaatagatataatataatgattgaaaataatatatccactggtttatgtgtaaataaacagttatattttgcttttcttaatatattttttcttatatgatcactaatttattagagcgtcatgcggcatcttggaagtgcaggaatgcttttagtcatagtcgtaatggattacttgaacatatctaatctaatggttaaaaataatttatccaccagtttaagtgtaaatcaatggctagatgttttactttttcttataacttttgttagatttaccctaatttattagagcgtcacgtggcatcctaggaatgtatgtaggtgtgtggaccccctataacccaataccaatatatttgtagtcaactattatttgttgtggcttggtggtatcaatactaacatatcatttgttgatggtttctcacttagtattgtccattatcagtacttgataacacactgcatattggggatcctctagagtcgacctgcnggctacaaggtgagcattcaacttgggggngnggggngtggtgggagagaaatntaagcagagtattgtnaaagaggaaaagatagggtnanntaagatagtanaaagaatgatatggatcttta

SEQ ID NO: 99271 - DNA, 879 bp, Oryza sativa
  unsure (1)..(879): unsure at all n locations
gaaatttgtggttggtgtaaaggataaataattatatctttttgtaggaattagtgtatttggtggcgncgcgagaatagaanttancgtgttcnnnnnanatancccccccccccccagtggcnttttgaattcantatcancttcttgcaagccngcagggcgactctagaggatccccaaacacttaatctttatctttatcttcaaaaaaattaaacaccaccttaatgtaaaaaaatggggcaccaataatattttttttggtggagctaagaggtaactttttacgtcagtaagagaaggagtgaggagagaggagtgaataagaagaattctttttactctctcaggcttaaaatatatagctacgggggatgtgaaaatgggactttgtgaactactacctccgttctaaaatataagtatttttagctatgaatctaaacaactgtgtatccagattcatagtcaaaagttattatattttgggacggaggtagtaacttcctctttctacctgtaacagtccacatcatcccaaccaaaaacatggggctctgcagcttcacctaacccaagactacagtctacaatgagagatttttttatgtccgaaaactttttccgacatccggttaaacgttcgatacgacacccatgggccaaaattttttttttggtgaactaaacaggccttagtcccttaaagaaaccctctaggtgttaagtttaggacggatgatttacacattttgaagcaggagactggagggaataggaggagctggggagtggcaaggatacgagcgggacgagtacagagccaatgttcagggaagaggcgacaattattattttaccatcagggaggcaggg

SEQ ID NO: 99272 - DNA, 1025 bp, Oryza sativa
  unsure (1)..(1025): unsure at all n locations
ttcttgaaattcaaattcatggggtgggcgatgcggtgatatctaggccagtgatcatggtgatgtctagcagggtagnagtcatcggccccttgattgaacaggaacgcattgagggtgttggaccacaaatacgttgcagaagccattaggggttcgtccttagccgaatttgctaaagtaagagcaagggcttggccgattcctagttcatcccagtgaacctgcttgctagccgatacacgcttgcaccatacgagccaacttctctcaggagaacttttctcaagggaaggccaagacttgaaagtattcttccaatgacctagatttgggctggccaatctaaagggtatcctattagtttcggcgctaatgaactcagtggggttagaattgccgattgggccaagaaagtactgatgctcgtgagacaaactgggaattgcaatcagattagagagatgctacagatgcaaaagagaataaagaagaagaaaataagatgagatagaggaaacccgatctactgcacaaaatagagatctagccgatgggtgctcacctctgcatactttgccgatggcgcggcggatgggctgacggaagtcgacattgctgcaggcggaagcttggccggagttgggatcgccttgaggtcgcctttttgcgccaaggagatcgccggagaaagagaagacgaggtttgtttaaccggtgagaacggaagtacgcgtgtcaaatttctcgggggtgcgagttagtatttaaagcgcggcggtaacggtgggaaaacaagcaatgagcgatattcttgtacatgaaaatatggcaaatccgcaacattaccaaatattccagacttggggggcatgtgttaacgcccaactttggtattttcggtatcgcacatgaagatagacctcaagcagaatccaatacatagatcgttccggaaacagagcaagaatcggcagaagttcgaatcggctgcgaccagaatcgacagagttcgagtcggacaa

SEQ ID NO: 99273 - DNA, 700 bp, Oryza sativa
  unsure (1)..(700): unsure at all n locations
aaactgggagatttttgttatcaagcttctagctagttactctatccagtttcataattccttacgttttagacaatggcatggtctccaaaatatatctttgaccttggtttttttattgtaacatatacaataaataaatgcatgtttacttttattatagtacttcgaaacataaatttatatatgttgntctagttcctttaaacaaaataattttaaagttactgatagtcaaagttacaaaagtttaacctcaacattgtctaaaatgtcaagaattatgaaaccgaagggagtaaacccttatggatttttttgaggtaaacatcaagaagaaggataaggtttctaattattaagaagaaaaaagagttggccttgtttgaggaaaaccaggcctgaaaacaacataatcgcattgtaaattaaaggaaagagtaaagggcacgaacagttcctaaacttgtacggccatgtcatctagatccccaaactatcaaaatatatatttagataccagaactcgacaaaatgtgtcattccgatcccaaactgtcacagcccttccaagatcctatatggcactgatgtgtcatgccacataagcgccaacgtggtatcatcaataactctacatgacaaacgagctttcgcgtctaaaagagaggaacannaaagcaatgaaaaggaaagagag

SEQ ID NO: 99274 - DNA, 700 bp, Oryza sativa
catcaccacccactcaaaccccatcgccatcgccagccgccaaccccgctagatccagccaaagcggcagcccgatctgggtgtgtgctccgccgccaccaacgggcgccgtcgccaccgcaaccgaccgccagttgccacctccatcactcagccccgccgccagccgccaccccgtcagatccggccggaacgacgcagatctagatggttgccaccgccgctgcccaggcagctcccccggccgtccgggtgcatgctgggcaaagccccgccaccgccgtccttgcggccgcgcggctttgccggcgcctgctcaggcggcggcgagccagggaaaggagggggaggagggagtcggcagcggtgttgcctctcgtgttcgtgttgtgaatccagaatattgaatgcttctccaaacatgcatgtttgcgcttgaaatataatgtaaagtgacatagtataagatatgaacaggaccaatccatgacagtttgaatcgaagaaacgtgcagacttttaattttgtccaataacagggcaggctctcgaaaagcttgtaaattctgatattgttgatcaagataattttgttttcgaagaaccttcgcaaaggacatggagttcatgccaatttataagataaacaataataagatgtagtgttaaagtcatattttacaagttactagaaaaaatg

SEQ ID NO: 99275 - DNA, 675 bp, Oryza sativa
  unsure (1)..(675): unsure at all n locations
attttccaggcggttggtaaatcctttatgagtttatttacacagattttacaccacatatgccatatatatatttctaggggtggtgaaaccatgtgtgttttagagacttaagcatatctgttaaagcagtgtgcgcatggcgtatgcctaatactttggaaatttctttattcacaacatacaagcttctttatagctggtttgctatgtgaattttcaatgatgtagccaactttaggttacactcattatattttacaaagcagtcggtatatcacttggatcatgttattgagggattcataccgcatatgctatatattgatatcaaggtacttggttgattgcaattatcaaaaccactcggttgggtggattatttattccttgactatatgcttagtttggtcagctaaacacatagtccggggctacacctattaggtgcatctaggcgatgcacctgactttatttttcagcccttcacagtcttcatatttggtaaaagtactcgngagaacatggcaaagatgattgaaagcacttgctttagagtaatctggntcgagagaagatatcctttcgactatgaaggtctcaggngctactgtgaagattattggtaccccatacccacacggcatgggtattcgactagttataagggataa

SEQ ID NO: 99276 - DNA, 858 bp, Oryza sativa
  unsure (1)..(858): unsure at all n locations
agcgctagtactagcttcgtgttgaatccagcaatgccctttactgaaggtgccctcttaggagtttttcacttactagctactccccgaattttttttatctaaacacatgcaaaccaccaattacaaatgtgagcacgcaataatcacatttaattatttagacaagatgctcatatgcagcgatatgtttccatcgaacgagtagcccaacaaactattgggccgtattgggctgctgaattgatcacgttagcccaacaacccacctctaaaattggttagttgcatcattatggggagttttctccattgttcaaatcattcatccggtagtatatcaaaatcatagggtttagggttgcatacggcgagttttattcattgttcaaatcacaaagaaaatacaaacaatgcggtattgtactactaaattctcaatactagcgattcatattagtcgatcaattgtttgctgcatgctagtttgctcaatcccatgtgctcagaattgatgaattttagttacactatatccacgctaacactgttattgccaaaggttatcctagatggtttatatatacgcacaccatcatcgtgttaaggctaccgtcatggcactgagccaaagctaaccgaataagaaatgagggaggtgtaatagactaccgggccaaccggatttacggtggtgacatgggcaggttgattagaagtagaattctaacttttgcgtgctcagatttgtaattagtggtttgcatgtgttcagataaaaaaaattcggagctacccctctgttccacttctaaaatttaaatttatcctgggtacagngcgatattcaaattcaat

SEQ ID NO: 99277 - DNA, 735 bp, Oryza sativa
aggtgtacaccccgaaccacttcccacaaggctactaggtggtcaatgaggttgactatgataggtgggtttgcttcaagggtcaaatcttgtacccaagcgtcgttgtcctttccttggggactttccttcctttttagagatcgcatagactagcgacatgaggtctttcggtctgcgcccatcaattcatgtggagtcctagaaacgcactatgtttccatcactgacagtgttggacgttggtaatctgtatcatcggaggttgttaatttgatagtcagtcgtgataaacctgctgttcttttcagatcaatttgtagtgtcaatccttcattacatcacagattcctaagctacaaggaagaggtcacataagtatacgccgcaatcgaggatcagtatgctcagagcatgttcacttgtattctgttctggggggtaacgagtcactccttgcaaaaaacatcttgacatatctccacatgaaacttcttatatgatcactctcctcattttgcctttttcccatctcttcgttccttatcaatacctcccacccttacctcgtatctccccgacattgcttaactatcatcacctaaccgccctctatctctcgatacctaaatgcttgtcacaacatcatgtgtccatcatctcaacgattccactctatcctccctgacacctcgtcgctagtacgaccgtctcatgtctacgtccaccaacccc

SEQ ID NO: 99278 - DNA, 730 bp, Oryza sativa
  unsure (1)..(730): unsure at all n locations
cagggccaatgaanaatgagatgcgagctggtacccatgaaaacagcccaagaagaaggccgaagtccattgtccactccatccaagtcggcgccgctctgaactctctggtagtaacccgaccgaagcaatcccactgccatctcggatctccccaccttcctccgctccacgcaaagcacccgagtccccccaccccgacctcccttccgcttaaaatcccccacccccgcgcgccacgccacccccttcttcttggcattcgttctgaccccgtcgtggggcccaactcccatgaggtgcaccttatacccccggcgtgcgcagcagccatgggagctcaacagagcgtcaatgcggggaaagggccgtgtactttccctgtctcttccttggattgggatgttctgcttgctgtgtgtgtgcgtgtgtgtggctaacgtgtttgtggaaatgccgcaaccaatgtggatgtgcacgtcgacctcacccacatgctctgcgaggcgctcctgctgccgaccatgaggtgctccggcttttgcctattaaaggtgttttcggaggcacttggatggccagacatgactttttggttgggtgatgtgtttttggggttttttcaagaactttggcgccaattttctgccaaatgtcggaagggcaagcatgttgggttggcttccggtggcgaaaattcatttttggataccggcccccagacatttgc

SEQ ID NO: 99279 - DNA, 980 bp, Oryza sativa
atcgaatctttgaacatatgtatggagcattaaatatagataaaaaaaactaattacacagtttgcatgtaaatcgtgagacgaatctttcaagcgtaattagtccatgattagccataagtgctacagtaacccatatgtactaatgatggattaattaggctcaaaagatttatctcacggtttccagtcaagttatgaaattagttttttccattcgtgtccgaaaaccccttccgacatccgatcaaacatccgatgtgacaccaaaaatttttatttcaccaactaaacagcccattctttttccttttgctatagtcctcccctttgtgcgtgagaggaatgaattaaagattctatgtttaactggtcttcttcaatcaaggcatgactttttttgagttggatttgaaggatatggggcatggcatcgggtctgcgagattgatcgccgcaagactgaggggctgaggcacaagcagaggccaaaatttcttcttttttttttccgtgaagtactttccttggtgtgctgtgatgagatgattaaagatcaagtttctgccttaatttctcaattggagcatgatttttcatgagttccaatgttttaagaatggaaccaataatgttagaatttgctttatttcaaacttagaagaatgtgcgttccagagaaatcaagaggccatggtaggagaccttgccatatactctctccatcccaaaatgtttgacgccgttgactttttaaaaaatatttgactgttcgtcttatccaaaaaatttaagtaattattaattcttttcgtatcatttgatgtattgttaaatatactttcatgtatacatatagttttacacatttcataaaagtttttaaataagccgaacggtctaacatatttaaaaaagtcaacggtgtcaaacatttagggaaggagggagtatttttttaggaagaccttgccatgtat

SEQ ID NO: 99280 - DNA, 759 bp, Oryza sativa
  unsure (1)..(759): unsure at all n locations
agtaaattaatgtggtttatgataatttaaatttaaatagtatgtagaatggtgattcaaatgtaaaaagtaagatggtatgactttatggaagaagaaaagaaggaagatagtttggaccgtagattaatcatctaaaggctaaaaacaattgatgtgatatgacttaattagagaaaaaaaaagaagaaagataatttagaccatagattaatcatttaaccactaactaagtgaggataaactatatatgtatataggatatcataaaacataataaagatatacattgaaacattatgtgaattatgttggatcataatttaacatgtttgtatttgaaaagctgttaaattataaaaactataaagatataacatgtttgcatgatgtttaaatgtgataattgttagtggatgatgatgtgtcatcttgttaattagtggattagtggatgatgatgtggcatcttattagtggatgatgatatggtatctttgtatgctaagcttaaggagttagtgaggataactttatagtagtaagataggatttcttgtcagggctcctttgaacctgctcatgatgttgttgttttccctaaaaaagaacccacctgtaatgcacgcaatattactggataatttgtaataatcagccgtgatcagagctagcatatattgttttcttgtcccagataagggggatcctctagagtcgacgggcnggcatacaggatgagacatatcaaggagcagg

SEQ ID NO: 99281 - DNA, 2000 bp, Oryza sativa
  unsure (1)..(2000): unsure at all n locations
cgtggnccnattganattttcgaatgtcgagctcggtaccctgctttatttcaaacctagaagaatgtgcgttgcagagaaatcaagaggccatggtaggagaccttgccatatactctctccatcccaaaatgtttgacgccgttgactttttaaaaaatatttgactgttcgtcttattcaaaaaatttaagtaattattaattcttttcgtatcatttgatgtattgttaaatatactttcatgtatacatatagttttacacatttcataaaagtttttaaataagacgaacggtctaacatatttaaaaaagtcaacggtgtcaaacatttagggaaggagggagtatttttttaggaagaccttgccatgtatataggtgaggtatagcataatgttctatattgatgcaactttaggataagggatattttacgttcctctgattcagctcatgctgacaagttatgaggaacacctatgtcacgtccggagttttcctttacttaggtttcaaaatcaccaataaattattaatggaaattacttcgttaatcatgaggaaaccttaattatcaatgcatctaataaccgaaaaagtcagagagaatttttcccgaatactctttgcgtttaaatcattaacaggatttaaagcagaacgatcagagcaaaggaaataataatcagtaagtttaaaagtggcaagagttgaattaatagttttccctctcggccggttttggtcatgaaccatgcccggttcattcccctttgtccgttctcagttttgttttgcatgacaaaccgaatctcttttgtttccggtaccgttcatgttcttttcctagaacgacaccgcttttccttttctattttggaaattccctccaatcctattcctactccgaatccctctcctccttttcccccttgcgccagcctccccctcccccaccaattcggtcccctccctccctgaccaagtcngcttcccccctctcccccctctcccccctagccggccccacctcattttcccctctcctatataagccatcatatcccctcttttttcccacataaatttattggagtcctagccaaaaccttaaccacccccttgcgccgccaccgccttagccgccgccgctcctatcgtcgtcgccgccggttgcaatcgccgctgtcgtcgccctcgcgtcgccggtgagctcctcttcaattcttttggtatgattttacccatacatattttttcaatcatctaatctactcggttctaggtttaatccagtcgtcatcgtcgtcatcccggaggttgccgccgtcgcttccatcgttttcctcgccgccgtcgtcattttccggtgagatgcccctgtcctgtctttgtttagtggtcgttttagtttcctaacccctaaccctagtgttaacgaccaaatttggtatttttcgcatcaacacctagccgctctgtgccgccgtcgacgcccagttgccgctgccgccgtcggttgtgccgccgccaccgccttttgttgccgcgcggccgccgccttgcgccgccgctgccgcgtctcgtagcggccgctgccatgtgccgagccgccgccaccgccctagttgtttgccatgtcgtttagcgactgtggtctcgttaaaatagagttttagttgctgtttagcctttgttactagcttggtaagtgtgttgtcgaagctttagttcgttcagtcgtcagagtcgttctttaggtttggatggtcccgtgacacgatgagttggctcgttgagtcactaactcgtaaggcttgcttaccaatgatctaattcctttgttcctatttatctatgggcattaatctatgataaatgactaatgttttcccgttaatagtaattacgtagctcatattgtaaaattcatatctaaataatccaagctccgttttaatccattcaaattgcagtaaattcgttaaaatgtca

SEQ ID NO: 99282 - DNA, 676 bp, Oryza sativa
tctccgactgattatttcgtcactaaggctacaaaacgctgccgctattgctgggtgcattcatcttcactgttagtttatctgactgctgccgactggtttcttcacttccatgccgattgcatcagctatcaccgatggataatttcaactactccaaaagtataagctatatgctcaggggcttactagctcaaacacaagtatcataccttcaatttggaattgttccggatacatgcaacatgaattcatgatcatgggtttattttctgtgctcaaagactggactatttattattccccgtaagggttatcaactgaatacttgcgccagtcaggattcaatctttatatctattttggagtatcccataaaggataatcacttagatcagaagctatttatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcacgtgatcaagtgtccaatacccttttaaaaaaatacccctttttttttaaatttttaaaccccccccaacacccaaa

SEQ ID NO: 99283 - DNA, 1124 bp, Oryza sativa
cctgtcccttgttgatacaacctcatgcttgcccgcccgcaggtcgactctagaggatcccccctagaagatatacccatactaatcacaagccagcgtgtggtccaggctgagtttagagtataactcgaactagtcaacatatcatggcaagggtagaggcgatggtgcaggacagacttggatttttggtctctgctgcttccgaatttacctaggcacgagaggggactgcccgctgcctgtataggagagggggtgaaacctaaggtgggtgtattcattagggagagttatatgatgggttctgtcacgacctctattcgggtacttcggtatcgcgactcatggtagacacgatgttgaggctgtgtcttgtgagtaaaattgtacacctctgatcaaagtaaaattattcgaccagctcgtcttgattagtctcactttattaataatttgacttaatgaacgggtatagttcaggtgatttggttgtgcctgtttcaacgtggatttagcgttgtacagtgatgtttaatattgctcaattaaatatataatgttttactgctttcatcttatgatttataaatgctgcttttactacaaatatcctatgagccactcctttgaatatctctgcctcagtatgacttgttgagtacggtggttggtactcagtcttgctttatttctcacccctcctcccaagaggcagagaatgttttgaatggtgagttctatgaagattaggcttgtgccggacatcgaggttttgcctgtggatttggaggaagctacgctttgctaaaaagattaagtttagatggtctttagtttttccgctgattttctgagtttattttatatttttgtaagttgtggaactatatcaaattatcatctgtgtactctggctggtcctggacagagattcaatatacattctgcttggaattcgggttagcgaatttctgagcgtgacaaccaaacacctcccaaagtaaattgctattggtgagaaattgtgtgtattttggtggtatttcaaacgaataatgtgttttttcagttccatgattaaagaggtgtacaagagattatatggatcacgattcagaggt

SEQ ID NO: 99284 - DNA, 1499 bp, Oryza sativa
  unsure (1)..(1499): unsure at all n locations
aatttcgataagcattagatctgtactttgacattttccgaaaattcctcaaactcaattcagaaatttgaaagtgaattcaacttttacctttcaaattaattttttaatcagtctttcctcatttacaatttgttcagattctcatatatcaaaatccaccccaagataaaaaaaaaatccttatgatccgcaggatgatggatgataaaagaaaacacaaagatttttctatgggtagatagcgaagatattcctaaattaatttttataatttgatataactaatcattattaatattatgttttaattaaagtattagttatgagattaatcctactttgatccccttggtgatcgaatgcaaacatatatttacatatacatgtaacaaagcgcaaaatctttaatacgtattcattagcacaatactgatatctcatctatacactcaagcagcaaatccaagttcacgatgagcacaactatcgcatgtttctggttagcatcaaagcttccaacgaagcatggtcggacacgacaaacgaaacggattaagtaaagaatcaattctcacggatgtacatgctttggaaacaattgttgtgaacacacgcgtttccgtaacaataatgtagcataccgcagcggagagaaaatgcggagatcgtaggacgccacgatgacgcaagcagatgggaatcaatctcggataaaaattatgtcaaaaacatcttcaatttttataatagtagagataccagtcttcacgctaagtcacgtgttattcggctgcttatacactggcacggtatatgtttaattgataattattgaaaatataggtgcagtgaagtacctactttataatttgccttaaatatatggcataatttgaattaaagctaccattaaactgattacttttattaacacaaaattttagtcatttattaaaaaaatatttaaggatcgtagcgttagcacgggtatattactangcttcttttatctaccctataattcaccaatgtatggtacattctcatttcacattgatcgggcagggatcgcccaataaatncaacggcctaacgtacttccacctctccataactctttncctacaaaacccgtccgtacggaaggctggcaatcttcccttaagcgcaattttggtcccttttcccgagcgcagcggggcttaattgcggtgcactgagatgaaaatgccgggaacaaggacaaccgggcgttgtcttgcctaacttgccttttcaaattcttcggggggttaaactccgcggtccttaacgggttgagggcaatcgggtgccacggcgtttgaaatttccgggcaaaaacatgggaacaccaacacccggtttggcacagagaagggagagggccgccacacttgggatagtggcaaccggattataccagggcccttgtggggggagggttaaataggggagaaaaaggaccttttgtttct

SEQ ID NO: 99285 - DNA, 906 bp, Oryza sativa
  unsure (1)..(906): unsure at all n locations
atgcatgacttttttttaattgttcttctaaaaaatcaaataagatggacgattaaagttgaacagaagagtcatggttgcgcttaaaatttgcgcttaaacgctgttaggtgtggttggtacaactaaaagagatggatacccgcgagcggcggcgacacaagtgtagttgagtagtagtttaattctctaaaccagatgtggcaacggatagaaatcattcggcgatgacacaagtgtagttgagtagtagtttaattctctaaactagatgtggcaacggatagaaatcattcgagcatgcgggtatccatctcttttagttgcacaataaccagatgtgacaatggatagaaatcattcggcgatgacacaagtgtagtaaaccagatgtggcaatggatagaaatcattcggcgatggcatatgctcgcgggtatccatttcttttagttgaaccaaccacacaccacatctggtttggcgatgacacaagtgtagtaaaccagatgtggcaaggcatatgctgcaacggatagaaatcattggcatatgctcgcgggtatccacatctcttttagttgaaccaaccacccacatctggtttagagaattaaactactactcaactacacttatgtcgccgccgctcgcgggtatccatctcttctcttttagttgaaccaaccacatctaacagcgtttttcgtcctcgctttcacgcaaaagattcgaatccggtgtgttacagtgaccgggcaaatttctatttaagctgctgctgctcaagttaggaaagcgaagtggtacctatctaacttcagtggccgnccttgctacagtagcgccaagtactgttggcttgatgcatgcttggcccaagccattggctggtggtagcttttt

SEQ ID NO: 99286 - DNA, 607 bp, Oryza sativa
aacgccgcaaaagctaggctgttggtgctggcacgggtatgctcaaaggtcagggtggtcgacaccacaactagcagtgatgataataacttctttcctgcaaggccgtaaataacacaaggagcagtggtacatactattttctgagaaaaagatcactactacaaaaatgattttcgtagaattttggctttcttttccacaatcgaccaaaagggaaaaaaaaaagtaaacgcctgctaaaatggtttaggccacctcaggataacaaactgtggcagacccaggatttatccgatatccaagcttgtctaccccagatcacaataggcaggactaaaagtaagacataaaactaatcacactatgacatagaagtaaaatacattttaaaattgggtttactcctttcaagcctataggaaaagatatttacataatcatatattaaatatgttgataaaaaaacaaagttaatactaaagtaaatttcataaccaagaagatacaaattgcaaattacaaaaggtagtttcatatttcgattaccccgcggtctaatcatgtgtaaccgaccccaatcagacactcataggttctggaacgg

SEQ ID NO: 99287 - DNA, 934 bp, Oryza sativa
ttgttagagataagagtcgtgtccgacatggacatattttgtaatctcaggtataaatagacccctaacctcatgtaatgagggacacacgtttaataacaatctcagcgcttcgccacccttttctttcgttttgttttcgacgagttcttgctttcgggttgagctgcatcggtttcgatcttcaactagaagtaaaacttggtatggtggcttgcgttctcgggattagtgcttccatctttatgacactctaaccttgtgtatgtaagctgtcgagttatcatatatcctatataatctctgacaatattgttatttaaccttcagttggctaacatctatcactagaaggcagccgatcaggttaaataccaacgttgacttagattatatagggtatccaccaccctatgaaacatccaacgacttgattgtctaaatattgtctttcttttcatacttatagctgcatcagttgagtttgaccctataagtcgtgattagaatatcaatctctagcctgtctttggttgccgattagggtagtatcggggtttcaaccgatcttacctgatttagccttatattttatgtgcttaattgatatgctagatccgccctttatattgagatcttcttgctttcaggtatattaagcttctcggttgatatattttgcttgctttaatatcttaacatagagtggtatcggagtattagccgatacatgctagatctatctaatcggctatgctatgagcgcttataatctcattgttaatatatatttcgatctaagtgatttatactgtctcggcataacgatcgatctatcccaatcacttgacttaaatatatatcaacatagggattatgtaccattaatatctacagccgattgaatagatttagttctttcttatttattcag

SEQ ID NO: 99288 - DNA, 1246 bp, Oryza sativa
  unsure (1)..(1246): unsure at all n locations
aaaaaagaaagattttttttagaatacccccccccccaaaaagtgtgggtggtgggaacaaaccacaaaggtttcaaaatttaatttgggagtctcaaaagttttcccaaaaaaaaaaacccttttatttttccaaaacctttatattttaaaaacaaccgcagttgcattgtgggcctacacatttcccttccccccaatgaaagccattttcccaaatttgattttgggcctgtttaaaaccgccaaagtatcgcaatttaaaaaaggttccctttcccctggagagagaggcaatacccccaaccctttttagggaaaccagttttgtttgtgctctttataagagccaatgattgaaataggccctcacaaagtgtcaaaagatggggtacaagaaagttctcntcccttggtctgaatgctgctaataagacacacttgtcgattctaataaggcccttaactttccacggcataaacatgagaaggtgcttttgaatactgcattcgaagaataaaaatctaatgcattaacactgagctagaacataaccagctataaagtgctctaatcaaggtgtgtaagcaaaggtgaatgacagaagcatacagaatggtgaaggatagtaaagttacaaaccagcaccagtcctaatacaaatattgaaattggaaaggtttgtaagttacagcatagagttggttgtgaaatttaggctggccatgaattaaaaaaaaaatgattcacaagttgtctgctgggttgctgcaaaaagaggtgcctcttgtcctccacaataaatttgtgttgttccgaatttatgatatcacagatattagagagttgcctcaatgcagtgaaactgcattactgcttcgaagacattacaattgagagccagcccaacaaagagctataatttacatcatcccaaaacaaagtaagttttcaatacaagttataggcatgtaccatgaagaactgcagttgtgtaaatgaataaagagtgagcctaagtgtacaaactacaaagacagttatgtcttatgattaacctgtcatgttctttaacatgatggtcaggtatatgtaaaagtatttccatgttcataatgaatgttgtcacgctcagaaattcgctaacccgaattccaagcagaatgtatattgaatctctgtccaggaccagccagagtacacagggtaccgagctcgaattgcctatataaatggtcatatacg

SEQ ID NO: 99289 - DNA, 712 bp, Oryza sativa
  unsure (1)..(712): unsure at all n locations
tggcgggtggccggtggggttggnttngggtggtggccggtagggaagggttggtgtttccttttttataagtgaaaattaattgaatatatgaggtgaggttactcatctttgacgggtgtaaacttaaaacccgtcataggtaagtactcatcagtgacgggtttatatgtggacacgtcacaatcattatgtgtcgggtccttatatatacccgtcacaggtgagtatttacctgtgacgggtcattttttttagcctcatctatgacgagatttattttaacccgtcaaaggtgatagtatctgtgacgagatattttggtccatcatagataggccgtcacagatgggctaatctggcgtagtgagaaaagatcatgcactcaattaagcagctagttaattaatttacatatggccttggggtttatgtccatttgcttatgttttttcaacaaaaaaaaaagtccttttgttgtaaagcaaaggagcaacacaacttttaaggttggggcctccaacaattgtaagtacatgtttttcacaaagtcagcctttaaaatcacgaaaaaaaacacgaatatttgagaaggaattaatatcaaataattagaaaggttgaaacttcaaacccaggccagctagcccattactttgtggagctatgtagcgcccgttccgtcgtggcgcctagcgggaaaattatctct

SEQ ID NO: 99290 - DNA, 665 bp, Oryza sativa
  unsure (1)..(665): unsure at all n locations
acttcttagaagtcaaaatcctaatactgttaaaacaatcaacaaaagagttgaaacatgcctgtactcctggcctgcttgtgctgagatctttcaaactagaacaatccttctcctgcatacaaaggttgtcatgattaaatggtaaatactaaaatctaaaacactggacatctgcatgcagataattgtggagaccaatcatagttgcataatcacaacaaatacaagtaatgcaagattctcataaatcagaatattaaggttttcagtgaacttacttagctcatctaatgaaatgctagcagcactctcgccagatttaatcagccgaatcttacctgtacatataaatatttttccaaggataagcttttacaacaacaaagacaatcaaaataaataagtacaaaagaatagctatcaacattactcaaatgcagtataattaaacaaagcagcaggcttctgtgtccagtttggtaacagagttatggagttaccccgagaaaattgttcaaacttcaaacgttatttattcttgctataaaatattactaccacaaagtttctagtggaatggcagatcaacataccatcgcgtcgaagacaaatctctggtatattnntcacttgatcattaatgctgncattgtatactctgg

SEQ ID NO: 99291 - DNA, 684 bp, Oryza sativa
atcattctttcagcaatatctgccctttgggataccaattgtttaagcagttgtccacgattcagaatgaagaacttttgtcttagctttattttcctcctgtgctttatccgtctggtaaggaacattgcaatgagaacaatgcaaataaagcctgttgcgctaccaactcctataccaatgcttaaacctgaaagtatatatatatatagatatttgtttaccacttttaataaaaaaaagtttcccatgaaaatagtttgttacttccccaaacatgacttgtgcaaaaatatttttcaaaaaagctagtgaatattatatatatacctatggttggagtgcagggtatgatcttgggatctttgctctgagttccagatgggcacgaacacgcatagtttccaatcttgttacgacagttacctttgcaaggatacaaccatggataatcgcactcattgatgtctgtccatcaaacgatgttgggccagggaattaaaaagaagtggtgtcaatttgtatgtttctagttgcaagaaaagggggcatggaaatttttggagagcattctcactttggcagcctccatgtaggtagggatttccttcataaccttgagagcagttgcaaaggtaccctgagcggctaggtctgtcgatgcaaagagcttgttcctaagcc

SEQ ID NO: 99292 - DNA, 682 bp, Oryza sativa
agttccagcaaaaagttgggtgtaattttaggctggccattatttaaaaaaaaattattcacaaatttttttgttggttccctcaaaaaaaggtgcttcttgtcctccacaataaatctgtgttgttccgaatttatgatatccagatattaaagagttgcctcaatgcagtgaaactgcattactgcttcgaagacattacaattgagagccagcccaacaaagagctataatttacatcatcccaaaacaaagtaagttttcaatacaagttataggcatgtaccatgaagaactgcagttgtgtaaatgaataaagagtgagcctaagtgtacaaactacaaagacagttatgtcttatgattaacctgtcatgttctttaacatgatggtcaggtatatgtaaaagtatttccatgttcataatgaataacaatataggaactcatgatcaacagtgagataaaaaccgacaggagttctaaaagacacaaccaaaacaaataaccatatgtaagaaccaggtaaaaagatatttcaagccgatcagttaaacaaattgtttccaacaacaagtcaccatgaaaaataaatgcatagaactgaatctagaaaggaggtagaagtttgtaattcatacctgagaagatgctttaattccaagaaatagctccacgaact

SEQ ID NO: 99293 - DNA, 730 bp, Oryza sativa
ggccgtcattgaatgagactccgatcgtacccccgatgggccgtaagcttatgaaactcatgccgtcgaatttatccaccggtctaatatgaaaaaacagagtgggattcagatattagctcgggcatgctcaatttatgtcgtcggctcctgcgccgaccccgtgaggagccttctaagggtggacaaaaagctcgaaattcgtggctcggatcggctcgtagcaagctcggctcggatcgactcgaactcgtagtcttaatgagtcgagtatagctagccttttagctcgtgagcttaacgagctagctcgcgagctgctcgtttagctcgttagtataaaatatcactaaattttcatgaacttagtatttattgactagtgcttagtcttttagttacatcaaaactattcatattcagtaagtattatattagttagtgtttattattatgttaatatataataaaatgttaaaattgaaattattaatacgatattaataagatatagctcgttaacgagcctaacgagcttaacgagccagctcgcgagccgagccgagctagccttatagcttattaacattaacgagccgagccgagctggctcgttaagataacgagcttaaacgagccgagccttaacgagacgagcttgctcgttatccagccctagagccggcgcgtagacaaaggccggcgcccgtttcaacgccgtaaccggccg

SEQ ID NO: 99294 - DNA, 724 bp, Oryza sativa
ggatccccctttctgatgatatgaatatcaatctggacatgcatgtctcgatttatagtactacattgctaatcgttcaacttcattggatgactcaacaagaaatgcaatgctttatacctctctgaaacaaattttggtaccggatttaagtgtgacatgacgtcttcatgtacttgtattttatacttgatgcttcaaattaagtactctctccattaaaaaaaagaatttatggttatgaacctcaacaaaattcaaatttatagttagaagctaacttttttttagatggagggagtagttaataactcgctatcttaactcgtcagaaaacgtccaccatgctttttactacttccaccacccataaaaacccttgtttctagctatagacctgcccttctcttattaatatttatccaagttttaatctagcgagtgttttttatagaccatgaggatgaaactgctagtagaatagttaaactcaaacctattggagagataaggatttcttatgcagggcctgtttagtagggtccaactcctaaatttagctaaaggagttgggtctggagtggaattgtggagctgcctaaatccagctccacctctctagatcatttcgtgagagagctccacccagcttcactcttattttaggtggagctgaaactgtttggttgagcttcagatccaggagaagtggagctggggtacc

SEQ ID NO: 99295 - DNA, 582 bp, Oryza sativa
atgacatcaaagcgaataggctcttaatgtatattggcaagatcttgactcggagcaattgccagatcgcagaaggtgacccactatttcatataaatgtactaggtgcagactgcagaccaaatgtgtgacacaatagatgtagtgaattctcagttaaataggatgaaaccactgttcaacgatgaaatttctgcgcaaaacataggtattactctcctgtggtgatattgttacagtattgatttcatacatgcacaacctgtgacgatccatggacctgaagatgaaacaagatttggaaaagcagtttcgtgcacgtacaaaaatgactctacactgaattaggacctgtttgtttcggcttaatattattgtaacgtagattgttgagttagattactgtaagctgaattataataagccaacatatatagaataagctataagctgtttgtttctctggattataagctgtttgttagctgttagcaacccaataaactaaaaaaagaacatttagagtagattactagattaaagtaatctggcttatagattataataatccatcataatagg

SEQ ID NO: 99296 - DNA, 553 bp, Oryza sativa
ttcgcgctgattttattattgactcccgtcaagcaattaacctgtgctctttctaattactgacaacgtgtttctataggactgctagtgttaattcctatgtaattcctttgcatcacaaattcttatatattccggataaaactacatgaacatcagaaatgatgcggaggagtgagtcaaggagctttttttcgaagttccaagctccaaaagccttttctcctttctcaaatttattaccagaaacaaaaaaaaaaaaggagacaacgaattaataagcagcaaatgaagcttgaggagcaagttaaatatagatcactaacccagttgtttgtgcgagggtgatgacggtgagactccagaagtccttctcgagcatggagacgaagccaccgaggaggatgaaggtagtccacaaaaccaccaggaagcccatccctctgatggccatggacaagtaccccataaatagggcataactattgatcatcaccacttccacccattgagagtcatcatcgacattgtcagccattgtgtatcacttctt

SEQ ID NO: 99297 - DNA, 694 bp, Oryza sativa
  unsure (1)..(694): unsure at all n locations
cttgatagacancttgctcccaaccttcaacaacaacaacatttatgttagcatacttagaacaggataaatattatgtgccttccatcacatttcaaatatctatatataaactaataatataaagatacaattctattattgacaatggttttgacttttgataatgcccttctgataggatatgtgtaatttttccaaatttactaatttaaacaaataaagaaattgtgtacaaaataacctcatgccagtaaagagacccatgctgggctcccatatggcaaccaagcaattaaggcaaatcgattacactttcaatatttgagcttctacacatgaggcatcaaaatgtctggtatcatgcttcagattcctcgtgctagttcttttcaccgaactagagatttctcatgccaattcacaattgaattcccatctggttgtctgttcaggcaggtaacaagacattccccacttttatgctacaacaagggcctcatcctatatacctatacaaatcatcctcactaatatgaatttgctgccatgaggtgcagccacgtcacttaaattgtttcaaccgttagatgagcatctatcaacaatagcaaccggtagatcaaaagatcaaaagctcagatagcatactggtacatgttcatttatttgggccattccaaccgcgccgttc

SEQ ID NO: 99298 - DNA, 653 bp, Oryza sativa
aaaatattccgaactgggggggcatgtgttaacaaccaaatttggtaatatcgacatcgggaaagaagattagatcgaagtgaagtcaaaggcggagatcgaattcaagaatagagcaggaatcggctggagtccagatcggctacgattaggattggctgggtctgagtcggactaggtaagccgatgcggccgattccgacaatacaacttggtgtatgacatcgggttcaattgaggtgcttcaagatgattgccgcacatgcatagagtccagagaaggcaattgtatctattaattatgatattttatgtaattccttagagatatgcttgggcaaaagtctgccgcaaagacttatggtatcttagagtttgttagagataatagtcgtgtccggtatggacatatcttgtaattctcgagtataaatagacccgagccctatgtaatttggaatctacacacgttcaatacaatctcggcgcatcgccacctttttgctttagttttatttcgacgagttcttgctttcggcttgacctgcaccggtttcgatcttcaacaagaggtaaaacttgttatgatggattgtgttctcgggattagtgctttcatctttacgacactctaatcttgtctatgtaattcg

SEQ ID NO: 99299 - DNA, 560 bp, Oryza sativa
cgagacacaaagcaaagtggaggggcttgacgacaacagggttagaagcaagcttttctaatatctgtgtggtgttagatattatacttccgggtatatcatcatgttccaaacaagatcatgtgtaatacgtataactattcattattagatgtttgcttcacaatactctatatggctaaataaagttagtacttcctccaacttcttattatttgtggactaaggtgagattgtctttatagacaccgttcaatataaaaattgaccacccacaaatgataataggaattaaacttaagtcttccggtccaaaagcaacactccaagccaacggaatatagtactatgtcaatgtaacacatcaatttatttaacatagatataatagaaaaatagacacatatatcctccattctataaaaaatcaatatgggacggagagagtaattaataacctattggtaggtaagattacgtctaaagcggtactagtaaatatggaaacaaaatttaaacttatgatcatactcgctccgtcccaaaaaaacaaaaccaat

SEQ ID NO: 99300 - DNA, 559 bp, Oryza sativa
agtgcttaggatgcttagccatgctgtggacccccgtttttataacaggagtcaatcgtgtaaacagtaccatttccctggatcagatctggtacgcacgaattcatagctggaataccaagtgcacatacacgagtgtctaattcgaattattacatcataagcccgcaggcatagtcttaaatcatcggaccgagcggtccggaatacatccaaaagcagaaatagataaggcagcggaattcaggcagcggcatgccattgccacaggcaacgaccgtactaagacctactgagtgccatcgtcttcatctccctcctggtagtaggtatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaagcaagttttgtaattattttcacaagcctaagacctagcatagactgatcaagttttattaccagtgttcatatttaacaatga

SEQ ID NO: 99301 - DNA, 624 bp, Oryza sativa
ataaaataaataataattctattttttttaataagatgaatgattaaacaattcaagtgaaatgttaaatttgttatattagaggacggatggactactccctccgtcaaaaaagacaaaccacgagtttccgtgtccaactttgactgtccgtcttatatgaaatttttttataattcgtattttcattgttgttagatgataaaacatgattaatattttatgtgtgacttatctttttaatttttttcataatttttttaaataagatgaacggtcaaacgttaagcacggaaaccagggtttgtcttttttcctttttttttttttttttttcggagggagtagttacgaaggggcacagggaaatcatcaaagatggggaaattgtactcgtagctctgtaagggctggatcacgagctgcataggaatgtggtggtactagcgcaaaagcagggatggtagtggggtgcaacgtgcacggctgcacgcaccaaaaaaatgtgtacgcacatcacctcaccagcgtactgtatggagtacagtaacagcacgcaagcacacgcacacggagacacgagtcgcagagataggcttttggcgggaaggggtaccgagctcg

SEQ ID NO: 99302 - DNA, 593 bp, Oryza sativa
tcaccgcctgcacgcgccgcgcgccgctggccgcagcgctagtcgccttctctccctcggtgcgcgcgtggggcacggctcggcggcttgtggatggcgcagcgggatccgttggcctttaccggccttttcgccgggcgagccggatcggtgtttgcctggcctgcacggccgcaccacacccggtgcgtgtgcgtgttccacgcgcatctgtcgttctggcgtagcggcgcgccgacacgcaggcacgcggttggtgtggtaagcgagagtactccgtgttttggcatgaatccaaacaggtctatctggatacctgacgtcagatagcgctggccttctttgtgtttcttctccaccaaagaacatgctggtttcggaaagagcgcgcactaccagatgagtactttcccttctcaccaaggatctgtatgcctgcgtgtgagttggagcgtgaaggcacggccaaattagggcatgtttagatccatttggaatggcaaatgacaaatgacaaaagttttgatggcaaaagttttagcattgcaaaagtactagttggtgtttagatgcatgttaagggtaccgagctc

SEQ ID NO: 99303 - DNA, 554 bp, Oryza sativa
tatttcttgatttctagtagtagtttatacttcatcaaaagaaaaattaacctaaaaagaaatataacctcctatagtataataaatctagacaaacctctatttaaatttgttgtactatgtgaggtcaaattttcttttatattggtttttttgaacgggggagtatgtactatttgaaaattataaatcgttgcaaggcatctgtctccaaccaagtggtcgatcgatcatagaaccaacctactccaattatctatccaatgatccgtacgttaagtttgaccttctgggatgagccgatgtgtgcacctgtcgaagtttgggcgcgtccgacttttgcatggctacacgctgtggcaacatcaggaattcaggatcgtcccagtacctctcactgtcccagtgatactcagaccctgtttagatcacaccaaacttgctttaaacttcccaaacttttcaaatcacatacatcacatccaaaactttcctattcacgtaaactcctaacttttttttcaaagtaccaactttttccaaacttctcctca

SEQ ID NO: 99304 - DNA, 571 bp, Oryza sativa
ctacttctacctcaccatgtcacttttggcccatagaagacaagagatcaagttatacacgttttggattcggattcaggcctcctgatagcatcaacttcaaacggacctagccgctgttctagaaggaatttcagggcccatgagtacttgttggaaagcttatggagtctactttctgatggatttggttccacatcaaaattcctactaagttgccgggaaactgcaaaacaagccacgtatctcatccagtccgaatctgatttgtgttttgggccttgtaattgtgtcgtgggcttagctcaagggggtgtgcgccctagggcaaccctaggacatccttaatcatatttattcagtagccgtcaccatttagagtcgggttttgcttagattattctgtcaagaacagtttcgccgctagatcggtttgtggaaccccaaattcgagtgcttaatcattcatatgcaatttggttgcaatctatcttattctcgcttgtgttcttcgattcgcatgcagggattagccttctcggtgaggtcaaccgggtttcggcacggttga

SEQ ID NO: 99305 - DNA, 908 bp, Oryza sativa
  unsure (1)..(908): unsure at all n locations
tcacctccagtggggctgccgggtgaaaactcagcctcgactttatttgagaccttgacggacgacggtggctgtgtatccgtcgctcctctccttggagacaccgtctaggtagccccttgccgaatccttccagacaactggtgcaagcttgctctagatgcatgtccccttcgtcggcgctctagcttatgcaaggtagccacgtcggagggcctaggggggagaacggttccatccttctctctcataatcccaaagaggtggctagagtggggcctggtgtcggttattagggttaagttttgaacgttctcggatgtagtttctttgttggcttagcggtgaccggtcacgcatagcggcggtcggttcggtgctagctttctcctaggtatgttgagttggagctatcggtgcgtgggtgggggttatttttcattttttttcctggttacgacttcccagggttataatcttggattttttttcctgctcaatcaaaaaaacttcgcactgtctggtgcgagtcattaaaaaaaaaaactctggattcaccagtgcggcagtgctacaaactgatcaataacattcgtcagacatatctctgttttacataaattaagcaacattaatctctgcacaacattgagaaacagccatctttaatttatttcacataaatagaacaacattaacttctctctttttttttcatacattaagcatgctcatctttatcaagaactaagctgtatcgatttattcaaagcgacagtagtactagtagtagtagcagcagcgacgtggtacaatatattccaccaaaagaacgctgctactacgcaatagcctaacgtgtgcctgacttctaagacaaggttgcgggtncgagatgctaacatcag

SEQ ID NO: 99306 - DNA, 618 bp, Oryza sativa
tctgtttgatgaatgaagccatacttcacattttagatcttcaagtgaatttcatttggggcttgctattgccttctgttgttttggttacaccacaaatttcagcatacattacttgtaaattagtggttatggaggacctgaaagaaaatcaataatggttgctgtgggcacaaagtttacaatgtcctggagctgtcatattaattcagtactaacccaactgattgctcctcgcttttgactgtcctgtggctgtgatgccacgggtgattggtgactgttccatccaggccatgcctattttagcttgatttacaggtcctggattgcttatttgctgtacagggttggatcactttggctggaccggcaaaaggaacatgcgtgttgccgggctaaagtgtcagacaccacatattgtatcagttctaggcctttccaacaggcaactccaatggccgtactctgtacaggtttgatagaacagtgaattgaaaagtgcctgttacaggtaggacgtgtgaatttaccttgtagtaaaggtggtgaactttttatgcgatctttaatacagaaaagaaaaaatgtgggaataggtatggttgatattgtttt

SEQ ID NO: 99307 - DNA, 757 bp, Oryza sativa
  unsure (1)..(757): unsure at all n locations
cggccgcgtgaattgcaattcgagctcggtacccnnnnnnnnnnnnnnnnnnnnnnnnnnnnnnagtgtgtaacgatcacacattggaactggcacatattggaactgtccccaatgtgttgttttgcagtagtgtttgcttcttttcttcttaaaaaattttgtctgccatgcatcttcagttagcttggcgaaaggaaaataaaaatacaacgtaaaatcgacattgatttagttttgtttagcaaatccaaaaaaaaaaatctaacttggtcatagtggatcaaggacatgccagactttaggactcgttcttttactcaactttccgcttcaacatcttcattttccccatttttcattagcacgtttttaaactattaaaggtatgtctaaaaatgattatatatatagaagttgtttaaaaaacaaataaatttattattaaaaattgttatatgaattttcacatctcgcgtgcgctcgaaattcctctccacatggagcgaacgaacgagctcaaaagaaaatgaaacgccagaaatgaagccccattgttatatccagatctaggtgtgtttaggtcacaccgaagtttagaaagttggttgaaattggtacgatgtgatagaaaagttgtgtatataaaaggttttgatgtgatgggtaagttgaagtttgaaaaagaaaactttacacactaaacaagggggccagagaaatttcccctttggtgttaaaaaaaatttgggggggg

SEQ ID NO: 99308 - DNA, 747 bp, Oryza sativa
  unsure (1)..(747): unsure at all n locations
cgatgagttgaaatctagctcggtacccgttcagaccactgctgtcgctgaaagcaaccattgaagtgttcgattcaaccgatcaaattccgttgatcgctgttgtgctccaccttgtgtccatgtccatcatttgacatcctaagtagttgttgcggtgtaaaccacttccctcatatctctaccatgaatctccggcaaattctgataccacttgttataaaaccagcttgaaatcaccatcaataactaaacgtgaatgaaactccatagaagatccacactggtgacaacactgaggaacgatatttgataatggagtccaaccatagcttatatctctgggacactgattacggacggtcctccttgatccagcatatttatatatcgtatcagagttacaacaacccttggcaagacaccgcttgcatccgttctctctcgcctaagttaagtcaccatgtggttacaacatatacgcatctctatttaagaaagagcctaagacaaagtccaactctatctctaccatacacctattaaaactctaagtcctaaataataaccaactttatacacatattcggcataaactctaatagaaagcaggggatantaaatactagaatgttttgaagccaaggacacctattagaagaagaaggggagtccgagatagatcgccgagggtgcccaagccctttggcccccacacacccccaaaagggggggaaaattttgtgg

SEQ ID NO: 99309 - DNA, 753 bp, Oryza sativa
  unsure (1)..(753): unsure at all n locations
ggggcagagtganattcgagctcggtaccctatattaaactcagtaatattaaattgcctgacgtgaacgtacccatcagtgcaaaaatttggggtcacaggaaagactatgtaaaataaaattgcaatggcgcgcgaggaaacaagacagagcggcaatatttttggtatttcgcgcgcattgaatttcaggaaaattaaccctgacggacacacgctaggcaaatttatttttccccgacaagctagttctgacggtaacacgtcaggtcctattttcctgacggaattttctttatctctgacgggatttggccgtcagaaagaatacagtttctggtagtgatgtggtatcactttatctgtattatttaaacattttacagtattacaaaagaatatagtggtaaatgtacaatgttgaagacggtgaataagctaatatattttatattttaaaacggaaggacctgacctgcaggaaaaataaaaacgtaaacatacctcatgttcattagtcactcattatggttgatctgttcttatggcctcgaaacaagtaaaaatgtcgacaaaacatgccattttcagacgtgtactgtaatgatatgaacagttggtcatgaaaaatttaaattcaaaatacgttgcacaaaatattattaaaaaatacaaattcatttataatcagtgttttttagaaaaaaaggtaagcccttttaccccagggggttgggggccccaaaattttgg

SEQ ID NO: 99310 - DNA, 664 bp, Oryza sativa
aataatgagatttagagagatgcaaaattcagggggagaatttcgctgactcattccagaattttgatatagaaaataaaatacccaaaattccatctagaaaaattgaacgaagaattgagtgcattatactcttttttccgttagataagttttcccagtagtttattataagatttttaatgaggcaattcatgcgacattgcaagcatatgctatgtactctttctccaaattttttccactgggtttttcttttctccaaattatacagtcagagcccaagggggagtgtttggaaaccgctggcctacgtaagcccggcctggctattcactaattgtgtccatcactaaacatagaaggtggaagagggagctataaatagagaggagtgacaaattatgctataaatcaaaatttaaaatcttactgatttattgatcatgtacggctaggttcacgcattaagcactactacagcgccaatttttccatgcgggatagccaatttctgcgtgcgggtgggcgggccgcatgcacccagtcgtctgggaaaaacgtgattttcgcatgcgggtggcgcgcctgcacgcgaaaaccaattttcgcgtgcgggcgcttaaaccgcctgcgcggagaaaaaaaaagaaacccaaaaaaa

SEQ ID NO: 99311 - DNA, 691 bp, Oryza sativa
ctttgaatcgtaggaatgaaaaaacagaggattctggcaggaatacaattgtaaaacagaggattgtgaaacacaggaaaaacacaggaatgaccatttgattggaccagaggaaaaacgcaggaatcagatgagagagatagactcagaggaaattttccaagaggttagacctcttgctaactttcctccaaaatatacataggattacccattccataggaattttaaaggattggatatgattcaatcctttgtttcaaagcccttcataggattttttttccataggattgaaatcctccaaaattcctacatttttcctacaaatcaaaggggccctaaacctacaagagaacaaagactgtaaaaatgtattgaaattcacattctaacaatggaaaattaatggatatgttcatcccattggccagatgtaacgaatcttacatatatccttgaaaaatggaataaatcaaatacccactcactttgtctagaaattgaacccccatgactaattatgcccgattgtgttggttcattgatgcttctggtcaactgagtggagaaatcaacaaatcagttttcacagttaaaaaagaataacacaatgcaagcatacaaataggtatacaagagtttgcaactttatttaactataatctacattctgcaatttctaccaaaa

SEQ ID NO: 99312 - DNA, 949 bp, Oryza sativa
atacaccggtgcaaagcgaagcctctgcagccccgggcgccgatggtggacgcgtggataaaaaagagatcgaacggcgagcacgatttgcggacgcgctgcggcgatcgctccctcgccctctcacctcaatcggaccggaatcacctctcgccgacgccgtcgacgatagtgatggtaggacgaggaggcctgaagaagaacagatcgacctgccgggcttctgccttcgtctcatcaggtgccggctggtttcacctgcgctgcgcatgacgacaaggagcaatggatttactgaattttcattgatgatattagttgcgaccatggatttattagttacgttaatacggagattgtgacttattaacatgtaaaaacttgactttgtggcgaccagttcttgagttgctcttaattatcctcatcttttccttgcctgaactcaccttgtgagttgctacttgttcttattaaatttcttcaaaaattcagattatacaatattccgtattttattcactcacgtaattagataaacaatcacagtttttgtaacacatccatcagattgaatatttcagaacaaccaaaaacgctcatatgtattccagatagaaaaatacagtctacagattacaaagggataactcagtattcttgcaatttgaacaaaaaaaaaaggctgttcaggttacaatctggacgactggactacaatccttgcaacaatttagggattatttcatattacaaaggagtgaaggactacaattttttcaacaccatcctctttttccaaatttacagtcctttcaggtatagcgattttccctcttctgtatatattctgcagagaagatagagaaccaccatcataaagataaatcgaaatgagaaatgcataagttctgctgttatcgggaacaccagaatcaggaataagaat

SEQ ID NO: 99313 - DNA, 697 bp, Oryza sativa
gcgggacgactctagaggatccccatcagtgctagtaagaagatggacctctcagatcgtaccgcattcctttgtccgttatactacatgaatctgtgactgatgctggcatgccaattgacctggacatagttataagaggaccttcatagttatgtatagcatgtgatcaactctctcatgacctcccatctcaattataatggagttttccactaagctgggaccaacggtggatacaggaaatttttagagccgaataaaactacctaccttgaatatttactttaaaagaatgtcttcaaattgctgcactaacatcgaaattttattatgtgtttgcctaccagcctaggcagctgccggagttgtcaggtctattagaacaggtgtcgaatatattagttctaacaggttacagttcgatttataattattatcgatgacacgggtagggttagagttgaccttcataacgcggcaacccttaaaactgagagagaggtgccataatgtaaccatggtacttccatgtagctgacggttgaggccaacgacttggattaaattgcatggtgtgtgctataagctaggttcaacatcgaagacgtggaatcaaccctcacggagcttcataataaatgctcttgctaggctctcataggaaaaaaaaaatctccgaccctttatgccctgg

SEQ ID NO: 99314 - DNA, 660 bp, Oryza sativa
ggcgaattcgagctcggtacccaatcaagtaaagtatttaacaaaattttaaaagcctagaagagaagatctaattttaaataataaattgcaatataaaagtgggctagataaaattttgataaatactttacttgattctatagtttctagatttttctgggatttatttgagccaaggaagtattttttaataaatggaattgcatttcatgaataatttaaattgaaaaagttttaaaaatcctccttttggctttgggccgaaagtcggcccaaaaaccactcctatgtggccacagcaggggcatcatcgccatttcgcatcatcaacgacgtcttcaaacggacaaagcgacggtaggggcatttctaacaaactgggcaatttggatggtacttttctactcgagctcattgcgatggtattttccaacaccaggaactttgcgatggtacgtaccaaatttgctcttcttttcggcattacctttctaggatgtggtaagtagggataagtatagggtggggagatcaataactttcaaatgacaaaaactgtagcttttttcataactatactgactttatgggatgtgggacgtacggataagcggataagcggagggtggagagataaattgaagtaactttgaaatg

SEQ ID NO: 99315 - DNA, 523 bp, Oryza sativa
agctcggtacccccgagctcccaagttccaggcgatggggcagcagcacggagagaggagaggacgacgggtggcagtgccagaagtggctacgacgggtggcggcgccagatgcggtgatttggcaatgacgcataggaaggataggaagaagggcggtggcgccaccagatgctagtgccaaatactgatgctcccgcccgagagagagagagagcgaagagagaagaagaagagagagagaggatgaggaaatgagtggtcggttcgccttgtgttggtcgcttgataatgagcattttcgtacttttttcattgattggttttgctaaaacaaacacaataattttatccccatccaaaataaaatctgatagttaatatatttgggtgttttaaaaatattcgatattgctaaaaaaatggttaagatatctgatgtggctttgagatgcgtgttgattggtatcttttaaatgatcggtttcattaaaataacccgtttatttaggaccatccaatg

SEQ ID NO: 99316 - DNA, 535 bp, Oryza sativa
gtcactgcaactaacatgattgtagtcgtttattataagaattagtacattcgatgttggatggaaagaagtacattcggaagaggcatccgatcccgaacgattatcatcagcatattgcaaattttagatcaatgaacagggaaaagcattcgatttcaaaaacgcgcgcacacacaaacacaaaagaattcaccctaactctgtcttcattctctcgagcctctgtcatcatgttgccaattctcttttggtaaagcgaaaagagaataaagatagagagaataattactccatccatttcacaatgtaagtcattctagcatttctcaccttcatattgatgtaagattcattaacatcaatatgaatgtaggaaatgctagaatgacttacattgtgaaacggagaaagtaacatctacagctaccattgtgatttgtttcttcatcggcgcagcatgcatcactgtaagaatttttttggaggtgttcaatgatatctcaaaactttatactccctccgtttcaaaatg

SEQ ID NO: 99317 - DNA, 632 bp, Oryza sativa
tgcccccccccccccccccttttatcatatggttttcaagaaagaatttaatatatttttagaaaggaaaaaaatactaacaaaagaagaaaaatctgctcagacatattcatgtgtataaactttatacacataaaatctatgtgtataaacattcaatgcagcaaaattctgtatgaaatatttgaatccaattgtcagacatttaaaatttggtctataaactttatgtgtataaactttgggtgtatgaactttgattgtataaacttggtctataaactttgattgtataaactttagctgtacaaacattccaaattaggaaagcatgtagagaaaaaaaagtggtgcccagaaagaaagggcaacctcctcgcgctgatacatgagcatgggctcgctgaattcgggctttcctgcctctggtagccaccaaataacaaagagaaaaccaatgtatgtctagagtttattaaaagggattgtttagattccttgggtggcaatcctatagttctaataactccccttttaattagtcaaaatatagtctctttcatatggataaaagttcaaacaacaaattccagacctaaatatgacaaacattttcaattcctaaaacttta

SEQ ID NO: 99318 - DNA, 726 bp, Oryza sativa
gggtttgggctgtttctccttgtctattaggagttgggcgagattcttctttccttccacgctgttattaacagaagattgtaattggttgcccttaatttcgttcagtgctttgagggcaccttcgtacaggctgcgtagcttaaggcctggtagcatgcttgggcgcaccacgacgaggaacaccatgtaattcgacagtgccttgatcgcccgtacatgccgcaacgatgatgcatattcaccactgatcaagaggaagatgtctgtggtgatgtgcaagataaggatggtctcttggaatgcaggtgcaaagtccagagcctcttctagttcccgatgcattgctgcttgcggtttcgccaacaccgccgctacttgttctggtaattccaatgcgggcaccatgggcggctgcttgtcaggaataataggcgggtacgctgacttgagacatttccatatactttcgaacataaggatcctaacatctgatgactgatagcataacatatgaaagcccaacgagttgttgtatctgtactcatccaacggtcattcagtgaaactaattacaacactgatttccacatcttcaacttccatgttatgtcacgagtgcactcgtcaaacaagttgtattgcccaatgattcctagccacctcctatagctagttgttggatgatccttggaaaagaacctccacggatccagggagacgatg

SEQ ID NO: 99319 - DNA, 1614 bp, Oryza sativa
atgatgattttaagtgcacaagctaccctaatctgttcagtgtgactttgtataagaatgattcagttaggaccatgtgcctacggcaatggaggactcttttgttcttcccctctcagatgatgcatgtggagaatttttgcaactgcgagatcgagcaattgaatcatttgcagcttcaggcaagaagtgatgtttggagttttatttggggaacaggtatatacacagccaagagattttacaatctcaattactcttctttgcaacttcctaggcccatgatttggctgtggaaaaccaaatgtgtcatgaagataaaggtgtttgcatggcttctgttctgtgatagacttaacacaagggatatgcttgacagaaggcattgtgcaaaagaagatgatgatctcacatgtgctttatgcaatacacaccaccagacttcatgtcttcttcacatgtcctttcagtgtggcttgttggcagcagctagtcattcattgggattgtaatttggaattctttcagatgattgttttggcaagaatcaggtttgcacaaaggggtttccttgaggttttctttctggcggtatggcatatttggaagcaaagaaatgggctaatttttcagaatattcggccttcattccaatcatggaagtctttgtttatgaaagaagttcttctgcatatgtgcagaatgaaagatcctctcaagcaatctctttttgattggttacaaactttataggattgttgtttttgcagtttttatttatccctttgtaactttgtacatattttttgatctataaaatttaaaactgctgggcaaagccctggcagtacttccagtcaaaaaaaaaatgtcattgtggttatagacccatgcactttgcaagtttgcatgtcatctaaatataaatcaaatacttaaaaattttgacaacgtgttgtgttattataggtcaatcttcaaacgtgtcaccgttggttccaatgacaggggcacataggtttcatgtgtttgcttacaccgtggtcccgggctcactatctggaaaataaagaactaactcaaatattaatagcacaaaccacaacataaaaaaacatctagtgtctttacgggcggtttcaagtttgaagcacacgtaagatagcagcctcgcgcgtcgtccctcccccacgaaagacccgggaggcgacgccctcaccggtacccgtctcccattacctcctcctctgcctcgccgccgcccgagcggccgtgcggccagaaggacagcggcggcggggcttcgtcctcgcgctcggccgggggggggggggggcggcggtttgggggctgctcggggcaggggaaccgcccgggcagatctagcggtgggtcagccggcggcggggctgagcggtggggcggcgacgacgtctggtggtggtggcggcggcgtttcgaggtactggtggcggcggaggaaaccgctagatccgagcctggatctggcaggatggcgacggcggcggggttggcgaggggatggcgacggtgaggcgaacccggccgcgccggcggcggagttatggaccccccggtggtcgtggcggtggt

SEQ ID NO: 99320 - DNA, 2306 bp, Oryza sativa
cgcagtcatcgttggcgacaccacctggcggcagcagcggctggaagtgtggctgcagcgacggcaaccgggacgcaaggccggtggctgcgtaggctggcgatgcacggacaaaggcggcatgtggtgacatgcggcgggcggtggtggcgtgcggaggctggtcggcggggggcgccggtgcggtggtgcccacgcgctagcggaggttaagttggtggtggagcatcggtgcgtcaatgataggcaggcggaggatggcgggtgaaaacctagcccagccgaggccgggctggcaacgatggcactcaatcgtcattccccctactgagggtgttgtcgtgctgtctcaccccatctagtggtgactgccgggtgaaaaccctgtcaaggtttcttcagaccttgacggacagcggcggcgatgctactgtcacttctctccatggagacgccgtctaggcagcacccttgccaaaacctcccaaacatcggttgcaagcttgttctagagttatttcctcttgtatcggcgtcctagtttatacaagttggctatgtcgaagggtctaggggggagagcggttctattcttttctctcaccctctctccctaaatccctaagatgtggatagagtgtgtttttgtgtcggttgtaagggttgggttttgggcgatcctagctgtagttcctttgttggcttagcggtggtcggccaagcttagaggcagccggtccggtgctagtcttctcctgggattgtgtttggcgttgtgagtgtgtgggtggtggtattcttttttccttttcctggttacgatgtcccaagattgtaatcttgtaatttttttctattgtatcaatatgaacttcacactgtctagttcaaaaaaaaatcttgtgtctttaggtagaccaaacaatccaattagtctgtgatttttttaaaatatgctcaaaaaataaaagcaaggccaatgaatcagggaagcattcaaaaaaatcacatcccaaaagtaatgatgcatctttagttatacttagaaaaaaaagtccgggcattgcaacaggtgaaggctattttattttaatcttattattgtccactctgaaattcattgtgggaattcgatgttatatggtttagttaagctgaaattcactatgcgaatttgcttggatatataaatttttagaaaatcatgagctgcagttaggagtccgttcgtatcaagttagcatgcaagtttttttacagagatttcttatatgactccttctgaattttcaaaagtgaaccaacttaaaacctgacttaaatacggatctgtattttcaaaagcaaacaaactaaaaaccgactcatacacggatgacgtacaaaattaacggtaaaaacattttatagtagtagagagttgccaaacttaaaaaccgagtcatatacggattacgtacaaaattaccggtaaaagcattttatagtagtagagagttgccatctgtgttctcgctgagctccttgaatcgatcccaaaggggtgtctcctacattgtgcagtacaattgaactgaccatgaatttagccctcacatcccacagccaatccattcattaataaacaacgaaatcttagctgcttatataaaaggtgattacttttttaaaaaagttggcacctcaggtgtaacatctttatttatcatctcacgtcatttgaacttaaaaaaaaatacttgcataaaatctataactaatataaatattcctatttttccggtcgtcacatctaattttcgtcaatacacaatccgattcggtaagcaatagccatggaaaaaattgcaaaaaaaaaaaaaatcggcggccggcgccgacgccgcctccacgccatccgggccgccgcccctcccgctccgccgggaccgccgccgccgcacctccccaggggagggcgtcgccggccctcccgccgctgccaccgccgccgctcgctgggggggggggcgcaccgccgccgctcggtgcgggggaggcaccaccgccgccgctcgcggggaggcaccgccgccgccgctcgcggggaggagggcgccgccgctcactgtgggggaaggcggcgccagcgccacaccccgccatcgtcgcgctgtgccggctagaagggagggacggcgtcggtggcgggggagtcggccggctgggggaagggagagacgccggtggggagagggagagggagagagggaggggcggtcggctcggctcggctggggggagggggtgaggggagggtgaggggg

SEQ ID NO: 99321 - DNA, 672 bp, Oryza sativa
catcaagtaaaatttaaaatacttcttggtgtcttttaaattaaaaagccgtgattgcaacccggttcatcattacgacccatatgttatgaaccgtcacagataacatcatagatctgtgacaggtgttcacatgtcatacatgagtttttttttatcactgaccaataatcactaaggaggcttatacccatcaagaatattactacctcccccccaaaataattgtaattctatattggttagcatatattaaaggttgaaaagaaatactatggtgcccctcattaaaaggggtttatgtgaaaatggaaagatggctgagggtaaaatagggagaaatttaaaatgagaaatgattggtgggggtaattagtactctagaataacaataattttgggatgaattttcaatcctagaaatataattatttggggacggaggtagtactattcataattgatgaagagttctgttggagtgtaaatgccaacctacaacttaaaccacattttaaaacgatgaatattttttttgcaattatagaaagaaaatctccgaagggtggatcggactctcgctgttccaaaataatttttttatatgaatcgggctaatattttaaaaatcactttgaaaccttttggaaaaaccctccttgttttcaaaac

SEQ ID NO: 99322 - DNA, 742 bp, Oryza sativa
taagtgctacagtaaccacatgtgctaatgccgaattaattagactcaaaagatttgtctcgcggtttccagccgagttatgaaattagttttttcatttgtgtccgaaaacccttccgacatccgatcaaacatccaatgtgacatccaaaaattttcttttcgcgaactaaaccagttcccaactttttctttaaactcctaaccttttcatcacatcaaaacttttctacatacacaaactttcaacttttccgacacatcgttccaatttcaatcaaacttccaattttagcgtgaactaaacacacccatatataagcagagcaacaagtgtgagaatgctactggtagcagtgtacgtaatgtggtcgggctgtacgttttttgtaggcacaattaagacggtgacgctgcaatgctgtgatgagtgtagacatggtggactaattgtcggatcttgtacgaactggtgccccagactttgtgttaaacgaaaaattacagacgataaatatttccgttacgatatttggttggtcttttgacactaggtaagttggagctgtacgcatgtaccaaacaagccctacatatgctatatggatgccaaattcctatagtgaattgagtgtgtagctatgttactcagtgttttataaaaatgtaatactacctctctactaaaaattaataagtttatatttaggctacttttgtactaaatgatgaactacttgca

SEQ ID NO: 99323 - DNA, 1102 bp, Oryza sativa
tagaaaaatatagtagtattttgaacacaatataaacatattattaaaatatatttagtgttagatttaataaaactaacttgatattttatatgtcgttaaaagtttactataagtttggtcaaacttaacaaagtttgactagaaaaaaaatcaaatggggagtatttaataaaaaacacaaggatgacatgcacctctactatattaaataaaaaattttggtggaaaggataaatagaacaatcaagcatatgttaactactactccctccgtactcgtaaagaaagtcatctaggataatatttaactcaaaccttgagaataaaaatcatgaataactgtcaagttgttcaatttgaaaatgtaaaaattatatgaatagatttgtcttcaaaaatactttcataaaagtatacatatatcacttttcaataaatatttttatagaaacaaggagtcaaagttatattttggagatcgcgtcgctgtccaaaacgacctttacggtacggagggagtatgaacattgccactgtggagatatcgatatcatatagtcaaatatttgcttttccttttggattgggcagcattgtaagcttggtatgcatcaggaacatccaccttcaccatggaaaaagagcctgtaagaaataagtaccctgcattagcacgatttgagatatttgggattgatcttgcaaacatgtatagtcgagcaacttgctagtacaaggtcttcttgatggcccaggaaatatgaggtgatttcttgcagctagatttcgactgcaagctgcaaaatcaaaaatactttatgcaaaatttttaggtggtggcagtgggctggcgcacttgacgaagagtgaagattttttttctttttcttttgactgattaaccgttgtttacgtggagggaagatcgctaatcttgtactattatatagtaaaaattatgttaaactttcttcaaacgctcctaagtcaccatacatgacactcctacaaacactctaaagccacgatgtgacactctaataaattatagaaattataataaaaaataaaaatatctaaccgtcaattttcatttaaa

SEQ ID NO: 99324 - DNA, 601 bp, Oryza sativa
ccgaacccctagatgcgccgttcggccccaaacttcacaggccggcagttaccgacttgccacgacagtttctaccgactttacttgaataaccgtcatctgctggacacatggcactaggaggataaagatgctcattggatgcttggaggatctccactctctcaagtcacctccacactataatacccttctcctctccctcattcacacacaccaaagcacgagctgaattacaagaggctctagtgtactttattgtatattagaatagggagagagaaaggtagaaggaatcggaggaatcccggagttgtctgttatctcctcttacttttgtatcttgttaattactctgctttaatagaaacattattctgagcaattaaggtttgcttagtgagaattacttcttggttagttaattgcgtagacgcggtgtctgggtaattaatctccagtggttgctgcatatcctacagtacgtttgaggtgggtatagaggtggtgacagccctcaagagcacttaagtcctccctgtccgggtacatagtagagcgacatctgggaacagcgggttgccagtgcctaaagtattgc

SEQ ID NO: 99325 - DNA, 985 bp, Oryza sativa
ccatagcctaaaaataacagaaaaaaaatctgaatgatttgaattacccaaataattatcatccaacaaagctaaaacaaaagtctaaatacaagatctgaaacaaattccaataaatatgaattttaaaaaagaaaatataagaaattacatacacaaatacctaaagttacagttgtaagaatagtacatttaacatataactaaactaaatttctaaaaaaaatctcagtttaggatactcaatccactgtcacaaaataattcacctcagtgtcacgaagcatgtcatctcaaactttcagaatataaaattcactagaataaaccatcattgtaaaaatttcagtgactacaaatcactctataatttaaactagtgaaatctaatgcagttcaggtccttttgtactaagaaatagaacaagatttcctctgaaaatttctagatgaatagcagacacttgtcccctctaaaaaatctgaatgaacaacagattgaagaaagttatctcaaactttcaatacaataaccatcattgaaaacatcaaacaattcagtttagaaaacaatatctaagaggcatatgaatctaaaattgattttaaaagagaaaatatacgaaattacgtacacaaatacctaaagttacaactgtaagaatagtacatttaacatgtaactacagtaaatttgtaaaaagttcttagtttagcgtattccatagcctaaaaaaaacttaaatgattcaaactacccaaataattctcatccaacaaagttaaaaaaaaagtttagcaaaagatttgaacaaatcccaatccatatgcatctaaaaattgatttagaaaaatgaaaaatacacaaaattacatacacaaaaacctaaatttacagttgtaagaatggtacatttaacatgtaactacactaaatttctcatgtttagactaattgataggctcaaaaataatccaccaaata

SEQ ID NO: 99326 - DNA, 635 bp, Oryza sativa
  unsure (1)..(635): unsure at all n locations
tggcccccnnaatagatcgacttcattgacgccngcggnngactctagaggatccccgataatgaagaagcacagtgcgtggcttaagctgctcctctgtcccaagaagccggcgaggtccgcggggatcgtcgagacgtgggcgggggaccggtccaagctgctcctcgggcccaagatcgcgtcggggtccaacagccgcattcaccgcggcatgtacggggagcaaccagggcagctcgggctgggttatgcacgagtacgccgtgacgtcgccggctgacctcgccttgtcgcagctccggctgtaccgcgtcaggttcagtggccacggcaagaagcgcaagagggagccgcagtgtctggacttccacgacgacgacgacggcggggatcaagaaagcgcgactcaccggcgcgccgtggctgagaccactctgttcgacggatacgtgccttgtcctgcagccgacggcaccgaccagggcacctatggcgtgatcgaccgcgaatcttcgctggcgtcacattggcttccctatcagatcgttcccccagcaggagaaagctgatgccactgctggtgtagagaatcctttgctcgatgaggagcgcttgtcaccaccacaacccgt

SEQ ID NO: 99327 - DNA, 570 bp, Oryza sativa
ttaatgatgtgtctttttctatatgtctttctttaaatgtggctgtagggaatactacttgtataaaaaatatatactccctacgtccctaaatatttgacgccgttgactttttttaaacatgtttgaccgttcgtgttattgaaaaacttttgtgaaatatataaaactatatgtatacataaaaatatatttaacaatgaattaaatgataggaacaaaattaataattactttttttaataagatgaacggtcaaacatgttaaaaaagtcaacgccatcaaatatttagggacggagggagtatatattagacctaatattttttagttttttaactatacagaggtacgcaggcgcgggattctaactagctagctagctagtattaacgtcatcgttgattcgcccccaaggttgaattaaactagtcgacgatggagctctataaatggcagtcccgcttccacgagctattcatgcactgctcgatcgatcaactgatttgtgaagaaggaacaacacaagatctagacgtactaagctagtactctagctcgctagctag

SEQ ID NO: 99328 - DNA, 560 bp, Oryza sativa
cgaggtgagcggcggatgcgcctactttgtcatttggagaatgccggatgtgtgccacgtgtacaagtactccttccacgacgatgcggcgacgccaatggcagagctgccattcgaatggaccttcatgatcaagagaacactgtggttcctgccccagtattccagcgtagccccaactccaacccaagtaacttatactcctaactatttccttcctcccttccgcaatcccaccctaaaattttttaacatgtcacatcgaacgtttgaacacctgcatgaagtattaaatataggctaaaaaacaactaatttcacagattgcgactaatttgccagacgaatcttttaagcctaaatgctccatgatttaacaatgtcgtgtttacaatgtcatgttacagtaaacatttgccaatgacagattaattaggcttaataaattcatctcacggttttactgacggaatctgtaattaagttttttttattagtgtccgaacatcccatgcgacaccatatttaatatccgatgtgacacgccacaactttacacc

SEQ ID NO: 99329 - DNA, 568 bp, Oryza sativa
attatatatataacaaagtaaatacatctaagcacttatgttactcaatgatcaaatgatgaacttacagtcctagggttcaaagcatccagccgccgccctgcacctctatcaacagctgtcctgctagtcctctcaatatcatcaccagaatcggaaattgtagtagtcttggccccagctcccagtatcccctgtccctgtacagaacgaggggagaatagaatgaggtgaaaaaatctcacgagtgatgtgatagtataaagcagcagttacaatgctatgaacatatctatattttttcaatgggagcaatatctatcagtcttgatacgatactcaggatgacaagagcattgaatagctacatctacaaaaaaaaaaaaaaagaagttggcttgccttatttggctgctggagctggtgccttgcttacaaatattttgggttcacatgaatgctgtgggatggacgattggattgagaatcacgctttgatggtgcagcgcctgatgatccattagtagatgatctgaagccaagttccttctcaatcacttggagtgaa

SEQ ID NO: 99330 - DNA, 570 bp, Oryza sativa
  unsure (1)..(570): unsure at all n locations
cggaagtagaattgaatccgactacgagtccgagtcaggtacgctaatagtggagtaatacggagactaaaccggggtcggccagagtaatggactgtttgtaaaccaaatttgaaaaatcaagtttccttcttatgtctggctggaagatcaaagaacagcaaatcatcaattgattcatttgccagctagtactccagttgaaccatcagttatcctaattcattcccttttttctaatgttcagagtacaaaaattcatttctggtaatgagatgggatcgctgtctcccctctccgctatggcatctcatctactccgatcctccccgagcataactttgactaattaatcagagtatcatccgcaaccgaaagtaaacatgaggaagagagtcttcctcccctttctctaatttgacagaaaaaaaaagaagagaaagaagcaattagtcactaacagaatttgagcatcagtcttgtcgatcgatcagcattatctgctggtgtcgccgccgggcgccggtgatggtgacnatgaggaggaatactcccatggcgtcatgtcca

SEQ ID NO: 99331 - DNA, 573 bp, Oryza sativa
tgacgactatggcttacatgttcagactggcaattgatctggccagatatgtcatgggttatatagaagagttaacatgttcatgttgacaaatgatgcagccattaggcagttgacgatggaggtctcacttggtataacaagagagttggatgattgctgtaggcccaagcttccctgtgtagtatgctcttttggctgttgataagtcgggtactggatcgaaagctgaaaatcccagcatgcaaagaccttgttatgatccttctgaaaagttggtccttcgtactttgtggatattaggaatagttcaagctgataccacctccgtatattatagggcatttttcttttggaaatatgaatatattaatatagtttttttttagagaaaccgagagatttatattaccaaaccagtagaatcactaggtaccagccgttccagaccaggtgggcaggcgggcagcctgcccaggaagacacggtctggagattaaagccatacgcgggaagctcatgcgccaccttatcaatactagatcttggggcgcgcctttgcgcgccgcctga

SEQ ID NO: 99332 - DNA, 571 bp, Oryza sativa
ccttcctatctccatctctcaaatcactctcctctcattgacgcatgcctcattttttactcctccaagcctcctgaccttcccttgatgtttccccttctaccaacatctagctatccacgcccccttcctctcttcctccttattgcgctagctcttgagcccttgcgtgatgagcctatagatcaccgaggtctcacattctctctcgacctccttgtctcgttagttttccctactttttttcgtcattggtagtcatgctcgttgctcccaccgttgacaagcctagatctagcgagatcccactgtcgagctccaccattccttgttgcggttggttctatcacactaaagagcccttctcgtcacacgagacccatcggtggcagtgatggaggaggagatgcgtagcaatggagtgagaggaaggtgatgcgctgacctactttctcatcatcgatgccgcctcactttcatcaaccatcgtatatttttaaagtaattttcgtatatttttttttaaaaaataacacattgttttagcatttcgaaaagcgtgcacggtaaa

SEQ ID NO: 99333 - DNA, 563 bp, Oryza sativa
atctgtggtgagttttgttagggcgaatttgtggtgagttactatgaatccttgtcagtgtgatgtataaagtagatatccataaccagctattttcccttttctcaagttgttcctattatttgtctttcaaatgataaaataattggaggactcactcttttcgggaaaagagttaatttctccagtgggatcgtgttatgatgattttttttcaaaaaaatattcaccatgtttgcaggttcttttttgtgagagctgggatgatggcatggttatttatcaacctatctttgtttgcaaagagctacctagctggttcagccaatctttcagtcattctctaccaattcttttgtgcggtattggacatggacatttcttcttttgatcatcatatactccatagttcatgatactagctatgtttcttcatgcagtggtatattgcagattacttccgtcatgaagaattcatgacttcaacgtagtatatcattttgtcctataatataaagatatgttaatatcaatccagtgtgcctgaatgatcatctgaaatg

SEQ ID NO: 99334 - DNA, 570 bp, Oryza sativa
ctccggaaaaagtacacttaaaaggacttaaggttcctcagcttatcatcgagttataaaattgtccctaaccacaaaaactagatatttgacatcctccaacttacaaaaaccattcactcttggtcctcgggtggtttttaccctggtttcgttcgatatggcagctgttcactcttggtcctcgggcggtttttaccccggtttcattcgacatggcagttgagtaagcgtgagacccacatgccaggtgacacgtcgtcacctctatttcccctttctctctttactcctctctgtcttctctgtgtgggtgaggcggggcatgtcgacgaccgagctccaccgccgcacccgacgatgacgacaacgcacaggtgcgagcctggccggagaaggggcggcgggcaccagccgcagtgtcagactccgtcttcacctacgttgccgtacccgacgatgatgacgacgacacacgtgcacgaggccgggcggagaaagggcgatgggctgtggaacggcggaaggcaacagccgcggcatcagccaccgaggccttcgtggggagag

SEQ ID NO: 99335 - DNA, 607 bp, Oryza sativa
tagtagggtcacctgagctcggtaccctgacaaagaaatatgtggtcatgcactcatgcgttcgtaggttagtcaatgcatttatgtaacattagattctattgttgactttctagatcttttatatttccttctaaaatgaaatgtaaatgcatctttcatataatattgattatttagaaacccaactattacaaagtattagttttgcttgaagaagcttacattagtaagcatgttgaagttctccaaagcttgaacctacaaaacctggcctcgaacattcgtatactcagagttccactttctgtggaaaagatgtcagttaacgaccatataaatcataacggtcctagttataccctcaatacaaaatcaatgcttagtgaggttgaataacgaggttgttactacaagataatacacctgaagtgctgtcagatagttatggattgaaaacatttagatagtgcatgaaccgagttacctgaataattgacaaagcaattaaggacatatcacataagatttgttctacaatgatttctcttaattccaaatagcacatgcacataatgtagagttagcttgatccattcaagaagac

SEQ ID NO: 99336 - DNA, 610 bp, Oryza sativa
aagatgccttagttgacctcggtacccactgttgtgtccattaattgttagtttagtctaaaaccttttggttagttagagaacaaatcatgttcagtatgagtttcacactgaaattaactttggaaatgtatcattgcttaataagaggaacatgtatttattttggtaacatagtttttttcagtagtaaatagtaggtatatacctatgcaggcacaaaataagttcaggacaaccaagctaggtttcataggatatttgtgtccttgaggctaagtagcgatccaattttgaattgctgcacccaccccttgtagtatcatatttcatcatgtgcatcattatccacttcactgttcgttcctaccaagggaaatcactcagtaatgtaattagtgtggctactgtagtgatttttttttgtgtccattgtacataaaaaatgatttaagtatatgcaattttttttttactttactaacgccccatttgttttttaatttcagtggaccataaccaagagcaacagtacagacttcagtttaacaacgccaattgttataaatacgatgttggcaggtgtattgagtgcattctgggctttgtt

SEQ ID NO: 99337 - DNA, 615 bp, Oryza sativa
atatgcggtattcgagctcggtacccattaagccgccttaatttttactacataaaaatcagtaactaaacattcaataaatagacttgcatcaacgttgtcaccagataatttctgtagaattatagaattaatacataaatttcatgcttcatctattgtataaaaatcatacattggtatcgttcacttttgcatgtatgggaaagcactatattggcatacaatgccgcataggattgatcgactgtatgtgttgcttaaaaacaaaaagttgttgtgttaatttgtttagaacttaatcaaatcactattacaaaggaaaaccttaaaaataaaattctccgaacacttaaccattaatttaaggataatttattaagtgaaattgacgaggcatgatctcaaccgtatagaaataacggatggcatagatttagccaactccactcgatacatttgtacccaactctaggggatccagaccccaatatcacgatgacccctttgaatcatgttctacacattgtagttccatttactgctgattgcgacaaataagcagaatcctatattttaaatacttcttctgtgctaacttagattcaatatgca

SEQ ID NO: 99338 - DNA, 533 bp, Oryza sativa
atatttttcaacacaaaacaaacataataacaggtagaagtgaaatgattgtgttcctctaattttgtgtatttctaaatgttagtgctgtgagaaagggaaaaatacacacacgttttttttttcatatttccaaaagtgtttttttcaatcgtaggtgacataccatatgtacaagatgcgctcacgtggatagtttgataatcaaatgatttacttaactcatattagtaatctaaatgtgtattttgaaagtagaatgatatacacgacacacataaacaagttaaatgaccctccatatattttactgcataataaatgttagttttaatgaaactaattttgtgttgtagaaattgctaaacttttctataaaattgataaagttaaaagaaatttgactagtaaaataagtcaaaactgagggagtaccaacaaaaggactaaaattttcgtccttttttgctgttaaaataatttaattttttattattattcttttcaaatacatatgcattttataagaaaaa

SEQ ID NO: 99339 - DNA, 570 bp, Oryza sativa
accctttttttatctctgctttgcttccatgcatatcaaattttcatttttttattattatttcttccatgtaataactgcctttgagataagcctaaacaacatgttctagtttctttcaatatcatttttaatgggaaaggtgttatcaacaattctagttgttatcaatatagtttcgttttgcagaaactctaccaacttctcatgtatcgttttacttgattaggtggtgaggggagtggccaagaagagaaagtggacgagaaactgattcttttctccgggaatgattacatgggcctcagctcgcatcctgcaattcgccatgccgcagtgaaggtgctcctttcttgcacccatggctattgtttggtgcggaatttttttgacactttaggatttgcaccatgtttcattgaggggcaaatcctagactggcgcatgatcgatttttccttgtttgatctatggagtggactgaatcaatgcttccgtggttaactttgccaacattctggtgtatctactagacagctgaagagtacggcatgggccctagaggatctg

SEQ ID NO: 99340 - DNA, 510 bp, Oryza sativa
gcctccaagttttccgtggggtttacttcatgcaatgttttctctagtatctgaataatgtagtttctggtaaactcatcttctgtcatttatagctgcactaggaacttcaattctcaggctagtgacgttgctatctaacagttaaacaagtactgttgcgctactaaccctttcttcttttttttgcagtctggcatcgtttgtgttcttattgatgctctgattaaattggagatatattcaaactatgtacaggtgtttatgacttgtctttttttgccatgtcttaattgttagtatcactgttaggcattacacacatcatttctctttaagtaacttgaaattggtggtattgcaggcacaccttgctcctagtggttacctaaagatacccactgtgagttttctattctatattttccttttaattccatagtaccagaacctctgttcttcatttcccactcctgtttctattacccagccatctcttaggctgtgttc

SEQ ID NO: 99341 - DNA, 516 bp, Oryza sativa
ttatatacaaaagttactttaaaaaattatattaatccatttatcaagtctttaagctaatacttaattagtcacgtattaatgggtaacaccggaaaccacggggaactccaccttccaaactcagcctaagtttagacgcaaacgcttgtataaacacacttatactcactcctgtaaacaaatgcatgcgtgtacatctatctctatgagtatctctcaagatagaatctgcatgttataagagttatgaagtcacaacagatttataccgacattgttaaaaggataattagctgtaaatacgagcatccatataactgatctcatgatttcgttggaacacatgtttttgtacgtacccctccgtcaaaaaaatttaatcctagctatgaacctggacatatacgtatccaggttcgtagccagtttttggacatagtagtaagcaataggaatcggtttaatcgataatggacttgatcgatacaattagctctattgtcgtatatatgg

SEQ ID NO: 99342 - DNA, 668 bp, Oryza sativa
cgaggtcgcgccgccactgaaccatgatcacctgcgcaccgcgattcctgggagtgggacatatatagaagaactcatcatggccgccgatcagatcctcgcgcagccttggtgggttggctcacgaacatggcggtttggcctagctgagacgatggtgctgctatttccactgccaacatcgtcggctgatggaaaagagaggagagaggaagatagtgaggggaaaagaggagagtcattgatatataggacccacattttatgttagcaaaccattaaaaaagtctatttataccggtttttaaagataggggagctcttatatctgatttacggttgagagatgagattcaagtattcaaccaagagttaagtagccatttgggcaaccagcgagcagcatgcattgatgcatagcaggagaagtgcgacacggcagcaagcagcagatgcatgcacatgtagtggcaccttgataattgctcggaggagtggtttaaagaggatgaataatttggaccttttacacgaacgataaataactatagtgtgttgtaatgaaagtaaactaccggagaaataatctttattaggtcggttctaatataagctgggactaaaaaattttatttagtcccggttaaaaatttgttgatctttatcaa

SEQ ID NO: 99343 - DNA, 680 bp, Oryza sativa
ttcctgcagcccggaggaggaagggggagaagaggaaggagcgtattgcgtatagggggaggggagtgcgggtgatcgctcacattagcaacaccctatagaggctccctcaactataaaaacaggatcaatttgtctcctcgagctgtttgaacggtggttttatcctacgtgagacgttgaccaagtctttatttgacgtagcacctacatggcaacgtagtaaaaaaaaaaaggtgggaccaaagatgctgccctccctgatctagctggccagcgccgtagccgtccccgtcatcccaagcattccgcaatgcgggatgggagcggctgccccagcgtgccgacctggccatgcaattccatcgggagatgttgcccgacaccgcgccgctgcctgctgctactgctgctgttgccggttgaagttgatcatgtcgtcgcggacgcgtagctcctccgcctgcttcgccatctctaggactcaagctgttgcagcgatggcgaatgcgagagggagagagcccctggtcttcaccacgctgtccgcaccggcgccgagctgcaccggcgccgccgaacgcagggaatgcttcgtggtgctggtggatagccgacagcgtgtccgactgcggcggtgacgtcgatgaccgggattgctgctgctgtgtgggttcatc

SEQ ID NO: 99344 - DNA, 623 bp, Oryza sativa
attcctgcagccctgtagttgggaacaaggatatgcaagaagtgatactgacaagcaggtttttctttttctgtttatcacaactccatagaaatgaactatatttaaaagggttttgacactactacataggaccccatcggttacccatgatttgtaataagccgtaacggcttaaaaaacatcaaaaccaacttcaaaattaaaatttacattttaaattttagcagcgttttaataagttaatgtgtaaacgatgagatttgctccgatctaacaaaaataactcgaggtaacggtatctcatggtaccaaatcgtttcgcggatcgttagatctaaacataacgtgtattgttagatctaacgatcgaaaatgatttgttgtcgtgaggtactggtatcacaaggtatcctggaacgcacaacaaagactgtacaggtgcttcatggaaaggtcgtgtactgcttggcgatgctgtgaagcttacaatattttcaagacgtacgcaacgagaatcaagggtcctcctagtcgcgccattcaaagcacgtcacgacctctactatatatgtgtactccaatactagacgcatgctttgcttatacgtgtcgggcatatc

SEQ ID NO: 99345 - DNA, 676 bp, Oryza sativa
  unsure (1)..(676): unsure at all n locations
agagagagagagagagtgtgtcataatagtgggtaatagcattagtaggattcatgcatatacgggggtgntnnggggggggntncccncnnnattcccaccccctcaccccgncttctcttctcccctccctctcctaccactgtccgctccattccaccccacccattcctccagattttgtcctctcataaacactcccccatatcttaacctcttccttccccccaagcaaactactcatctctctacccacttgctatgccccctctatttcgtattaaactcccccctttttccttaccattatacactacctgacttctgtgcacactcactccttccttttcctttcacacatccttcccctctccaccctgatgtcttaaccctctctctactccctccgcctccattcctacccatccaatcatataccccgcactaccctcatacattcgccttacccctcaacagctcttctcccttcccaactccattaagttgctcttcttaacattttgctcaccctccccacacaccctatttttcccccctctgcctattaccgccccctctcacaaccactacacatcgtcctcttccgtttctccccctctccctattcaatcacaactccttccctctttagcatcccctccacattttccccccg

SEQ ID NO: 99346 - DNA, 624 bp, Oryza sativa
tgtggttcattgagaacctatgctgatgctcgcattgcgctctagaggatccccgctcggattaatttgtcggctctgaacttgtataggagtaaaattctcaggcgcaagcttttctgtagtctgtatttattcagaagacgcccgtctagctataccttgaaattagaaagaaaaacaagacatttgctacgaaaatgagcaagctgtcagcagttcaaatcatagtggtactactggacatgctagtgggtaacaatcgatcttgacgatggaaaccatcaaaccatggctttgtgcttgaccaaagcaacgaaagctacgtcgcatgtgtttcagactttcaggcctcgtttatctagtcaggactctgaatataaacgtgaggacgaccctgtttaaagccggctaatctgtccgtctaaaactcaaaatctaccaatctgctcgtctgaaactgaacacggacactgacctattcgctctgccaagaacacaagatgctaagtgacaacacattcaccattcaaaaattcagacatcacgaatgtgtttggagcgtacaaaacggcaccacgctgacatggcaatgtgaaaagtgtgaattttgattgcacggctgga

SEQ ID NO: 99347 - DNA, 617 bp, Oryza sativa
actccctgcatccaaagaaaaaaaatataggtcaaactttcaaaactttgagcatgtgtgttcgaattagacaaatgaaattcatatgtgtagatttgttacaaaagtactttcttcataatattgtaatattgttgggttccatacgtatattgtagtagtagaaatcactccctccggttccatgattcttgacgttggattatcaataacttttaaaatatttagtttgaagactatagaacatgatgtatagattagtcttagaaagtactttaataaaattaaatatttacttactttttgcatgtattataatagaaaatcatagtcaaagatatgttttggacagtagttgtaaaagttgtattttgtagagactatcaatgtcccaaacattttttttttgtgactggagggattatgttatttacatgttttgattttgttattgttaattgtttgagccatttcatctaacaataatgatgatgatgatactggtgatagtgttactgaacctgggtaatttacagattacttttgccttattttgttggtccattagccatatgaaatgcaacattatacattagacataactaaatgaaagactc

SEQ ID NO: 99348 - DNA, 1033 bp, Oryza sativa
  unsure (1)..(1033): unsure at all n locations
ggagtggacagtttggattgctcaaagaactatcacctcttggcgacatggttcacttcgattttttgaattcatcatctccttctcttgtgcactgcttcattcttaannntttcttttatctcttcaggatgggctgttgatatttctgcctatgatgacgatggaaaatgcacacatattcttctttgctcaaacccatcctcatatcaggctgttccaccaaaggtaactgcatgttaatctgccccttcatatcacaagtgtaagtcagttgacatcatcatgctgcaccaacaggttatctatgtacgcccatacataacattcacaaacagggctggacaagatttttacataaaacttagtgctgaagatgagccaaaggtgctacatgcacatgactggagggtttcttttatgcactcagaaggaggaactgaaaaattgcaggtatggcgtcactcttaatgataggtctagctacgtacttgtatgaatgaaattttcatgaagccattgttcagaactacacaactgtcattacttgctccagccaaatctttttcttaccatgtaatatatttggtgatagtgttctatatgttctctggatttttaggcaatattttagttagtaggtcttttctacattctgtatgttgtacattttagttagcacactattttgtttatttctcagcttagatttggttatgcaaaccactgttatttgaaaatgtgtggctgtatggtcagtatggagtattatcactttaaaacagaaacaatataaactatgcatggtttactcaaggacagacttgcaatggattgatgcccctgtgtctcccactctctttgatctcaaacttttcattctcattagtttggtatgcaaaacatcatttatgttgaaaagaagatagcatgcaaatatcaagatgagtgcctgcaaaactcaggaaaaaggagggtaattgtcctcttgttaggaacttaggatactatacatgcgctctagtatcaacaa

SEQ ID NO: 99349 - DNA, 682 bp, Oryza sativa
agctatgctcattcttaaccatttaaccattattcagattgacggctacaaaacagcggctctggtatgactagatcactagagctatgaatctgtctttaccacatcttttgtcaaaacgtcagcttcaaggactaaataattttacaaaatgaacaaccaaggtcaaagcaataagtattttcagaattttccaactgatggatatgctctttgctttagtgaaaaaaaaatattttcatcaaccatgcataagtacaaacatagttgatgtagtcgtcactatacctgctagtggtaccagaattgtaaccagtcatgtatgaaataaaaagcttctgcagatgtaagtacaaaagctctctcggtttatgatcaatcaaagagactccaacaactccaagttcaacaataagttccaatagtccagcacctgtatctgtatcattttgcataactggcgaggcttggtgatcacccagatcagatctgtaccctccctcttgtcttcttgggtaatcagcaaacttcaaaatcttaacatcagcagtctcaactatactgagcttgaggtgatgttctctaaaaccagcggaacattcatcagggttttccaggtcaacacactgaaagaaagtaacatctccttgctggatgctaacatcaaaagttgtatgtccat

SEQ ID NO: 99350 - DNA, 749 bp, Oryza sativa
  unsure (1)..(749): unsure at all n locations
aaatgttagatgtagaatcttgttgctgacgtatctttatatttgagttgtttctgttataatgcagagttgtgcactaataattagcaccaaaatccgaagttctggatttgcagaacattttatcctgatatagatagatggtttacgttttctacgaacagcactcagatcatgatttaagatgttagtttgaagactggctcagtaacatagtttctctgtgcttgtaaaaatagcacttttgccagtttgatttccttcacatatcaattgattccacttagaaagaaatcagcatttccatgttatggtgggtggtgtatgacttggttgcagtttcattttctttcgtagaatcctttgtgctgaagaatgggtgtgatatgctactctntgattatggatccagataaatctaggccgtatatagccttcacccttagaaaaagacaagaaagatgccagctgatcttccttttcttttttgttggccactctacctattctgctctaaacaagcaccactccacatctccactttgtgtgttcattctactcccacctaatgcagtggtagaactgtacaagaatcaataaccataaaacgcttgctaactatttgccttcaggtagtctgctccattgtagtggtcttcttatttagttcatatgataacttcttttagtacacatatgtttgagttaacacagataccacatggtatactgacaaattattttacaaa

SEQ ID NO: 99351 - DNA, 656 bp, Oryza sativa
  unsure (1)..(656): unsure at all n locations
cgatgggaagtttgatcatttcggttcaggtcgttactcatatcaaaactatgattatactattatagcngctaatatagtatcatcttctataccaacgattatattggtaatagcagagtaccctccccttttgtcattatgatcctgaatgagttgaaggctcgcgcccatcaggtaccagaccattctgccagggccaaaatcaaggttagcccttgtagaatctagtaaagcaaattctacagacagggacttggattgatgtaacccaataccagctgaagctctagtttacatatgctaccgtgtcgttgattgttgtcctaggaatttaaataatggcatgagtgctaatatatcgactcctagcaaacgtaatatagttggtaggtttgtgaggtcgtctagtgtttaagtggcgaaagaatatgatccattgggtcaattagctctctagcaaatcaacacatgatgccttgttacggctgtattacaattaatgaagaattcttcgatgcagctaaagatttggtagtatcagttcataaaataaagagcaggcccctaattccccgcaatctagggcaatcatgcttttctttttgtgctatagagatctctcacaaaaaataagatccttatccccacatagt

SEQ ID NO: 99352 - DNA, 540 bp, Oryza sativa
ttaaaaattacaccggggtttttaaatcggggaaggcgttgctccaacttggttggggaaaaaaccccttttatcccaaccgtgtgcttattcgggaaactatggttgtgggcacacccgggagacacaaatttattgcccttggaaataccccttgttcaagtttttacaaaaagggttttgggggggcctacaagattttgaaagaggggccaacaaccgttcacataaaaaaaaaatttgtgtttgcgcctctgtgtaaccactccttttgaaaaaaagaggttgttttttctgcaacaacacaccttgtggggggttttttttgtcagccgactttctcccacaaaagggtaaaaaatcttttttttttaaagggtgccctctggaaaaaaaccgttgaggttttggtatattataaaggatctacctttctttataaagaagggttcacatacaatttttggaaagtggtgcgtcacatttaagggcgccctcagcggtgtttttttaaaaagacacctcccgataattaataag

SEQ ID NO: 99353 - DNA, 613 bp, Oryza sativa
cagatggctgtcgaaccacggttgttcgacagggtgctaaacatgcgatttcgcctaatcgacctatatttttacaatttttcattaaaatcgtattatttccaaaaaaattcgtgtttaaaatactttgaataataaagtaagtcaaaaaaaataaataataattccaaacatttttaaataagacgagtcatcaaagcaaacaaaaactcaaaatcccttatattatgggacggagggaatactttgaaaactatatagtatcgttttttttttcattccatgtttgcattaacttcatttcggttgtaatcccaaagtttggccaccgttattttaagactagccactggaattttagattggaaaagaacaccggtccattttgcaactattgtgaagtttgccggtttaaagtgaaaatctgcaaactagataaaaatttgttcccaatatgcaatttactcttattataatctttcagaaagactggtagaatgctggcaagtgcttaaacagccggtttcaaagtctttccaacatcttgatcaatagttgacaagagtaatgctatctgaattctgaaggaatgctcacacttgtataagaatga

SEQ ID NO: 99354 - DNA, 719 bp, Oryza sativa
gcagtagttcatcacatgtcttgtctcggaatgcatggctatgacactgaattaccttactgggtctgaaatcccaaagccaattaaactccgtggattatcatgacgtgctatgtgcaagcgagctagctagctacgcttctgaatacttcaaaggacacttttgaacatctcaaggacagtatttcactttgctcactacatgccatgcacatgcatggctggaattatatgatcattatatctacctttatatcctgacatatagcgcctgatagagccccatctttgttggtccactcttaaacggggggccacccatccgtacacccagtgaccatgtgataacaacatcacctataatgagatgctcccccacaagtgccagtggccagtgcatgggcgcccttgattatatttcgccctgcatatctaccaactgataatacatactatctgtgattgatcaactatcatccaaggatcacgctactgtatacatacaacattaactagctctgaagagccaaacctaactacttaactatgaggatcctcagtgacagtcaatatgaaggatattgctgccctagattgagagttcattaacatgtgaactatcgggaccagcgatacaacggatctatatgatgtgagttcactatgtgatgcttaccatctacctattggacacagctcgagagctcgaagccatgcga

SEQ ID NO: 99355 - DNA, 657 bp, Oryza sativa
actcgctgatggcggcaacggagagacgatcagacgacgaccttaattggccggcctgcatatatatagttgattgtactagctccgacccatattactggacttttggagtggaaggttataaagtggagatcattcgccttattcaaaaaaattgaaattatattattctgccagccattggctgaatgatcaaaaggactgaacatatgacttatctttttttataattgcactaattgttcaaataagaccaatggtcaaacgttgcatgataaaaagccaaaaacgtcgcctattatgggacacagggagtactgcattacatgctgtaatctattccctcctccgaacttaaatattctacaccgttgacttttataaatatatgggaccgtggatcttatgaacaaccattcagtcattatgagttattctcctatcactagattcattgtaaaaagtactttcttgtttacatatggatttatatcttccacaaaagttcttgaacaaaacgaacgatcaaatattttttaaaaagttaatggtatcaaatatttaaggacagacggagtatatacttatctgattctctgttccgaggcagagtagaatccgctctatatgcctgcctccaaggaccaacgagaatga

SEQ ID NO: 99356 - DNA, 573 bp, Oryza sativa
cccgcatcgtcggtatctccgccagtgtcagagtatgaccagtacgggatttcgtttgcatgtagagggttgcggatatgtggatcgattcaggagatattctcgtatgattttggcgggttagagcgactcatgattcagtatagctcgggtttggtgggtactcgtggtcagtcgagaaggagtaaggaattcctttgcatttatatgatgagtgttatagcgcgagactgttcgatgtgcgatcacagtggtcaacatccctttgttagttgtttgggagtagtaaattatggtatagtcgcttacaattttggttacattattcatccggtcgcctgtggaatttggtattagagaatcatttcgtgatgttttagttctacccttgtcgtttgcttggcagattatgtgatagacagatgtggagtttagctatatcaatccatgtgattcatcctcccggataaataaagtggtgtagtgcaggaatggcatatgcaagcaggtctaagtgtattattcatcctatctgggcaatgagcaatgttagtactatatgcgccgagggtg

SEQ ID NO: 99357 - DNA, 1455 bp, Oryza sativa
tatcaaaattccttttcagtggaggtcacctactacgttctcactggaagacccgtggaatatcctacttttgtttattctcggaaacaaatctagcagcgtaatcatacaagggcttttaggaaccaacagattctccagagtacagaagaaacagccggttgaagtcctgatataccgttgctggagtaatgctcaaatagtcagtgaggatcagcaagctctgggtcacaattgatttgactttgaacatttccaaaattgacagtaactaagcaaagcgtgctactgatggagcatcttctgcataacaaaaggctggttacgttatctaatgcttggagaagttaggaaataactggttctagaaactggattggcaaacaactttagcaccaggtaagtggttccaatggttttttgctttcaccaagattaacaaactgggaaaactaatacaggcagctgccctaccacggtgcaaatgtcttatctaaggaagaagagaagttgaatctacacaagaagattcctagaattacataaagcttatgctcagatctgaaggatacaaagataataatttcggtagaggcagctgaactggttcttgtaccaaaatgaaggtacataggaatgacagaatctttaagagaaaaaggagttcaagtcttccacattgaatgattatggagattcatcacgagcagtcaactgagagatactccttgtcccttcagaattggaagcacacaacagtcgttgtccttgcacattgagatgctcaattgttcattgtctcgtttacagacgagagatggtaatcactaatcagatctagcctgctcattattctactggtaatgcagtgatgaaatgtgttcttaaaatggtgagctcagtcaggcctgtgcactactacaataataatgcaactagaagggaatactaggttactgttaataccgcaaggactagtggcaattgaagccattatttttttttctttacatgtatggtgcgcttagtgatgcattaatcatgctttgaacttttttggtcatctgcagacacaggaagcatcttttgatgcagcgtggaacttgcattagcgagggcgcatacatgccgagtatgtttgtgctactgtttctgatgaagaagagatagctaaggtacgcaagctggctttacgtaaatcacatgaccaatgttcttgtgacgcacttcaattcccatgttgcaaaataagactcaaaattattttgacgtgatttagatgctgcccaagatttcaagtcaaatatgaaatatatgttgcattcataccatacatagcggaaataccaaaagtgtttgaaagatatatcattgtggctttcttttcatcatttttttttccgagaaccgaagttatacagggtcgtcatgattagaataacgtgctattcttga

SEQ ID NO: 99358 - DNA, 1452 bp, Oryza sativa
aaaaaaattttttaccttttgcaagaaaaaaaaatgaaattattgatccatgacaggaaagaaatttatttcatctgatttcaagcaccttttccttgattggtcagggttcccaactaccattttaccagcagacaccagctagttttgctgccatgattatcactgttcactcatatataaatggccaacaaatgtcttctcaattttcttttttggagatgaagtctgcttatttcatacagtaacacagagtaactaggttaagatgcagtagtacagtgcagacactgcaaacattcccagcttctccagttaattgtactcagagcatttgaatttacaacatcaaccactgccactgcatttaacattacttccaagttacttgtactgccattgatcagaaacagtttgtagtgccttaaagagaggtcaaaagcttatggatggataaactgattacatcctagtattaggttctactaatagtgagcactacaagcatctgtgctcaaccattatcttgatgtgaacatcaacaaccaaagatgatgtgcacggtaatacataatcatgggaggtttaattaaaattgtctgctgaactcaaaggtgaaagtgatgtactgttttgttcaacatctgaagattctctctctctctctctcactcacacacacacattacagtaaagtcagatactcacatgatgtaatgtagtaagttgtacccaccgatggaaggacaaaatctctgaaatgtgacaatagtacgaacaaaaataggccttttatgattaaatgtaaactgcaagccaagcaaaggttaattcctagtccaagcctacttatctttcttgctctaaattttccccccaccttaacaacctaatttggtacgaactgctacgtatttaaagggttaacactggacagagtaaagcactgatatagattttcaatataaaatgaagcgtatatctagattaaaagtaaaagaaatggagctgctgttcataaatccggatcaaccaaagaaacaaattttctttgcaattacaaactcccatactaaatctgtagatcgatgtaaacatggtaacaactgacaatgacatgcctattcctaattgcttttgacacacagctggtagcattgattcaaagaatgatcttttgtcaaaaaaggtatcccaagaatgaaatggtcctaatattatgtttgcataggaaaataaaaaagattagaacagcaaaagagtctcaaaagttgctcaaatttttgaaccatttcccctccactggatggatcaaacagcaagatcaaggcagtagtagaggtaaaactgaacaaaagccccagaaattatactacagtggtcacagctttttacaccctcccttttcccaacctcccaaacgcggaggcacccgaattcaaatcccccaca

SEQ ID NO: 99359 - DNA, 570 bp, Oryza sativa
aggcatttatagacgaaggctgtgtttagttccacaccaaaattagaagtttgaagaaaaaggttggaagtttatgtgtgtaggaaagttttgatatgatggaaaagttagaagttcgaagaaaaagttgggaactaaacaagcccgaagagagtaacatagtagtagcaattactccttctgttcagtattggtcaaagtcttgtaccagtgaaacaaaatacatcttgtatttgtggatgcagggagtaacatagttaaaaaaatatgtacacctaactagtaaattattactgggttggtttaaacctcatatgatagtagtaatacagttaaatgaagggagagtacagggattacctcaaaaaaatagaggaggaactcatagattgagagtgattcctgaaaaccaggacaaccagtgaccctgccgactttcttcagtttgggggaaaggactcaacgccagttacagaaaccaaagcaaaactgattcacctttgagtacgatgccattttacagcacgatcctgcaaaacaagtgtaggtgcccatcgaatggtggtaact

SEQ ID NO: 99360 - DNA, 1303 bp, Oryza sativa
tgaatccgccgcttgatctccttagattcagtgtgttttttttgggtccattaaagcaaacatgtgttcaactagctgagatgcttccaccttttcgatactgcgattcaatcggtttgctgaatctcctcgcatttttttggatttgctttgtttgatgactttttgcgtttacttgactccttgcttggatgcaagtgtgattcggaacgtgtgcacaaccctgaaactgtagtgatgcgctccaattggtggttggatcatagtatcatcttggaagctgtagctgtagtggcagagctatcgtttgtttaattcagattagggaggcattttcctcgacgagggcacaaatcgcgggtctaggagctctagttgtgctgggaccatacgttcctcgtcctgttgcatcgtgttaatcatgatggccgtgcaccccttgcaccaaaccgccacctacttttccaatttgcactgcaaatctaacacaaacgctgaaccttctgaagaacgcctgctggtagatgtgtatataaacaattgggctctggagtgattagtgaatcttatattgggattaccatttagaatgggatgcagtttggttccttcatcttggaaattaccagaaaccagcagtccatatgacttcatctaggaaatttccaccaatactaacatatgacccatcttagttggttaagtatatattggacctatcttaaccaaaaatataatacagaatatatattggccctatcttagttgcttaagtatatattggacctatcttaagtatatatatatatattctagaaatttccaccaatactatgacccaccaattctgtattattttacattttggttaagtatatattggacctatcttagttgccatttagaaccaacaccaagtattctgctggggtttcgtacctgcatttttctcgggagactttgattttgcatacaggattcttgttgaaacattttcatgttgagctattattgtatagtcgaacttgcattactctcatgggaggccaagtagacatctcactttccatgcctcccatgctacacattattttagcatatttgtacatatatgttgtctggcacgatcattccgtattcatgatttaattgacagacctcatgccttattttaaaaattgaaggattcatcgtgttgttttttggtgtgtaaatattgatttgacctgtatctctatttctatcaactgatgtatcttcattctcccctgttatcctagcagtttctagtagagttagagtt

SEQ ID NO: 99361 - DNA, 524 bp, Oryza sativa
cgtgcggcggtgaacgatcgctatgccagtagtttatcaaaattctaaaagagttgttatattttgggacggagggagtattatacagtacaccgacaaccatttgaagacaaaaaaaaatactggtgtggaaatggtttgaacatatttttttcagacttttttttcccgctggacatagaggagcaagttcgccgcacatatcctaaccagaaagagaaaaaaaaaagatcggacggtcgctccagcagcaagatagattgtgcgtcgacatgcatgattcatggcaatgatagtgaaccccagaatttagtacagccggagatcgatgagctcacaaccttatctcatctaatcatgatttgattttttgattagttagttttagtggccaccgcgtcggctcgcaggacaggacaaggacggacagtgctgagcaaaatggcagctgcctataaaccaactgcggcagattgtttacgacgcattacatttgttagcccatccatttaattatactatta

SEQ ID NO: 99362 - DNA, 730 bp, Oryza sativa
  unsure (1)..(730): unsure at all n locations
cgcggnnattgannttcgaagtannnnnnnnnnnnnnnnnnnnnnnnnnnnnncttgcctaccaacggtgcacataacgaacactgtgtctgaacatacaagtgcgggacaagaaagcagagggtgttttcgaacgagctaaagagtactcaatcagctttaagcatgcggccacctatttggttttctgctgtacatcttttgagtctatagagcttacgtggaatcattgttgtggcgttgtttcacaaaacaaatcaagaatcagttgggctgacttgatttcttttgcaaaacttatttttagagagagaaaaaaacagttgcaaggtctatatgtacttagtgtgtaacaatatgagttaaggtatatatatatactatctcctttttcaatgtatggcaacattaacttttagacatgatatttggtcatttatcgngatatgtattattgctttgattttttttttaccaaatgtactttaaacctgatcaatatatatttgtatttttaatttgaccaatgatcaaatgttatgtcaaaaattccatcttgtaccttgccaatcgtccagtctttttttcatcccgttagctaattaattctctttttttttttgcctctttaagggatgtggaggtatataccacccacgaattcaatgaaatggcattctcatacttaaggtttacaaggaccatgacattcaataaccgcattttacca

SEQ ID NO: 99363 - DNA, 741 bp, Oryza sativa
  unsure (1)..(741): unsure at all n locations
gtgtccattgatggctgtcgttcagtacnncaccacaaatttgaatttgaattcaaatatttttttatatatagtatttctatacatctaaagtttatacacgttaagtttatagacctaaattttatatatccgattcaaatttgaatttgaattatatccgattcaaatttgaatttgaattcaaatatttttcatatatagtaattctatacatctaaagtttacacacctaaagtttatagacctaaagtttatagacccgattcaaatttaaattatatccgattcaaatttgaatttgaattcaaatattttctatatatagtatttctatacatctaaagtttatacacctaaagtttatagacccaaagtttataagtcaaaagtttacatacccgattcaaatttgaatttgaattcaagttttttatacataaatttttttaactttttgtttttttaaaaattttttgtggtgtactgtaataggaagagaagaaggggaggaggaagggggagaagagagagaggagcacagggggaggcgaggggtgatcgccagggcagcgcgggggcgatcacccgcgcgttaggatttccgcatcagaagaccatatcaattccataatgcgagccatgcagccattatatccgaccatacttaacattctttaatccacgtatccacagttcgttaccctaggtgtgaaaacgaagtagatagatcaaaacaaa

SEQ ID NO: 99364 - DNA, 732 bp, Oryza sativa
  unsure (1)..(732): unsure at all n locations
atgggcctttgattgatttgatcnccgnttgactgcaagtagttcatcatcgggaatctctgaccgaaattatttgaaaatttgacccaatttataaaaaaatgcaaaaaaccaaaaatttcgggcaagaattgagcatgccggcgagggtgaaattaccgcaattttagaaatttcgaatcaaaatttcaaaccgtgcgtatgagtttgtaatttactcattcggcttcatattataagttactttaacttttttttcttagttaaacatttttaagtttgactaaatttgtgaaaaaatatatagtaatattgttaacccaaaataaacatattatcaaaatatatttaatattacaacttacaaaactaatatatttacaggttttcttgttagtatgaacgagctttttgaagatgtcgatgatgaacaagtactccgcccatggaggatggggtgtactaagttgccagttgtctcttcggcaatttgaacatatagatcttgtacaacgaatttggatggagggttgtccaaattagatatactatccctctcgggtgtctttttgttttttttaacggagggagtacgtcttttaaaagaaatactcctccgtttcataatgtaagactttctagcattggtcatattcattgtaatggtaatgaatcttaacacacacacacatntatatatatatatatatatatatatatatatataggaaa

SEQ ID NO: 99365 - DNA, 689 bp, Oryza sativa
  unsure (1)..(689): unsure at all n locations
tctggttattttaaaaaaatctaaagagatggttattttgggacggagggagtattatacagtacaccgaccaccatttgaagacaaaaaaaaatactggtgtggaaatggtttgaacatatttttttcagacttttttttcccgctggacatagaggagcaagttcgccgcacatatcctaaccagaaagagaaaaaaaaaagatcgggccggcgctccaacagcaagatagattgtgcgtcgacatgcatgattcatggcaatgatagtgaaccccagaatttagtacagccggagatcgatgagctcacaaccttatcttcatctaatcatgatttgattttttgattagttagttttagtggccaacgcgtcggctcgcaggacaagacaaggacggacagtgctgagcaaaatgccagctgcctataaaccaactgccgcagattgtttacgacgcattacatttgttagcccatccatttaattatactattattatcgaacgcacacactgcacgcacccatccttttgctgcgatncgncaatggccaccancaaaatttgcaagattctgcagatcttgtcgctaccagggccacgatgtatgnttcttttaagaaggtattatttnctcgacactaacattccacttgatatatacaatcatttaaatttgagactttg

SEQ ID NO: 99366 - DNA, 734 bp, Oryza sativa
  unsure (1)..(734): unsure at all n locations
acgggcccttggatttgcgttctgactgatgcaagtcagttctcaatcttcaacatattgggcactaaactattgggaacgcaattttgtgtgtttaatcttatggaaatcgatttgaatcctttaaaggacactcataagtgtataatatactcatagatataatttaaactatagtgctttaattctcaacattttgacaaattaagctgaatatgaatctttccttgtccttacccagaatgcaacaaatcaaatgaatccaccagtccatcaccatatcactattatcatcctctctcgtttttttaggacggtttttgatttaataagcaattaacgaaaatggtaaatatccctaaactattaagcgcaaaatattggcattgagacccaatataatggccccgccgtgtcgctgtcccgtccacgtgccccccgagagctgagcgataaaaatccaactgctcagctcagctcagctcagcctccgttgtacatcactctcctctcctctctctctccagaggccacggcagccgccaccgcccggagaaacaatggaggccggcgagggcagccgggccgntctttttcttctcngcgncgacgtnttncttnctcgncgncgtnntccacggngccctcgacttcacctacctcggtacaaggttccaagatttcttttcatttttaatttcncattccaggtattaggctccttgcttcagggg

SEQ ID NO: 99367 - DNA, 753 bp, Oryza sativa
  unsure (1)..(753): unsure at all n locations
gcgtccgtgatgacnatctgttaggacnncatcattatctcctgattttggcatgtgctatgtgaatttcataatatgatctttaacaatcatattttgcttgttcaaatttgaggatatgtattgatcagtaaaggggatatttgttgcttctgaacctgtacatgcaattgttgtcaatctttgagttatgataatttattaaatatttagtcacgtggatttcacgtgcatgcttactagtatgtaaaatgtagaaaaaataggagggggcccaataaaaaacctacctacatggtttattttcgtagtcccgctccctctccttttctctcctcccatgcgttaattccttttccatcctccctattacttcacctatcctcctttcggcctctcctccctttatctccttttctcgacggttggtaaccggatccgatagcggcgaangggtgggatgagtggtggtggaagcgttaaatttgcctcgtgcgggaaggggcgatgccgtgatggttgctacggtgactactaccacagttgtgaggggcgaaacatcggcttaggtggaacactacaatgacggtagactctaggtatgtggaatcctctgtagcaacaggagaaggggattccatcgtgacctctgcctttcatcgttttctcccatacttagcgcatggatcctcaatattcctggcggtgggagcacaggttcttattttactctctacaagaatcggtctttcg

SEQ ID NO: 99368 - DNA, 773 bp, Oryza sativa
  unsure (1)..(773): unsure at all n locations
ttgggggccgcttcactttttttagaaaagacctggttgagggctccccccgccccacgagaacatccttaccggcgtgggtggcatttaaaaaaaatatttccttgcttccaaaaccctgaaagattaacaccgggggccaacctatcttctgttcaaccaattggaaggacccgaagggggataaccccctcttttttacccacacatggggaaccaattaaaattaccctaattgttggggaaccgggcctttttttaatcttttcccaacacaaaagagggcccccccctaacccctggacaatgtaaaaacgtgtgccaagcatttaattgggaaaaattattttttttattctgttccccacaataacaatatttggggggcaaaaagtgtaaaccccttttccctcccccttccccgggttggtttttgttaataaatataaccaaaaacgggggtcccgcttattaaaacacccgcgcgcgggagggcccctcctcctccaattttttctctccccggtcccgccaattgtgtgtaaaaaaacaaaacaccccaagagggcgcgctctttaacaaagttattgtgaacccacaactcaccaaccatcctttcgggggagggagaaaaaaaagaacaatncatcactccgttcttcttgtttttcatctaatcactcaccacaaaccaacaaaacttctcatccgttgtgccgtctgtctgcctgctcatccgacaacaacacactacatctttcctcctctatca

SEQ ID NO: 99369 - DNA, 623 bp, Oryza sativa
ttggctaaactaagaaattgtgatatatattttggtgaaaatgtttttattaaaattattgacttcataattaatactttaattaaaacacttattctacataattcttagttttaaaattcctaaaatatttcattattttcttcgtgtatgatttatttaaacaaaatgtgtcatttcccaataaaatacgaaaaataattaacaagtgtagaattggtaaaaaaggtaaagatccttaaaaggagtagaaggaaggactcaaaccagggtcttcaggatgagagcaccagacccagtagcaactcacgtgtgtattacatatacaagcatgtatttatatattttcttataacttagtaccgagcaccagatccagtagcaactcacatgtgcattacatatacaagcatgcatttatatattttcttataacttagtaccaaacaccatgaagctaattctatatgactagttaaatttttgtcttctcgaataggatgtgagtgtcaatattcttgacactaaagcattatatatcaccactaatcttaatagcgttgagctgacgatttatttatgcaaataagtttttagcacggtcgttgcaaaaaagtttctgg

SEQ ID NO: 99370 - DNA, 751 bp, Oryza sativa
  unsure (1)..(751): unsure at all n locations
gacggttgattgacatccgcgntggtacgtagttcatcaaaagcaaaagatgtgaagaagcaaacggcacagcattaaacaagcaagaagttaaccaaacaatctgaattggaagcggttttgatatgttttttcagttgggactggaggcgagcggcgccacaaaccaaattctgcctcaccaaatgagctgagatcagcgtgcaacggcgcaaccagttccgtgcaacagtcgaagatgcattcagagatcagtgcgcccaccagttccagtcgagcagagggcatccgccatgccggcaacaacaccgaaccatcgcatcacgaaccgccgtgaagaccgaagaagaaacagggagacagggtagagataggagaacatggctacatttgctacggcccatttgtcttctgtcatgggccctgataattgagaaacaaagccgagtctgaattccaacccgtccaatttacccacaaggcgaatttttttcatttttcattttaattttttaatatttacataaatattataccatctaaaatatttacacaaatagcccctgccgcccaagtggagagaggcaaggtgtgcgtattttgcatttaggtcccttgccgcactctacaaggctgaaaggggtaaatgcaatttttgctctgccaaaaatgcatttttctattttttttcaaccggtccgtccttcaagtcacccttgccgcccttccagggtctacttctgtaatattt

SEQ ID NO: 99371 - DNA, 722 bp, Oryza sativa
  unsure (1)..(722): unsure at all n locations
gcgcgatagattnccggtcgtattccagttctactgcaagtcgctcatcaagagaggaggaaaaatggtgcaagcgggcgatagattagtcgccagctccgcactggctccaagacaccacttgtgatactttttttgaaacaggtgatactttgtcagtgttgcagcagaagagagagaaaagagcaccaaagcaccgcagagaaagtcattgatgtggttaaaaaaataataaagcttttggttgtttaacgtgactattatactctccaactattaggttgcttttagatgacatggtacacaattatcgctagcaatcgacgataatattaaacctgccctaatgccgacgtagtctgtcttcacggaacaaaggtcgcagccatgtccccgaggtcagtttttggctcaaatttcggaatcatgataaacatgctgtccttcctgttgttttttttcgcgaactgtccttcctgttgtttccaaggagatgatgataagatactctttttacatgagctgagacataagcgtgctctttgtgttggcgcttagatggttgcagatgatttcaacttatatatacagaagaactttgtgttggccattagataatagcagggtatttcaacttatactagaattgtatcgagcggcgacacgccgcgcaccgcatgcaaaaggggattaaccacagaattacttcctttggctaaaaa

SEQ ID NO: 99372 - DNA, 536 bp, Oryza sativa
  unsure (1)..(536): unsure at all n locations
cctcccctaattgtgaagcatgcaagaaaatcgttggaaaatggtaatcctcctaagatgtttgaggtgttatattgtcaatgttctgcaagctagtaagagtcaagatggccgagttggtctaaggcgccagtttcaggtactggtccgaaagggcatgggttcgaatcccattcttgacaatttattttttatttttacatccagagtttaactgccattctgataatttgtttttttgggtttatacggagttttaagtggtgtaaggtatttctgccaacatcggtggacaaccttattaacacacacaatttcggttcacttttgttgacaaattattagatccctttttcatgaatttagtgaggaatgttcttcccttttaatttggaaattttatctaagcatagaactagccaataatatgcaaacatttccctcttgcagcgatctggacaaccttataagcacacaatttcggttcactttgttggcaaattatnnnnnnnnnnnnnnnnnncgaactcgaatca

SEQ ID NO: 99373 - DNA, 585 bp, Oryza sativa
aaacaagacaaaaataagggaagaagcaatcactttccagatctactctgaacagtaaaagaagctcgtgttattgatcaatgatgttaaaattcgaaaatccatgaacataacatccataacatcagatgggggcaccacagcataatcaaaaactggagtagagcatggtaaaatttcacataatcgagttaaatttatcaaaactacatgctgagattacgcaaaaaattcaacctgtcaactttctggttcaatctcgcaatggcatatctgaaccaaatgctaaatgtgcaagaatgcagcatactggtaatcttataccacacttctaaatgatatcaacaactcgctcgtctatttcttgtacaaatcgatcagctaaacaatcgcactaatagatcaaacgggtcaaaaattccacaaaatctgtagcgaactgacctccgcagctccatttcctcagaacgaccacagcctgcacaacccaaaaaaaaaggggtcaaaccacagcaccaactaacctacttcagcgggggtaactaagcaactcaccggaaccacggtggagagcgcggcgatctc

SEQ ID NO: 99374 - DNA, 606 bp, Oryza sativa
  unsure (1)..(606): unsure at all n locations
cgctgggngtgatttccgctctgcagtacgccatagttctcgcctgtcacgatagggtttaaccatcaaatcagtatgaaaatggcacctcccttgattgttactttctgcaattgctgtcttaagatttttaaactcgatcgatgtcataattttaacctgctacagctaagaataaataaacatgatatataaactcgattcttttagatcgtccctctcaaaataataataataggtggggtcgctatctgtatctggacggtgatttctatgagactgaccaaatattaatctccctgtaattaggtcaacttaagtcaaatatttgctattttactgattcccggtgtaatatcaatttacgccatctttattttgtttcccttttagttaaaagtacatataatttcccagagccgtccccaaaaatcttggggaacaagaccttatgtacttggtgaaaccccgtgcattgttgcgggaatttagtatgataaaaaaaaataaagtgtaatatagctagataacatcagattaagtaaattaacgtggtttatgataatttaaacttgaattgtagaatggcgattcaaacgtaaaaag

SEQ ID NO: 99375 - DNA, 746 bp, Oryza sativa
  unsure (1)..(746): unsure at all n locations
agccaggtgatcccntgtacaaagctcatcacatgttttctcgatatgtctcgcgaactccatatatagtacctaacaagcacagaaaattgcgcaccaccaaaaacatattatcagtacaccaacaacatgcgactgacgcatggataaattctcctattacatactagcgtgatgctactatatttatggttctgaggtatttagccataatttacgtgtattgagcgtggaaataatatagtgcccttatttgtatggcactgacaaagcggatggtgtaaaatggtaagaaatttatatcgggccattgatgagataagcaatgctctaataataattattgtgcaacaaaatttacaattccgctggacaactgatctaagacggggaatatattacattagtgctggctggattacgtgagtctgacatattacatgcatcgcnctactaacaacatactattgcaatacagtggaattgctacgtggcaatcgaacctaatgattgatcgatcgatggagatccacttaataagtggcaaggggtatgcaataagtggcaaggggtatgcgatttcaatctgaagtttaagggatgtctcttcctcgaaatcttgtttttttatccgcctttttaaggacaacatacttatggntctaggcgcgcttctatacgaccaagtctctcatctgtctttctcagtgaaccggccttccggggaaagtcttgccggacaccca

SEQ ID NO: 99376 - DNA, 736 bp, Oryza sativa
ccgcgcctgagaccccgtgtgatgccctcgttcatcaagttaagttttctgaaagggctaatttggcaaattttcgggctttagtgaaaagcttgagataaaaggcggtgtacacgggtgtctcccccttggccgcttccctaggcttggcgtaaaagaaaatctccccgtctcgtcgtctcctccgctccttgcgccatctcgcggctgaacaggggaggggcggcgatctccatccggcgagcggagcaagggaggggaggggatcttggtgagcatccatctgcattctctttctgattcatctatctctctcttccaccgggattgcacctccgtggaatttgcttgcgttaaccctagcttctcttatagatctggaagaggttcttctatttgatttcagagccttaaccttaatacaagtaacagcttgtttgttccccccaatagtttgggggttcaactgaacccccacgtcccaagttggatccgcccctgattcgcgtggttggagtgttttggttagaattttttttttgtcgggatatctttggtagttcttgcacctagatagtaactgcaccggtaaaaaagaagccgagagggtatcattgatagaccaaaccaattttgttcttgctcggtagatcctttactggcatctaggtgggatgaaccaaagaagacctcccgtcattgtggatgggaatggattcgtccatttggatccgtt

SEQ ID NO: 99377 - DNA, 753 bp, Oryza sativa
  unsure (1)..(753): unsure at all n locations
agaggtagactcctcgttgcaagnagcncatcacaaaataacaacaaaaaggaaatattacctcaaaacatcaagataatattacctctgccacttggaactatctgcttagcgacagagagcaatgtaatatctgttctcttgatcggacactagaaaacgacgtttcattgcaagaacaaatggatcagaagcatgcctgctaggaacaattattcttctaggaccatgagcaggtaattttccgcctgaagagctcatcccatgtgtataccgtgatagattattggttgcattgtatatctcttcggttttaacacaagattctttaacagtttgtggaaatttattttcacccaagaaaacaacatctggagagttctacagaaaacaacaaaataaaaacacaactaaatttaatttgaaaaataaaatggcaaaataaattaaaaaaacacatttctatacttacagtcacatcttgaaataccctgttggaaaaaattgaagaaatttgattaatcccagctgagttctcattacttcttatattgttgtgatcaatgacatcaatagaatcagggacagatcgaaaagatttgcacagctacaacagaaaaatgaatataaatatatagaaacatcttctaaaagaactataaaatacagtattaaaaaacaaaactagtaccaatgatgaggaggagtaaatatctccatgagcttgataaccctcttcatttaactgattat

SEQ ID NO: 99378 - DNA, 732 bp, Oryza sativa
  unsure (1)..(732): unsure at all n locations
cgtgttgtcctactagatggtacagtagttcatcaagaccaaagctggttcaaattttctagaaaatattcaaaaaaaaatcctttagaccaaagttggttcaaattttctagaaaatattcaaaaaaaaatttgtaataagtggatggaaatactagatttttagatgtatttttcgaaggcattatttcctttagaccaaagctggttcaaattttctagaaaatattcaaaaaaaattgtaataagtggatggaaatactagatttttagagatttagataatactagttttttggctgactacaattttacatatatatttatatatgtatatcaattccaaattttagttctttatcacgaaaactgatatttagactacaagaaaaatacaacgttgtatataacatttttttgacaggattgtatatattattttcgaaatttgaagaataaaatcaaaatagttatcactccacaacaaatacaacattctatttataaatttgttcccatataggacttactcattattagttttgatgaaaaggatggaacttattaattttgaaaaggagtaaaactttgtatttatgaatttcaaatctaagaactattaagctaataacataaaaggtaacggtacgaatacgcagntgcttctatatataactttgtaactactaaattcagattttgaaatttttggaaaaacttattactctcttt

SEQ ID NO: 99379 - DNA, 737 bp, Oryza sativa
  unsure (1)..(737): unsure at all n locations
cgcccccatgatgacattgcactgccacagnagttcatcagtacaatttctgattatatgtgatattattaattaagtcatgagatcactggttcaagttacctttgcagtctgtaatagtattgaaaagtgtagtgctatgaaaatggttggaaatggcagtggttcatttataataaacataattctaaagtatatccactgatttgatttttgacagtgctatcgtggaagcatctgtatccatgacatgcctattgtggatactgctataatacccttgatttattttgctacttgtgactgtgttgtcactatgtatgttgaattctctgacattgcagtcatagaagggggctagctggacaccatgttgagatagcttgacaccaagttaccccaacaatgtgggcagacagtaaacaagaaccacaacatggctgtcaacgatgagaccatatccccgacatagcaaccccaacaggaaatacccaagagctggctgttgacaaatggcatcctcgacaagtttgtaccttttaccaacagttctaggctggtgcggttgctatagtatggagttcatatcctccacatgaacctataatagtttctacatataaaacaccacatattcaacacgcactgcaccgcactaaggttagcaaatcacccgtttttacatcacatagtaatccaaatggaatataaataaggatatttttagcatattaccc

SEQ ID NO: 99380 - DNA, 748 bp, Oryza sativa
  unsure (1)..(748): unsure at all n locations
gcgcgcatgacatcacgatcgcacatggcntcatcaccggggtcggcgacctggcggcggtgcaggagagaggagctggcggctatcgagaggagaggaaaactcggcggcggcgtcgtcttggctcgagcggaaacgggcggcggcgatggaagggagaggccggcacgggggagctcggggcagcggcgtctgcgcgggctgtcgcgtgcgaggcagccggcacgcgacgacgcggctgaggcgacagcggtgtgtcggcgcggcgcagcttggcacaacgccgggagaggggcaccggtgggataaaggaatggagtctcctgcgttacaggagcctacccgggtcacgagagccctgtccaacctgaccttacatatgggagcccttaaactgtcggtttaaccggccttagaccaggtttaatatattgtccactactagctccaattcatgtatggctaatctaatagctcatttcatacaataggtgttatcctacactttttaatacattgacccacctgtaatacacacacttgcgtctgaagggtgctacagctggctccaaacctggaccccaatgcttttgcgattctcgaattnaatcccccttaaatataattaccgcttggcttataaccctgcttttgggccccgctctttacgcccaaacatttggtcacaccttagttcacccacccgtgtttgccaatgacccaattattacggaaacgtttttaattt

SEQ ID NO: 99381 - DNA, 716 bp, Oryza sativa
  unsure (1)..(716): unsure at all n locations
ccgcgcgatgagacgccctactgcaagtagntcatcaactgtagcaaaatactggcctttggtgggggcaggtaccggtggtagggggctaaggaaaaggccccactaccccactagtgctagctaatttgtctaaaccagctactactccctcgtttgaagacactatccacctatacttaaatacatttttttttaaactacttatctgatctacgcttcgaatggaccgttgggttttgaacaattaaatctttatgacaagatctcacacgactttactttgatgaaaccatgcaacttgcttttcatatagatgtaaagtactggtagatgtgactaagttacttgttagacatatgaaagtgcattgaataaaacctaaaagtaatttacatatattatagaagtaacttagatcaaaacgaaggtaactttaattaatgccttttttcattgaacaaattatcatatatataagttacttttagattttattaaaaatacttcctatacattcataatgctctgagttgattacttttattattgtttttagttaattctataatttgtgctgattaatttaatttctagatagagtcatatttttatctttacaacgaacttacttcaaatgacatgccaaagttacattcgttttgttttaagttacttctataatatatgtaaattacttttagactttacttaat

SEQ ID NO: 99382 - DNA, 701 bp, Oryza sativa
tgataagagtagttagaggaaaagtagtactatataatttgaatttttcccacaaaatttgaatgatagagttgcattttttttacggacagagtatatatatattaatctagagagaaatttcatttgttctcatggaataaaagtaagatggcttttaagaaatcaatagagattatttaacttatacaccatggatctatatatcataaacttaatttgcttaaaaagatccttcaatgagatgatgtagtgattaatttgatgcatctgagcatatctatattttcgttcctatccttttttaggggtagctataatggctatgcatatcttttcaattctatccttttttatgggtagctatattggctatgcttcttttttggatgcattaattttgctcaacctattcataaaactaaaataaagtttcaagacgcgcctagaaatttttttctatgggcgtggtgtgtctagaagttgcctacttgccttcaaatgaaatgggggaaaaacgcctagacatgataccaatcaacgagtaactcgttttacctactcagtgtaaaatcccattgagagagagggggggggggggggggggaagaaggaagggaaccgtaaagcccatttaagcggcttccctcctgccatgacacaagtgggcctttggccttatggccttctccatcatgggt

SEQ ID NO: 99383 - DNA, 732 bp, Oryza sativa
aaataatttgtgaaatgttgtttcatttattaaaaatacttcccttgctcaaacaattcccagaaaattctagaaaatagaggaacaagcaaagtatttaataaaattttatctagctcaattttatgttgaaaattttcctagataattagggtttagcttgtaggcttttaaaataatttctaaaaatgatttaaacaatgtatttttaatttagttgatttttagggcgtgacaaccaacaaaaccatgcacccacagcccaccatgtgatttattttaattgacccacaccgaagcggtggcattaatccaacattaccattagaacctacagtctatacattaataggattttccccattgtgtgctagttgaactaagcatggctaagcaatccctagtccaatatctagtcatgttatatcccaagctaacaaaggagcatggtaccaaaatagcatggctgtaacagtaggtaaacatctcatagtattactgtaaaacaatgcagtatttgatggaaaacattagaacatttgcaatataggatcaacatgttcaagtgacaagcatgacttgccttgctctgctgctggaggaacctcggcgactatctcaaagtacaccggagcgtcaggagagccggaatctaagcgacatacaaggcaaaccattcaaacaggctataagactactgaaacaaagaacaaaaccatgttaatggattct

SEQ ID NO: 99384 - DNA, 695 bp, Oryza sativa
atgcatatttccttctactggtggtggagggctttttaattaaactgatagtttacataatatttgcaggatatcatgcatcggtcgatcgatagcactgcaaaagcctatatatctacttgatgcctaactcgcagtgagctggctgatgtttatcgggtaaaccaacggcggggatccatcaaacgcaaccttggagagtctcttggccgtgaactacgtcggatggaccatgtgccacaacatgtatcttgttcgggtggcgcaataccagcttgcccgagtgcactggaacatggcgctgttgtaccctaagccatagcttgctgctttcacctcagtattacctaataaaaataaaagaaacaaccccacgatggcattggattaattcataagagatgtatttttaatatgaaatataaaatattaaatgtagaccctaattcaccaaattacatagttaaaaccttggctcgcactcaaatggaccgattatttagtgacgagattatcagaaaatgcccaattttagcccaaatattacaaactacatttttactattaaagagactacaaaactactgattccaatctttcaatccttaccactaccgttatatatgttggagctctaagttgccgctttgatattgtattggtacatgcaggtctaatgcaaatctactagttag

SEQ ID NO: 99385 - DNA, 726 bp, Oryza sativa
atagtctgactgctagcacaagaccgctcgaacttagggttggggcaatagtctggaacgacggacccactggtaaactcggaaacgatataaagctggagccaaaagagaacgtggttaagagaacgatgataaaactgactgacaccacgctctctgttagataccaacactgattaatatacgcgcaacgtggacggagtacgctcagatgacggggcacaaaactggaaccggcgcgactctcatgtcaaaatgagtgaagggattagcgtgaaccactatccccacatttgtccgcgaccttgggatacgactgcgatcactggaaaaattatagttgattgactgattactaatgagactccacaataatactgtaagtgcgcttgtcagtagcgcgatgcaaccaatgcactgcttgtttttgattatgacactattgctgcgtgacatcgatgagcatgcatgtctgactaggggacatgacgacatgtgactgtgaggagaatactggcataacctggatattcggttgtgtgcactgcaccgattgaaactatgatctgcggatgcacaggatagagaaatcatgtgtgatgtcaaaattactcgttgacctatatgtgagcgctactatatctggtctgtatctatgcaagcgtgtctctgtcacatatcacatgagatcgaccacgacggtaggtcaggatctagtgtcgttgt

SEQ ID NO: 99386 - DNA, 759 bp, Oryza sativa
caggtttgatgactcaccgggatggtacatagttcatcaagttctcatttgctttgtgcaactaaatagtataccttatttacggcctcttctttttttccccctcttttcatgtcattatcaaagagagaggagattaggagggagtgagagagtggcgatcggtgatggactgacacgtatgatcaatggccgaaggagaagcggtcggcgatggtgatggattggtggaagttgcacctttgaccttaggggcaaacaccgtctgggaagactatgcggtacacctgagtattgtaacgagggctgcggatgatggagcgtaacttcgtgacagattaagcaaacttgttctgttttttgcaagggcaagacaaccactaaatctagttgttgagagagagataatagaacatcatgtgtgtgtcacgattgttctacagcccaaccatgggcggctactccgtagtcagatctaactttgtgctaggcatcatgatgaaccgcgaagaaccacaggctcgcactgatgttaggctttaaatatttggaccatccgactcggtaagattgagattggggatctatctccagtttccatcgccgtctatgagtccgagctcattactactcaatggtctacaagatggatgtgagttatcacgattctattatcaactgatcatggacgcgacgaatgtcgtaccagtccatcttggtgtttggcgtcagcacgttatcaatgttcatttgaagaaa

SEQ ID NO: 99387 - DNA, 760 bp, Oryza sativa
cacggattgattgactagacggtacagtagttcatcattaggggtataaaccttagatgtatctaaatactatatataaaaaatatttgaattcaaattcaaaatagaatcgtatatatttcaaattcaaatctgaagggcggatataaacttttgattcataaactatgggtctataaattttagatgtataaactttaaacgtattgaaatactatctatatcaaaaatatttgcattcaaatttaaatctaaatcggatatataaacttttgatttataaactttgggactctaaactttagatgtgtaaacttgaggtgtacaaactttaagtgcataaatgtactaaaataggaaagtaatgcggtgccaaaaaaggaaactaggtggggggagggaattgtatcagatcgcccctagcactcaatcgctaggtagcattcccggtgtttaggaagtgggctcatcatgttttgaagaatacagacacacatttgcaggattaaacgtcaactaattacaaaacaaattacaggttccgcatggaaactggtagacgaatttatttagcctaattaatgcgccattagcaaatatttaccggaccatcgcattggcaaatcatcgcggaattaggctcaaaaggttcgtcttgtgatttacatgcagactgcgcaatcgatgttttgttactttcacatatactggtctatgcatgtgatcaaacatttgacgtgacggaaaaggtgaaaggttg

SEQ ID NO: 99388 - DNA, 507 bp, Oryza sativa
aacatgtttgaccgttcgtcttattcaaaaaatttaagtaattattaattcttttcctatcatttgattcattgttaaatatatttttatgtaggcatataattttacatctttcacaaaagtttttgaataagacgaacggtcaaacatgtgctaaaaagtcaacagtgtcaaacatttcgaaacggagggagtatatatataattgagtaaatttcatgaaacaaaatatattttgagaaattccgtacagatttaacaccaaattacatattgaacatgttattggttggggctctagccccagctctctggttggcaggaatctaatcccatatatctgttgcgtagtgagttcatagtgccagcaaaatttgcacagcaaccagcatacggccaagcagtgatggctagttggctggagacgttcagggtgaaagaaatgatgtgcatgaaaaaacattaggctgtttattactagctggatcatttgtgaattgtgatcat

SEQ ID NO: 99389 - DNA, 558 bp, Oryza sativa
cgaattcgagctcggtacccgacttcaataaatgtgttctccttatctttgtttggtctttttattttattggatgtgtttaatttcgtttgaactacatcttttgttagagtgatactttgtaataattggctgtagctctgatgagcaaaggccgggatgtttattccattatctaaaaaaatgtatagcggtcctctcaatgctagacacttaattacactcgctcacttattatattgctggagtccaaaatactcgctgatgtatccctctgcatttagagtttgtttggttcttggccacgttttgccaaacctaagcttaggcatgcaacaagtgcttaggttggtgtttgcttttctactaaccataggcttgccttaacttgataggcatgtttctgcttgctcgctgtgtcttgttttgccaaatctgtggcgttctttttctctgccacaagtgcggcaactagcttaccttaggcgtggcaattttagtcccaaaccaaacaggcccttagtccgtccccctaggctcctagctatctctcctaat

SEQ ID NO: 99390 - DNA, 704 bp, Oryza sativa
aaaacaaagttgtagaactcattgaatatatcctttttttttgttatttctccatccgagtattattgaactatataaaatttgaattttaaaatacaaaaaattgaaataatttttcgggtagtagttgtataatgcatcaatatctataacttttgttttggtcatttttctatatgactttgtttgaacaatttgaatttgaatttcaaaatataacaacttgagacaatattttcaaatactaaatgattttaactgaaaaagacatcaacaacaaagttatataactcttcaaaatctacaaaaaatctacaaactgatcgtaacattgtaaatttggttttataaagtataagagagatatgctaattttgtgtactgttactatcactttgtcggatgaaaaaatgaccaaaataaatgagttctacaacttatattttcatgactttttcagcggaaattgtttattgcttcaaaatattatttgaagttttgaaattcaaaatttcaatttataaaacaaagtcagaagaaaaaatgccaaaataatagcagtaagaacataataacatgatagaagcatggttttataaacatttagaaaaaagaatcatccaatttgaagtgtatatgaatgagataaactagttctaaattttcaaattttattttcaaattttgaaaattttatttttaaa

SEQ ID NO: 99391 - DNA, 577 bp, Oryza sativa
atttaataaaaattaaatccatccatgctttatatttaggaaattttatttcccacatttaacttcacatgaaaattaaagaacatttaatataaattctaataataatttattaaataatttataaatcctgaaacaaaaatcaggatgtgacatccccccttcgacagaaggatttggaaggggcgaaggccctagttgcattctcctcgggcaaggcggcgaaaggaggtccggtgcaagggccgaacgtggccgacgtggcgaaagcggctgcggctgcaagggcactccaaattagggcggagatcctttcgacaagccaactggtggtgccccaagccactccatcgcatgcggcagcagccccaactgcgctcgccggtgtgcaggcccaagttagccctgaccccgaaacacaagccgaagccgacatggaagccatgcgacagaacatgacatggctccaagacatgcttcggcaaatgcaagaacaaccaccagcatacgaggcggcaagggggaccaaaggcacgtcggcttcaatcttcagtattccgcaggttatgtcacacct

SEQ ID NO: 99392 - DNA, 584 bp, Oryza sativa
catgatacaaatgctattaatggtttccttttacattctctatcttgaggaaaacaactgtacgaacgaaaattgccatatggaaataaaaccaacaagatgttgaagaatctgaaggaactttggtacgcgatgttgatcattctttaaccaaagcccttaataagaggacatgcaagcggctggacttctcgctataccctctccatttcttgttatatgtcactttaacttttttttctagttagatattttcaagtttgattaaatttataggaaaaatagcaatactttaaacacaaaacaaacatattatcaaaatataattaatatgaagataatttggtgttacagatgttgctagatttttctataatcttgatcaaactaaaaaaacaacctataaaatgaaacggattggagttagtatttgatatttctggtggactagcatggtatatctgccaaccttaaggtcactagcccaacagtagcactgtatgggcttgtgatatagacaatgagcacagcatcgaattactctgaatctgtctcgctctaaaatcaatacataatgaatcact

SEQ ID NO: 99393 - DNA, 656 bp, Oryza sativa
  unsure (1)..(656): unsure at all n locations
cgcgtgagtagacaccttctagnagcncaccatatttccgctgttgtcctgagattgacatttgaagtgaaatgatgaaatggacattcacagtcacatgctcaggtggttaatttgtaagcatcgcaatgctttagtgctacataaaacaagctttgggcatgaatattggcactgggagttgacaattgatcttgcatgatgttagggtggtaaaaccccaataatccagataagaaggattttacaggatgggaggatactacaaactacctttgattctgcaaccctgatggatagcatgcctattcccctttgggatctttgacttattcttcctttacattacattggtttgcatgagattgatgtaatatgtatgatggcttttgctaattcagttatttttggtcatacagtgatgcattggctggttctttgaggattcattatgcataatgggattctactgcagctatgcttttgaacttgcctaaagccggaaaaccaattggagaatggttcctttcaggtgcaagggcagcatgcattggtgtagatgtttatcctagtcactttgcatccctattgaaggaatgcaagtcttgcaatacagntcattaaattcaccaacagataattgcttctggtcttct

SEQ ID NO: 99394 - DNA, 513 bp, Oryza sativa
cacaccgaaggtacctgtactattcacaccacgacctgcacaaagaccgggtagacaccattgacgaccagctctgccacctagccggactagcagagctgcaccgagttgtgaagccataccgttggcatcattggacttccaagctctgccgaacgacctcgcaccggagttttggccttgcccgaccccaactgggacgcgccagatatgactagaaggggccaaatctggtcgtccctcttgctaccatcatgaccatcgccagccaccaccgcaataggggatttggcctctcacgttggagagatgcctggatcttgccggagaggggggagggagggaggcaccaccaccgttggccaccaccacagggggccgcatttccgttggaggcgaggcaggcgagacgcgccttcgcctccgtattcgccaacagaggtgacacatgagtctgatttttcgttaatcctctattactataaagttagaacccactaaatcctaaagctt

SEQ ID NO: 99395 - DNA, 1047 bp, Oryza sativa
tggatcaaagctcttttgtctccttggtataaaaaatggttgtgactatgtctctaatattttagtaaatgttttctttattatcagaaggacagataatggaatgatttcttggtcctgacataaagggctatcttcaaatatgtgcgtgctgtttgatatgaattgaacatatggtactctcctacagtagtaaacccatggagaaacactcctgggttgatggtactgtttataagagagttcatatataaataaagcacatctctgcacgccaaattgaacagaagctgcacagcagatcagtctgtttgaatgtaaaattttagtactgatgacaataggacaggaaagggaacttgcttaggttgctgaggagactgttgttcatcggaatgagagacagtgggaatatcaattgtacgctgaacctggtcccgacttagcctttaattacagttgaagtttagctcaaacagatatgatcggctaggtgtcaaatatggtgacatcactaggagagttttctttcattctccgttctagctaatgtcttcacattaaagagaaatgagaaacattattggtcttaccaagcttgaatgtcacgggtttctctttattaatgcatgtatagaaacattatgcaatgtgctcattgcaatcttgacactacccattcacaagtgacatgagccctatttgtagcaataaactatcatggagatagatttagccgtgtggatttcgctagccatgcaatggcatctttttattaaaaaaatctcacaaccatgtgttttcttgtagaactttagtattgacaatggtgagcattttgtagagcagatgcaagatgaccgtggctcatccgaatgggaaaccgtatgaacttctgaactgttgccataattcgttcaacacatttgatgctacttgcatgcctctaaaagaaaaaaaaaacaaggttctctacgtttcaactgatcatacacatgcgatctcttgtttcaactgacgaaaaggtgtcatcacgttaatcaaagt

SEQ ID NO: 99396 - DNA, 900 bp, Oryza sativa
tattcgctgccacttcgccgacgccgctcaatcctgctctgcgagacggtgccgcacgcgccaatgcgacgccgtcctccggtcgtccgcccgtccccgcgacctccgaccatccccgcggcggcgccacacgcacggccaggccagcaggcagcagcttgccatcgcacaagccgcctaggcgcctgcactaccccagtggcccagcctgtcggtggctagccggctaggcagccaacctcatcttcatcagttaggccatgaacgaatagaattgtctaagcctcctagattccttagaaaggctcagtgatttatcagcggtatgtcttctcatatatttattattatttaaagattttatccaccatgctttatgaattgactcatatttacaaattgacatgtttattgttatcttttggtgtataatgaattatgtatggcgcaattttttttgtctgcctgaatttattgattatactatttttttatacgattacaatataaatatggtatttgttgtgtttagttgtccttatgaagcgagcatttccgccccaactcttttttaatcctgcgtctgccactgaatagtgcacatgtggtttgtcacctgaaaccaacacgatgcaaagaaagataggaaaaacatgtctgcctcgttaggacaacaaatatcgtgggaaaagattcatcttctggcatgagatcctgtgggaaaattaaagttttactatgtttcatgcttcaactatttcatatggtactgtaggctgaatcgacaaaaaacccattttccttgcacttaagatttttctttttcttgtgttgaacatagatcttttttcaattgatccactcagatcttgtttttctagtagctcattttctagatag

SEQ ID NO: 99397 - DNA, 733 bp, Oryza sativa
atagcactcccaaatcaacatggagcaggtaggtatagtgtgcgttcgattccctgtgtaatctatggggtcaaaacatggctcctattatttcctaagcaaaagttgaaagaaggaaaactaaagaaaccgagtctaggtactttattgtctaacagatcatttccagatgaagcttccgtttcagcttccaacgaatgcaccaaagtctatctactatcccactggaatccaatgcgtaaccctaatatatttccaatgatcttggtgggttcagaacttacgattttgctggtgcagatcaagcatatgtgcaaacaaaagacgagactgtgtttgggttgtgcgagactttcggatggagacaagacaaccgcatctctgcctttgcggcatttctccgaacacctctgcggcgcttgtctcatctttggactcctcatctcgcatatcaggcgcatcctcaaactggtaagcagagcggtgggaaaacgagacggagttggcggcgagcttgatctcgcgccgaccgttgtcgcacccgccattgctgcgccagcggctgcggcaggtgatggggtggcaaggcctcagggagatcctcaactgccgaggtgctccgcttcatagaccgagcaccaccagcgtccaggccgccaccgcggttcccgtctgccatatggttcccctcgtcgtcgtcgtcgccggcgacggcgacggcacgcacccgccg

SEQ ID NO: 99398 - DNA, 648 bp, Oryza sativa
ctactttgtttatgatcccacgcttactaattacatcgtacttacactaaaattacatataattacatatgtaattttgtgacttacatcataaatatactaaaattacatatgtaattttattacttacatcataaatacactaaaattacatatgtaatttttggaacttacaatgtaaatacatgccgacttttttttttttgaatattatgacatcatatcatagttactccctaaatttaaatagatgagattaaatttagctgttagatgtttatcctatggctcgaaaaatctgcacaataggaggctagaaaatatgtcacaggcagtcccattaaacataccaatttggtgtgatcaacgaacacaattaaacataacaatttcagttatttataaattgtatttctatatttttagaaatcccgtcaaacgctgccactatacattctctatgacccatctgccggctactttttattgtcattgggactctaaaaatcgaatataactatcggtggaatttaatttttacttatagaagtcccaccaaccatcgacgggtctggcattgtacttctgtaccaaccggccgctggctcttaattttggtggcattgagaatttaaaaaataaatatga

SEQ ID NO: 99399 - DNA, 573 bp, Oryza sativa
tcattttcaccggatatgtcctcggatagaaatgtctaaaacaaaattgcaaaccctggtattttaggactttataaaaagtacaagttatatatgaaacaagttttcgtccaaacagtactcactaattagtggacatgttaatttgtggttgatatatactctagtaacggtcactaggcagtcagcacatcattggtccatgtccatccatccgtagggatggggtggtggtggtgtggaaattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctacatattccgttagggatatagattatcttttgtaatacggactccttcctatatataaggggggtccgggtgcctctaggggcatatgttggctttctccaaatcatacaatcaacaagacactcggcggattcatccccggacaggagtagggtattacttctt

SEQ ID NO: 99400 - DNA, 642 bp, Oryza sativa
gggggccccccacagtacaacattgccctagcggaggccggcaagggggccgcctgcaaaattccatgccccccctcgccgcccatttgcaggcggccccccgcacagtagaaaaccgccctagcggagggcggcaagggggccgcctgctaatttcgttgacggccgtcgcccgagagcgaacggccggctgccacgtcatttacgccgccctctgggagggcgatttttaaaaatcgccctcccagagggcggtaggcgactatttccgtcaattttcaaattggaaaattatttttgtaaaacttttaataaaaaaaattataaataaaaaaaattccagaaacagatgtacgatgcgaaattccagatttgcccttccacttaatcagcacaacgcggatggaggggaggtacgcccatcggcattacggtacctggcggtaccgacgttcgttagccgtcggatgggttccaatggacgtacatgattttggtacctcctctcctgctggaccataaaattctttttaattttaaggagctcgcaaaggcaagcaacaactttgcccctgatagaaagatcggtgaaggtggcttcggctcggtgtacatgggatgtcttcccgatgggcgggtggt

SEQ ID NO: 99401 - DNA, 606 bp, Oryza sativa
ccatgattgtttacggtcgttagcgatcagttccgaccgtcgatatcaccaaaatagagaactagttatgcttgcaatgcatatccatgttagaataataatattgcactagtgtttggttcactaaccttttgcagagaataaccataaagtggaggagaattgacatcaactcagacgataaatcaatcggacgatgttgagaatcagacttgtgcatgaatgggccaagaactcagaattgacacgatgaattgggcgaaaattcacaagtctacgaagaaaagcagcagaggaggccgccagccaaaacttgggctggttgggccgacccctggttcgaccgaatcccccagcgccgttggatgcagggttgcgactggacgctgtggattagctcccaatgacggttggagggtattttcgaccattccaaccgtcattgggaggctatataaacccctccctctcttcacttcaacacacacctcaagcaaagctctctcctattctctcaagtttagtttagtgttcccaagctagtggaatgggaatagagtagaaatcagagggtttggctctagtagctcttctcttctcttgtgt

SEQ ID NO: 99402 - DNA, 1055 bp, Oryza sativa
  unsure (1)..(1055): unsure at all n locations
aagaacgtgtggaaaaagaaaaaaaaaaaaaatggtgaccaaaaggggaaaaccacaaaaaagggcaaggagagtgaacaaaaaaaagatgggaagacaaaagaagaatggcatgaatggcgaaagcgggaaatgtttatcgtcgccacaacttggtgtccttcgcgctgccactgatcgaggcgggggaggtgtggaaggtgctggacaagcggccggcagcggagccaacgccgaggcagctggaggcagcggaactggtggcgcagatggcagtacgctgcctgctgctgcagtgggaggagcggccgcccatttcggaagtcgtggccaacctcgagaacgcgctcgagctcgcccattgcgacggttagcatagcctgngctcccgagacatcctatgtgaattgggcaatgtatttctcatgtaaaaattaatgctgtttgcttctgtttctcttttgtgagcatacacaattaaacatcggaactgctaatggtctgttgacagaaaatagggtgctaaatctgtcacttttttaccattcatctttgtttaaaattcatgctgcatttggattcaatggattgagcaaagtcaggcacggttgtggactttgagatggattgggtttttgctagactttgttgttgtgttctgtgggtcccacatttacggttcaatttcgaaacacacgcctgcttttttgctttttttcctcacatttgaacagtgttttctattgctactttgtttatgatcccacgcttactaattacatcgtacttacactaaaattacatataattacatatgtaattttgtgacttacatcataaatatactaaaattacatatgtaattttattacttacatcataaatacactaaaattacatatgtaatttttggaacttacaatgtaaatacatgccgacttttttttttttgaatattatgacatcatatcataggtactccctaaatttaaatagatgagaataaaatttacctggtaagatgttaatcctatggctcgaaaaatctgcacaat

SEQ ID NO: 99403 - DNA, 615 bp, Oryza sativa
tatgcctgtaacgttcttctcttcttcagggagcagggttgcagcttaattggaatcttctgcacatcagcacatccacctcattgtcaaattaaattcgacttcaggtttctcaaagaaacgtagatggaccttagaatatcattacagggcatacgcatatactttattcaagcttattaattattactccctcgctcatgcagatcgtatgaagagcatactgagatacaagatggaggaaacatgaaggactacagtacatagacatgcagaaaagagaaagacaatacagactcgatggtgatcacactacactacaactgaatgattgaatccaatgaagcttaggaacggtaagatatacatgtccaaatctgaatttgatgaagaaactaaactaattaaacgatcacatcaaggagtagtaggggacgagggattaattgttccgtccagcgtatcttgcggggctgtggcgaacgccagaagcgagccggtcgatcgtgtatatatatactaatataaaatatgatagtcataagaaaatttggaagtttaaaatacccctgaagataaaaatctttctctggctcatgctaaagggtaaaatct

SEQ ID NO: 99404 - DNA, 592 bp, Oryza sativa
ccaggcgactaaacgcagtccaggagaggtcctggtacgcgatctggtgagtgggcctgaccactgcgaagaggtgtggcgaaggccagctacgtgtatacctccacgggggtaaaggtatacagagagctcacagtgagggggaacacggtccacggagtaccccgtgtactcgggacaagagaagccaaggaaacgggcgaggtcactaagctgggcgacgtggtgaccctcaccaaaaccgtgggaactgaagctggcgttcactgccatctacaattttgaaggagggagaaagatcagtaaccattttagaaacaaactattgaaaataaagaaaacaaaagaaaccttagcttttcgcaagtagttttgaacttagtatacttagggtcgtcctaagcgtcgggtttcgccctagggccaagcttgtgctctgataccatctcttgtcatgccccgaactagttccgaccggaactagcccgtgacgctccaaataaacctgttaatcgataccagtcccagaagacagtgctggtatcacagggagacagaatatcacagcaacagaggtctctttattatagag

SEQ ID NO: 99405 - DNA, 697 bp, Oryza sativa
cgctaacatatgtgtgtataaaatagaagttaatgcattaaataatgcattttcattatttaaagtacaaagattaatgataattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaac

SEQ ID NO: 99406 - DNA, 615 bp, Oryza sativa
aatcgtttctggacgtggctggtgctggctttggcagaaaattcaaaccttcaacactgggtcaccggccccaaaattggcgcttaagaacccttatagttttttttaaaaaaagggacccaaagccttgctttggatattaacctaaaaaaattccccggcccttgcatggggggatggtaatttaaatcctataatggtaagggggataagctacgatgaaatttcgctgggggaattcgctttggatatttttttataaaaatcatgagctacaattaggagtccgacttccatctcaagttagcatgggagtttttttaaagaaatttcttatgcgactccgttttatatttccaaaagcaaacgaacttaaaatccgactcaaacatggatttgtatttccacaaacgaccgagctttaaaaccgacttaaatactgatgacgtaccaaaattccggcaaaaacatcttcaatttttataactagctgggtggcccgcgcaattgcgcggctagcacccatacacaattatatatttttttaatatgattttacttaaaatttattaaatatttatctcattgtcctaagactatgaaagaccaaacctt

SEQ ID NO: 99407 - DNA, 604 bp, Oryza sativa
aattctgtaccggcctggggttgaataaacccctgttagctaaatatctacacggttatatggatggttatcaaataatcaattgcatgtggtgcccatgttccaacaacgaacaatcatgccaatgattttaattggcccccaatcagattaattaactcctccgtacgtatctaggagtagctagctatctccatcgatatatgatgtttaagtttatatatagtacgtgtacactgcatttcgagttgagaacttacacattaatttgtgcttacagaaatctgaatgattctaccatgcaattatgctttaatttgtttattttatggacatattagaatgattctacggttttattttgaatattctaccagcgctgctaagaatgatctgtgctgagttgtatcaatcagagcaaggtttagtgcattctagctagcatggtaatggatgagcttgctagacagggtcaagatcaagcttgccaattgtatttcggaggccggttttgctcttgaaacagctctattaggcttggagatatacattaagatttgagaaatccaatcccaagcgagaaaacacacacacaaacaaaagg

SEQ ID NO: 99408 - DNA, 2198 bp, Oryza sativa
tgcatataaaattcatctcaactcattttagggtaaattcacattccacagaatcaccaatttgttttctactgtaaagtgaaataaaataatatacttactttgtacctaatgcctctaaaactattatctttaaaatgaatagttttagataagttgaactttagaagtttatataaaattcatcttagatcctttttgagtaaacccaagttctatagagtcatcaaaacatatacttccaagttgtaaaataaaatcatatacttactgtataataaaagcctcaaatatttatgtaaggaataaccaacattgagcagcctttaatttgtaaaatttgtagaaaattcatctttagtccaaatagagtgaaccaagtttctatagaaccagaaaatggtaagcttcaacatagtaaataaaatatggcactttttgtacaggttatagctctaatctttaattagataccctaggagttaatcacctagtattggttaagcaaaatatatgtgtagaagtatttaagatgaactctagctatgaataaaccaaaaataaaacttgttagaccagagaggtcatagttccaaccttaattcccaaagacttagcaaacttaactcataacaatttctaggttggtaggttaagtaactaacatagaccatccctatttataaaatatgtagtaaaataatataaactctaaaattatgaactaagattagattagctaactaaaatactcattttatacatcactagcaagttagagcaagttctggacctaaatctccaaaaccatgtacacatagagactatatgcctagaacacgttataacttgtaaaatacataaagaattcatgttaactctagaaattgtgaaaccaaatttgttagtcttagaaaacacatatcttcacctcagcaaacataaacttaataagaatcaccttacaacagcatttcacaatagtacctaagtaaatactaccctataccgagcaaacttataaaattcataactctcaaataaaaagagataaaatagaaattctttcacctaaattcatattatactagtacctatccattatgcacaaatcaagcattttagagcattctggatttttcgcatatttcggtgtttaattgcataacgtgtactttgtatagatgattgcttaaacggtgaagaagtgaattaggtgctgacattttccagttgcaaggcaagtcccacctccctctctttgatcactttgaacctatgttttgaaggttattgaaaatatttgcaaatcttgcatgtcgattggacactaataaattaaaattttgttaaacttgttagacaaactcctattacttgcattatcaccctaaccccacatatatccatatcccacattcctacccttaggaacaatatgactatgccacttatatatgagtttagatgtcactagattgctataatgcttagccatgcttagtatgtgtagtacttgtcatttgggctcttattaacttgaaaaaatgattttattcaagttttggacagaaatgaataaatgaggaatttgacaaacaaagcatatggccatcaaagtaggcattaatcatatataaatatgcacctcattgccatccatagtagcaaggagatcattcttaaatctcatcacattttgaagttaaatttcagcatttagaagattaaacataagtctatactcaacacatatccacataccgctcataaccgtgagcacggctaatcgattagtttttagactctgctgagcttgtacagctttacccacataatgtgaatcgctctagtttgtccgatacccgtcggtaccaccacactctacacattaagcgagtctagaggtcacaacgaggcttttacattaagtcttgtctaatccttgcatgagcacaatgagtgttgttccacactaattctagaatcttaatgtcattatattggggggtctttaccaatataacgccataggcaagccggtacaatcgcttcctatgtggcactcaacgttgtacgtgaggcggaacattacagtcgtcccctcacgcggaacagtacagtcgttccctaccaaaccataaatacaagtgaggcggaacgttacagtcgtcccctcataatcatgaactactgta

SEQ ID NO: 99409 - DNA, 531 bp, Oryza sativa
agaaatagaatataatcttcagtccttggagtcttcgaaagagttcgggtgtggctcttatagctttttcttcttttgtcagacttgtactatttatagaatattcttctcaatatatttacggtactttacttcactctgatcatttgagtaccgactttatgaaatattattcgagttataatttcatagttagcttactcgagagatgcaatggtgtgggtataatgttcatttgtatgaatgctctaagtcaggacggtgattgtagagtagtatttggtagcataagtgaggtgcttaacctattgaatatcattatttggggttatatgctgtggatacgtcgagttgggccgctgatggtgacatctcagtatgggtattcctccgcgcatgtattaatcctaagtacaatttcctaggaagggtactcctccgtatttagccccggttggatggccaagacgggttgtcgtaagaaactctaggggtggtctctcaaaacaccaggagggcatcataaggggg

SEQ ID NO: 99410 - DNA, 560 bp, Oryza sativa
aaccaaaccctggcagctaaggcaaatccaccataaaatcgataaaatcaatccttgaagccatcaactgactgattctctctggaatatactatagctgcttctccaaaggacatgcttcttctagtgcttatatgttcattatcggcataatcagttggcaaagccgatagagctagtgatggactgtcaagtgccaagatggtatgcatattgatccaaagttgcaagaaccaccaaggacctccataattgatcacttcatctttcacaatgttacaagcggcagagtgaagcatctgataaactgagcaagcagatactttcccaaaggaatgtgcttcttctggaccaggaactgagcgaaatgttgatagttgactgttggcccacaagttgaaccgcagaatacatctctctccaaccacttggccaagaatgcaacatgttccctttcagaaacagatcctgtgcctttatgttttgctatgtatcctttccaacctccatggatctgttttgtcttaagagtatgatcacacttgatgtctagctgaaag

SEQ ID NO: 99411 - DNA, 533 bp, Oryza sativa
cagtagtccatcatgatgccttcttggataatgaagttatgggcgaagaggttgatgttgtgtcaccactcgaagtttcccattttccgtagtttctagttcaccaataaatcatctatagaaattgctttcgttaaccaggagaaaacccaaattaacaatgtatttaataaccggaaatgtcaatgagaatattttttgaattctctttgctctaaaatcattaacaggacataaagtggatattcagagcatcggatttaatcttgttaatttaaattgttaatatttgagttaataataatttttctctcccgcctttggccgtgaatcgttcccgattcactcctctctctgtccgcggtttcgttttgcatgatgagccgtgtccgttttcgttcgcaggttccgttttcgttctttgcctaaaatggcaccacatttattttccaatttgggaaagtcctaatcctattctccctatccctatttttcctcccgctctccccctcgcactcggccaccgctccact

SEQ ID NO: 99412 - DNA, 594 bp, Oryza sativa
gactttgaacaattattcaactttgcattatctgatttgagcatttgctattcctttgctacgtatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattgga

SEQ ID NO: 99413 - DNA, 787 bp, Oryza sativa
  unsure (1)..(787): unsure at all n locations
acagtagttcatcaataatcacatagccaaaacccccttacgatgccctcctggtgtttcgagagaccacccctgggtgccgagttccttacgacaacccgccatgaccatccaaccggggctaaatatggaggagtaccctccccaggaaattgtaattaggattatatacacgcgcgaaggaatacccgtactgagctgtcacatcagcggcccacctctacgtatccgcagcatataaccccaaataatgatattcaatagcctaagcacatcgcttatgttaaatgattcacttgatctctcaaagtgtatgaatatgaattcctcaccaaattttcctttttgattcctactctaaagttgatatgtggagcttggtactctaaagtccaaggccaatcgtttcatgaggaggttgttgatgcgaaaaacacgaggcctgggagatctgcttaactccagtgtaggtccaaaaatcttgcctttaggttcgtgagcgtgccagttgattagatcctgcaatcaacaagaaataaagacaggaaaatagcagttaaatccataaatgatagccgatcagccaatcgccgatgacatatcatttatctttgagccgatgtcatatttgaatcgatcgacggatataaataagtaagaaagaactaaatctattcgatcggctgtagatattaacagtatgtaatccatatgtcgatatatacttaaatcaagtgattgggatagatcggtcgccatgccgagacagtatanatcacttacatcg

SEQ ID NO: 99414 - DNA, 789 bp, Oryza sativa
ttcattcttctaagatagttttagtcgattctcaatgttgggttcactgcaacctactattgtgcttcctgtgcatggtatacttggcatcctcccttttttgtttaaaatatctcatgaacatagctcatttttttaatgtggatatgctggaacccagggatctctgttgcacatcaatgtattagtaagtcggcatctaattttgaaaggttctaaagcagtaaccattgtttgtgctgccaccaaccttatatcgcttacatggcccaaccagccgcttgtgctacctacctaagcagtacatggttggacgctgattccccttgtttgtgacctagtagatcaccaaatttcagccaatttgccattttcattattttctgacaccattgctggttcctcatatacatagttattggagatgtaagtagggttgcttagttacctggagtatgattcttgcttcttaggaattctggtagcttcaccttttccagcggatgtttttggcaacgattgactattttgtttcatgtgcagtgcctcttttgattcgactatcaagctatgggaagttgagcaaggacgccttctgtacagcttggctggccacaggtatttgataccaggagaaaaaaaatacaccttttcaaaatacaaggcatattttgagtattaaatcaagggaaagatgggttgacttataaaagaaacggatggagttctttcttttggttgcttgcaatggctgaactcaacttattcgtgattgcaggcaacctgtgt

SEQ ID NO: 99415 - DNA, 692 bp, Oryza sativa
acaacaacaggcagcgctatagctatcagcaactggacagtatgtgcagtcatcattgaacccaccaaatcaagtagcctcaccataacagataaacaatacaatactagcaggaggattgagcaatcgtgctagagggagatcgaggggtacaccgggaatgtatttcatgagcacaccaccagatcagaggggagcaaacagatggacccaactaccacaatccctctatagagcacctctcctgtaggacgtggcaaaaatactgccgcactctttaagggcatagctgtgccacaatttggtcctcgtcactgaccagaggatgtctttggcctgcaaggatgatgagggatgatgatggaagaaatgcaattaggagagtctgagagtgacacatgcttgcagtttgcagtttggggagggagagtttggcgaggcagccccataggcccataattcgccatgatggtgtgtgcgggcaaggacatggggtgcacagcgcaattccttggaaggggaagtccatgcagcccgcttggttttctttcggtatccggttttctcaaggggttggatggttttcaagcagtgtccaccaggtttttcttgtggtattcgttttttaggtggggtggttttcatgctggatctccttggaagcccaatgtttccaagaggctgcagtttcc

SEQ ID NO: 99416 - DNA, 584 bp, Oryza sativa
acacatccacaaatagcatcacacaaggcaacccatgaccaaaaaccaccctacgacagcctagtgcccttgagttattgacctacaaaggaaaacttggagcacaagagctccagccgggcaccaaagcctagcttctgttgacactgcccgcagaatctccatgatgtttggatgttacattgaaacacatgatatttgcatgggcaaacagaaagcatgactcaatgtttgaacacaaataatatcacagcattcaactgaacagtgttcacattcattcaatacatcctgcagcatcaacaattttgcagccaaccaacgtatgactggataatggaagacagtcaactgaatcaaatagaataaatagaaggaactagatagactgaatgcaaggaacttcttgtttgctaactctataataaatttgagttgttgggctaattgggcccagctccaactagagctaaagatctcagccatgaaaagtacagtttactaccttctctctactaatggctggttgatctgatgtgtattatacttagaacttctatgcaagaggatttgttttgtatttt

SEQ ID NO: 99417 - DNA, 1251 bp, Oryza sativa
attgaattgcttccatacaatcaaatccctactgtgacaatatattggattttaactaagaaaatttataagctgaaaatgatacttagtactttgtccacatttctcaagtcgcaattgtcattctccgacttccaaaatacaccaaatgcatgttcaattgtcattctggtgtctgcattctttgcaagcacaagtgttatattaaattgagcaatctcacgcttttagatgcaataagataattctttgatggtcctgtttggtttcgggctaatattggctattacacaaagaaaaccaagtcaaaaaacttgacattaccaaaaaaaaaggtaaccagtttggtaagtatgtcttcataaatgaactggagagctaatgtggcatgttacccaaaactttcgcgaaccaagtgaaagataaatgtggtaactcttgcataattcgtcaaatcatcatattaatttgcatgttgctttgactgtaatatttatagtaaaacatacagaaaaccgatggacataattacataaggacattttcaagcattatcttgcaaatgctctgctgatccgcaacaaatgaaaacttgtcaacattgtaaaataatcagtaattaacatatttatcgcaaagaaaagacacgcacatatcaaacaactgtcacaaaaacatttctcaagttaacaaataaagttatcaagattcaatcatctgtagactgtagctactaaagtttactcacagtatgctgaaaactgtaagatggaatcgtaagggaaatgcagcaaacagatattagttaattacctccaccagcaagagaatcttcttcagccttaaccttatcaatacgctctgtgtgcagcttttctttctctttatcttgatccctgtctctttcagctctgtctttctccttctctaactctttttcttggtcatggcgctccctctcccgttcacccccagggcgtcgttcatgctcctccatacgttccttttcttttcccttgtccttgtcacggtcactttgagtcttctcccttttccttttcttaacaatctgttgcaactcttcaacattttttgtgattatttcaagaggttcaagaagggcaaaatccttcgcaagatcttcatcattctgcaacaagataaagagcatgatgtagcatgcatcagaaaaggtaatgaacactagaagacaaacaaacttacttcatccgtatttgcttctagttctat

SEQ ID NO: 99418 - DNA, 593 bp, Oryza sativa
ttttatgtagattccttatagataaatgtgggcaaaagtctgccgcaaagacttatggtatcttagagtttgttagagataatggtcgtgtccggtatgggcaatcttgtaattctcgggtataaatagaccctgagccctatgtaaatgataacacacacgttcaatacaattttggcgcatcgccaccctttttactttagttttgtttcgacgagttcttgctttcaggttgagctgcatagatttcgatcttcaacaagaggtaaaattcgttatgacggcttgtattcataggattagtgcttccatctttatgatactctaatcttgtttatgtaattcgtcgagttatcacatatcttatataatctctagcaataccgccatctaacctactatcggctaacatctgttagcagagggcagccgattaggttagattttgacgtcgatctagattatataagatatataccactctatgagacttctagcggcttgattgtctagatattgttcttcttttcatacttaatgctgcatcagctgagtttgatctattaagtcgtgcttagaatatcaatctctag

SEQ ID NO: 99419 - DNA, 552 bp, Oryza sativa
aggtagagagtgaggggaagctttggaggactgcccgaaagtttggcgctccatccgacttctatctcaacgagtgtagctttctaggaggaattctggaggagtaccggagttgtcggcacatgtcacgcccagaaatttagcccaaatttccagactattttgtgtattaaatccttgtccaggaccagccagggtacacaaaatgacaagtaataaacagctccaaacgtaaataaagcataaaatacttatagaagaggcacttagtcctcacaccgaaacaaaagcagcagcagcggaaaaggcgatcctagcggggcttcagctccactccacaggcaaaactcaactggggtctgagccttggtcttctaacttcgtcttcagctcagaagcactacacttctgaaaagggggaataatagcaagactgagtacaaccaccgtactcagcaagccacaccaacgatgcagacgtgcaaggggatacaaggaggggtttgtggctatttgcataaatgcggttgtaaatcattttattgagcaaaa

SEQ ID NO: 99420 - DNA, 693 bp, Oryza sativa
ttcctgcagcccaaatcgattgtggtcaagggactatctgaagaattcgcgaacattgtatcaatgaaaaattattcacccttcgtcaaaaagaaagaaaagcccacgacaaacatgaaacaaacatcactggggttcagactttcagaacagaagctgtgattgtttcacgaccacacacaaccatcggtctcaagcacattacgctcctttctccatggctacacaaactacagaactcgtgagaagcaggccacggtagcatggctcattgctggccacacgcaagcccgaaaatatcatttgctacagtccaggtgaaaaaaagatctttgcttcaccatagcatccaggaaaggtgcaatttactgtagcaaaaaaaaaaaaaacagaaattttgatcacttcaattcaggattcagcaaacgggttcaccaaacggaattcgcataggagcatatcgatcatgaagttagtacagcaatgggatcgagtttttggtttcagttgaaagcgatccagccagtagtattgtagtacagcacattgaaatgattaagacagcgattacaaacaattgctgaaattgacaacacagttccgaacttctagtcgtaagtagctgtcgacattattatggagtaatgaaccgttgaacttgatcatcagatatatatacagaattttaacttt

SEQ ID NO: 99421 - DNA, 526 bp, Oryza sativa
tttaagtcctcttattttattaattaatattcctcgattttttaccttatgaactatagaattccttatatgccactccaaattaactggttcccttatatgccacttcaaattggcttctcccttctatgccaccggttcaagtttgtcctcccttttatgccattgccgtcactccaccgccagttgaccgctaacttcatagtaaaaagacgcatttgcccttgagagttggtatacaaccaatggtaggtattttagtactaatatagctactggatacaacatatgaaaattgatttttttttcatcacatgcaattttagccatcaccatcacaaataaattttcaatataagcacaaaacatatagttttccaacaatacttatacaaagagcatttttcactggttctgacaaaattttgttcactcaaaaaagatttaaaataaattagttatgatttttttgaaatttacacatttttttagttgagagggcatattggtcatttaaaaaactaac

SEQ ID NO: 99422 - DNA, 599 bp, Oryza sativa
tgtaaccatctctagaatgaactgggtattatggtcactcattacgctccgcatccccttggtgttggcctttttgctgtcagatcaactcttattagagatacattagttgcagcctttggtttttattataatgggggtcatgtggttaggtttgtgaaccatgatagaggtactaactggagagctgctcatgctgacaaaggagtgtggattatgtttctagggtatcctctagacttccgctctacaagttacatctctagagctatgggtttgtttggaaagttagactacttgcaggaggttgatgctatccctggtcgtgttctgttgcaggcatattttgatggtgttgatttggtccaaggaagaattgttcttaaatagattcctaatcatggtggtcaaggggaatcgtggacctttggagtgcttaacttaaataataagtttgctaatccacaaccgcaagatgaagatttgccccctattggtgtcccgcaacccgcaccaggccccactcaacatcaaggtccagcttgggatgatattaatgagcagcaagaggatgtagggggatgggataactaggatca

SEQ ID NO: 99423 - DNA, 583 bp, Oryza sativa
ttcccatgcaccaacggttattaaaatcctcgggtccaactaaaaggaatgaaacggaagttagtaaaagaaacagacaacatcgaaccctattatatatatgggcatgtttggattgctaccctaccagtggtagtgccaaatcttgggcaagttttattactatcaacattttgttagagatttctagggagagatttctattgatttggcaagttatggaatcaatccaaacatcacacaagtactatttagactacctgttggtagtgcaagatttggcactaaaaccaaaacagccctatgtttccctggacacatcagatcccaagattgtgccctagcagaccctattttccccagggcggcacatctccaccacaatagcaccgaaccacactagagctactaaacatccagcagcggtaaatctcccacccacacgaaaatcctctcgacgtaaataaacacaaacaaaagaacctaatatccccaacgccccacatctccaccacaatagaaccgaaccacactagagctactaaacatacagcagcagtaaatctccaatccacacgaaaat

SEQ ID NO: 99424 - DNA, 682 bp, Oryza sativa
ttcctttctttgaaattatattttttttatttaagtcacttgagatctctttccagagcatagagactaaatgaatcactgtaacaaacctaatacctagaaattccctatgtataacttgaggaccagtgatacgttgagaacactataggtgatactttgagggtaccggatgaaacctcgaggatactagatgtatcatggtacctccaacgtaccagatgataccttgaggtaccaggtgtatcatgatacatcgaggaccacgggtgataccttgaggataccgtaggtgatactttgagggtactggatgatacctcgacggtaccagatgtatcatggtatctcgagcgcaccagatgatttcttgaggtatcaggtgtatcatggtacctcgagaaccacgggaggtattgggtgtatcataatacctcgagaaccacgggtgataccaaataatacgttaatgatactgtaggtgatactttaaggttatggcatgatacctcgaaataccaggtgtatcatgatacctcgaggaccatgggtaataccttgagggtaccaaatggtacctcgagggtaccgtggtgatactttgagaggatcggatgatacctcgagggtatcagatgatactttgtgggtaccagatgtatcataaatattggctcgagga

SEQ ID NO: 99425 - DNA, 646 bp, Oryza sativa
tatagggcgaattcgagctcggtaccctaaaggattgtctcgggatcacaaaatggcctgtcaaaaacttatctacaaacgtatatatctacagagatatatatctgctcgtatataaatacaaacgaattttacctattatttgtacctatgatcatcgatctgaataaaaatataaaatattgaaatatacatattcataaataattcgtgtatttaaatgcttatagcaatttgaatagtttgaaatctgaatcatattttttgaccaaacaatctgaaacacattttagttttattctcttatttactagaacttgtaattttaaaacactacagtaatgttttgtaaaatgtgagacatcttgttttgtaaagtataagaattgaataacgcaattttgacatgtacaattatcgtgggaattagtacttttcttgtgttggctatgaaatttaactacccatcaagtttttttttaaattggggatgggaaacggttgggggttttgggaaaaactctttttttttttttttaaaaaatatattaactatttttctattaaaagaaattatataaataatacttattttgtgtgacatgttttatcattaaaaaaactttaagtacgacttatgctttag

SEQ ID NO: 99426 - DNA, 558 bp, Oryza sativa
tgaactacctcaccgtacgaatgctggtcaacgcaactacaagtcatcagtttcacctatggttgacctatctcaccgtgtagatgatggtcaacgcaactacaagttatcagctttacctgccactaatgaactacctcaccatacggatgctggtcaacgcaactacaagtcatcagtttcacctgtggctgaactacctcaccgtgtagatgatggtcaacgcaactacaagttatcagctttacctgccactaatgaactacctcaccgtacggatgctggtcaacgcaactacaagtcatcagtttcacctgtggctgaactacctcaccgtgtagatgatggccaacgcaactacaagttatcagctttacctgccactaatgaactacctcaccgtatagatgctggtcaacgcaactacaagtcatcagtttcacctatggctgaactacctcaccgtgcagatgatggtcaacgcaactacaagttatcagtttcacctgctgctgaactacctcaccgtgtagatgatggtcaacgcaattacaagtt

SEQ ID NO: 99427 - DNA, 862 bp, Oryza sativa
  unsure (1)..(862): unsure at all n locations
taagggattctctctatgttatatgaaatacctttcacgttatggccctaggaagaaataggggacctcaagcaacagttatatatgtaggtcttttttttttgcatccttagttaagggaaattgattggcagactggggcttattatacatctgaaatcagcaaacaaaaatataatgaagtaatagtggtattatttgggttaatagtttggtgtgaaagtttttttactaatataagatggatggtttttttcttcgaaattactaataaaagatggttgccacttaaataaggtactagatccaatcaatctggtgtttgatatttattcttgctgagcttggtagttttattttcatgtatttttttccctctaagatcgaatgatttgtgctaattgttcgatatatgccataaataatgtgtacatcattacggactaaagaattatcttctgtcatcataaatgcagtaaaagcagattaagtctaacggcgatcaggaatttctcagtttttaaaaaaaatctggggcatgtatgagtagcgtcgagcgagagatttctcggtatccacatcaaactctgggtgcatatattagtcttctctgtgcttttagtttttctatataggttgagaagttgtttgtatcctacttggtcatgtaattcctatgtttggacttcatgtaattcttgggttggactctatgtaattcatgagctgtgggccccaaaaaaaccttatgcgggaactggagatgggcaactcaaaaaaacaggaatactaaagaacggtgtaccgttcttcaacgggatagtctagcatggcatgcttncatccgcataggccgtcacct

SEQ ID NO: 99428 - DNA, 848 bp, Oryza sativa
aaattcggcccatcgaccctgggggagacaaaatagacttttgcgaaggaatttgatttgaaagcatttggattcggaattgaactcgacgatagatcggggatttgagatcttgagatggcacggacactagacaacaagcaaagaaccaaatttcgcaactagggtttttaagagataattttcccgctaggcgccacgacggaacgggcgctacacaacacgtcatcattaatatatgtcccatttctctctcacacataatccctctataaaaaaaatggggaagcaccggaagtatggtggagtccttggtgcctaactccacccaccagggttcaaatcgcacatgtagatgagcgtgtatcctctaagattgggtttttaggatagacgagtaatttattggacccgtgctcttatattttgaaatggaataatatattttataaaaactgcatatacttcatgtgtcccaaagaaaggcccctttggcatagctctagttcctaactctaatttacccggagccggagctgtgccaaacagttcagatcctccgtttttggaagtggagttagctaagctactcataaaaaataaaatacgggggtggagctaaatttttgctgcggcacagttccactccaatctaaaagacccactaccatttaatttttggggatatttagagtcgaactgcaggcatgcaaccccacctctcacctctctttccctgccataatcctcaccttttccacccggccaggcgcacaggcggcatagtcgacggcttggggtgcgcggtaggccacgggcggcgcacggttggtggggggacggcatgc

SEQ ID NO: 99429 - DNA, 574 bp, Oryza sativa
ctcccaatctactagtaggtctcttgtgagaggtagcagctcatcctcacttctgtgagttctctcttcacctcataattcaaacttacataaacattcttatggctagcaattcaacgcgtattttacttgctctttaacccatataacactggcaaccctcctggaattaccactaatcccaactttaggctggcttatggaaatgtagcctcattatgagaaaaccaactacttgcgccgttaaattttgataaaaactacattgaatttatttttcttccaggagacgaatgattatgtcggcattagccatttattccgatttatgatagattcagctatcctgatgaaacatgatgtggctgataaagaaagaaagaagggaaaaaaaagaaaaaaaaagaaaaggagatcaacgaattattggtagttaaatctaagaaggaagatctaatgttgttttcagggattaaaaaagaggaaaaaatggtcaacacaccattaaagtgaccaaagaagaaatgctggcgagtgctacatagctttcagaacagatagaaataagtggcaa

SEQ ID NO: 99430 - DNA, 632 bp, Oryza sativa
agatgtcatgttgacaaaagacattctagttaaaaggaaatgaaaagggatcactgatattgtttatgtaatgctaatgagactatacagcatctcttttttgaatgtcaagtagccaaaaacatgtggagtgccgtatcttttttgggccaattccctatatgcccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgtgatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcaaatcaaatttgatgaatttcgtatatcttccc

SEQ ID NO: 99431 - DNA, 650 bp, Oryza sativa
aatctattttcttagcacaagagcaattattcacaatatttgtaataatattattcttgtgctgaaaaggaaatcaagccacaggaaataaatgagcggctagatcaaaaggaggaattcagatatttggatcaagaactaaggataggtctaagatcaaaggataggttaacaattaattccaataaaattggaattgctttggtttaggttctagcacaatataggaaggtttcttggaccataattcataataggtaagaagggttttcaaactaaatttaaataaagaaagttttagacgaaagaaggtttttagattaaaaccaaatcaagaaatacctcaagataaatcttaaatgaaaatcataaaagaaattaaataccaaagagaaattttatataagttaggtttaggaggtctctctaatcatattttcctaggtttagaaggatattaagaacataagaatatgcatgatgcaagactagaaaaatagttaattttcaggatgttacaatttaccagatttaatctttcatttaaagtgacccgttttatttcgaggtttatgatttactcattttgataaaaccaaaagagttgatcaagtgtatcaaacaacctcaccaattttggaagatcgaga

SEQ ID NO: 99432 - DNA, 632 bp, Oryza sativa
ttcgtcttatttaaaaacttttgtgaaatatgtaaaactatatgtatacataaaagtatatttaacaataaattaaatggtaggaaaagaattaataattgcttaaattttttgaataaaacgaacggtcaaacatgtttaaaaaagtcaacggcgtcaaacatttagggatggagggagtatcatttaaaggaatgagggcatccagtgctcaggacttaaaacagtttcccatttgaaaatgctatattgcgataaccatgtgatagataacatttttcattgacgcaataagtcatggcagcaacttttctttataaagtcattaaaattctatgggaacgcgacaaccatatactagcgttatgtctttttttaaagtaagcatcttgacttgacgtcaaaaccagtgagttgagcttatcattttgggatgagctaattaactagctaagttgctataccaaagttttcagttcaagcagtgttaatgtgtttggctagcttgctagttaagttgctaatgtgtgtttagcttgctaagtaggcttcgtcagacggcagtagtgtgcaaatgcaagatggctaatatttgtctgacgaaccttcacttgatctccacaactgtagga

SEQ ID NO: 99433 - DNA, 558 bp, Oryza sativa
aaacaatccagcttatgttaatttggtactcaatacaggtctttaattgttcattcaattaatagaaatacagtggttgaaaccaattataaattgcatgtacaattaaaagttgtggtaaaagaatcaaatcatcaataccacataaaatcctcgtatgcatgccattaaatctttaatatcttaaaattaaatatttttaaagtcattaatagttaaatttataaaagtttgaccacaacattgttcaaaacgtcaagaattatggaaccgaaggtagtaaactttattgttgaacattgtaaagcaaattttgatagagtcatatgatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccata

SEQ ID NO: 99434 - DNA, 524 bp, Oryza sativa
ctagccaaacacattaacactgcttgaactgaaaactttggtatagcaacttagctagttaattagctcatcccaaaatgataagctcaactcactggttttgacgtcaagtcaagatgcttactttaaaaaaagacataacgctagtatatggttgtcgcgttcccatagaattttaatgactttataaagaaaagttgctgccatgacttattgcgtcaatgaaaaatgttatctatcacatggttatcgcaatatagcattttcaaatgggaaactgttttaagtcctgagcactggatgccctcattcctttaaatgatactccctccatccctaaatgtttgacgccgttgacttttttaaacatgtttgaccgttcgttttattcaaaaaatttaagcaattattaattcttttcctaccatttaatttattgttaaatatacttttatgtatacatatagttttacatatttcacaaaagtttttaaataagacgaacggtcaaacatattttaaaa

SEQ ID NO: 99435 - DNA, 1331 bp, Oryza sativa
tgatacctcaagaaatcatctggtgcgctcgagataccatgatacatctggtaccgtcgaggtatcatccagtaccctcaaagtatcacctacggtatcctcaaggtatcacccgtggtcctcgatgtatcatgatacacctggtacctcaaggtatcatctggtacgttggaggtaccatgatacatctagtatcctcgaggtttcatccggtaccctcaaagtatcacctatagtgttctcaacgtatcactggtcctcaagttatacatagggaatttctaggtattaggtttgttacagtgattcatttagtctctatgctctggaaagagatctcaagtgacttaaataaaaaaaatataatttcaaagaaaggaaaagaatagtcaaaaggaaaaaaaataggtatgattgggccgtggcccaagacatgacagcgcaacagcactactgggctagctggcctaccacgtacggatgtgcaagtgtaggagttaggtggtgtttggatcagggacttaactttagtccctgtctttagacactaatttagagtattaaatatagactacttacaaaactaattacataaatgaaagctaattcacgagacaaattttttaagcctaattaatccataattagagaatgtttactgtagcatcatataggctaatcatggattagttaggctcaatagattcgtctcgtgaattagtccaagattatggatgggttttattaatagtctacgtttaatatttataattaatattcaaacatccgatgtgatagggacttaaaagttttagtcccatctaaacagggccttagtctagtctagctggccacgtaccgatgtgtgtatgtataggagtcttcaccaaaggtgacggcctatgcggatggaagcatgccatgctagactatcccgttgaagaacggtacaccgttctttagtatttctgtttttttgagttgtccatctccagttcccgcataaggtttttttggggcccacagctcatgaattacatagagtccaacccaagaattacatggagtccaaacataggaattacatgaccaagtaggatacaaacaacttctcaacctatatagaaaaactaaaagcacagagaagactaatatatgcacccagagtttgatgtggataccgagaaatctctcgctcgacgctactcatacatgcacccagattttttttaaaaactgagaaattcctgatcgccgttagacttaatctgcttttactgcatttatgatgacagaagataattctttagtccgtaatgatgtacacatta

SEQ ID NO: 99436 - DNA, 517 bp, Oryza sativa
caggcgaaaaggacacttcaaatgccaggaggtccaagttgaagtcagtcaaaaccctccgcattgagactggcagaagcaaggaaagaattactcctttgagttacagctatcagaaagaagaaaaccaaaatgagaatcctatatgttctcagaactgtgggatagaatgtgaagcctgcatggttttgtttaataattcttatgtcggagaagctgaagaaaaggaaaagatgaatatcttggacagaattatgatggaggagaatcaggaacagacaaatcatcttcaatccaaagaatttgtgcattatgttgcccctctgaatttggactatgaaacattttcagataatgaaaactgcgtgctgagtgttgctaaggagacagagcataatgatttcaactctgtgaattgtatctcacaagattcagtttgtgaaaatccacagaagatatcagaattattgcattttgtttcccctctggttttcaaaggcgatgacttcactgacag

SEQ ID NO: 99437 - DNA, 702 bp, Oryza sativa
taacattacaggtaaatcacttatccaatcaacaattggaatatatcattatattcgatgaaaacaaatttttatagcaatgggttatacgacaatgacctgacgaaaaaatatatattgaaattaattgtattgcatatttaaattaattggatcatatatatatatattacttttagatctgcttgaacctactccttatacatacataatatttcgagtttctacttgatggatatagtttgtgcatacatacacaaatgatttattgacttacttcattcaatgatgatgagatccctattctagggtaacacgaatgaattatgaataatttcttaagaaatacatatagatagaaactttctactttcaagctctcatattatgtggtcgcaaagaatgaaaaagttacaaattctcaatagggccccactattcttctaacttattatacacttacgtgatatccccacatgattttccctctccatacgaactgtttgctcatcgataatgccgaagaatgacatatgcgcttatcgcatccacctccgaagatcttcgcaccttggctcagcctcgcattggagatcaagcagcgctcatatagggacaaagacaacatgcatggcaaggccccaccttctacgtgggagagagcccccgctaggatcctagagagagaagatggcggagaga

SEQ ID NO: 99438 - DNA, 1264 bp, Oryza sativa
aaagtgattgctgtcattccaagaaatcaggacttgctggggatcaagagtgattgccttcttgaactcaagcagtgagagcttatctgtctcgtttccatacaacgaactgcaaatgatttggactgcactgcacaccataagcagcaactgaaacagtccaattatagtgatcttcatggccagctctttggtcgaatagtgctaggtcttggttatatcatatatgcagacagagaaagagaaagggggtcaacacatgtctggcaagtgttctttttgaaagaacattcaagagcctaaagtttcaatagagaaggtgttttaagaaagttagggaatgttggtaaatggacaaatgtgaagtaccataaagcttttatttttctttacctcgtttcgtcagaaagattccacaacatgaaagctgcttgctgctataggttgatgaatgcaactgtccttcagacttcagaatcagagttgagaagtagcttcagaaacatacagttagcagatatacttattcagaaacatacagttatgatttttctttcttttggtttttttactacgcatatattttttatactagttaatgaatgatgaatctgactcccgcagtttcgtaaaaacaaaaagaaaagaaatatgatcaccagtcattgaaaagaagggctctagtgtcaaagacttgaaagaggggatgcaagccataagctagcaaaacaagttctaggtaacaaagaaacaataatttcttatcatctaacagtatctttctaatcatatgtgtactatctcaatttcatattataagtcgttttaactttctttttaaatcaaactactttagctttgaccaaatttgcagaaaaatatagcaatattttcaccataaaccaaagaaactatcaaaatatattcaatgttagatttaataaaactaatttggtgctataaatgttagctatatttttctataaacttgatcaaactttcaagaagtttgactttaaaaaaaatcaaagcaacatgagagggggggggtattaaatatgcataaaattcatgaacagaaacaagcctgtagatacatggagacccatcccacaaaagcccccaaagcagtcaattaatagatgaacataaacaaattaaattaaaagatcaatcgacattcattcaagaaggttatttccagcgagaagagtagccttcagcctgcagtctagtggccatcagcaatcagctgcctcatttt

SEQ ID NO: 99439 - DNA, 582 bp, Oryza sativa
gctggtcttactcttatggatcaaaatcatacaagtataatgtatgcaatgacctacctagccgtggagactagtcacctgaaaacttcacatagatgctggattacccaacatgcacccatcactaatgatgagtcttattagtgtcattgcaattaacgactgccacctatagagatgcacaccctttttatttaggataattagagccatgccactgctgtacattaaaaatataccaccactatttacattatctgtggagtaccattataaattaataaaataggaactatgccactctggcactctttatgtcctacccatcctctctccgagacgacgtgaggctacgcgctcggtgatgacatcgtgacatcgcagacagcggacacggcatcgacagcgagaccccgacgagtcgctgcgccgtgaagtccaggatctgagccagcgccgcgctagctgcaactccgcgcgtaccgcatcaggtcggggaacggcgctgacacggaggacaccgatgccggtctcatgctgcggaaaacggagcacggcatgagagactcggcgggggggggg

SEQ ID NO: 99440 - DNA, 737 bp, Oryza sativa
gcggccgctttagaactagtggtttctctgatgagtaaacagttttaatggagaggtaaaatcatgtggtgatatcatgtatgtgtataataatttagatataatttggggtcctattgaaaatttgtaactttttctttctttgcgaactcaaaatatgctaacttgtaagtagaaagtttctatctatataaatttcttaagatatttttcataattcattcgtgttaccctcgaatagggatcacaacattattaaaaaaagttattcaaaaaatcatttgtataattatgaacaaactaaaaacaacaagagaaactcaaaatattatgaatgtataataagtaatttaaatcaaatctaaaagtaatatatatatatatgattcaattaatttaaatatacaataaaattaattacaatatatattttttcatcagaacattatcgtataacatattgttataaaaatttatttacaacgaatataatgatatattccaattgttgattggatatgtgatttaaatgaaattttatttgaagcttacttattaggaatcttttatttatactgttgcatgcttgcatactttgacgtgggaaagagatacattgctatatttttaccatctattggtataatagttggttttcattaagggtgtgtttagttctttgggtataaagtttttgaagtacacagacacacatttgaagtattaaacgtagacta

SEQ ID NO: 99441 - DNA, 687 bp, Oryza sativa
agttttggaatctggttggtggatttaaggatgttatgtctgaagaagatttcataggcatgtatcaaatactccctttgctttctttaatatttaacaccattaacttttcgatatacatttgagtaaagttatgtagttatcatttattttattgtgacttattttgttgttaaagttattttaaacatgacttattatatatatatatatatatatatatatatatttgcacaaaatttaataagataaattattaaatatatatttaaaagtcaactgcgctaaatattaaaaataaatgaggaagtatgtcctttgaactctgttgctgtgggcgaatctcatcatttttctttatttgagcattgtgatgcactgatgcagaagccgttataggtactatcaaatgcactagtggctaacaaatgcatgaaagctacagagaattgtgataaacatcagcccaggaaagatagtacagataatatctcacatccagcacatggcaaattatggagaaatcgattggccgtttgaagatcattttcaggagatgacgtcaatgatgatattttcattttcattgtcacgctgatcctctctgctcgcatgcaagtcaaagccagggaaagaactgcacaagtcagtggctgctaacccagtatgatgcccttcattgtcaaa

SEQ ID NO: 99442 - DNA, 848 bp, Oryza sativa
aggaatctccagttgccatgaaggaaatcttttctgagggtttacattcagtgctaaacattggactttgctgcaccaagcagtccccgtacgagcgcatggacatgcgagaagtggctgcaaagctacatggaacaaggaggcatatctctgaggcaactaggtaatataatgtaagatatgtaccctgcctatagctgtgagatactctgctaccttctcgcatggcatgtttaatattgtcactctctcttatataatgaaatcacaactcttgttattgctgtaataatccgacactacatttggtttggaatcttacacaattacactgcagatacatggtattgttggaaactctgcactgttatcatattcttttcttttagagtaattgataccaatattcagccctcatgctttttgctgttgatggagataaggactggtcagctttatattcacagaacattgaaaattttcttgttagttccttaatttgtcaacaatggaactttcttctcagctactagctgatttgggtgatgactgccatctgcgttgaattttgtactcagctgttttttttcccctgtgaatggactgggaaattgggtctctcgaacgaaaccttatttggtttgatgttgtgtttcataatcaatttgattatatttaatggatcgaattatatataacacatgtcacatgtggtacttttctgggttacaacttacaatgctttgagattgctcatggcataaaagaaaaatacaagggcctgcttggaagccagctggtatttgacccgaaactggtactccctccatccctaaatgtttgacgcc

SEQ ID NO: 99443 - DNA, 564 bp, Oryza sativa
aaataaactcaaacggacgaaatatgtggcatgtggaattttccaaagctccaccgaaaaacttctttcctcgaaaacacaatcttgcaagcggaatttggaggttttaatatcgtcgaacccggcaaagcgggggagaatcggatgtaactttttctatagatgtccgtgcatatattatttgcctgattccgagtccgtatgagaaagttatgcctattttaatagatggcatattttgtccgtttcggtagagttttggaaaattctacatgtcacatattttgtctgtttgagtttattttttatacagttggttcctatgttctcctaagtgtgaaaaaaatatcaaaaaaatgaaataaaaataaaaaattgcatctctacgtactgtttaacttatatatgtcatttcatatggttatattttgaattagattaagtaatttcatatagtggtagagtgcattatgtttaacatgctgatcaaagggttttactaaaggagttatggtctaattttagtgaaggtgcaaagtagactaagtggtatgctagatattt

SEQ ID NO: 99444 - DNA, 611 bp, Oryza sativa
tgacataatctgcagataatggagggaaaaaggttatcactgaattcaggggacaaattaatcaaataatcacagttaaaacaactacattgattttcaatcatgatttaaaaagttcaagatatttggaaggaatcaaaagggcccataatacttaaatcccctcggctaatatctcttattttcagttaacttcagctgacaaaaacatgtcaaataaacaataaataaaattccacatccagtgtgcaggattaatacaatctacgggagttacattgaatgtgacaacagaagtctgcatcaatcgtacctgcatggcatatgatgagggcatgaactccacctttgctcgcaagcaactcctcaatctcaagggcatgttgtaagcaaaagatccgaggccgtgcaaatgcacagcctgtattccagctgatagtttcctcactaccttcgacatctggtacattaacatcacctctgcctgattgtttactcaactctgagccagggcaatcacttggtattttcttctcaggggtttctgtgtcaccgtaaggatgaatggtattttcactgcttcaagaacaggaagtgccaatatgtttccc

SEQ ID NO: 99445 - DNA, 602 bp, Oryza sativa
ttttgttaaattttattcatatttttctcaatctaaattaaatatgtcaaacatctatcaaatttaaagtccattttatcaaactaaagtcaaatttaacaaaaacaatttttgacaaaaatatgccaaatttgatgaaaatctgacaaatctaagtcaaacttatcacaaatcagtgaaacctacgctaagtgcattcattcatttgtatcaggggtcaccgatatggccgaaattatttgaatttttgaacaaaattttatcaaatttgaataaatagtaccaaatgagaaccaaaatttctgaaattttgttatggaattttgaaccctgccctcaaccactgatagcaaaatatttttttattagaagcagaattcataaatcaatagttggtcacttgtactaatgataatacaataatagtgtattacgagtagagagtctagagagtagagaccactgtaaaaggatcccggtacagaaggccaataaccattcacattttagagcttggcacagtcatagtccggcattttcagaagctttttcaccagcgcttcggccaaccaattgtcacgcagaaagctgatgaccgcatt

SEQ ID NO: 99446 - DNA, 1464 bp, Oryza sativa
  unsure (1)..(1464): unsure at all n locations
tttgcctaatttgttcgacttcttcaatggcttgggcatcttgagcatcagtcccagaaatgatcttcaggaacttggttaggtcagcaacatatcttgatatgccgatttgagccttgctttttgctattnacaaattttgggagatcggctagttttttgtgctccatatccaattcagcattgcattcttcaagctgtgccaagagaatattggatttgatcttgcgggcttcaagccgatcgatattggatttgatcggaccttcggatagttgatcgagtttgactttttcttcatgcacaagctgccgattgacttggattgtggcttcaatctccttgcgctcacggcgttcggctaatcttagcttggctttttctagtttaaattgatgttgctcaagataagtggctagagttaggacacccgccagttcttcaggaattagagcttgaacttcgtgcaatcgtgtcctaatcgatccatagtcgaccactaagctatccagagaagaggcctctagccgacgcgagatatcttccagtgttttctttgcatcatcagataagggagctagagctttgcttgaagtatctttttctgcctcatcaagataatctttgatatcaaaagaaaagagatcggctagaacttgcaggtataagttcagaaagtttgagagctaagtcaatatagtcgatctaaattcttgcattaaaggaaagcttactgggatagcaggagcagccggttgttcttcttccacaatatgatgactccccacggccgatggagttcagtcactcaatgattgttgtacaggagaagaaggaggaggaggaggctgtaaaaagacaagtgttagacaaaatcggctgaaatcaactagtaaaattgagagtgtcttactggtggagctggtttgagaattggtgctgccgatttcttctttatagcagttttcttcttctgcaactacaaaacctatgagtagtcagctgaaaaataatgattataaaagggtttgcaaggaaagatgttttactctgaagaagtgagtgggggcagaaggagttgaaggtatctgcttaggcgaagccgatggtgttttttcagtatcacttgcttcggctgtagcctgatcaacatcatcctcaatatcttcttcatccagagcatgttcaatggatggatccaaagcaggcaggtcgtcggttggcttggttttcttagatttggccttttttctttggaactagagtcaaggtgttcatagccgatgatctagtttttcttttcttggttacatcggttggttccctaatggcgccttggaggagggttgagaccttgggggagacaattcgcctccattaggaatcagacctgggcatattcaatgtttctaccactattgctctgatgtggaggggaggactttgttgtctgcaaaacaggaa

SEQ ID NO: 99447 - DNA, 517 bp, Oryza sativa
ctggatgctcttctgtcacttctagaaacatcagaaaataccacaattcatcgagtcacagctggtgctattgctaatttggcaatgaatggtaatgcctattccaacctctcatgagatttattttccacatttggtcaaaaggggctattatttcattgtatagttggctcactgctgataatattgcagcatggaagtagttgttaaccggtgtgttctatagtctttcactaaatgtcttccgcacatgccaaatggcccagtcattgactgaaggaaaattccccaataggtttccagcatgagatattctttttacatatttgaactatatctatattattagtcaaatttatattgcgatatttataaaatgaacaggcaataacttgagtattaagttagatccttgtaagtgcaggatcaaaccagggactaataatgaacaaaggaggagctcgattattagcaaatattgcgtcgaaaactaatgatccccaaactctgcggatgg

SEQ ID NO: 99448 - DNA, 588 bp, Oryza sativa
agtaaatggattttttttcccttttcttgaatgaagccctaacatcatagagaaagtagggttagatggtaactttgattttgaaaaaggggtcaaatgagcaaattagaataagtagagtctgattggtagttatgcttcaaaacagagccaaatgagcaattatccataaaaaatatggacggtccaaactagaaactattctaaactcttgagggatatcatcttgttgtttgcatgtcatctaaatagttataaaataaaataaaaaaaaatcaacatgatagattaaaatgtgataaacaaatccataaacatgcaagatcaaatttaacttctacaagttacaacgaaaaaagtaaatttgattatagatatacattaactagctataatttaatttatatctcatcaagagtttagaatccaatcccacgatccaaatacatcgttgtttgtacttacatgtgggttgcatgaacaaatgatggaactgatttttgtgatacagttggcacaaaacacaaatgagggttagctatgttatacggacactcccatacggatacagacacgaatatggtacat

SEQ ID NO: 99449 - DNA, 715 bp, Oryza sativa
tcgatgtcagggtctgttatatgtactgtagatcatttttttttttatggtttctaaggaaacctaattttccccgtctaagatctggcaccttgtgtttcggaaagataatttccttctttctttgtcatatttcccgtatctcccatattctggtttaaggacatataacaggacacgggtttaaggagaccttatctttcccgagtaagattctggcccttctatttcggaaagataattccttctttctttgtcatatttccttaactaaaggatactttctcttataatatcaggtatatagtattatcgtatgccacgaacatgtgtataggaggtatgccttatccttgacactgatagatgggacaactcatcaggggaggaagacgatagacgggatggcacatcggttgaggaagacggctgacgggatagcatatcggggggaggaacatgatggatggaacgcagagctcgagcttgtcacctcccttgtcaccgcccctttcccttgcctccctcctctcatcctctgccgtgaaccgccttcctcactagctgccagctcgttgaccctgcttcaactccagatgggaaggcgagaaggtgtcgagtaaatcagtggtggtggtggcggcggtcgtgatcaagtgcttgtgcaggatgggagggggtggcaacagttacatcatcgtcgtgggggcatggg

SEQ ID NO: 99450 - DNA, 613 bp, Oryza sativa
ggtggggtgaatggaagttgcatctatttcatcaatcggccacaatgtacatgacagatctattccctgacatcataccccaggtaaactttgtcatcactaaatttcataacggttagctaattcattacttgactaatcttttgttcctgttttgcagacaacaaagtcctcccctccacatcagagcaatagtggtagaaacattgaatatgccccaggtctgattcctaatggaggcgaattgtctcccccaaggtctcaaccctcctccaaggcgccattagggaaccaaccgatgtaaccaagaaaagaaaaactagatcatcggctatgaacaccttgactctagttccaaagaaaaaaggccaaatctaagaaaaccaagccaaccgacgacctgcctgctttggatccatccattgaacatgctctggatgaagaagatattgaggatgatgttgatcaggctacagccgaagcaagtgatactgaaaaaacaccatcggcttcgcctaagcagataccttcaactccttctgcccccactcacttcttcagagtaaaacatctttccttgcaaacccttttataatcattatttttcagctga

SEQ ID NO: 99451 - DNA, 689 bp, Oryza sativa
cccaactcctaggctattcctttggtttgtttattcctccgtttacctagaacaaaaaaacaaaattagacgttgaattcaaagaatgttaaaaccaatgtttcttttgtttagtgaatttcaaaacgacaagctctcccatcctattcctaagatagtatactagtacaatctttctaaaggaaataaggaaaaaaaatgaaaggacatctgaatctgacggccataaatacatttgccgcacatgtatgctgacaaaaaggaggcagctttaaaaaagggaaaacaagtgtaaattttgcacttaaatttgttggctacggcatatgtatgttcagttctttttcaaaaattggttctaataatagttgaacttataatgggatttgtgcagaaatgtgccattgggagcgccaactatatgatgaggagaggagactgcgtggtttgggcgctgagacaattggtatttatttgattcgcataattattgtgttcaacacattcatcggcaaaagggttattgacaaagcatcacatgaaaaatttgaactacatatcaccaacgaaataagttactatataatcacagtagcaaacttctttttttctggatgcttatttccaggttttgtttaatagtatgttttcttctttgttttgccacacactgaaaattgtgaaatacg

SEQ ID NO: 99452 - DNA, 573 bp, Oryza sativa
gcggtgacaacaaggacggtttcagcggtcttgcttccctttttttttaagaaaaaaataacagttgttaacccaaagttaaaccaatcattgtcacactataaaacaatatagctttcctaaccgtttttcaatcaggtttagtatttagttctcccttgttccctacgagagaggatttggcttcctttaatggcaaaacatataaagtatggcgttattaatgaatctcctctttatcactttttgtgcagaaaaaaaaaattatagagatgaacatggacaactgcttgtacggtgaatccatcaaacataaaacatgtaactaagctacagtgaaaccatcaaactaaattctagggagtatttcatacaaaacataaagtgaaatgtggactagttagaaatagttgtactatatgactggtgttactctctagtttgtatccaataaaagatatcacaatgccattaaatagtgatgaatatactataaggtggtattttgttaatctaaacgaaatgaggaagggatcaaaattttagtctctgatcctaaagtgcacatattta

SEQ ID NO: 99453 - DNA, 537 bp, Oryza sativa
atcaaaatacccttgatgacattcaaccatatccattcattagctcccaaccctatctctctatgttaggtgaggcagtgacgacgcacacgtagagggatggcacagtggtgccagcgtcgccggtgtggagagggagggagcggtggttgcgcatgaagaaagggagcgacgacgaaagctgcacacgaacggagcagcgataacggcgtgccaagagagggagcggtagcgcacgcctcgacaatgatgatgaggagcgatggcagctgggcccgggcgtcagagctaggactagggcgggaggattcagtaggggatgggtggcgaagctcaggctgaggcgggtggatgcgacggggaaggagtgtggagctcgggctgaggcgggtggatccagcggagaaggggcaacgatggctcgatgatgatgaggaagagcaccaaaggcaaggctcaggcggcagagttcgggctgtagcgatgggtaggcgatcaatccggtggcggggtaccgagctcgaattcgccctatag

SEQ ID NO: 99454 - DNA, 528 bp, Oryza sativa
agagcccaagtgtgaaattcattttacttttctaaaagagtaaattgcattcacggtacaagaatttgttaggtgggtgcattctattgtaagaacttgaaaactgaacaaactggctcaccaacttgactagacggtgcgcttttggtcaaggtgaataccacacggaattttcggccacgttagcaagacatgtcattcatgtaacatgtttttgcttcttccttcaaacgacagatagactgaaggttcattttagcaaatatccccagttcaatggtaacaatatcaaatcaaaagctctataggtctagatttagctttgatagagggcactgtaatctcttgattgatgcatgaatcaattcatagttatactgtcaattgaacaatgaaactagacagtagaaatttagcttgatctaaaaggccaacgcttgcttcgagaagactagcatcaccatcacccgccaccaccactgacgaagcacacagtaacatctttgagttagctagcctgttcgattt

SEQ ID NO: 99455 - DNA, 636 bp, Oryza sativa
cctgttcatgattgaaaccttcctggtgaattatccttaaatatcattttcttccactgtctaatctcacatggaaatcctaataatcattttgttcttatatatccgaaggttatccattccgatggcctctgctcttaattaatttgtgcagttcttttaatccctgatgctgttgcatcgttgatccgttgccaaatggaggaaacaaaacacacagcaaaactattttttttcatgctctgtttttgtcttcatacgtgtgcctgactaagaatattctcccaaatggcaattaaatatggcgttgattaactcaggcaacatgtcagaaaaacacggacttctgaaagctgaaacttggaaaatgttggactgcaattcaatttctggaagtagtggataacctaatcctgtacgaacaactgctggatatgaatctcttgtcggtgtgctgattttccattagttaattgaataattgagtcggtgttttctttaattatggtttggggcatgccgcatttgcgccctgattacgcaaaatgtttttatattttttggctcgtgggtttacgaaatcgaagaaattgggttgtgttagatctaaagtttgaatccaaacttcagtccttt

SEQ ID NO: 99456 - DNA, 563 bp, Oryza sativa
ttattgataggtgggccccacgaaaacacgcacacgcaaaacagctatataagcgccggggggtcgctttcttggcccattgttgcgcccgtctttgtctcgtttgtctcgaatactctcctctctcaaacacttccgtatagacacgcctttcgagttttctgcttcgagagtttctgattcgagtcttctcagcgaccatggggaaatccaaaaaaccggcctcaaaacagaaagcgaagaaaacatcttccggtcttggtccatcgattatctctgaaaagcggctcaataaacttgtttcaaaaggtgccattgctagtctcaatctagtcattcgtcctgctggtgagttgatgtaacgccctgattttcgatcgggattaaaaattattaaataatgtattttttagaaattaaatataagttaaatcaatttaatcaagtaaaataatgggagaattaaaatttccccttaaaaatcattggccgggaatattttgtaatattcttgtgccctaaaatactctctgaaatttcccgcgaattttcggagcccaagt

SEQ ID NO: 99457 - DNA, 586 bp, Oryza sativa
ggtcactgttttataaccaaaccaagttcacataggccgtgtctagatgttttggcaaaaaaaaaaaagtttgacgtatacggacacacatttaaagcattaaacgtaaactaataataaaccaaattacagattccgcatataaactgcgagacgaatctattaagcctaactaatccatcattagtaaatatttactgtaacaccacattgtcaaatcatagcgtaattaagcttaaaatattcgtctcatgatttacatgtaaattgtgcaattggtttttttattcatatttaatgctccatacatgtgtccaaacatttgatgtaaaaaaaattaaaagtttgaaggtaaataaagacagtcgtactagtcagcttctgtaggctagctgtagccacaagcttcttacacctcacgtttttttagccgcacctcacgtttttctagccacaaaagtccttattgatccacgtggctacagcctacgggctgcatcaatcaagttcgtactcctcctagtattccctcgaaaataaaccaaactcttacaacaatataacacattctaggacgattagttta

SEQ ID NO: 99458 - DNA, 501 bp, Oryza sativa
taattgttacaagcttatggcacttctaaaagcatgacctatgttccatggcacttcaaaaggaaaattttcagaaaaatatggatttccttagaacatttagcagatcttgtagagatattcctaacaaatggattcttattaaccagtaatgactttaaatgaaaataaagacgggcaagtcaaagggcacatactgttcggaattgtgatccatccttcgtcatccaaaacatcggtatgctttccagtaggaactgaattttttgaatctgcatctgcagagtccccaccgatatctacatctccattatcagtatcttcatcttcaggggaggggtgatatggatcatcggcaataaggccctccagagttgtaactggcttttgtaggctatccctttgctgatcttgctctggaatccgcggaagctcgggtgcaacaggctgcgaagtccggtagaggaaattcatctctacccgtcctgccaagcaaagcaa

SEQ ID NO: 99459 - DNA, 557 bp, Oryza sativa
tcatcaccggcgcgttcccggacaacatcgaggagatcctcgacgtggccctgctgctgcaggccgaggagctcgacggagcagcgtcgtcgacgacgtcggaggaggagagcgaggcgcgcgtcacggtgcgcgattgcttggcatccgccattagggtcgggctcagctgctcccggcgagctccctacgagaggatggccatgagcgtcgccgccgacgagatgcgcctcatcagagacgcttgccttcgtgcttgtggtaaataagtaggacagtatactgattatttgtagaactttgacagccgaattagtcgatggataattattactacgtcatcggcatcgaattctatcactattcgaggcttcgagcaagctgttgtggagtaaaaaaaatgaaaatgtaaaatccatggaattcaggagctctgatctcttgatttatctagtgtactgtactgacagaaaatggatgtactctgcatattcagatttcagaatagattgttctgtttatgtccagattccagaatataatgggccctgggaaat

SEQ ID NO: 99460 - DNA, 578 bp, Oryza sativa
acactagatttgtacaaagttttcttcagctgtaattcaattcaagtctataagaacagaacatgaattaaattttattgagaataatgccaaaattggcattgttagcaaaatcctctaactggaagtaatcaaataaaagtttctaatctcaagccctactaccccctaactcagtagggacccaacccaacattgcaacctccagctggactaattttccttgaagacaggctgataacttaagctaggctgaagagtacaagggccttgacacattcactagcccagtttaatgatattttttgggccttgacatattcactagcccagtttaatgatattttttgggccttgactgacataattttgagcatacctagcaggccaaatccttgtggggcttggtcaggttgggccacttgtgttatatctggtccatcgctacattcgtaacctagcataatttattagttagtttcagttgtcgcttgtcagaaaaaattgctcaggtcacaagtcccctgtgaaccaaaatgtttgagtcacgaaattgtcgattgatgaactacttgcag

SEQ ID NO: 99461 - DNA, 564 bp, Oryza sativa
aatgctttacaaccgcctttatgcaaatagccataaacagtccttgtgttccccttgcacatctgcatcgttggtgtggcttgctgagtacggtggttgtactcagccttgctattattcccccttttcagaagtgtagtgcttctgagctgaagatgaaattagaagaccaaggctcagaccccagttgagttttgcctttggagtaaagctgaagccccgctaggattgcctttttcgctgctgctgtttttgtttcggtgtgaggactaagtgcctcttctgtaagtaattttcgctttatttacgtttggaactgtttattacttgtcgttttgtgtaccctggctggtcctggacagggatttaatacacaaaatagtctggaaatttgggctaaatttatgggcgtgacagttgagtccttcacctcgggcccgctacaccttggtgtttgatgattttttttgaagctggcttcaggtttccttgcagtgcatttcttggtgaaggtcttaggctatatggacttgaggtttctcagcttacaccaaacacccttgt

SEQ ID NO: 99462 - DNA, 595 bp, Oryza sativa
  unsure (1)..(595): unsure at all n locations
gttggccggagcgctgttaanaaagcttctaaaatggcggactatgactgtggcaagctttaaaatgtgaatggtaattggctttctgtaccgggatccctttacagtggtctctactctctagactctctactcgtaatacactattattgtattatcattagtacaagtgaccaactattgatttatgaattctgcttcttaataaaaaaatattttgctatcagtggttgagggcagggttcaaaattccataacaaaatttcagaaattttggttctcatttggtactatttattcaaatttgataaaattttgttcaaaaattcaaataatttcggccatatcggtgacccctgatacaaatgaatgaatgcacttagcgtaggtttcactgatttgtgataagtttgacttagatttgtcagattttcatcaaatttggcatatttttgtcaaaaattgtttttgttaaatttgactttagtttgataaaatggactttaaatttgatagatgtttgacatatttaatttagattgagaaaaatatgaataaaatttaacaaaattttggataacatccacccaaaata

SEQ ID NO: 99463 - DNA, 764 bp, Oryza sativa
cgcgaatgcagtactcgatggtacagtcagtcatcacgaaccccactctcgctaggcatggtcctacttttatactctaaggggatcccacatatgctgcgggtactacctaaggaggaggaaaaatattttatatactaaggacatgtgacgggccttaacccaaaacctatctgggcgtctgctggtgcgtggggcctatgatataatgcggggcgaccttgtgattcagcgcttaatgactgaggacttaacctttgctatacccacctacgaaaaaagtacccgggacatttaatagcggtaagaccatctgttaccgggattataaaccattaatcccctcattagtatgattagacattgtggatcacgcctactgacacaatgtcaacaggaggactcaagctggacttgacattggccattataccgaccacataatggataaaggctcgccacatcacattatatgcggcgtggggttgttgggtcgaccgctatgaatgtcggtatgtggatcttaaattactgacctgatgctgaacattaaacagaatcataggtgtgacaagcaaatattgtcacctattgaaagtgttgcttgggagcctaacagcagaactgatatgctcaaatgatgatgtgaaacactgcaagatacgtgtaagacataacatgtttcataatacccccggaaatttaatgcattattacgatacgctcaatcagagcatgtgatcacatacgtacattgcggaaga

SEQ ID NO: 99464 - DNA, 858 bp, Oryza sativa
  unsure (1)..(858): unsure at all n locations
agggtcactggattgatctcttctactgcatagttatcactgctcaacctactgcttgattaaatagacctttatgcacttctgacaccctacagtangcaatttacgtgtgtactgttacctctgttttctgtttactgtatcacacatgtgaggaatatagtaaatcagtgataattgaccctggtgttgtggaggtaggagaccagttctctggcagtccaacgcctgaattgaggaggctgaaaatctgtattttcagcagcccaacatctgagagccaataatgattagaattaatttgagcaacatgttgggtgtcttatatctgttctttatcaaatttagcacaattctatacaagtttggcatagaaagtttatttttcaatatgcttatgaacatgtcatctttctgtactttgaattgtgttgtcatctttgtaatattaaatggaatgccgcacaggcattacaatagtatcaactgctgtacctaggattgtaatgctgcagtgctgcgctatgaatatttctactccttgttatacaaggtgtgtttgtgtgtatctgaatatttgcctattaattaattgccaccttcactcatttcgtttgatagtccatacaaagggaataacaattactcctctattctaaaatacaaggcatattataaaaacattcatggcaagggattactcccatgtngggcatcaggaggggatttatgggaaaaagtatggtgatagagaacactattgtgatagggaacgctatgatgatagagaacgttaccataatagagaacgttatggtgatagggggattttggttttcaggtcatgcaagacgtgat

SEQ ID NO: 99465 - DNA, 596 bp, Oryza sativa
attgcttgtgcaaatgggttacagagttaaataagcttttaggtatctacagctgggggataattctgacaaatggaggaagcatgtctgcattgtcaaagaaagcagatagcaaatatagcagctttgctctagcaatgtttgattgatacagttctaggaaatttctgcagcctgagaaagcaatgagctgctcttaggctgataataagggagcgatggactggtagtaatgatgcatatacccatccagcttctgtggaagtgatgcattgcatttgcctattattttcgtagagttgcattcatcttttggcctgctgttgcttgttatgtgctgctgtcattcatgctatcagtaactatatgctaatttcatcgacgagaataggactaactcttgtattcctgttaggggcacctatatgttgaataatgtgttgggctcatatattaccatgatgattttttcctggtttatataggtctggaaatgtaacaagatcagtctcaaaacctcatgggcggaacttgtttctgcaaagcttagttgaagaagggcagaatccaagcactagcaatggtgccagcaactc

SEQ ID NO: 99466 - DNA, 721 bp, Oryza sativa
gttcaacatatagaaaaaatgtttcaacaatttaaacagtgaaacacaatcgaatcattcttgaagcattttgctataacacatgaaacatcgattttgagctactgaaatatccaaatactttgaaaaaaaatgaaacacaaagaaaaacaccgcaaatttttggtcttactgctttctagtggcaggccaccgtattggcaccggattacttatactccattcatgaagacactttattgcattctctagatgatccacaccgggtccactgttcttactactaccgttgttgacgaaaatgagggtgagctactcccctgattgttggttcccctcccttgatctagcgccctgagcttaacatggtcagaacgccatgctactacatcctggcaatgtggtgcagagcaagatgagacgcatcatgctcgccatcgagcattagcgatggtctcagcaactcggattcatagctgctacaactgctatggggagagaaggggaaaaataaatgaccaccactggtggagtgggaattagaatgcctctaggaaagaaaccgagatgtagacaatgacccgataaagtgtgacatatgcatttaatatgtactcgtacgccaatatgacatgacagcgtgtccatattagccttcatcgcgagagcgtgatatatagctattgtgtactactattccagcagaaagaaatatagctgc

SEQ ID NO: 99467 - DNA, 551 bp, Oryza sativa
tagtggtagtaggaggaggaggaggagtagcggtttaactcgtgtgttgcggggtttctgggggtgaaagtgaaacttgggttggcggctccaccccatatataggcgccacaggccggtgtggaacagcggcgcgcgcatgctctcgtggaaattttgtgccgtgtcgggggctcggccgcgggcggggtcgccgatggggggaatctcgcgtatcgactatactcttacttctaaagagcaaggacaatagcagtctataagccagctgtaaacatattttaagaagataaatgaagagagagaaaagcagcgggctacagatttctagtcagctataacacagaatttaagacgcagtgtgtatgacagatgagaccaggtattaattttgtagtatgtaactattgtatgaggcttccatccaatggtccaataaaccaaaaaataagccaaattttgaattttcaaacttaattttgaaatattttcaacgtaattttttttcaacattggcttttaagttacaaagaacacatatataaaagttt

SEQ ID NO: 99468 - DNA, 638 bp, Oryza sativa
ggggtgttcgtctagcactagggatccccctcagaacttgacccaaattttcctatgtccaatatgctgatgacaccctgttttatttgaaagctagtagtaaagagctctttactctaaaggctttatggcaaaccttccagctgggaactggtttgaaggtaaattttaataaaacttgtctcatcccaataaatgttgatgaagggaaagctcagaatttagctgcagtttttggctgtcaattgggatctttgccatttacatatttgggtttaccacttggtactattaagccaaaggtaatagattttgcacctttagttgacagaatcgaaagaaggcttacaacaaatgcttcattcttgtcttatggagatagacttacactggttaattcagttttctcttcactacctacttattacatgtgtactttaatgttgccaaagacagtgattgataacattgacagagcaagaagacattgtctttggagaggctctgaggtcaattccaataaaagatcttttgcagcctgggataaagtttgtaagcctaagagaaaaggtggtttaggagtgctaaacgttactatcccaaaaattttcatgctctgctcatcaaatttttggaca

SEQ ID NO: 99469 - DNA, 605 bp, Oryza sativa
ttgacctcacctaggttaaagtagcaatttttggctcccaaaattggaaatgttagtttctaattattttgataagaaaattttaagacctagaattctggtatgtcacagttggtgtcatcggctcgtcccctaaacacgagagcgcgaaggttgcaggcataatgtttgcaccaacagtaagattataaagatttttcaccatggacctctctcacgagtcaaggaatggttaaggacggggagctaatccgaattgcttcactcatgatggtagtcagatgaggctggatccattggaaagaggactccgagagctttacatcaagtactcacggaccgaaaatggagttcatatgcatatttggctgccgttcgaagtcaacaatgtagtaggaagccgaataagattgcagcatgtcacaccctaaaaatcctaaatatataaattgttgtttaactggaattattaaaatttattttaaaagtctagaaaagaagatctaattttaaataataaattccaatataaaatagggctagataaaatttcattaaatactttacttaattctataattcctagatttttctgggatttattt

SEQ ID NO: 99470 - DNA, 651 bp, Oryza sativa
tcctgcagccccttgccgaatttgttatcacgagttcctatcgccaagatcaactccaaacaagctctccctcagagaaaggcttagatattatcttcttgttataatgccgagcaaccctttccttatccttagtaacttttgtgagagctctcaatctggattgaaccaaatcctccttcacatcggacatgagattataatattcatcggctgacaacgcattctgcaaatctgttctcctcgagccgattctaatgtccataaacaagcttataaggaggaacttggatcgatccatggcaacccatccgataggaccagaatgcttcagccaacctagtatgccattgccgaggataatgagaaatctttctctgaaacaacttgatcaaactcttgttagatgcctcggattgcccattagcttatgcatagtatggcgaagaattcaacaatttgatacccatgctatcggaaaactgaacaaactcatcagacacaaagatagacacttgatcagtcgtaatagtatgaggaatcctaaattggtaaataatatgctcttgaacaaattgtatagcatcccctgaatcaaccttcttcaaaagaatcgcccctacccacttggtaaagtaatcggttgccacc

SEQ ID NO: 99471 - DNA, 519 bp, Oryza sativa
gactgattatttcgccaccatggctacacaactgtgtcgctatcgctgggcgccttcatcttcactaatgacagaccatattactgttgactggtttcttcgcctccacggctgtgcgacttcatcacctttgattggtgccactgtctttaccaccaccaatatctttgtcacctttgatgggcgatgtcatcccctcgttagtcatctcgttttcatgccgactacataagctaccatcaatggacaactaaaactacaacagaagtacatgttacatgcttagggggctcatgaactcaagcgcgatgatcataccttcaatttggacttgtcccacatgcatgcaacataaattcatgatcatgagtcaatttcttatgctcaacgagtggactattcgttatttcccacgagggctatcatctgagtatttgtaagagtcaggatttaatttttacatctactgaggtacactctatgaggataaccactcgatcagaagccacctaaatgaga

SEQ ID NO: 99472 - DNA, 551 bp, Oryza sativa
  unsure (1)..(551): unsure at all n locations
cgagggntttgagtgcgaaccgatgaattctccgtgaattcgagctcggtacccttgatcggggcacaatagttcgaccaggcattgtgcaaccttggagttagtgtcagggtcatgccaaaagacatcttcgacaagctcaacttaacagtgttggcaccaacaccaatgcaccttcaactggctcattcgtcagtccgttacccggcagggatagcggaagatgtgccagtcaagatacgggattttttcatcccggatgacttcgtggtgctggatatggacacgggaaaaaagacaccgctcatcctgggatgcccgttccttagcaccgcgggagccaacattaacgtgggaacaggaagtatccgtttccacatcatcggcaaggaagagaagtttgagtttcaaccgaggacggaacaatgctccatggtcagaataaagtacgggccgaacccacagaatattcaagaggtcgaagtggagccacccaagacggacagcctggtgaaattcatgcagaatttcctagagaagaaaacaacaat

SEQ ID NO: 99473 - DNA, 719 bp, Oryza sativa
atacacatgctatcagatggaagccaggcaagaatggtccttgatgtaacatcataagctacatgaataggttactcttaagaactatacatctggattagaatagtctaatgatgacgacttgcgggtcaaatcggaatttccattgtggcaaaggaagttccactgctcaaccaagagattcagaggaattatagtagaccgcttattgtgaggcaggtgatacagcaaccaaacacaatactaagcacatggtgaccctctatgtaaatactctagatatatcgactgcacctatatatactaatcgtaccgggtgatgtgaacctacacgcttgagctcgccaagagaaatggatgaccgtactacttgagacatcagacactcaaatggatagctcgaactttatatatgcggatcctacgagctcaatgctggatacacataagtgggtatacatgcacctaaacattaccacgatgagcgcgatccctaactggacactatcactcatgacgagagcgaaagcgaggcgacgatggactatcgcgacgcacctaaaactagtgtgctaaccagcacatgcctatgcgtgtacgagagctcatggctaagaaggacatgctcattacaatatatgactgctatgacagctaatgctgagagacatggagcaggctcactcactagtcaatgtacaatatgcaatacaatttgt

SEQ ID NO: 99474 - DNA, 652 bp, Oryza sativa
  unsure (1)..(652): unsure at all n locations
ccggcattgagtgcttatcctttttgcncccaggtcgactctagaggatccccatcgacaaccaaaagcaggctggagattgaaattctaatcacgacctataaggtcaaactcaactgatgcagctataagtataagtatgaaaagaagaacaaaatctagacaatcaagccgttggatgtttcatagagtggtggatatcctatacaatctaagccaacatagatatttaacctaatcggctgccttctaatgatagatcttagccgattgaaggttagataacgatattgtcgtagattatacagaatatatgataactcgatgaattacataatcaagattagagtatcataaagatggaagcactaatcccgagaacgcaagccgccataacaagttttacctctagttgaagatcaaaaccgatgcagctcaacccgaaagcaagaactcgtcaaaacaaaacgaaagtaaaagggtggcgatgcgccaagattgtattgaacgtatgttagattgattacatgaggctcggggtctatttatacccgagatttagaaaatatgtccatgtcggacacgacttttatctctaacaaactctaagataccataagtctctacagcagactcttgcccaaacatatct

SEQ ID NO: 99475 - DNA, 677 bp, Oryza sativa
  unsure (1)..(677): unsure at all n locations
cgatcaactctctattgggcggatcaagtcgacaatagatcggcttaagcccgcaaaattgatctcatagctcaactcaaagaatgcaatgccgaatggatcttgaaaacaaaaagctaccgatccttccaagtgctattgaagaacaaaagtctaggctgaaatcggccattaggaatgttgccgatatgactaagtccttaaaagtcgcccctggacccgatgcacaagatgcccaagcaattgaagaaatagaccaaatcagacacaaggctgtatcggctatcaagcgatacttatctcagtgactatgtaataggattaagaaaaaaatttgtattcggctaagaaattatggtacttcatttgttgcttttgttgctgaactgatgtgccgattaatataacctctcgtttttgctaaaaaaatttgcaacttttgctttgcaacttttacatatatgtgcccccctaattttacaatgacgaaggcattaataaaattataaattgaactaagggcgatataaccatatcggccattgtatatcggcaaaacacaaccgattacaatataaaaacaactaagggtgatataaccatattggccattgtatatcggcaaaacgcaaccgattataataaaaaaacaactaagggcgatatanccatatcgg

SEQ ID NO: 99476 - DNA, 529 bp, Oryza sativa
cctacgagtgctccacctccttcacggcctccccctacgcttgccgccaagaaaggaccaacggaatccaacactagtaatgcatatccacatgatcataatcaaggttacaatccttttataagttcaacaaatacttctaaaacacccaaaattgatgaattagaagattttgtcatggcaaagccttctagcttggctaatggttgtctgcaagatctaaatcataatggaattgggattggacaagattcatctacatctgctgcaggtttcatggattgggctgagctaaaacactctaaaggggtgaaccaagggaactttgattctttgttcgctagcagtcagtaccaagaaaaagagaaagcagtgctctatgcttctggaatggaaagcagagatgaggaagaactattagagcatgagaaaaaacaaagagaaaaggaagaggaacagagaaaactagaaagggacagggaggaagagcttgagagggaaagagaaatgatgagaagaagggaacatg

SEQ ID NO: 99477 - DNA, 780 bp, Oryza sativa
  unsure (1)..(780): unsure at all n locations
aaaccataggatagcctctcgtgcagcacttaagacacaccacatggaatgtaaccctcatggactttgcctagaaggtttgcgaaactgtttccttctctgtgctgcctgagtgttacgtcactgatctcgagggcaactcatgctaaggtggagttagaatgcctagaggagatgtacaacatccagcagagtctgcgtgggtttaagatgcaaatggtgcgtttgccattattagtatatgtttcttttgttttgtgatgccgagcacgtaaactctggcatcttactgagatctagtactcttcgttcattttcattctcatgcatggacgacatattcatcaaggctgcgtagagctgtagtgtgtgcatttgctttctggactggtgtacatgattgtattaatttttagtccgtgcccccacatttcctgtgtcctactgtccttcattggctagttgattaatgacaacttatgagccataatgttctattacacttctcttatattctattggggaataaacaggaagcatggaacaaattcaactcgaagaactcttctaacacttaaatcgtttggcaatcctgagccactgaggtactaggaaggaaacaaatgacatacttggnaagcttttaatgtttctatcattataatagcctcttttcttttttgcttaattcttggccgagtctttgattcattctatgtaaccacagttgcttctggaacctgtgtgtgatgatctgcaatttgtacccatggtgtgtag

SEQ ID NO: 99478 - DNA, 627 bp, Oryza sativa
cgactaagtctcccgtcttgctgtaatcgagaatttggattgaagtcaagaaattttatctcggcgggtacaccatttcttcattccgtattccttgtcaagatccagcaactgttctcgagcgatcgagaaggcgtagagtctgcgacggagccttgtcgacatttgtcgtactcgccttagtcgatcttggtgtacaaccatagagacatggagccttcgtcattgtcgaatagaattttcttgaaatcaatactaagaaaagaatattagatagaaatagcccccgagcgaacgctcaaagggtaacatgttataatataacatactagtgaattgaatgtacagaccagtgttttgtatatgagcgtcttctctcttaccgactccgatcagtcagtttgtggagtcatacactctccctagcccccagccttgtcgtcggagaattgttctcggatgataaggctcttggacctttgacctgccttggttgaacaagcactgatcctagccccaagccgtgaagttggaaattccatttccgattacacagcttggttaatacgcacggcgagaactattacacgaccagatcttacatggtctttcgtctctaaagtgatg

SEQ ID NO: 99479 - DNA, 670 bp, Oryza sativa
ttctcagtaggagttcacagaaagaggagcataggggccatggccgacaatgcatccaaaaggcaagtgcaactgtggattcagctgtaaaatactttgagaaacgacaattccaaattccaactaggcctacatgttttgtgtttcttttgttaaaaattatttgtcaagttcagctaagctcattgacttggcaagctcttggtacataggattgaacatgtatgccacacactggttcaatgttaccttctccattttagttcactgttatattttaatctttttttacacactaccaattttttgtgctgatgttgttgatcgattctttatatttttggcaagcacgcaagattggggaggtgacattgcgtactgtacatgatttcttttggatttgggctttctttttcccgtgatgggatgtagggctcttggctctggtcacgcgaaccaaagaacttccttttctcaagtggagtgctgcgggctatgggctatagtaacctagtgggctttttcgtcggattttttgtgtacaaactgtgatgggccctttgttttctttcaaaaaagaggtggtctttttgccctactataaaaacggaagcagagtcacgagtaacgctgcttttttgttcacgtgcatggctcatgtatgcgcgcg

SEQ ID NO: 99480 - DNA, 653 bp, Oryza sativa
tccttctccccttcaagattaatgttgttttcccaaaagataatgatctttaagaggtcattaatgatccccacaactttaaataaagctgtcctgcttggttacaagacaatatgattaacccttcagcccgccaactaaaatatataaaatttcgtcaatattggacatggcacaataaagaaaaatattgggatggccgtcgtggtgcttctcgcagaattggccgcattgctcatgtcagcccttcacaaggagaagcttactacctacagaagctactgcacattgttaggggcccaagatcctttgctgaaatcagaactgtatcaggtgttgaatatcatacattttgaccagcatgtgaagcattaggtctccttggtgatgaccaagaatggtcaaatgctataaagtatgcagctcaatgggccttctcattccaagtacgccagctttttgccacaatgttactcttttgtgaggtaacaaatcgtattagactttacaatgaacatatgtcatgtatgagtgaggtcatagcatatcgtacgacccgtaacgcttctcaggccatcagctccatcaatacatttgtaacatcatctcgccttcttgagttagacaagctgctaacacccgttgggtatagt

SEQ ID NO: 99481 - DNA, 577 bp, Oryza sativa
tatttcttaagttgatgaaatcttctgtaaactcatcttaacataggaatttaaggttcgattacacatttatacttgactagcccactaataggaagctggtataggcctgaggaatttttggggggtcttatattaagatccagataatttctagttcctgaaaatcctatttattctaaagcctattccttgattgttggttagctaataaaaaaacttatgcaagtctaaagtcaggttttagcgaatttgcagaacaaattacagatgcttacattgcagtataagaaccagagggactaaaagcttacagtgggtccattaaaggagcaatacttgaaacatctgatgcagatgccgggaaaaagtgagcaaaaagctggtgctcaaattggcatgcctgagaagcaacaggaaaagtagtaaaatatgtcttgcagtcaaaatcagctgaatattataagaggagagaaaaataaaagcatgaatactggagattagataaaattggttatgtgccgtcaaaggctcagaattcagttttatgacattgaaagtcccaggttgaggggaa

SEQ ID NO: 99482 - DNA, 992 bp, Oryza sativa
  unsure (1)..(992): unsure at all n locations
tagtaagacaaagagggcaagcggccatcctcccagcaagctcgagcgatatgccggcacaatggcgtcgcggcaagcgagagccctcctctcgtcggcacgggtcgccggcgctggcatcgccgccgtgagctgctgctgccaccgctccttctcagaaagcggcgtcngcgtcggtgagtcagcaagagcctgctacgacgcagtcggccggcacgacgtcgaagctgcaggcggcggagggagcccccgccgggagtaaggaggggttcttctggatgagggagcccaggacggggaactggatgccggagaaccacttcaacgacgtcgacgccgccgacctccggtcccagcttctcttcgccaagaaaaactagctagatatgccctagatcactgatcattggagccaccatcaagatgatgcacatatgcaagcgcacacacgaacgcgcaccagaagtcttcattgtgtgttgtattgtggattaatcaccaagtagcagattcttcgttgtgtttttgtgtgtgtggaagtagggattaatcacttcgttcattgtgcttttgtatgtgtgccacttcattgtgtaagcacattttttattcaaatttctgtgttagtttttgtgtgcgcggaacacaatttgaaatttgtgttagttttttctttttgttggttcaaattgtgtgcggaacacaatctgaaaattgttggtctgtttgtggaacacaatttagaatcacggacagagcttgcccagtaacccgatcaagaaaattttttagctacaacttatgtattttcatcatatgtacacccctccaatccaaactcagacactcatatcagcctaaacttggtctaaagtagagtaaataaagtaagtgagagtagcacatctctccatttccttttagctcttggtctaaaatagagtaaagcaaacgagtagcacccctctctatttctagaatcgcaatccaaa

SEQ ID NO: 99483 - DNA, 771 bp, Oryza sativa
  unsure (1)..(771): unsure at all n locations
ggggggggggagaaaaagaaaaggagaggggggggggaaaaaaaacataagggaagggggggaaaaaaaaagggcnggtcacacaaaaaaaataaaaaaaaagaaagagtgaattggatttgatgcattncaannnncnnnnnnnnnnnnaaaaaggaagggaaaaagggaaaaaaaaagaggggaggaaaaaaaaaaaangggaganaagaaaaaaaaaagggggggaaaagaagggggggggggggaaaaaaaaaggggggggaaaaaaagggggggggaaaaaaaagagggggggggaaaaaaggggggggaaaaagagggggggaaaaaaagaggggggggaaaaagggagggggaaaaggggggggggaaaaaggggggggaaaaaaagggggggggaaaaaaaaggggggggggaaaaaagagggggggagaaaaaaaagaggggggggaaaaaaaaggaggggggggaaaaaaaaggggagggggagaaaagagggggggaggggaaaaaagagggggggggagaaagaaagggggggggagagaagaaaagagggggggggaaagaaaaagggggggaggggggaaaanagagggagaggagggaaaaaaaagggaggggagggagaaganaaaagaggggaggagaaaagagggagggggagagggagaaagaggggggggagggagaaaaagaggggggaggggaagaaagagggggagagaggaaaaaaaaagggggagggggagaaaaaaaagggggga

SEQ ID NO: 99484 - DNA, 679 bp, Oryza sativa
  unsure (1)..(679): unsure at all n locations
attgaaggcacatcataataagggaacgacgaccatgatttcgcgtaacagacaccgggagtaactatgttaatggcagccatcaatgacctcgttggtgagcgtggagaaagaatcgccggggagggggaggcggatgagaagcggcgcacgcagggggtggggcaacttggggcgccccccgggtgtgtgtgtggggggggagtggaagggtgtcttnttgacgaaaattgtcgcttgctcaggtggaggagaagccgcgccggttgaatgccccagagattggggaaacccgggtctgtaatgacgccatctccattcaggagaggcagtcagggcgtcatccgccggtcctggcctggtacccccccatgtgagaagcaatggctttctcttgtgggcccgcgcttgttgcgctctgctatgggatagtgggtaaggaacctaacacccgccatcgcgagaggaaccactcccccccccccatgggaaaacccgttgccgttgatacacaaatttttggcttagggatctccctaatatatagtattcaaccgcctgggaagatttcatccgaccggctgaaaaaaataagcgatgtggttttacccccgtctctgtaaaacttcttttaactcaactatggggggccaattgtttaggtttattgaatcccaac

SEQ ID NO: 99485 - DNA, 722 bp, Oryza sativa
  unsure (1)..(722): unsure at all n locations
tgcggtccnntttgaattgacataccactgctgcaagcccgcgggncgactctagaggatccccccgatgcttacccctgcctcgtttaactagtgcgcaaaaggggatcacactaaagcatacgctttgattattaggcgtaggtttgtaatagtgccaccgcaatagggcctgttcattaaaatacactacatggtgggctgtgggggcatggttctgctagtcgtgcccctggcgattaaggaccggctcgcgggatgccctggaagaacttattgtacttaccacaagccagcgtgtgcaacagctgggcttttagtgtagcttttctttaaccgacctacccaagcgagggtgggcgtaatggacttgggtcaaccagtgtggccctttgatcgggttacagattcaccgtggcatttaacgggggctgcccgttgccttttggggacgggggcggaccctaaggagttgtaccaccggtagagagggttatactaagggtactgtcacggtctctatccggtatttcaagcaggcatgtacacccaccggaacatatcgtggggatattgtttgtgggaacaagtgtacacctttgatcagagtcaaactatccccatagccgcgccccgtgatattgggcggctaccggattcaccaatgatagtgtaacccctagatcagctttatgaaccggcgcaggtttatgtgttggttg

SEQ ID NO: 99486 - DNA, 614 bp, Oryza sativa
tttttttaattacgggcgacaaacacgttcccaattaattcgcgtggatgaaaatataaaattaaaaccgatttaaacatggatgacgtaccaaaattctaacaaaaacatctttaatttttatctctacctctatctctactacttaaaaaattgaagatgtttccttcatctgtccaaataaaaaaaaagcgaaaaaacaacctaaaataaaaaagtatgattctcctaagaagtggcagaaaaaaaaccgtagatccgattcccctataatttttgtccattttattttctttttgcgtttcttactcttttttttttctttcaccggtttttccttttccttttctctttcaccatttttttatttgcctccccatatgtttcctcctccaattcattggaaaaaccgattcctcactactcattattttccccttgaattccctttcaatttggctttaattcaccgaattgaatctccatttcatcgccattattttttatctcgagttttgtggattgcttcaattttgataaaaaacggaaaaaagagatcggtttgatcaaaattctcaacaattttgatttgattgagaagatcaactcctttt

SEQ ID NO: 99487 - DNA, 607 bp, Oryza sativa
ggctccaacaagcccgcctggcaaacgagtgcttgatcagcgaatcccattgaggttatcaggataagacacacatactcctaaagatcactcgatattgaaagctgctgaccctaattgtggtacatagctaaaagtcgactctaaaccaggtcctttacaaaatactaagctccgcaaaaaaaccttgagcactggataaaggctactggtaaccaactctaacatgcttaatgcaagtacgcgattagaaaaaaagggccctttgcgaataagccatctcaaatcatccttcccaacagatgggcatccagaccaacctatggacacaccctggaacagagcaccaagcgcaatagctgacgtggtttctcgcagacttaccgcttcgcttaccagtaagcaaactcccgaacctttagttttgttccccaagtagatagcaacgttcaacaattttcacctgaagagtctaaaggtgggctctgctatagcatgactttacagtgcttaacggactccttgaccccaaaataatggttacgggccgaggttacatataccgtgtccatcccctccaccagatcgctactaccacctgtgaaca

SEQ ID NO: 99488 - DNA, 844 bp, Oryza sativa
  unsure (1)..(844): unsure at all n locations
cgggggggttttcttagggagtttgggagaagccttaaaagtgtgtgagtagccccctggtcaccggggagacaaaggtcccccttataatgggtaaaaaggggaaccagggccatatttcttcctgaggaaaaaaccgctcccgttcaacgccctaaaaaaacccacgtgtattcgggcccgaggaatccggtccttaccttagggtgcgcgtggcctggggttggcccaacccctttaaaccaattctctacctagaggcccagaactcattctaccacaaacatacccatcccccatggagtccaattttcccccccccccaattctactgcactactcccgggtgcagtaggacagcatccccgttggatctaccccaataaatagctagtgtcccctttaatgtactccaaaaatccccttcatatttaatactgaatccctccatccgtttcaggttataaaatggctcctctaagtttgcctaattttatagaaaaaaatagtaatatttccacccccagtatagtttctttaaatctataattgaataaaaataaatgttcataatatatttatcttgggttaaaaatattatatttttttttataaaattagtcaaccttagagtagtttgacttggactaaagtcaaaccgttttataggggttcctctagagtcgccgtccgcgcggcanagatgagcaatacaaattgtcccggngctggggggaggaagatannaaaaagaagagtatagacannatacgtagnnggagtacgcataagagagggagaccaaagcaaaccctaagcaaatagagcggcgtaaacacagagc

SEQ ID NO: 99489 - DNA, 653 bp, Oryza sativa
cagtcagtcatacagtggtgggagaacattgcaaacacgcctagtgtcccgaaaaaaggactctcatcgctcattgggttagtcgtctaggaaatttggaaagagagaaatccgcggatttttgatcacaaagaggtggcaacgaatttcctactaatgaaaatcaaagaggaggcgagcctttgggctttagcaggagctaagcggttgcgtgagttaatcccgcactctgtatagtgtacagctatagtggttcttcgttttccttttacccctaggggtttgtattttctcctgctcttagatgaaaaggcactctagtgctgttttccgttcatttttttttaaactgcacaggcgagcgtggccgcccactcctactagtgattccattcctgtggaccgtgcatgatatgcgtgcagctgacgagcgggccaagccgctcgatcatctaccgctcgcccgctgaaataaatcctgaccattaatgccatgttcggtcgcgcgcaccgcagcccagcgtccagttgtccagttgacccagctagggtccgatgcatgcatccgttgagtatccccaccaaccaacttcctttatgatttacgcccccttggtccagaagatatatagtggaaacaccctttcccgggt

SEQ ID NO: 99490 - DNA, 876 bp, Oryza sativa
  unsure (1)..(876): unsure at all n locations
caggctgggtacccttaaaaaaattaaaatattttttaattattttaaaaaatagtaatagttataaatccgtaaaggtttttaaaaaaataaactttatcttttaccatgtttagaagtcttaaaaatggtaaaagtttaattttttatacgtaaaatttaaactccaaatattgccttttttttgaccggaggaagtactaaaaaaaagcaaaacaaaaaatacgcttttgtccattgtgcatatcatactgctcggtaaaatttttatttgaaaaagagtgaaaaaggggtgcatcgtcatcatattcccccccacgtttaaggcatcttgttcaattggattcttaacgagtaactaaaaaatgtaaaaaaaaaaaactagaaatcttatgatgtgagaattgagtttatgcccttatcggttggcaatacattattataagcagtaacggcttattagctacttaaaaacaattttaaagtaaaatttttatatatttattgttaactacttaaaaataatgctaaaaaaatagtgttgaaaaatactctgaaataaacttcaaaattaattcataaatttaaattttgacaatgactcatgggaaaccacaagcccttaaaaagagtcgaagtgattgcttgcatgtcccaccatatgcaatccctggtgaatataacatcgtccatgtaaaggggatcctctagagtcgncctgcnggcntgcngcnagnangtcatcaaatcaancacctgggggggggggggggggganaaataaacaatttagttcgganctgtaagagcgcaggttaataaggagaacgattcatacacgatcagttgtatacaactgcacgatcttattcaccc

SEQ ID NO: 99491 - DNA, 693 bp, Oryza sativa
ttgtaattcctggtagacgggcccttgtcaattgtaaatgtctttttttccaagaattttataccactttaaagtttaaaagatggattggctgattattgcaaggaactggtgttcaactcgcacacgcgtttgttaatctttatgcgccatgaattatgcatcaagatgatatggcacatactggctgtgtaatgtatgagtttcacccttttattccagattcgaaggtgtagactccacaacagagtcaggtaccttcagctgcaatgcggcatatataatatatattcaatatctggcaacctggcgaggcttataaatactaggtcatgtgtgagtcatgttcttttaccacaaatttaataaagctcaaactggtggtttatcgaataaactaaataatcttgatttgtgctgcctataattcaaaggttaactgccgcgatagttccctaaagaaaaaactaaatggtcgccagattaaatgcttccatcggtgtcttgtgaactatagtcacaatacagtatctaacactatctttttgtggtcatatttttaagtgatgctggtattcttattttggaggtccacgttattacttggttgttgagatgtttaagtggtttttactatcaacattttctattttaagggtgttttcacacgcttttattctggaacattttcac

SEQ ID NO: 99492 - DNA, 726 bp, Oryza sativa
  unsure (1)..(726): unsure at all n locations
tttagagggttccccctacacactccttattatacttgacattcttttaactttttccttcagatttaattggggtagtcagccgtattggtccatatgattcggcgagcccaacatcagacaaaaaactcagaagaattcaaattcagaaccaagagtatatgtaatccttatcctcttcggggcttctttggaacgtgagaaattttcttgatatattcctattgtaattgaattgaattatgaatatcctataaaaatgttgtatatattgcaaagaatgtctaaattggagttcgtactactgataaagattgacgtgtacaagaaaaatgaggaccattgtgtcttcttgtaggaaaaatgattacatattgattttttttatgctgtttacctctagtagacccaacatacccacagtaatgatttgcataattgcattgaattgactgagttaattaatttgggtaaatttcagaaactgatcagctctattcgcgtgatttttttggaaacaaattattcattgacctgacatttaaaagaaagctaaacgcacaaacttgaatcttggacagaaacaatttgcgattctattaaatactctttgtctatagttttgctacttaggttagtagtagttagtttatgctgtcagcatttattaactaattatctaatcgagggtacccagtggcatatcaaanttcaaangtgccacat

SEQ ID NO: 99493 - DNA, 686 bp, Oryza sativa
  unsure (1)..(686): unsure at all n locations
gcatgncgagctgttattatagggcgcgccaacaacggcttgtaatatggacccagcccacaagatagatgattgcttagctcctttcctattattagcttatcttaaggtcaccatatataatatataatagattagctataaggttggcaataatttcttctcttcttttaattttccacttatacatttaatgtatttgtcttgaagtttgtgataatctagctcttgcataagagtcaacacctttgatttttcactatctctctcctccacttaaacttatagtagggcttatagctcactattatacttgctcttagagcacccgcaatggtaaagtaaggtgctatctataaaacatgtacatctcagcaatagacttgattaatagtaaaccaccttaatagtatgtctacattggtatctatagctctctcatgcattgcctcgtttttctctatagactatctctaagttagtagatagctttgctctctctcttcatttaataccttccaagtaggaaaatatgctgacatggatctcttgtagagagcctatagataaccattgtgggtgcccttaggctatgttcagcaggaccccggcgcggaaaacaaaacacttattattacatgattaattaagtactaaaatggattaatatgatttttctaaaacaa

SEQ ID NO: 99494 - DNA, 969 bp, Oryza sativa
  unsure (1)..(969): unsure at all n locations
taggcggcggggggaaaaaaataaggtgaggggtggggggaaataaaggggggagggaaaatataggggtggagatatnntgtntncccccccccccccccggtgctttgttgtgnngtgcactaacncccncnnnnnnnnnnannncnnnncnnnaannnnncnnncccagaaaaaaccgccaaaaaaaaacacaccccaacaacacaccccaaaaaacaaacacaccaaaaaaggggggggggggggaccccacacaaaacacgggaggaaacaacggggaaaaaaaaggggaggaaagggggaggggacanggaggaggaggaaaggggggggaaaaaggggggggaaaaaaggggggggaaaaggggggggagaaaggggggaaaaaggggagggggaagaacgggggggaaaaagggggggggaaagaggggggaagagaggagggggaagagaggggggggaaaaagagggggggaaaaaacgggggagaaaaaaaggggagaaaaggggggagagaggggggggaaaagggggaggggaaaagagggggaaaaggggggggaaagaggggggaaaaggggggagaaaagggggggggaggggggggggagggggggggggggggggaaagggggaggggggggggggggggggggggggggggggggggggggggggggggggggggggggggggggggggggggggggaggggggggggaggggggggggggggggagaaggggggggggagggggggggagggggggggggggggggggggaggggggggggggggggggggggggggggggggggggggggggggaagggggggggagggggggggggaaggggggggggggggggggggagggggggggggaagggggggggggggggggggggagggggggggggggggggggggggggagggggggggggggggggggggaggggg

SEQ ID NO: 99495 - DNA, 646 bp, Oryza sativa
aacattaacagaaattcattgccattaggaagtttagcatcccttgagccatttactcctactgtttctgaacacatatggggctatcacaacaaaacacaaaatatcgatgctcactcatctctgttatcctcaaaacaaaaggagagacccagaaaagccaagcacagagctccactggaagacaactcaggaagaaaatagcaacattataacgcaatcacaaaatgttatttagacaatgctgattctactagcatgacaaacttcaaagttagaaattaatagatggtcacatagatggcgggcattattatcccaccgctccacgagaattggtgttgtttggaatgattttaagtacaagtccaccctcaaagtattgaataagaaattcttcaatagatgcaagttattatcagttatggtatattgtgatattcagcaaacaaaatttgcagagttatatgtaacccataacattctaatttatgtgcaagctttcagacatttcaagcatagttcactaaaggcattgacaatttagacacaggtgatcaaacattaacagaaattcattgccattaggaagtttagcatacttgaacaaatttactacaactgttcttcaattcatatggtctat

SEQ ID NO: 99496 - DNA, 743 bp, Oryza sativa
caaagtcagacgattatgataatatgatattagatcgcgacagtggagcatacatacatatacaggtggattaattgtttaactatatatatatatatatatatatatatatatatatatatatatatatatatatttcagaacagcaactgagcctgaaaaccacgaggtctgaaactgaattctgattcgttttggattatgtgtgttgcagagctgatatatagtacacagtaccatgattaaattgacaatggaccatattagttcgatctttaacataccgttcgtgcatgatgcagtggtgagtagcagaagtataaggatgattagatactttaattagcagccagatcacgattagctatcatgcaccctcactattccaacataaacaagtgtcgatgaaaatgtttggtcactacccctgcaactgcaattaaccacacctccatgtgcattccttttgcacaactgttcctaattaagtccactaaatcaaaccacctactcttacatcaaatttcagcaaatttggctgcatggaaattgcatttctagtgcactaattaattaactctgatcaagtaattaattatctaggccacgagatacagatagatactaagagttgtactacatgtgtatgaactatgaacaatagttaatatcaggcagcacccacacaaatgatttgtactctgtgttgtctacaagcgaaaaaaaaagaggaaaaaaaacaa

SEQ ID NO: 99497 - DNA, 639 bp, Oryza sativa
cgatcttgagtagtattccctctgtcctataatatagtaacctaatactagatgggatatctcatagtataacgaatttagacagtccatccggtactaggttgctatattataggatggagggagtatataagtacggagtagagaacatcctcaacacttgaagtaagtttttttttctgaacaagagggcaggagttataggatgaaagtgttatatgagcagagtttaatttgagcattggcggtagagacatcctattggctggtttatataggtccatttatttaatgcaaaacctcagttttcgttagcatgtttttaaattgctaaatggtatgtttcgtgtgaaaactttttatatgacaattgctctaaaatataaaataaatccagttttctaatttgaataattaaaaatcaattaattacatgctgagtaatgtttttttttgcgtgcccttatttaatacccaccttaattaggtcaaacaggccatagtggtttgaatagggccatagtgtaggtttcatagaattgcatataactttttttattgccaaaattgtcttagtatatggtaaaattctggcatttgctttgagagagctctgagttcttgacatcagttttgttt

SEQ ID NO: 99498 - DNA, 526 bp, Oryza sativa
tttggattacattgcagaaacatactgacatatattactccctccgtccaaaaaaaaaaaagacaaaccctagatttccgtgtccaacgtttgactgtccgtcttatatgaaatttttttataattagtattttcattgttgttagatgataaacatgattaatactttatgcgtgacttgtctttttaatttttttcatatttttttcaaataagacggacggtcaaacgttggacacggaaactcagagtttgtcctttttggacggagggagtatttcatacgcaataccaaattgacaccatattagacgccccactaacacatgctctaagattaaaaaaccaacagcacattaatgatctcatcaaaatcttgttgaaagttcacctacatgtgcataatatttgtgtacaccaagatttaacccctgatggatttacactcacttaccaaatgattctactaaaatattgataggacaaaattggtaacaatccaaataagtctttattttttttagat

SEQ ID NO: 99499 - DNA, 612 bp, Oryza sativa
agaaaaagttgttatctgcatatgttccagtaatttagatagcagatctagtcttttgtcaagctagatagcatataataggaaagtacatgtactcctccaaattgaagcagctaatggttctatttactaaaagagtttcctgtatcggcactattgcacagtatttgggcacaacttcagattaagttcacataacttcagattaagtgcatctaccagatcacatagttattttttgacaaacaacacaccaaaaaaaaatagtgtagaagactatggggttagccttgtcaatctcagaatcacgttgttgtgtcgggcagacttagttatcatactttgctacggatgcccactacagtcatttgaatattagaaatagatgaaactcagaaatatccagattgaagagctcacggcgtaaaaattaatagatatatataaatagattatactcttaacattttgtacttaagtactgctacagctaccaggtagccatctgtcaggatcagcccttcagaagtcagaaattgaatgataagcatttgaggaaatataattaagcctaacagggttttgtgggggagggggtatttactatcattg

SEQ ID NO: 99500 - DNA, 616 bp, Oryza sativa
attgataaaagatggataaaaatagttctccagcaagctgattggttcgtttacccccattcagttttacgccacgtgtcatgaagcattcggcaaacgatcgagtgtctcgcgcatgtattgctgtcttcgtgcggaagaaaacaaaaataacagcagcttctgaatgtcgtctcacctcacgtccctggtatctaggccaaacactctcattaatctctcatccccgttctataaaaaaaattcaatcatcccagctggcctagctacattggcccgtgctgtgcacctgtgctggccgagttagctatcactgacttgttagctgaacccatacatgtgagtattgtagcatatatgacaggcttggaaaaaaataaatcaaaccatattggtctcatatacaattatttgtggcattaaattagtattagttttatagtcaataataatataatgagaatgaatattgatgatcaaattttggtgtcaatgccattttaaaagctaacacatcatatatttctcaaaaagagaaagtatggtatagtctgccacacaataaagaaaaaatgcccacacctttgactgggttataatattcatatattactta

SEQ ID NO: 99501 - DNA, 549 bp, Oryza sativa
ctctttaaaatatgtttatagatggcttatagcctactattgtacctgctctaagagcgagtttaatagcatagcccactactagctacaaatcatttatagccaatgtaataatcaattcatacaatagttgcttactatactattaatacttggtcccacctgtcatacacacattacgtcttagagtttgtgctatagctgactacagatctgtagtctgctactcttctctcttcatttatctctttaaaatatgtttataggtggcttatagcctgctattgtaggtacagtagtagtaggctataatctagttataaatactcctatattttaaggagatataaaataggagagagaagagcagcgggctacagatttgtagtcagctgtagtacggactccaagatgcagtgtgtgtatgataggtgggaccagatattaatagtgtagtatgtaactattgtatgaattggctattaagttgactatatgtgatttggagctagtagttggctatactattaaacttgctctaatactcca

SEQ ID NO: 99502 - DNA, 893 bp, Oryza sativa
agttataaatactcctatattttaaggagatataaaataggagagagaagagcagcgggctacagatttgtagtcagctgtagtacggactccaagatgcagtgtgtgtatgataggtgggaccagatattaatagtgtagtatgtaactattgtatgaattggctattaagttgactatatgtgatttggagctagtagttggctatactattaaacttgctctaatactccacccgttcttgaaaacttacgtcattgacttttttaaatatgtttgactgttcgttttctttaaaaaatttaaataattattaattcttttccaatcatttgattcattgttaaatatacttatatgtatacatatagttctacatatttcacaaaagtatttgaataagacgaacggtcaaacatgtgctaaaaagtcaacggcgtcgaatatttagaaacggatagagtagaagactataaaaaagctaaatgctgaagtggatgagagaggagaggagagagaggggaagtgggtggtaagctcacagccggcttaggtataggacaaaaaaataatctataagagatacagttagaccatatattaaccataaaaagataaccactatacaagttaacgttaactgggaggtacgtactgctgtaaagatctattcagtagacagctcgctatattattaggctcgctggggggggggcggtgggattctttcggatacggtggacagccgcgctctccgctccgctggcgccggattggaacttggaaggcgtcgcgtcgcggcgcggtgcggcggggacggcgggcgggtgcgtgcgggcgcggggcagtcaagccggggcctatccaattcggcagtccatatgcacgccaca

SEQ ID NO: 99503 - DNA, 701 bp, Oryza sativa
ccgactccgattggcgattggacaacactgaaggtcagtgactctgtgacgtaactcaataattttgcctcactgcttattgtcatggctaattagttagctcatagcttaggttgccaatttgtgatttgtgaatggctgaatgggaataaatcgctgctgttattgtaggattggaattagcttattgggtgaaacataaagaggattggggattggtattgacctattgtaatatttgctcattttgaacttgcttgttaaattagtcggctattgatgttataagatactattgttatttatgtgtcgccttttattcaaatttgtacttgtatatgagatttgccgtgtttaaaaaatttggtaagtgatttgaactattgaagtcggactagccaagaaaaattcctagctacaccaatagcccacttcaagatagcaattagtcttggcctggggttcggcaaaatcctgggaccagggcggagggctcagtagggcgaggtgtggcgctcgccgtacctcgtgccgcctgctgaccacccccccttcccccttcctcgtactcctccgcacagagcaacaaccgggtcagagagaatggcgacgcagcatcgtgagaagacgagcgacggccgagacgtgctgtggacgcgtccgcgtgtgccagtgctggtcctcacactgatagctagtag

SEQ ID NO: 99504 - DNA, 1636 bp, Oryza sativa
cctatgcactagacactatcaagttttgcattgggagagaatagtgtcttcatattagatgaaaaataaatatgattggtagaaaagagagatgatgtatttattaatggtccactttaagaaactatgggttgtagagagtgtagtttctattgtgatgtcttattaacatggcaccatagacactgcttatgaacactatgggttgggactgtcctaagtagaggagcatatatattgatataaaatagttttataggctggataagaaaaagaaaaccctaagagttaccctaagatgctagtgaaaatataaaataaattaccctaagatctgtgaaaatataaaataagtttgtaagtattgatacaacaagtgccaaccaatccgagaaatataaagacaagtggatagcaacgtatagctttttataatattagtagttcgtaaatctaacaaaatagagtaagtcatatgagaatagatgtcaaataggaacatatttgatggggcctactatatacgtgtttggttggcatagttgtcaaccgatgaacgcacatggtgggcccccaccaaatacgtgtttgatgggccccgcaatttacgtacaatgtgctcatcatattgatatgtataattgattattttgtgccaataatttagaattaacaacttaaatgtatgaaatgcatatttctaatcatgagagtattgttaacaatatcatgcatgccatgttgacaactcgagataacaaatctagaagcttgtgccatggggagcagtatattttccagcaaaacaaccgattattgcatgcattggtgataatcttttttaagagatatcgacgaaatggaagtacatgcaaattttttaatccaattaaattaacaaagcatattcattttttaccgtacgtataatttgatgtacgtacgtgaacatctcctcacttttctccacaagagagattttcccatcaagcaacttatcaccatatatacagttaaagttaatattagaacatggtgaatcgtattagatcatttggaatgcagaataatctttagtactccatctaataaagcacacaattaaatcacatatgttttcccagctagttgaaccctgcataccagctacaacactgaacactgtcatcacacaaccaaattcaccagtagtattaaagaatcacataaaacactgtcatcacgatcaatctttcgcaaaacccggtgttggctttgcaaataaatactccctccgtttcattttatttgacaccgttgactttttagcgcatgtttgaccgcttgtcttattcaaaaaatttaaataattattaattcttttcctatcatttgattcatcgttaaatatacttttatgcatacgtataattttacatattcataaaagtttttaaataagacgaatggtcaaacatgtgataaaaagtcaacggcgtcaaataaaacgaaacggatggagtagttgtagtactctacaagtctatagattttttcagatgtcgacactatgaatgtatgtagagtgtgacacattattgcaacatgtagtgagatgagttggcatgggcgagttcatcagtttagtattatatta

SEQ ID NO: 99505 - DNA, 622 bp, Oryza sativa
ggggagaccagatccgatctcccctggcgtcccctagcgatcaatcgcccattaggagtttcgctcctcacctcccttccccctccccttcttctcttcctactacaccataaattttaaaaaaaaataaaaaaacaaagttagaaaaatttatgtatagaaatactatatataaaaaatatttaaattcaaatttaaatttgaaacgggtatataaacttttgacttataaactttgggtctataaattaatatttgaattcaaattcaaatttgaatcgggtatgtaaacttttgacttataaactttgggtgtataaactttggatgtatagaaatactatatataaaaaatatttgaattcaaattcaaatttgtatcggatataattcaatttcaaatttgaatcggggatgtaaacttttgacttataaactttgggtctataaactttaggtctataaactttagatgtatagaaatactatatataaaaaatatttgaattcaaattcaaatttgaatcgaatataattcaaatagaaatttaaatcgggtatataaacttttgacttataatctttgggtcaaactttaggtgtataaactttagatgtatag

SEQ ID NO: 99506 - DNA, 1342 bp, Oryza sativa
tgatagtactgattgaaaattggcagtgttgctatagtgtcgacattcatcgattggaagtatgcaaagctaggtcatctctcctagattagattacatttgctaatctagtgccaatctagtggagttgcctagctatctggactttaagtgatgttaaaggacgtacactagtgctgtgtttagtttctaaaattgaggagaagtttagaaaaattaaagttggtagtttgaaaaaaaaagttaagagtttatgtgtgtagaaaagttttggatgtgatggaaagttggaagtttagggaaagtttggtgtgaactaaacggagcctagattagatttagcagacgaagtttctacagcaagccaccgtacttgatataattctttctgttgtacacggcaacattctggcgacgtatatatatgcagtcaaagttttgtgacttaatagttaatacatatataatggtattcatatttatcgaacaaaaatataaagagatgaatcatcgaggaaagcactaaagatgtggttatataggggttcaaaatcctggtgctgatgagtgtacgctctcgttggtgcatttataacaaggatttagtgaggcacgtgatttgttgccggtattactaaataatccttaatatgtcatttcaacaatcaagcaaggagtaaacactatattagttattaacaacaaataaatttgttttatgctatgtttggagagaaataaatttaatagctagctctgtaggagattataaatgaaatattatgttgttggccaagatttgcatcgcgagatgtggaaggtgtgtttagttcactccaaaattgaaagtttgattgaaattggaataatgtgatggaaaagttgaaaatttatgtgtgtaggaaagttttgatgtgatggaaaagttgaaagtttgaagaaaaagttaggaactaaaccaggccgaagataggaaaaaatgatgaaaagctaaggtttaatcatgaaacaaactaaataatatcccgtgcattgatacggaatatatggataaatatatattaagtatttaaaaaatgatggataaatatgttaaaaattacggaaacgatgtgagaggcgataattgaatatgctttgcgtgttattttgtaagattcaataaattatagatgatattgcatgcttgtaattattgttagtggataatggtgtagcatgtttacgtgttgaggtttaaatttaataggttataactttatacaaagtatagatttaatagacatgaattcgccgcaggtctttgtctcttttgtcttttgaacattatcaataaaaattt

SEQ ID NO: 99507 - DNA, 787 bp, Oryza sativa
tttaaaaaagaagagaaataattgattgctggggcgttcgcgcgctcaactgagattaaattataactacttagttaattaattcttcgagcaacaataacagtttggctggccttgatgcgtttccaattttttgtgtggtttgcctttgccacaacaggtataagcatgaaaatgtgaaacatgcactaatccggttcttctatttcaatgaaattggtcaaaaaaaaagagaaagaaattcaattttgtaggacacaggagcaggtgaggatgccacctcctccaccaaatgtgagatgcacatgtcgattcctctgttttcgaagcagaaaagaattgaagtgtgtacttgctgctccatgcttgccgtacttaattactctcatcaaagcatgcatgatagatcttcagacctaacgaggaattaaagaactactcgtacttctattactactcttcgcagagacgaaaccggagctggaattattaattaataaataaataaactatgagctcctccaaaaataattagctagcagcatctaatctactggtagtttatggaagtcgtctccatgatagtactgattgaaaattggcagtgttgctatagtgtcgacattcatcgattggaagtatgcaaagctaggtcatctctcctagattagattacatttgctaatctagtgccaatctagtggagttgcctagctatctggactttaagtgatgttaaaggacgtacactagtgctgtgtttagtttctaaaattgaggagaagtt

SEQ ID NO: 99508 - DNA, 619 bp, Oryza sativa
catgtcaaaaaggttcagaacttggtatcctcgagaatatattaaactcagtttgttaagctccatttttgtggctgtaaattgctgatgctgtagagagttcctgcaggagaatctatgttgttaataatagtaaatctaaaattggtgtagtgtacttttactgtggcttatacagatatgaatcaatgaacatatccatagaaatatggaattaacacaaaacagtctatgcttgatgaagataataactggataaattacactttgaactacctctagctcactttacatttgttgtactttgaaacacttctctcttctctagctaatcatatttatggtatccacctgaatattctctagccatatttatcatatatcctcccgtaaatgtacagtatgtttataggttgacagtatcccgatttgtatcctagcatcttagaatactacgattctaccaagtcgaaatggtaccgatcccacctagtatcctaattttcatagtatctcaattctactattcattactatacgatcctacgaaatctttggtggtatccggattctacgatccttacgatattacaaaatattatttaaaataagatggttt

SEQ ID NO: 99509 - DNA, 768 bp, Oryza sativa
cccttccctgccgccagatcgaggaggaggtagtggcggcaccggcggtggcgggcgcggtgctgggggaggaggccaaggcagaggtggaggaggtcgcaacggacgcccgtctcgtgcggtggccgacagcggcgaccgccaccacgacgttgtcctcgtgctcctgaagcggtggcgatggcggcgccaccgcagcgcggtcactgctccgccggatccgatcatcgttgccatcgcggatccgtcgtcgtcgtcacctctctctctctctctcttatcgccacgccgccggtgtcgtcgccgcggatccggtgtcgtcgcggcccttctttcttttctttcttctcttctcttcgccggtcgtcccctacgccaagcccacacggccacctcttcttcttcctctcgcctcctcctttgcatccgcctcgctcccttctcttcccatggcggctgctactgctctcacatgatcagagatggtgatggctagcgtcggcatcaacatgccgggtgtcacgcccagaaatttagcccaaatttctagactattttgtgtattaaatccatgtccaggcatcaaccaaggtacacaaaacgacaaattaatatacagatccaaacgtaaataaagcgtaaaatacttacataataggcagttagtcctcacaccgaaacgaaagcagcagcagcggaaaaaggcgatcttagcggagcttcagctccactccacaggcaaaactcaactggggtctgagccttggt

SEQ ID NO: 99510 - DNA, 602 bp, Oryza sativa
ggctcacgtcaagaacacgacgttccccatgagtaagtgaatattggacctgcaattgatcgtaaagttaaccggttaagatcatatatgaataaaaatcgtaagataaaaaattagattcaatcgtaagaacatatattgaagctgtttggttaaaggaaacgtatgtcttttctgccctttaaggcaagaaacccactcttattccctttagttatactgtactaccctatgtattcatgttggttttcctctgaaagtacggcaagggttcattttaccattcgtcaatcgatctgagagctattgaaacacacgattgagaaaatagaggagtaggagaaaaatacatggttagcagggctgcacatataaaataaaagactgcaataatcatgataaaaaaataaccgtttggttaggctatggaaaccataggaatttgagagataataaaagacttgaaaggaaatttttcatgaggtctaaaactcatgttgattttttttccaaaacttgcacggattgaaatttcatagaattaaatagggtaaaatcatttgtttcaaaggagcatttatgaaaaaatctgtaggattgca

SEQ ID NO: 99511 - DNA, 642 bp, Oryza sativa
tctctctctctctcttcagaaattcgtagtacaattattttgccttacacatcttcgattgttctttaggagggaatcctcagaaattccccaaaagactgatggtgccagtgtaaggaaaacttccttttggttacacgatggtgccatatagcctgtttttattagagcacagggttgtcgatttgtcttttaacacagagaatacaatttcccctatgtattcttatctttttccactgcaaccatagttcactgaaatattcacaatccataacatggcctaatgcagcaaccttttaacctagggaactatttactcaattcttttttagcatttctttttttttgtttggtacagattatctgagtttctctaacaattgtgtttcatatcattgctggtttagtggagcatcggctatgagagagtctagctactagctacaatcagccacttcttgctagtttgttgtcctttgtggcaaggacagtgaactcatactggggaacacaggttgagcattctctgcacatttctaattatatgtttgtgttggtagcatagtgcagactcaagatgtttagatcactttagactaaagaactcttcagggaatctggctatgagtaatggcattg

SEQ ID NO: 99512 - DNA, 531 bp, Oryza sativa
ggttcatgcaatgcccgtcacaattcacaggtaactcatccaaaagcagcgttggtactgtattgatagtttaatacacctaaataacatattacatttacctttcttttttcctttgagatggaaggcgcatgtacttaaacatcaagattagttccagacatactatgtcggatgcaaaacaaaagttagtaagcagaaattcgccagttcattttagcaaaaacacctgacagaaggtaaaaccagtcgacattctgaaaagaatgatacagaatgcagcactccaaactcaaaagtgctgccagccaactcagtagtatcatattgtttaaattatcacattcctctgcaatgaatatcatattccaccaatggatttcgtgatttggcatccatcttaagctaccgacaatctgatcatagaatagatcataggcaaagtcatgatagatagaacttccaacccctttttcgattgtttaagcaaaacatgaaacttcctaaagtaaataacagaaattcacacat

SEQ ID NO: 99513 - DNA, 605 bp, Oryza sativa
tattttaggatgaaggtagtactagcatatgtcacgtccacccaaaatcctttatatgatggtgccattcgttatgaaactattgtttttaaataaattaattatgacattcgttcagaagttcaacaaacgaaataaagctgcatatggtgccatttcattgtccattgtctggctcagaaaaagttggtgcgctttcttagtcgcaatcattaattgaaactgcaggttctatcgttttatgatctttggtactagtagtactaattgacttgtagttgacgccattttttatttatctttacgcgaaaaatggcggaacataatggaatcggagtaatttaataataacttattgataattgcacacaccatcaaatcacgcctagctagggtttattcggttcatccctataatgaatgaattgaagggggactaatttcacatctcaataggagtggtataagttatctctaattccccttcaatcattttgtgaaagggattaaccgaacaaagcctaggttgtgtttagttcagcgcaaagtttggatttttgttgaaattgaagatgatgtgactgaaaagttgtgtatgtatgaca

SEQ ID NO: 99514 - DNA, 509 bp, Oryza sativa
ccaaaaaaaaaacataaagacgctgttttcactagcacaattcatgcaattgaaacttacatgtaaaatttccaagaaaaccacaaggtttgcactgagaaagaaaacaatattggtactacgataaatgatttgacaggaataatgatcatttgatcagatgctggcatagtgaccactaccgagaattcacatgtcatacacacaatatatcacatcagcagtatacgaagtggcgaaacttgaatcaacgaccacccacccccaacctacccagcccaatcagtgcttcagccagcccattagtaagagagaacaatgagagatcgagataggcagctagggggccacaacaccacggtttcttcatgacacctctgcccaatgccgattagtgatcatgtcttgtcgttgaccatcgtggcgttgtcgagtctgaccaagctgccgcccacaggagccagggagtaaattctgaccattctaataccctaaatccttaaacaaca

SEQ ID NO: 99515 - DNA, 552 bp, Oryza sativa
agataagataaatgatcaaacatatttttaaaaaaaatcaatatatggaaatcggagaaagtattgtattcttagacaaaagtagtaaaaaaatttgcaactgattaccgctgcaaaacgcagaactccatcaattcccaagtaggataatcatttccaggacttatagggtgtgtgtgaacttaaatcctaaaaatacttggagcctcatggttaggccaatacagctattgttaaaatttaagtttcaaattttggttttggagatggttttagaaaaatcttaacgtacttttttaaaaattggcttttaggatgttttttaaaaaaaaaaggggaagcgaaaccaccccaattattaaaaagtggtttttattctaataaaatttaaatgttttatccacgaataaaccatttgtcatataatcaactattgtccactcaatagggctcttatatttaagaagagagaaagtataacagcctttttttttagacctgcaaaagtgatcacaaagaatggtagtggcggacggggatcctctagagtcg

SEQ ID NO: 99516 - DNA, 645 bp, Oryza sativa
agcgagtgtccgatagctaattactactagttttttttgtgtccgacagcaaattcgtgttcttgcggtgtctaccagctaattacacattttttaagtgtcctgtagcatctgacacgagctcaccttactctttatttttgcataaacattgaggatatcctgatgcacagtatttaaactatgcatgatttcttaacacagagtcgttgagagctgtgtttattaaggagaatgcaataatactccatccgtacccaaaaaaaaagacaaaccctgctttccgtgcccaacgtttgaccgtccgtcttatttgaaaaaattatgaaaaaaattaaaaaaaacaagtcacgcacaaagtattaatcatgttttatcatctaacaacaataaaaatacgaattataaaaaaatttcatacaagacggacacgaaaacctaggatttgcatttttttttgacggaggaagtacatgttatgaccatgtgattagttaacagcctaacttgcaatactgtttattagtcccgttgaactgtaacaaccatacggcagatactcccggagttggaccgcttgctcctaggatcagctacagacgacatggtaaaaatcaggcaagaacagcagtggaaacaaatcta

SEQ ID NO: 99517 - DNA, 1006 bp, Oryza sativa
tttcattttatttgacaccgttgactttttaccgcatgtttgaccgcttgtcttattcaaaaaatttaaataattattaattcttttcctatcatttgattcatcgttaaatatacttttatgcatacgtataattttacatattcataaaagtttttaaataagacgaatggtcaaacatgtgataaaaagtcaacggcgtcaaataaaacgaaacggatggagtagttgtagtactctacaagtctatagattttttcagatgtcgacactatgaatgtatgtagagtgtgacacattattgcaacatgtagtgagatgagttgccatgggcgagttcatcagtttagtattatattagttgacgatgtgtctgtttctgttaaccctgaccaggcaagaagcacaccggccgcatgaagtgtgccctagctctcgagaagctgcagatagaaagtattttatccaaactactcatctcgaaaacggtggcatgtgtcctcatatgagcacacatatgtcgccatctttagtgcaatcgtgtttagcagctgcaaattaacacgactgcagagataaagaattcattgatacgtacggtggcttcatttgattgggtcatgacgatgagaccccaggttgctatagtaatttaaaatggatttgactttgagttgcatattactactcctttgtaatgccatcttctttctttcttttttcctttgtaaaataattctcgtaatgtcaaatagagccttttaaaacttgttgacacatatatagtgaccaataaggcgataatagagaattcacgatagctacacgagaaacacgctaggaccctcaaattgtactgcgcgcattttgaatcggcggtatgggtctaattaattaggtttgttgtgatggaacgtgaagaggcatttgatagtagtggtaaggggtgtgtgatttcaaatctaaggtcccgtgttaatccccaacatacttataactttttttt

SEQ ID NO: 99518 - DNA, 771 bp, Oryza sativa
cattttagaaaaccgacaccccaaaactactatgtgtgctggttttagggaaccacaaaaaactgagccgatcaaccgagtggttaagtcccattacacgaccgactgatcctagagggcatatgcttcccctctcccaacctcccttcgtctcttcgtctctccccagcagccctgcctctctatgtccactctcccttccctcgatccctgtcacttgacccacaccggcaagtggcaccgcaggatccacctctccccagtgcggtgacgactctctacccctccctagcacatcggccactagatcgagctccctagagctcgggggttgtcggatcatgccacttggagcttgggggccatcggttgagcttggtgacgttagatttgtcgtcaccttaccgatcgagttagcggtggcgaggttggatccatccagatcccatcatgatgccatcaagtcttaccatcgataacccatgtacctggttgtattcatgtcccattttcccatcactgctgctgaccccatcgacgacgagaagaaaaaagtatgagaataagttcaccatatcggatttatgatgtgattcaattctttttttcttgttgtttctttttgagagaatctattttataccactgagcttgctcaagttcaacaatttgccatcaacattgtcgttttctataatataccgacgactttattaattgttctacaatacgccattgggctaagtattcttttcaaaaatacctaaaata

SEQ ID NO: 99519 - DNA, 570 bp, Oryza sativa
tatagggcgaagtcgagctcggtaccccaatgttacaccaatattatacgagaatatcacgtgttaaaaactatgccagtatagggctcaaacctatatataatgatctggtaaatatatccctacccacccgtttgatctagatgcatgcttctaagtgccatgacatatcttatgcctgcaaaatttttgatgctaacggctctttgatattgctatcgatataacttccgcctgtgtgaaagacaacatgttatattgaataccaatactactattcgatactactatgagcaaaatgatacttcgatcctatttctgccgacctacttcataggtgaggggagcatgtaggcttcttggatctgatgctctcaatgtgattggtactctgaataattgatatcgcgcaatgcatacgtatcaaacacaacattctataccctatattgaaaatgatcctatttaaggggaaaaaatgtaaacctctttattagcataagcataccaaagggctgaactctacggataaatatagtggaatgttggttgcaaaactactatttacat

SEQ ID NO: 99520 - DNA, 628 bp, Oryza sativa
  unsure (1)..(628): unsure at all n locations
tagatatgtgattgttaacagattgaggagccaagaatttggttacaacaaagattataaaagcagtcttgaatacaatctgttcgtgaacagtcatcgtcctgttaaattttttctccaatatcctctgaattgttacaatggtaagtccatcaaaggaatctttctcaaagatttcacacttataagccttaacatcttttacctcgttttttattgcaggcaaaatctccttccgtccacaagggattcccaaaagtaggctgacatcctcacatgtcaaacaaatttcatgtctagatcnnnnnnnnnnnnnnnnnnnnnnngggtctagcttgcacagaatccatgctccgaattgcttgttcagtttagtcagcctcatggaaagcaacccatcaaactccatctgtttcactagctctttttgctgatcaccaaaacctaagaatagatctgagagaatagcaggagtgcacctggtgtaaattttttcttgtactacctttttacccttgatgccacttgtttttttggaatttgatactgcagaaccaggtagctgcttccgctgatgcatctttcttgcttgagccagccctgaaggactctagtgaaaacagaacta

SEQ ID NO: 99521 - DNA, 1049 bp, Oryza sativa
cgactctggaggatcccccacttcctcatcaacaactttaaggatccaagagcaaatgtaagaagcgtaaagaatagggaaaaaatttggggataatctgaattcgatgtggcttctctccctacttggatttgaagaggaaagattcaaggtggctagcatcttctatggcgccgccggccgccggacctcctcctctcccacctctccccaccggcctctgtcggggagctcgacgtcgcgacgctcggttggagctctctttccctctctctgcgccgtcgcaagcggggtggagctcgacgccgtgacgctcggtccgccctcgggctcgaccccatcctcatcggcgctgaccccatcctcgtcggtgccacaccaagtcgccgccgcatcgcctgtcattggccaccagacgaggagcaaagtgagagagagaagaagggagagaagaggggaaagagattgtcctacgtggcatcctgacatgtgggacccacgtgggtccaatgctgactcagccgctatataggacaaatccggcatcaatattgccctgggacctcgggtgatcggttttgtattgttaagagaccccacatatctatttttacggttggaggacgattttgtaactcgatgacaagttgagggaccttcggtgtactttttcctaggcataaatggggaaagcgccaaataggtctaatgggccggcctggcttatcacggcccatttgacacgcgactgcacgcttaaactagtttgcatgtttagcatagtggaaacttgaaggtcttaatttatttattttttatttgtgttgacgtgatggcaggtaaacttgaaccatgcacgttttgatattcttttagttatccaagatccgcaatctgattgtggttagttcttccaatggagcagggacggcctagataatgacgtcatgcaggaacgactcaaatcaatcaggttgggcgatcatggttgcgtgcaacatgtctcaactttcagctatggcaagtattgcaacagattagtatatata

SEQ ID NO: 99522 - DNA, 574 bp, Oryza sativa
atttgctatttatatgatgttggagctagctgctagctacctatattgaaccttctcttgtatctcaatacatatacgtgtttcttatctagctacaatggagcatatacatacatataaacaatagccttgtggtctgtcacccccattcccaaatcctggcttcgcccttgagcatacgtgctaggaattagctaggatcccctacccgttcaaccagatagatcaatccatacacccagcgctcgcatatgccccagatgaaaccaccaggaaagcggcatcaggcatctagatcgacttgtgcgaggaaagcctagtagtggccgagagcgaacctagcgagtaggggagaacggggcgagaggcaagggggaagatgtacctcgtggtggcgggggtggcaccggatctagccgggcgtggggcgaggtccactcgtcgccggcggggaagctcaccggcagccgtggcgcatatgcgtccagtcggcggcggggaggggacgatctccgcttcttttcccttcgccgcttgctcgacctgttgttctttgcttcgtctcgaggcacac

SEQ ID NO: 99523 - DNA, 640 bp, Oryza sativa
ctccaaaaggatgtgtactgcgcactgactaacaagattgctcgaagaaggagaagaagataaaagaaatatgatggagaagaaaaaaggaagatggagcgaaaacaccccagccggtagctgcaactttaagattattgtaatctatattattaagacaggttactgtaagctgaattataataagccgacataaaataagctgtgagccgtttgttttcctggattataagctgtttgttagctgttagccacccaatagtctaaaaaaacacctttagagtggattactagattgtagtaatctggcttatatattataataatatatcataataagttatctgtttgttttagcttatttctaataatccagattataataatcctaagttgaatgaaaagagccctagaccctagcaatccatccgttctataattaaattatttttaatctcttcagtttgtcctagaatatattcacttttatagtcattgtatcagagtttgtgaaaatgtggtatagatgtaatgggaatatagaaaaaaataattacattaggatttgataaaagtgtggatatcatagttttttggggttttgaatatgtgtgggatgtgtgaaaaatggggtaccgag

SEQ ID NO: 99524 - DNA, 656 bp, Oryza sativa
caacttaggattattataatctggattattagaaataagctaaaacaaacagataacttattatgatatattattataatatataagccagattactacaatctagtaatccactctaaaggtgtttttttagactattgggtggctaacagctaacaaacagcttataatccaggaaaacaaacggctcacagcttattttatgtcggcttattataattcagcttacagtaacctgtcttaataatatagattacaataatcttaaagttgcagctaccggctggggtgttttcgctccatcttccttttttcttctccatcatatttcttttatcttcttctccttcttcgagcaatcttgttagtcagtgcgcagtacacatccttttggaggccctgttcttttcttaaaaaaaaactagataaacttttggataaaagtggtaaaagtggcacgcttttcaagttgctaaacggtgcgtttcgtgcgaaaactttctatatgaaagttgttctaaaatatgagattaatatatttttcaagtttttaataattaaaactcaattaatcatatgttattatcacctcgttttgtatgaaacaattaatctttatctttatctttatcttcatctttaggtgattcaaacat

SEQ ID NO: 99525 - DNA, 646 bp, Oryza sativa
ctctatctgatctgtgcctgcactcgctgctgacgctggttctccttcagcttctccctgggtgacagtttgtcaccgatcagcgtgaccttccaacagtgtgcttggaggatgaaaactgacccagcttttggcacaactgcaggttcaaactttgtaattaagccacaaagatatgcagataatatctatagaatcgaatgtctccatgcaatcagagattgataacaccagccgatggattgactgacaagagtatttcaggtgtctcgagcaagaagcgttcaggttgctggatggaaatttcaagtgcgtagccctcagagcaatacataagctttcataacagagcaccttcctactgtaaatttattatgctatctcacattattttcagttgacagctcaatgagcataatatggaggaaaagagctgcgtaagaactatgtaaccgtatttatatgattgaaacagacactgacttgaggaaaatagcattcatcctatatacgcggttaaatattgcaccaggaatttgaagaattacctcggaagcgattgtcatctgatatgattccaaaagtctctgcagtatcgcgaatcatgatgccgcatacgccttggggtaccgagctcgaattcgcc

SEQ ID NO: 99526 - DNA, 564 bp, Oryza sativa
tttaactaaaactcttttccttctaatatactagcaaaaatgcccgtgtgttgcaacgggtgaaaaaaattctaatgataatatacgtttttcatgcataatcatgtcaatgacaatgtttgtattttaatgagcgacatgcttttttataaacgatgtttttttctcttgcgcgattttctcaaaccatttttcaaaaatggcgcatttctttctaacattttttttcctagcatgttctttttgctttttttttactgacgacgaaaaccatatttttctcctttttttgcttttcttttctagtgtgttttttgcatgttttttctgacaattattttctcgcgtgtttttttgcttgttttttcgaatgttctttttttctttttccaatacaggagaatatatgacgaaataaaagccgtgtagtagatgacaaaaaatcgatggatcctatccggctcaagtgtccatcaatttaacttttttctgacagttttttcggatcgatttgtttttttaataggcgatgtttttttacacggttttttcaaaccatttttt

SEQ ID NO: 99527 - DNA, 667 bp, Oryza sativa
agccttctgataagacagtttggtaacaccatgaaaaacagtcactcgactttcactactttgcaaaaggagaaaaaataaacataccttgagatcaatcaggtaaattacaggctagagtaaaatatattgcaaatatgaagttaagatgcccacacaagaaaatataaatgtgtttgtttgatgaatatgtgttcaggttttttggcccatggcctctgaatctgacttcaacttgaataaaacggatgctaaagttttgagggggtttggaaatcagcatgagttctggacttctggtaatattacaactactcctgtagtcctcccacaaaatgggttctggagtactaattagtgatttaaagggcttaactcctctagtccttccacaaaaagttcttcagataaaacagtacacttggtacagagttataactatgctggcaattcataaaaactgcataaagaaacataaatcgcagagatggtcgcatgacacatattggcatacaagtttctgtggtattgtggtggttatgtagttaaagcattagaggcacagggagttggttcacatgcattaacatgtagcttgaaatctttgcggtgccatacaacaaattgtttggattgcccacacaaaatgtgctgcccctcacggagg

SEQ ID NO: 99528 - DNA, 692 bp, Oryza sativa
tgactggtatcatggtttctgtgggtttcacagattataactaagtacgatcatgtgatacttgggaggtgccatgatcctcctcggtatcatggctggtatttactccacaaaaagtctacacccatgtaatacacttcatttgttcatatatggggaaatgatttttgcttccgtcaacttccagatcaaatatatgtacatggagtggacatggataagttcatatcatttgattcgatcgatgtatcgtctgacactgcttagagcaagaaaatgaagaacctcctgttgatggagaccgtcaaccaaagaaaacgcggtgggtgtcggcgtcggcgccaccaccacgctcacgccgttcttccgcattgacctcatgtgcatcggcggcgacactgaagaggtggagctgccaccaccacgctcacgccgttctcccgcactgacctcgtgtgcatcggcggcgacactgaagaggtggaactaccaccaccacgctcacgccgttcttccgcactgacctcgtgtgcatcggtggcgacactgaagaggtggagctgccgccgtcggcggacgcgagcaggtgccgccaccggcttcgccgccgcaaccgccgccgtcggcgccagcgagatctcacgcgccatgcccacggtgagagaactgtgagtgggggacttggataagca

SEQ ID NO: 99529 - DNA, 856 bp, Oryza sativa
tatgtttgttcaatccctgttgggtgatcatagggtggatgtcgataatgatactcttaaaacaatgttgaggacctagcttacaacgagaaagaccatgagaagtttatcggttggtgagtaattccgagacacttttatatgctggatgtgtgcgaaacacacaaagttatctgcaaccttggatatgatccagcttaaggcaagtaattgatagagaaacaaaagtttcatccgttaggggtcctaaaagattccgacaaagacgatgtcagttaatactactttaaaaggcactcactagtggtggtggcagtgaatctataactgtcaccatatcactacttttgcagtttttataaattagcccatgatattttttgatgttatggggagcgtatcctatgcacatagaccctcacgtaatacacaccgtgtacaccaactaaaaattatcacaaaactctagaaaaaattatacatgtacttccaatagtattacatctatgtgcaaagttgcatcttcaaatttattctatatagagagtaaaaaaagataaaattttgacagaatgacaaccttaaaactgtcatattttttctgttctaaaatataatgaatttgatgttaagattttacccctaggtgtaatagtattgaaaaacatgcaaatttttttagatttttttatgacatttgttagttggtgtgcacgtgtgtacacatgagatcttgtgtgcataggatatgttgccgatattgatggtgttagtatttattacaaacaactaactaccacatatttaaataggcaaccaagtaatactaacatatttgattaaaaatgtatcttgt

SEQ ID NO: 99530 - DNA, 1345 bp, Oryza sativa
gcgtacgaacaggagggagctagaaggaattatctaacgcaagcaagcatcgatcattggattctcgagatgtgatgattgggggcatgacataaaaatttgggcccgtacattcgctgcaatgctaggctaacgtacaagctatagctgctctgctgctacccccaattctcgtcgctttgttccttgctgtcgtcgtcgtccttgctacctgaagagatgcatatgctggtacccctgcagcagcaggagggccggactgattagccactagacgatcgatggatcaataatctgcagtttcgatcttgatcgattgatcggttgcttgcttgctcactcaactaataaggcggaaggagatgcagttagctagctagacgtcatgtgtacgtctcagctgatttatatattaatgaaggagatggttttaatatatatggtgttgtttggtgtttggatctttctgatatctgaattaacgaccaatcagtgatgactagctacacttgcagatatatgtggacaatcagacaatgtagctagctaggtgtactactactacatggttccttgcttgcacgacgcaaattgtgttatttggtaatatgacactgcaagcatgtggtttgcagctgcacaaagcccggccaatgcttccacattttgctatgctgtcttctttttcagagctagcttagcttgcagcttgtgcagggtgtggtgaacatatatatatgtacagtgtagctactgtggttgagaggaagaatatgcatgcagattgaagacacaaagcatatgcatgcagcttttgcccaagaagaaaatatgccattggacccaatcgagtacttacgaaaaaaacactgtccatctcaaaaaaaaaacactgtttatccttttcttttgtgccataaagcagcaaccagtgtattaacacacacctgctatggtaatcattcatccatgactcagttatgaagtggttcgcgattttgtacgctctgtaattgaaaggctcagaatttaattaccttaaaaccacttgggcttttcatcagctgattaattgggtacatcttgttttgctagctagatttcttttgttagtttagtttgtgctaatggcatggagatgcaggtgactgcgtaactatatatcttacgcacagaggaatatgatatctgcttattatattttaggatggatactacccatcatagcaccttattaataaagtcgttcataatatatgttattacaatgcaacttttgcttgttgatgtttgatcagcttaattaattaatagcgatcttttcatccttgttgtaattaaaaaa

SEQ ID NO: 99531 - DNA, 820 bp, Oryza sativa
aagataataactggataaattacactttgaactacctctagctcactttacatttgttgtactttgaaacacttctctcttctctagctaatcatatttatggtatccacctgaatattctctagccatatttatcatatatcctcccgtaaatgtacagtatgtttataggttgacagtatcccgatttgtatcctagcatcttagaatactacgattctaccaagtcgaaatggtaccgatcccacctagtatcctaattttcatagtatctcaattctactattcattactatacgatcctacgaaatctttggtggtatccggattctacgatccttacgatattacaaaatattatttaaaataagatggtttaaaaataatgtaaataaatatgcttaagtttatataaaagtctgttaaatatatcaaaaccaacgtggtttctcttgataaatgtatctatttgcatgacatatattattactacaatttttttatatataatggctatatgtaattaatataaatattaattaaacttaaaaaaagaagaaaatcttatatagtattccaatactacgatacgatactactttaagcaaaatgatactaggatcttaatactggccacctacttcataggtgaggggagtttgttggcttcttggatctgatgtgctcaagtttattgatatgctgaaaaagtgatatggggtaatccagatcgcaacaaagacaaatttagttagcctaaagtaaaaatgatttgattaaaggtgattcgatgtaaaactctttaagagtaaaagtagtc

SEQ ID NO: 99532 - DNA, 1198 bp, Oryza sativa
atataactttttttattgccaaaattgtcttagtatatggtaaaattctggcatttgctttgagagagctctgagttcttgacatcagttttgttttttccgtacttgttagtggccatacaacctcacatttctcattgacgatgctacgttttacacgaaacattccacactctgctaaactaaaattcactcctttcctatggtgatgtgaatgaggatgttaacttttttcccacctaaccaggttcaatttctatatttggcttagtatgtctcgtttaatatgcatgcacctgcgtgggcggaaaaatttatagtgcaaaccacatacatagtataaacttggaaactattatatgatcgaaaaataaacgtttgatatctgtccacatcactatgagtaaaaattttactcctcgttaaaactaatagtaaattttgtattcagtgtgacatggatgaatctcacacatacggtagtttacaagtttgcactatatatgtgtggtttgcatcatatattttccctgcatgggttggggttttgcacctctagcatgcatttggttcaaagggttgggtagggttgaatttactttttaagatgtttggtttggggacagataatggtatagtttctaatagggaatattctcctaaggtccgggttaacatggtcccttaaaaactgccagaccaatctaacctatttttttcactcgttgacatgtgagccatctcttaaaaagtaacattattccatccaaaaacagagagatgattcttacccatcccacctcgtctccaaaccaaccacatgtctaatttcatttctcttgcaaatctttttttaaaaaaagccctaacaacttgaatataattttcctttatatcatagttttttttcggacaaaaaaaacgtgaatcaatatattagaagaaagcaaagtatttacaacgggcctcctactagcagagaccaacaaacaagaaatttgccgtagacttgtttatgcaaaatctgggtgaacctaaaatggtttctggaaacaaatggccggaagatatttgctcaacaacaacaaagtagcattgccaacacggacaatcaactaatacaatcaccaaggaggcaaggatcactctcagtggcccatcgtgcaaacaccacccaaggcacccaacaagtaaataa

SEQ ID NO: 99533 - DNA, 693 bp, Oryza sativa
tatggattaattaggctaaaaaaaattcatctcgcgaattagctcttatttatgcaattacttttattattagtttatgtttaatactctaaattagtatccaaacattcgatgtgacagggatccctggatcaaagaccacctaacaatgcctggctggttggttgcagcaaggggcaccaagaagggtcaaagtagaattctgggaaagtgatgtaccattgaggaacaataattaataatatagtaatgagggtgtttttgtcaaggtttttgctcttgtttatgtgccaacttgttgggggggggggtagatcagtggatgtaagaaaggagattgttgttatttgttaatgtggagccaaaggggttcttctgaagactcgtgccaaaagaaaatgggtagaaagattgatctaaaggtgaggggtgtatctggaatgacaggcttgtttggtagatcaattaggccacttgttgctcgtcattgttatttacttgttgggtgccttgggtggtgtttgcacgatgggccactgagagtgatccttgcctccttggtgattgtattagttgattgtccgtgttggcaatgctactttgttgttgttgagcaaatatcttccggccatttgtttccagaaaccattttaggttcacccagattttgcataaacaagtctacggcaaatt

SEQ ID NO: 99534 - DNA, 1157 bp, Oryza sativa
ggactcctatacttttctcccaaatggagtgaaagaaactgggcagtagctgtttgattattcgagatcttcttttttagttttttaccatgtcaatgctacaattgacctgtttgagtatttagatttaggaaacaacctcgttggtgagtcgtgggaccattaactccattaacaaacgaatttgcaacgaaattttcaggtaactccattaaaaattcaaactagatggtattacaactgtcagtccgccactaccattctttgagaccacaattgcaggtctaaaaaaaaatgctgttatactttctctcttcttaaatataagagccctattgagtggacaatagttgattatatgacaaatggtttattcgtgataaacattaatttatagataaaacatttatatgttttcttaacatcctaaaagccaatttttaaaaaagtacgttaagatttttctaaaaccatctccaaaaccaaaatttgaaacttaaattttaacaatagctgaattggccaaaccatgaggctccaagtatttttaggatttaagttcacacacaaaatttaagtcctggaaatgattatcctacttgggaattgatggagttctgcgttttgcagcggtaatcagttgcaaatttttttactacttttgtctagaatacaatactttctccgatttccatatattgattttttttaaaaatatgtttgatcatttatcttatcttattataaaatatataattattgtttattttgttgttacttgatttattgttaaatgttatttaaccctgatttaaaacttttttatatttgcacaaaattttatataaaacaaatgatcaaatgtttattaaaaaatcaatgacaacacataataaaaaaagtagagatattaacttttaactatgtatctataaactagatatacttttgtttagataggtggcagaagtctcactaagccttgtttagttctaatttttttttcaaacttctaacttttctatcacataaaaacttttctacacaaaattttttatcacatcgttatgatttcaatcaagctttcattttagcatgaactaaacacaccctaatttaatttttaagaccaaggtagtttgcaggtcgtcggcccg

SEQ ID NO: 99535 - DNA, 1709 bp, Oryza sativa
ccttgtcgtagcgagggcggcgtcgacggcgctgccgaaggtgcccagccagtgccgcttcccgcggttgggctcgcggatctccgagacccacttgccccaccggcgctgccgcacgccgcggtagctgcccggtccccgtttcgctcgccgagacgcccgggcacgggcaccgccggcggcgtcaggctcaggcgtgtcgccgttcttcgcgcgagcttgcttcttcttcctggccgcgctgcacgtgaacaagacgatgataaacatgtcaaccacaccaaaaaaaaaaagcaaaaaaagaaagcaaaacgacgcactcacagcacgaaatggattttctaagttttgtttgcagcaatttgtatcatgctgattgttctgtctggaatttactcaacgtcgactctgctttgcccagctaaaacctttgatggttctgtctgccttgcaaatttgcaacagagaacaaactcctaaaatttaacgctttgtttgagctttggaactattcaggccaatccctgttccatttcttagtgatcaatcctcagttcctcacctatctctacggtggaaatttatctagaaatgtaacggacataatagcaattactccatccgttctaaaatataaacatttttagcacagtcacatgtcaaacatttttaactttgatcattaataacaaaaaaaattaaaaagatcaatcatataaaattgatgttaccggatctatcatcaaacaaactatcgtaatatacaactctttttatttaaaacatcttacttttataaatattgttggtcaaagtagcatatctaagaccgtgctagagtccaaaaatacttctattttaggatggagggagtagcaaacatgaaatagaaaattaatccgcgattatttttttcagaaccaaagttgtaataacgcacaatctcaacatgtttcccctcctacgaacacatctatagttccaaaagaaacggtcaaaattttttaacttctaaaaaaaaaacctatcccctctaatttctccacaaaacgttcaaaaaaactctttgcaggtacactctcctatcctacgaaacaccgttatccaattccaatccttgggttacactaaaaatcctgcaccattgcaccatcacatcgcaagcatccacacatttcagacattcagttaggaccaaatgtctgacgctacctgcgatgatatttctgcctgcacaatagcggctaaaccacccgtatttctgaacgcgcaaacaaagtactgaatcacgccgccaaaattaagctcttacctcgacgacgccggcggcggcggcggcatcgctggcgccttcgtctccacctccatccccacgtctccttcccccgccgccatcgatcctcgcgaccgaccaacacaaaaatccacaccggccgcggctcttctcctgctcaatctaactcctcaagaaaaaaaacctgagacacaacgagatcgagaaacatgtgactacgcaacccacattgccagcgacgagaagatcgagagggtacccccaatatccatacttggtgcgcaaggcaaagaggggaaaggttcgagcggatggcggcgcgctccagaacgaacggcttcttcagttcttcttctccactccactctccggagacacgggtaaggcgcgcctctgtgacatggcaggtgggccc

SEQ ID NO: 99536 - DNA, 836 bp, Oryza sativa
tcgatctagttaattaatactccatctgaaacagatgcagtatattaacctagtatactagctagctaatatactgctacttctgtcgctctagtatattaaacagatctggttgtaagacgttttgattttggtcaaagtcaaactacttcaaatttaactaagtttatgcataaatatagtaatatatataatatcaatttagtttcattaaatcaataattgaatatatttttcataataaatttgtgttgagttaaaaatattattttttttctacaaacttagtcaaacttgaagctagcatgtattttcttggttcaccttcctctgtctctcggtccatattctacatacccatattggaacatagacaatgggttttatttttttatttttaacgtaaaccgaattttatcatattaacatatttaatttgtatatagtgatgaatgacaccatatagtctatatatgttgctattttctttaaaaattattaccatatattttgatgccatcctccccttcattagctattacattgtataaacccatctctctttatttttaagtttttatgtattatatatgtagagcgcggcatgcgcagctagccaaatacgtactccaacatgtccaataactaaacgcgtttcacaaaattatctgactatatcatgtctatcatatattgtagacgcccttaaaccctaaaaatccaatataatctagctagtatctcaaaatctaaagggtgcctatactacaacacatcttttataatttacctctgctttcagaaggatgacgtgctaatttatccagttaaaaatg

SEQ ID NO: 99537 - DNA, 591 bp, Oryza sativa
ggaagatgcatgagtgtaacattgacattcgttacctggtaactaagccccccattgttaatctgtcccaaatttcacctactactaaccttgcaactgaagtaatttgcagttgagacaagaaaggaagaagatgacagtgcggatacctaaacttctagtctctattctgtgtctgaagtctgaactctgaagcaaagtcagtcaaaccatatgccacaagacaaaaacattacagtgtcatcatcaatctcagcacttattttcatactgactagtaattatcatcagcagctactagtatacagcttagtttctgtttcttatacattatatgcacaattacagcatgctgctaccctcctaatttaaaaatgaaatctctgatcttgtcaaagaagcaaattaaggcctgatcgattgatcatctctctatgcactgtagtattctgaaacttttgaaactaatctgttcctgtctgtctgtctgtatgtaaaactgcagtggtgtagcagtgtagatgctgggccattggatctccagggccagtggatggatgtggtctaatttctagggttgatggatggcgg

SEQ ID NO: 99538 - DNA, 1051 bp, Oryza sativa
cagcaacggaagctggccgcggcgaggggcgtgtgcacttcacacaggcatttttcccaaattttttcttcgaacttccaacttttccatcacatcaaaactttcctacacacataaacttccaacttttctattacatcgttccaatttcaacaaaacttccaattttgacgtaaactaaacacaccctcagtcgtcgctgatcattttggttgtgtttcccaacaaacctccgtcccataaaaaatcagcctaatactagatgtgatatattctaatactatgaatctatatattcatctgattcattgtagtgttctagatttctttttttatggagggagtacaatttgtagagtaccattaatttacaatatagattaaaaatatgtattataaaataatagatttaacaccatttaaggtagttttcatgtttgaaatatatatttcattttataaaattgaagctaaatttatagttttgtgatacacatatttcaatatgtacgtagttttacaataatttgatcaaatgtagttttataaaatttactcattaggagtcattaggaggttgtcacaaataatcccaaatcatgcaaaagccaccgaaaaccttagtttaaggtaatcttttatcatgtatccaagctaatatacataattgctaccaaatgaatattttccatttaatgaaattctcagttttgacttttttaaatccctagtgaaggatcaattatggcttagatatagtgaaattggcgaatttaaaactttaactacttgctaaacaaatgtactctaccatggatataaataaatatataaatatactttttataaaatatgttattcatcatttgctattggaaatattcaacttttgattttatacgtggttgtatgttagaattcaattattttaaatattaaaaagttctaaggatgctttataaaatctactgttagagtaggtggggcagtaaatttactgacactaccattagttttttagaaatatatagaaatgaggttcacatccgct

SEQ ID NO: 99539 - DNA, 761 bp, Oryza sativa
atgaatttgaaaaaaaaaataattctttcatgaaagaatggtgtaaagtgtagtcagaagacgtacttcacgcaaggtaaaacgtcgttccatacatacgatattaccatgaacgtacttctcgcgacccaccttttcgtcacaggagtcaggatattccacatatatatacgtagctatcgtgatgaacaggacacaagctagggaacataaaattccaacaatatacaaaaaaaagtactcccttccttaaacaatattgctaatattgcgtcgacgttgatcactaatttcttttaaaatggttgaaataagaaaaaactaatgcgtatgaagcaaaaaaaaaacttttgtaatacgtaatcttttttagtatttataatttttgcattaaaaacaagattaaattaatttcaactttgtatatcacaaaactatatatttaaaaatttgtatcacaaaaattatggatttaacataattttcatttacaaaataatagatttgtattagaaaatcacatagatttaacatcagttttatcacaaactaaacttctgctatggatataaactataaaatgtatagttcttaatatcctcataatctgtagatgccttaaatatgcagatatgtgataaattgacactaaatatgtagttttggttaaaaaaaacgcatatttgttttgtgatagtttggtcaaatcatcgttttataaagtttactctaaaaacaaacattagaaattaaaagtcaga

SEQ ID NO: 99540 - DNA, 4603 bp, Oryza sativa
  unsure (1)..(4603): unsure at all n locations
attttttcgttgtttcttggggcgggggtgttctttcccgagtcggaagagaaggagaggtttgggttctccctcataagcccccgggccgacccggcaaaaggggggcctgcccggtcccccggttaggagcccacgagttccgttcttaggcgccctccctcccgtccaaatatatcctccctttggtactccgacatggttttgagaatgctcctttgaccagcaatatctatagaaattaaattgttttaaataaaaggagttgcatattatgatagtttgtttaatcataagtctagtaacatcatttttccgtgattattcttttttttttttttgctattaatagtcagagttaaaattgtttggcttatcccttttctacaaatgtttatattttcggacgaagggaatgagatattaggactagatgtgatacttcataatactgcccatctattcagtttcatagtgctatgctttgtctcatccggttctaatatctagtgttttggaagagagagcgtaatatctcgtgtgttcattagcgactccctgtcatgtgtcctcgcgggtgcgttcctacctcattcaatgtccccacattacgcccagctatgcctttttttggttagcggttttcgtcagcacatatctcgggccgttccctgttaactggtcaactgaaacacctccagatttcttcctacagttcaagagaagaatgcgaggatggtatgaggaatatattgatagtttgaaaagtcaatttctgatcaagttagcatagctgtacctaatttcctattcttacatctgtcattcggtttaaaagcctacataaataatctcacttcaccttttgaacttcactgagaaatatttgagattgaaattgactgggaaatattttgaatccacttacaagtcaatgatatatagcatgtgttagttccgtggagcaagtcaagcaagcctttgtaatatcattggcaagtagtttgtcatgtgtagacagaatattgtcttgatttgttcttctaggaactgtttaggggaaaacacaattttagacttaaatatattttcaccagtgaaagaataatgaagtaagtactatacgaaccatgtttcttgcatgttttaaaaaagttattagcaaaatgcagacaaccccttagatttcaatgtatatcctcccaacgcaactacattagccgtatgatgtctagagtgtgtatgtagcacattatctaaaattattagttgtttcattctgtcaacatatgattcaacactaggatggtatgtaacaaaggcaactatttactaatctctagagttcatcccaaggacacatccttaaaaatttgaaagagatgctcgaaatgcaatgggtacaccggtccaaaccttgtagagaatataatgtaaatacctgtataatccctacatacagacctgcattaaatgacactgtagagacgtttactacagtaaatgcatcatgatgaaaaataatgttttggctagtaaaagccccattatagcacaacccttcacgatgtagtccagcaacatgcatcaacagcttctgaatattgtaggaggcaaaatataagaaagaccacgtcttggggtacaatgattccaacatcttaacgatctagatgtaatggaacagtatggtacaataatctgtcattaacattgatttttttttatcgaatgtcattcacctacagcaaaacacaatgttacaacgttatagacacgtataaataaagaaaattaacatcagttttaaatagataatactcactgtccgactctttctcggtaacgtatttcaatagttgagtttcgatgtaaagtatactccgacaatgatttatcatagtcaacagtgcataggtgtcttgagttttgactcctatcttttgacaagcaaaattgactagagaatcaacctttgtattatatttatatccacttgcacagatacactaacaccgcatgccttgacaaatagtgattgtagcccctgtaaaaaaatggcaaaagagcataaacaccagtatataacaacaaagaacgaatgagagattgaataaatcttgttaatacgatgaagtgcatcaataaaaaaaaagtggcgtacacattactctaagttgtttacatgttataatcatgtacagagattagtttcaatattgttaaaaattgaaaatctaagataattatgtatatacacattactaagatgaagtgcagcagtgcattcaaagaagtggagcacacattactctaagatgtttatagattataatcatgtatacatattagtttcatcatttctctctagattaaaaattaaaaatccaagataattgtggttagcttcagaaagaaaggaattacgtcatactgctttgtaactaaaccgtcagcccaaaaagtagacaaatttatgcatgacttgagaattagaggggatcttttttacctagacttgagcaagtaagaagatggcgcaggcacattttgcttcacatggacttccttcacctcctcctgcgtgttcctgtagttaagacaacccaaaggacagaatccgcaaaagagcataaagagtagcaaatagcaacaaagaacgaatgcaagcatgattccctcccaatgcgaagggctgcaccatcttcacccaaaattttgttagtaagacaaaaccctctataattgccaatgcattaagaaagaaaaagaaaagaagtagcagcatgtttgcattacacatgggaatagcatagtccattctcggtcgcatccaaaggcagatggcgagggaggtatattcgaacaagaaaggaagaagataggtatattatgggagggagcccttagtagatctaaggagacacacacagcagaaccaacaaacaccacggatgacgtgtacaagaaaaggtaccttcttcttgcatagcgtagagttgccggagaactccatccatacgagagctaacattgctacagccttactagctggcatacaacttggcgcgtgcgcttccgtccccctctccatcgccagctgagatttattctcacacccctacagtgttttcaggtgcttaaagtgacatgctcgcttgggggaaacgggagtagaagcacagctgcattccacactgccaccttaatctttaaagttgtcatgatttttataataaaggaattgtacccttgttaagttgcactagatgaatctgagagttcaaattagtttatttcatccctgaatgttcctttctccttttttttgtggatggctacttgcaatgctatacttatatttgacgcttccgcaatgcttatgttttagaggagttgctgtcaaaatttctccttcttcattaaatgtatttctatttagtagcatcccggtgtctttgtagtttctggggtgttacacatcacctcctacgtgttcctctgcggtcaagacaaagacaacccaaagaaaagaatcgacaaaagatcaaacaacggtagatagcaagcaagaatgaatgcgagattgatcacatcctgcaagtaaggcgaagtgcaacaatgcatcaaaaaacaagttgcatgtctgcacacttcaatcggagcccattctcggatgcgaagcgcatcctaaggcctggcggcgatgcacgcaatcactgtcttttggcgcaatttcattttcaaatcagacatagatttgctcttttttattctatgtgtgtggggtcaaattttcatttgattcttttttattttgtgtgaagtcctagacgacaacatcacctatgcacctgatttttcttttccagatttccaaattactttctagatgtgtattgtaacacttgagcggtgctctaggagggagcagtatccgtgatacattcttgtatgatggattgagtacgtgatacgtttgaggtttaggttgtgatggggaaatatgaagtgagaattctaacatagagtagatataagggtgcacacacggcagaacgaagaaacaccacggatgacagcgtaaaagaagaggtaccttcttcttgcacagagtagagtcgcccgagaacacatccatgcgggagtcggtgtcactgcagccttagcagctagcgggctcgtcaagtcaaagcagccactgctcaacgtcgagcttgcctttgcagccatcgccgccgcatccatgcagcccttggtagctttgtccacgtcgttgcggcaacaagcgcatgcgcttctgtccccctaaagcacatgtctaccgcaacaacaacatctttgtcaatgatgacacaaatgatgctcgcgttcagtggatcaagaacaccaattcgcagtgtgttccacagacctcctcatcccttcacctcgcagattcgaccaagcaccacctgatgctctagcgtccagctgctgccatcgtcgttaagggcaaatgagctgagcacgaaaggatccttctaaaacaactcgatgtagcgcaacctaccctcgctgnnnnnnnnnnnnnnnnnnnnnnnnnnnnnnnnnncgaatgcgg

SEQ ID NO: 99541 - DNA, 764 bp, Oryza sativa
  unsure (1)..(764): unsure at all n locations
tggcctttgatgacctacagactgacagnagctcatcaatgatgcagttttataaaaataaattaatagaaaaataattttgaaattatattaatgcacttttaaaagtttttttaagctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgtgcttgccccagatccgatgtgcctaatatgcaaacccacttgggtaggattaactcctattggtgtgaaacgagaacggccttactcacacttcatgagaagtatattgcagagtaacaagattaactcttaattaatgctatttaaggaggatgctaaacattttatgaaacccatggaaaccttgaaaataagatttttatgggaaccaacttttcttgcaccaagttctattaaaaagatttcaagtccaacatctagatcattgggcaagatcaaaggaagaacaaaaatttcattatttggttcagggcacgaaaatgggacattcatgtgagagaatgctcttgggagaaagataaggaatttcacaagaatgaggatcttgctcacaagtttttcaaatgcaccaaaaagggaaacttttcctatggttgtcctcccaaggatggaggagaaatcacattgtcacaaaaacgttctttatggacagaaggg

SEQ ID NO: 99542 - DNA, 775 bp, Oryza sativa
  unsure (1)..(775): unsure at all n locations
ccagattgctacgattgcatatgctnacaacccattgtnctaacatcctcaaatacaaagcacttccctagttagatgtaggttagacttcccgttcgagaaactttaccttctacctgccctcaatttatgcacgattaatgaatgccacctgggtggaagcgagaggtggaaatggaaggtcttagttcggaggtgggatctctacctgatagttgcattgccattcatgatgatcccctggcattcgttcattcagccattcaccattcacccattcaactggaattttggttgaatgcctgaattgtgtccacaaatttgggatggatagttagttggcttgctcgatggctggcttgatggctggctagattgatcgagaatggctggcttgcgatcagttgctatttagcatttgatgctatcttaattccatttgaaggacgtaccttatcgcccaacatcaactcaatctatattagaattcgcctcatacttcaggaacgggtgtagcctttgattgttctcgtgccccatgtagaggaggaccccaacattgaacccaagttcaaaagttctgttcaaccacccaaaacccaatgtgattctttttattctgcgggaaattgggattccatcaccaagttctacttttattcatagagaaccattggtatatctcacacctggttatttccccctttatatgaaccttttatttattacccctcgtgtttacggcccgacctctttttcccacgggtaagttatt

SEQ ID NO: 99543 - DNA, 533 bp, Oryza sativa
ctgcgtgcagcctttggaccaggatccaagctacagtccctacaggagaagtccagacagcattcattcatgtttatgtgctcctaaatataaatggatttttgttggatgggacgtatcatagggctgcgaatctagatgggaaatattttcagattataatactagaatacgttttatctattccaaaatctattatattaggtcggagggagtatatttgtatgagcagcaggtataaatggacgtttccggtttggtgatctgcatgcacaaacacatgcagctagcgcccaccgacgaggattacatgtatacgacctccggtcctaaatggtacacattctaaggacctgttttattatttcttgttttcaaactgttaaatgttgcattatttaaaaaaaattatatatataagttgttttaagaaaaccaaataaattcagttttcaaatttataataattaatacttaattaatcatgtgctaaggaggtttctcgttttgcgtgccagaattgtggagatcga

SEQ ID NO: 99544 - DNA, 546 bp, Oryza sativa
gaaaattgattatatactttttccttattggtatggcaggggtattgtctaatattccattaaaccaggtaattttcatttctttttttttgtacgtgtgtgtgtgagtacagctggacacgcatacattactcacacaggtgtgcattttctatgtgcacttgaaataatgtcagagacccgcatgagtatgtgcatatatatacccccattatattaaaacgcatatgcatcactacaagacttgagagctctgcgggtgaacatactgctgtgtactcattttgggacaacagcactaaattcttctttcgctatgtatttgatgaaactgcatttgtaattccagaagtatgcattcctataagttaacaatatacgctttaataatcattaagctttctttgtcatcgagttgcatttactgacatgatggcttaggcttcgttcgagcgcatgaggaagagagaaagatagttttgttttccgggcgcacgtttcccgaactactaaacggtgtgttttttgcaaaaaatttctatagga

SEQ ID NO: 99545 - DNA, 1126 bp, Oryza sativa
atagcaaagttcatgccgtgaattttcctttattttaatttccatacttcttctatactttcatacaactttccaaagtttttctatattttatcacttttttaattttcaataaatcctaaaaaatcaatatatatcaagtttttatcgagtgtgtacccgagaaattcttatcaattacttgtaaggggtgtttcttatcaagctttgtttttcctcagatacataaacagacatttatttttttttctcctgacatttggacataccctttttttattgagttaattttcttctaatcaatttattataatttataatttatttatttattagattacactacagatgcgtacacactgagaccaattacacatgtaacaccacactcaacacctcagcaaatgtgacccttaacacacgctctaatagacgaagctagcgacacatcctgatctcattaaaatcttgtttaaagctcacctacatatgtgtaatatttaggaacatcataatttaaaacttggttgggggagtcatgcaccaacgactcaccgttgtattactggtgctcttccccataatttataattttatgttccatttgagactagtattgttttaatgattgagctgactcaagctagagcgaaagtaacatgtgtttgaaaagtatgttattttagttttgaaggaagaggcagattacttggagcaattcaatttaaatcgagccaaagagacagctaaggtggtattttttcacccctttataaggccttattggggaaatgcttcgtgtcgtgcgttcgatcggaagataaacatcggacaccaactttctcctttgtactaatctaaagttgattcaccttttccatgactctgactttacatatgcactattccttttctctctccacgtctcatccttgcatgtagctagcatttatttagcttcatgtagtctacgagtatatacatgcaagaggttctagttgtaagctttaaaggaattttccttgaaaactatttattcaatttactatccgattgcacaattgtatttgttgcaattaaatctctataacaagatatcaaatgattatattccgattaaaaaaat

SEQ ID NO: 99546 - DNA, 704 bp, Oryza sativa
acaattatctgcgcactggggcggaaaacaaacatggagcaactagggttgaaaccctatacctagctccgtaatccttattatatttttaaaaaaatgctatataatttgtgaaaaaaatagctcttatttgtttaggctgaaatcgctccgtaattcttattatattttttaaaaaaatgctatattattcgtgaaaaaatagctcttcattagtttagccctatgcgtgaaaattttcgagctctgataccgtttacacattcttctttgcaaaatagaatggaataaatggtgcatatttcaggttctatatatgcaaggatcataaaatttatcagatactctcatacatgtaattgtccatttgctgcttctcacaggagtatgctgaaatgactcataccaacatatattagttcacccgggtatctaacgttttgatgaatactactctctccgtcccataatataagggattttgagtttttgcttgtagtgtttgaccactcgtcttattcaaataatttatgcaaatataaaaaacgaaaagttatgtgtaaagtattttggataataaagtaagtcacaaaaaagtaaataatgattccaattttttttaataagacgagtggtcaaaccgtataagtaaaaactcaaaatcacttatattatgggacggagggagtacaatacaagatctt

SEQ ID NO: 99547 - DNA, 670 bp, Oryza sativa
cattatctcgcatatattctgcaagggattatgctaacaattgtttaagggaaaaaaactcatgagatggatgaatcatcatttgatgaataattgtataatttgttgtgtagggtcaagtggcagcagcaatgcaggggtgacatgcgatttgacagatagatctgtgctctggaagaggacaagttgctgatgcgagatcaaacacgcactggcgaatttgcaggcatgtgcagcggcagagtagttgtagatcgagttaattgtatggagagagcataatcttggtttgggattggcagcttgcccgacatcgaaataatataggacatggcgaaaattcggcgttgattaggggcgtacagtgtgtgatccgaccgaataaatctagatacttcgtatcgtcaaaatcgccataaattgtgtctgtttttagggagcccatgtacctttatttcatgcgtgcattcgttgtcgatgccaggaatggtaaattggtactagtataatttttcagatgatatgctatcgggttatcctggatatgtaataaagtagctgatcgtctggtttggtctgttttgcacttttgcttcgagtctatccgacgggtgccaaacaggggatatttaagtatttatcaattttaacgtggtatttaataattttt

SEQ ID NO: 99548 - DNA, 540 bp, Oryza sativa
gattacaagatcaaatcaactggcacgctagcacacccgaaggcgagctttggacctgcactggagttaagcagatctcccaggcctcgtgttttctgtcaacagatgccctgactccgattttcctccctcaacctaaatcggatatgaagacttactcacctataaaaaatcgatttattttatctatccaaatggttttgattgatttagcctctcttccctctctctcatcggtcaacgacgaaaaggtgggcactaggcaatgagattggtggccaacccacctctcttcctcgaagatgactaccctcctatcgtagaaaatggtctttggtactgtcgcatgctagcccgtctcctccacatggcagtcttccttcgctcctcgtcgacgacctccatgtcaagttagagctcgagctccacctctggcattttcatgatggttagggggagggggagatgactaggctagagagaccaaatccgtcgactagaggtgtttaaagatagtcctctcccttggcatcatattcg

SEQ ID NO: 99549 - DNA, 796 bp, Oryza sativa
aaattctccctctgaacatcctcctaaaaagaatcgctaaatgataccgcctccttaaaaagaccggcgtggtttcatcgaatagtatacatccatgttccccatacatcaattgacatatagacgaaaaggtacggctaattgttttcaccgaaagtatgtcatcacaaagttttagtgcgtgcgtctctcaacaaaaacagtctgacacacgcaccgagtatgtacaatagagaacatgcaaaatatgcccgcaacaacacatatattgaagcttaatttagccaaataatagttggttcacatctcgtataaatgttaagtaatctccactttttaccagcttcacacctcaagaatggagcctaatgaagcaagatagattgttcttcacctctcgaatagaggtctagtaaaaattaagagttgcgatcctcccacatggtcggttcaggcattagcagagaaaaatcttcgttttcaaacggtcgatttcgtaacccgaatgcaatatatgaccgatcttcgcatgcggctaatcaacccgccccgggggggcggtttttgcaggcgccgccacaagcggcccgcatggaacctaccgaccccctcgtacagaaaaacgatttttgtagtagtgtcgtgaatggatatattggaaatggtacacatttttaatctcaccaccatattactttgaattgtttttgaagaaccagaaagtttaagacccaatccatgatccaaactttgatgagctactgtaccatcggatggtccatggaagtcaaagcca

SEQ ID NO: 99550 - DNA, 515 bp, Oryza sativa
attcctgcagcccctccgaccatgtacaggaccgtttgtgtagtagtgatttttgacgattttatagatattcttcggttatcatcatggttactaagaatgagatttttgaacattttcgaagtttggatcatggtttgggtcttaaactttctggttcttcaaaaacaattcaaagtaatatggtggtgagattaaaaatgtgtaccatttccaatatatccattcacgacactactacaaaaatcgtttttctgtacgagggggtcggtaggttccatgcgggccgcttgtggcggcgcctgcaaaaaccgcccccccggggcgggttgattagccgcatgcgaagatccattatctcatgccgttggttcacacactcgactgttataatacgaatctttttctatgctaatgcatgcacggaccaggggggaggatcgcaactctatacttttacttgaactctatacgaaaggtgaagaacaatctatcttgcttcatttggctccatc

SEQ ID NO: 99551 - DNA, 756 bp, Oryza sativa
ccggggtgattcgcttcgtctgcaagtagctcatcaagtgcatctcgcactactacagaaagcgtttttgcatacgggcggaatcgatcttcacatgcggttggccggcccgcatgcgcgaaatggtctgcaaagatcaccatttgcgcatgcggccgtcgcagccgcatgcgaagattgatcttcgcatgcggccgcttaggacggccgcgcgcgcggtgatctttgcagaccgtctcgcgcgtgcgggccggccgaccgcatgtgaagatcgattccgcccgtatgcaaagacgctttctgtagtagtgcgagatgcacttgacgaactacttgtagtcgaacccgaatcaacgctgctcttaagtttaccagaagccccttcgcgtgactgcttacttttcgttcataatggctcatcccttctttacgtttcgatgcttccggggcatcttccaactagttcgggcagtagctcctgcttttcatctttctacttcaccgtccttctttggataacccataccctttgttctaatcctgcttttgttccaattttttagattcttaaggcccttcctctcccaaaagcttgcccatgagggtgggggcttcccacttatattattggcctttaccctttttcaatgagtggggggattttcaacaagagatattctccccctttatacatacgggttccttagttgtaacccgccctgcaccttttctctcatctatacccccgtttctttt

SEQ ID NO: 99552 - DNA, 871 bp, Oryza sativa
aaatgtatttgaaaatataaatattcaaaaaaatactactcaagctaggttcccgcatggaaaacgatgttacccattaatacataattaattaagtattatccataaaaacttaaaaaataaattaatatgatttttaaaataactttcctatagaaaactttttaaaaagaaatcatttacgggtttaaaaagcgtgcgcacggaaaaatagatagatgaggtgggataaaagggaaagaacacatccttatttcactaaccactccttacttttctcccctttctactctaacgagcctccacggtctcacctccattcatatgatttttatataatcttacttcttttgtcctaagaaaaataacctttatatatatatatatatagaaattaatttatttagagatgagggtagtagtctctaaaagatcaaacaaatcatattcttatattcacgggaagagagagtatataatatactccctttgtcctataatataaggtattttggatggatgtgacatatcctcaggcacagattcgtagttctaggatatatcacatccatccaaaaccccttatattataggacggagggagtagcacatattaacccgaataatgatggaccaaagtatacatgctctactagtactgatttggtgcctagccaatttatttggcatgcataaagctatagtactatgctaattgaccacctacctatacgggcatactctgtgttcaggaggtggcccacacggaaaatgtaacgatacattagcttataattgattaagtattagctaacctgctactcattttgattgacgatactgctgtgcacgatctaatactataaatatt

SEQ ID NO: 99553 - DNA, 1471 bp, Oryza sativa
  unsure (1)..(1471): unsure at all n locations
gaggacaaggaaaaagcatgtacacaaccaaaatcgtgcggacatttttcctacgatatgtcgattgatcgacgcgtacatcccaccaaaggtttccgccgggacgnacgcagcaggtgaacttattgtgggatttttctttttcttttgcgagtaaggtgcactgacccctgtagatctcgatgaacagagatcttgctttgctagactagctagctccgatcatcagacaagcagtcgattaaagttgaccagtcccatctcgatgtgtcgcccttgatcggcttgcaggtcaagttgcaatggcacgcacgacaggacgcatgcactttctcataaaatattatgtaataacttacacctagagctccataataagttcactgtgggtttttatgtccaaagtttgacttacaccctgagtactatctactggtcttatttcaaaatttagtgctctctccgtccctagatatttgacgctgttgatttttttaaacatgtttgaccgttcgtcttattcaaaagatttaagtaattatttattttttttcctatcatttgattcattgttaaatatatttttatgtatacatatagttctacatattttagaaaagtttttgaataagacaaacggtcaaacatatttaaaaaagtcaatggcgtcaaatatttagggacggagggagtataaataaaaaaatataaatcaggtttacaataataaaattaatagttcaaatcctagcgtggtcggggtggagttgtagtgcatgactccacccaaagttaatatcatggtgctcacaaatattacgtagatgtatgtagactttcaacaggattttaatgggatataaaactggtttccgtctcttttagcgtatgttagaaggcacattggtggctgtgtatgttgcattagatgtatagtggtgcatgtgtatctcccgtgtaatcgaaaaaagagtatttatacttgttctttttaattgaagagtgaatttcactttgagccacctttgttaccaatgtttcactttggatcaccctttaatcaatgttttcagtttggaaatttactttttattgagtaaattttactttggactaccctttaaccaatattttcactttgcaatgtgtaatcttacctttgtttcacttttgactatccgactcttttttcaagcatatattaaaataaactagtttctacttgttaatgaacccatatctgtacttagagtactattgctttgacataaggtacaagttgatgcaaatggataaaatagttgacgatggtctaaagtgaaacaaagataaaactattcgctctaaagtgaaaatgctgattaaagggtggtctaaagtgaaatactgataataaaaagtgggaaatttactctttattcaatgaaatgaataattattttttaaacagtccttaaaatattaaactact

SEQ ID NO: 99554 - DNA, 561 bp, Oryza sativa
ggacctattgtgacccgttttggtatagcaaccaccgtaaggaaaaggtccccttaagctctctcaaatataggtcgagtttgatttgcttcctctagcctcagatataatcatatagagggtcctccaacttttaaaaccagggtaaataaagttccgtgataggattgttagttgtttttgcctgacgtggcactccaatctattattatatactaaaagtcattaaacttcctacaaacgctctcaagttgccacgtggcgctctagtaaattagagaaaatcctagaaattctaagaaaaaacaaaacatctcccccttaattttcacttaaattggtgggtccaatattatacacccttagatgaaattgatcacaaaacaaacaaaatactattggtcccacctctcctgtttcttccgtgcataagtcacgtacgtacacacccgtacgtacatgggtatgtagtacgtatggctccatccatttttttcttttttcttcttttttccatttatataattgatatatatatatttaaaaattttgcaaacatag

SEQ ID NO: 99555 - DNA, 558 bp, Oryza sativa
ttggacgcttgtcaatggcatttcttggattatctcacaaaacaaatataatgataatatatttaccaacttttaccatttctaaaatttaggatttctattttttttgtcagcgtcgtatttaaattggcactaaatagttaaattcacaaatgaaaattgcatgtcctttttcataaaattaataaaaaaattgtaccttttccgatcatttccgactgttttcatccttaactcaaactgaggtattcttttttacatgacgctgttgtagcattataatcaccccgaaaattaatggtaggacacactagtcagtgacctctttctcctccaccgctctccctttctctttcaccctctcctaatctgtcctctcgtctctctttctaccgaagcaccgaggacactgtcaacaagctcgagggagttcctccctaaggcctttgccgtattgacatgagagggagatgtagagagggatctagcgtcggggaaggtggagctcgaggacatggtgtctcaccttcgatgctgaggtcctagacaagacaatgt

SEQ ID NO: 99556 - DNA, 1053 bp, Oryza sativa
agtagttcatcattaatgcatgtataacatttttataatttatttttttatcatatattaatatagtaacaaaaactaaacaataaagaacttacaaaatacaaatagttttgatataactaaatggctaaacactagttaaaacgtaacaagtactatacgtaaaaatggtgttccttttaactaacgagctaataaactagtagttcgcgagctggctcaatagttatgctcacgagttaaattatgagtacgagttcgaccgagctaagccaagcttgctttgagcctaattaggggtggaaaaatctcaaagtggctcgaagtattttggaaaacaaaatcatactcaaaggaattctcatatagggagtgtaattggtacatgtacaaattaattaaagaagcgaaatttttatttcggttgtagtgtacgtacgttgctcagagcacatcaaaatttgatgatatgtccgcgcgaagtaagattggttgacagttttttacactgtacacagcggttaatcaaaattaaagtgcacatcaaatatttgatgatgtctacgcaaagttattaaactttggttgcttcattcggtcgatggtaggcacataactaatcatgccgtttaattaggtgcctgcctagcttagctatatacgtaaaaaagtactgtgtgcatttctttttctggacagatcagtgtcacctgagttcagttttagctaaccctaacacgtgtagcctactagccatgcagtactttagataaccctgcgtcacctaaatttgacatgcaaatactaataaaggtgagaaatataagttccaaaattaattttgtatcgaatgatatatacgatatatatataatgacgaacgatgtgattgttaatcgatcagcgcgtgtcaacatgatcaggccgggtgtatatatctgccggcttcgctggatccaccaccgacaaaggataaaatgctgtatatagtggtagttggagggcacagcagcattagttgaatttcattaatcaatatacagatcgaaatat

SEQ ID NO: 99557 - DNA, 2130 bp, Oryza sativa
actctgccgcagtttctcgctctcaatacaaatttaaaatttatataaaaaaaattaaatcagtagagctgagactcaagtgagctaaccagtgtgctgacaaaaacactttaccagctggttcctaaggtgctaaactgatctcagtgtcatcttctaattaactatagcatgcagtacgtacctgtccatctgaagtgattgtcaagtacacgcttcaagtacatgggtcaaaattctttgttttttttaagggagaattccatgcatgggtttagatgcacaaaattatggccgtgtttagtttccccctattcctaactttccatcacataatatcacatcaaaacttttctacacatataaacttttaactttttttcaaactcccaattttcttcaaacttccaacttttttcagaactaaatacaccctataactatccgaatattgcggtttatatatattgatacgggttgtatttgaagctaatcacgatcgaggagaaacaaatgaagcaacaaccaaatagaaaaattatgctatcgaaaggttattcttgggtgttgtttaattaaatctaaattcattttgctagttgatcagtacgtctggcaaactgcagcaattttaattgatgaaaacgccggttagctatagctacacaatttaaaaattgtatacaaatgttcgtgatttgattcaaaactttgtctgcaacagaatatggggactggggtaattttatagttctatgataaacaagatgttattactgttgtttcgtgaaatgttaaacaagatgttatttctgagaaatttatagttgtggttttttgtgaaatctcacttacaaagtcccctagttaatacatatagaatttttcaaaaatatctagccttatcttttggcttatgcttatacttataagccaaaatttaaatttttaaccttaaatttggagttaaatttgaggttttttcatcatattttatttttcagcctttgcttttacaaattattttgccatcaaccttaataaacgaaacgatggcctcaatcatgtgtatcagttctcaatggaagcaatattgctttttgtgttttcagattgaccatctagtagtaggctatgttctcccccccccccacacctttcccaacttgcctttctcgtgttccgtacacatatttttttaaactgttaaacggactattttttttaaaatgttttttacaaaagttactttaaaaaaatcatattaatctttttttaaaaaaataataaatattaattaatcattaaaaaaaatatggcgcttcgttttacctgcacgggaggggaagtagcctccccaacgcagccctacagtccatgtcaatgggtgaaatatcccctgccaaaaaaaattagatagaatcatagaaccccagtttttggcctgcggtagagatcttgatagctactcccttcgtcccataacaaacctagtactggatgtgacacatcctagtactacgaatctggacatatctttgtccagatttatttagtagaatgtgccacatcccgtcctagatttattttttctggacggatggagtactcctcctatttcaagatataaccatttttagtatttaaaattataccaatatcttttctcctcgatctcaatatctcctaaacaatcgaaatattaatacttacattttggaatggggtagctaattatgcaaacaccatcacgtcacgagtgtcttcttcgaacacgacgatcactggttagttccaacaactttgaaaatattcacttgcattgaccaaaatattccatgggttcgttgttcgtataaacaaaaattaatgggttggcccaatcaagttaattatcactcccggtcaagcacaaaagtacaactgaagagatcaactaaactacgcaagcttgtatatgtcgtgctaagaggcaatcaatcatgcaggatcatgacaaaaaaaacacaactactttcccataaaaaaccaatctatttctagatgtaatatattatagtactacgaatctatccagattcgttgtattaaaatatgtcacgtccagtattagattcatttttttaggac

SEQ ID NO: 99558 - DNA, 1195 bp, Oryza sativa
tttttgtatagttagttctccttcgaaagagtctgaaggcagtgacggacctaattaaattaaagttaattcgttgttttaagaaactactcctagatgaacacatagtgtgaacggtcaacacaatggggtctcggtctccatttgtaaggcagaagtgcgtcgtcaaaagatgaacgtcagtagaattgcatccgtgcgtttacttccgagttccgaccgatcgactcgataacaacactgtgaacaaacacgtgcgtgcgtactccggcattaggccattctcaacccaataagtaggatgatgtctctatagtattaaataagctgtcacctatgataaaaaaatgatgtgtcaagtgaataaattagaaaagagaagaaaaccatgtcttgcatgagacttagtttctacacaatatccaaggcatcatgtgagataagtagcattaaatttatatatagaatagtggtatttgcattggaagagtagtatctagtactagtttctcgatgatgtgaaatttatgaaaagtatatcttaggttgggaatggccttaagaccgtctcccacacgctcggccggtgcagccatattaattactgctggtcgttctagtggaatgcatgtccatatgtacacaattgacaattcacagcaccgcgttcgtaatcgtgggtgcgtctgcacgtctcgttttcattagatatcgttataaaaaaagaaaagactaattaagcttgggcgaaggagcgtgtcgaatctgctcatccttggataatggtgaggccatcgattcgttcacaatcgatatactacctatttcttaaaatataacaaactaaagttagatatagcacgtactataaatttagacagataacctatctatattatgatgtatcttttctgtctgtctgtttgtctgtctatctatctatctattatatcattaaaatagctttgaaaggagacatcatattcgccgtaagggctagaaatttccacattaatcggagaaaaagaaaaaaaaagaaaaatgagagttcaagtagaaatacaatctaaaagtagctgaaattcggaattaaaatcttacccgttagattatagtgggtccgaattataatggtatagattaattgatatagtttatacaagatataattatatctatataaatagaagttaag

SEQ ID NO: 99559 - DNA, 1015 bp, Oryza sativa
ttcacattggcattgcagtgatgctaacctgtgtttggaatcctgccgttggatcgtgatccaacggtggtgatgatcgaatgtccttgttagattcgtcaccccctgatgatggcaacgatgattggtggcatcataagtcagagcagttaggtataatgtcaagtttagaatgtacttacacaaaaaagaaaagaaaaacactctggtttcttagtttctctttttgtttttgagaaagggctactccgattttaagttcgattgagcttaattaatttgtcgtaacctggtagtgagttctgtttaaagtaattatctggtttagggcaacatcaaactttagctgtcggcaaatttgaaattccaagcttgtggaattagtgccatcaccaaccaccggtcaaaaaacacagaaggttcagtctaaacttagctcacctcaacttatgtatgatgactctcacaaaattgaaatttcattgacatatttatgctgctaatatatttattggtgattgattggtgaattatgaattgtgtgcgtcatgatgaattgatgatgacatatatattttggaagttggcctcaatgataaggtaatgtttaggttaataacaaacaaaaaatatattaagtactgtttagttagtcgtatatgtatgtattgtgacctatgcagccttatacatatatatatatatataagtaaagaacaaagtgtaattagcattaatgcccatattaggtatgtcaaatgtgggaattttgagtggcttaagcataaactactgacgtcctaaaatcaatttttttccaaaatacaacaacttctgtacatactttctcatcttaatcaatcactatctttcacataatttctacacctgcttctttatctcaaccaataataaccaccctccatcccatttcagtactgctcttcttaatccctattaaaaaatccaaaagtgtttattttctaaaacagagggagtataaatgatgaagcat

SEQ ID NO: 99560 - DNA, 546 bp, Oryza sativa
acagtagtccatgcaataatccatgtaaacaatggcttgatcgttgttgatgagcgtgggagctatctgagaagtagggactaactcctaaattaatttaaaagtaagttttagatttaaaattgaatatggcttataagtcgaagatcaaacatccaggccagtagtataatttccgttcgcagcaattagaagttggtagttgacaacgtttgaacagcacttaagtatatctattatctatattgtactctcagtttatatagaatataagaacttctagtatatatataacttttattaattcgtaataattataataagttggtagttgacaaagtttaagcattactactttaaacattactagtatatatctatatgctactatctcgtgaaacaatagggatatatatattttttaagtaaagaaacaataggaatatatataaatactactataaggtaaggggtccgatccatccaagctagtagtactagtaccgaattgataggaaagctactttttttgactcacgggtgcaa

SEQ ID NO: 99561 - DNA, 640 bp, Oryza sativa
cattccctacataatccaagtcacatgtagtgcgcagaaaaatatttgcttgagagcaacaagagttagcacatgtaaagtcaacttgaacatgaggcacataggattttaccgttattatgatcacctcatgagttacttctagcatggcatgtgaatccacaagatttccatgagagcacaaaagctcatcatatttttcttgtaagtccacatgcttgctaatgagctccacaagttgagctttaaactctagattttctttctccaaatatgatttctccatgatgcaagaatattcatccaagtgtgaagatgagcatcttggagatgtaaattcttcacttggccattttttcccacatacttctaccttcaaaagattagttccacaagcactataggaagtagaagtatccacattgacactactcaccatttcattacctttaatggaaacatgtgttggtgaggaaatgaatgtggcaaaactatcttgctcattgaatagaatcacttgaaactctttacaaattgtcgataaattttaacactccacaatggttcttctataacaaactttacctcatcacactcaaacttatcatatctctcctcgaatgtattccaaataagataa

SEQ ID NO: 99562 - DNA, 559 bp, Oryza sativa
  unsure (1)..(559): unsure at all n locations
aggatattgtgatgtatttgatttgtgtgtataagtaactttatgatttgtgatgtgggtttggtgatgtgaatttgggatgttattttgatttggggatttgcctacttgattcgggagaaaataaaaagggaaaaagaaaaagaaaaggggaacatctggtactgccactattgtctctttagtcccggttggtaacatcaaccgggactaaagatcctctctctttagtcccggttggtggtaccaaccgagactaaagatgtacatctttagtcccggatccttactcccagttggaaaantggactaaagggggttcccaaccgggagtaaagatggtttctccactagtgttatggaagcagacatgcatgttaatatatattcagcgaaaattagaagtacttttaccataggcaacaagtcgatcaccatatatttcagagggaatattagtactatatagtacagggtgatgaaggattttttttatttttaatttttttaatatttatagaaatattatatcggcgaaaagatttacaaaaatagaccc

SEQ ID NO: 99563 - DNA, 2674 bp, Oryza sativa
  unsure (1)..(2674): unsure at all n locations
actgtcgatatatttgtcaaatggcctatataaggatttcacatgtaccaagtcgtttctcctaattttgtgttacaaataacaaggtatttaactttttgtcacttttaagatgtggcaattaaatatttacccctcacaacctatgacatatgaacccttatgtacctataatatgtaggtccaatgttaaattcttaattgtcactcataagagtggcaaatagttaaatatctctaaatcacaatggtagatcacttattcatgtattcacccaaggcattagataaattggtcatatttgttattagataaattggtcatgtttgtactgtcatctaatattctaatatatgtgtatgctaatagtaatggtatttctaatatatgtgtatgntaatagttattgttgataattaagtttattaatgaaaagacaaatatatatatgttattataaagtctatattttagagatatattattcttaatattaagaaagatatattgttgacattcgttgtcacaattcttaagaagataatggtgtgacttctcacttagcgctttggtgatggaggtggtgttctctatttgcttccaaagcaagaggtgcaaaggctgatcttggaaacagattgtaacactggtggtggagaaactgtctttactcccggtttgtaaccccctatagtcccggtttcctaaccgggactacgaatccgggactaaagatcgctatctttagtcccgggcgaaataaccgggagtaaagatctatctttagtcccggttggtaactaaagagatggatcgttaccaaccgggactaaagaggggatagggacaatcccggatggtccctttcttttttgttacttttttattttctcccgaatcggatggcatgcacatcccaaatcaaaccccaaatccccaaataaagtaacatctcaaatccacatcacaaatcccaaatccaaatcacaaatcttaaagttacttatacacacaaatctaaaacatcacaaatcctaaaaaaattacacacaaatcaaatacatcacagattatacatctcaaatccatacaatgaatcacaaaattacgtctcagtgaatcacaaaatatcaaaaaaaaaaaagagacggccgtctgcgccgcacgcctgtgcgtccgtccatccaccgcgtccgcgcggcctcatccgtctctaggggagggaggaggaagggaaggggaaggaaggaggagcggcctcatccgtctccaggggagggaggaggacgcgtggcgtagcctcatccatctctaggggagggaggaggaagggaaggggaaggaaggaggagaggcctcatccgtctccaggggagggaggaggaagggaagggagaaggaaggaggaaggggaggatggagaggggaggggggagaagagaggaggatcgatctgtgggtgaggaagtggttgtgattgtggagaagaggataaggactagggattatatactacgttgaattttagtcctggttggtattatcaaccgggactaaagatctaaatgatctttactcccgggtggaagtaccaaccggaactaaagtggtaatctttagtcccggttggtagtatcaaccgggactaatgattctcgcccccctaacatgcctttgacaggggatgaaccgggactaaaaatcatatttagtcccggttggaaagatcaattttttttaactaggactaaaaatcatttttaatcccgatttttaatgaaaccgggactattgtagaatttggtcgaccgaccaaaaatggtttctccaccactgtaagatgctggttgattaatgagccaacttaggaagtgtctactatcttgaaacaaagagaggagctaagttggaattttatagaggttcagtttattttctctcatatcgatcttataatagagttgcacatgaatgagctaaactagttgtgtgtactcggacaggggagagtgggatgttgacccacctaattaacccattacggcaatgcttagaatatgattgtaatcctgccgctgggtaagaaatgaaagttcttcggtcttcaaaaagaaagaaaaaacccgatggtgctaatcggagacctctagtcggatatgttcttccctcaaggctctcaacgtcacctaactttgtttatgcgcgcatacttaccaaattgttaaaccatacatttttttaaaaaaagtttctatacaaaagttgttgtaaaaaaatcatactaatatttttttaatttttagagctaatacttaattaattaattatatgttaatttgtcgctcagttttgcatgtaaggagaggattcttaactgctccaaaagtacacagtctaacccaaggtcacaaggttgctaggttggtatccagtgtatccacacaaatgacatgttcttttctccaacaaaaattggataaactttttgataaaagtggcacgcttttcaaactgctaaacagtgcgtttcgtgcaaaaactttctatatgaaagttgttctaaaatataaggttaatctatttttcaagtttgtaataattaaaacttaattaatcacacgttattaccgtctcattttgtgtgaaatacttaagctgggttcaggagtgagg

SEQ ID NO: 99564 - DNA, 566 bp, Oryza sativa
tcgtacgcttatttgtttgtcaaaatatttaccgacaaaatttgcagattttgttcagctcagtttgatttactgactaggctactttaccaccatgtacataaagtcattttgtacagttgttgaaccggtgggtctaattcctttcgttagtttagtgtgatgatagcattggagaggtcaaatgtctgcacctccctatatatgggttcggatgctttattgtgtccagatgactattaacttggtggcatgaatttcagtttcacctgttcagttcgatggaaatgaccatcgaatatatctaatttatatcataaggactaaacttgaagttcctggatgaggaaattatttatgaaacctgatggagtggtgataggaatttcaccctgcctgaccattactctttgacacaattaatgtaacttgcagctgtttgctctatatttacatattttttttggttttgtagggatgtcttggcaaaccagcagtggttgattttgtacgccttcacttaaacaatgtgagtgacattccccgccccctctccagtgatacac

SEQ ID NO: 99565 - DNA, 729 bp, Oryza sativa
ttctggttagctggaagtctgtttttagattttcatttagtgcaaatgtatatgtatattttttaaaaagttgttttataacactacaattataacaacttttatgttggtggagttgtaatttatgttgtgattgtcttaaaacgccattgcaatattggccataaactttatattatgtatagtaggatgttttcttcatgcgtgcttgtaatatactccatccgtttcacaatgtaaggctttctagcattgcccatatacatataggtgttaatgaatctagacacatacatgtgtctaaatgaatgtgagcaatgctagaaagtcttacattgtgaaatggaggaagtagtaaggctctcctattatttttgctccttttatcgttagattggcttatggcttcttccttgcttgttaattttccataacctcaagtagactgggttatttatttatatctaccactaagaggaggaggcagggcgaggagaaagatgtgttggccgtaaggaagagggagtaaaaggtgaagtagtctatcgtccttggaggcagtgccgtggacagcgtgatgacgataagatgaggcggtttgcagcttttttgttttcacaacaggggcgtgggagagtaggagcccaggcctatttgtgaaagaaggtttgcaacatctccataaaaatggaatggctcatgcatatttgtttcatgacgtgacacgat

SEQ ID NO: 99566 - DNA, 732 bp, Oryza sativa
caagaaaaatacaaaccagtggtaaaaaggaaaataagaataaagttattttcagacatactccctccattccaaaattactcatgctttgtttagttcctgaaaaaagttgaaagtttggggaaagttgaacgtttggaaaaaaaaaagttgaaagtttatgtgtgtaagaaagttttggatgtgatgtaaagttgaaagtttggggtagttgagggtgaactaaacacgacctcaatctagatgggtatgcgacctcttctaatataatctctcctaatatagagctggcttggtttgaggcctaaattggccttaccaatatttgtcaatttcaatagtgtttattgtctatttgggttggagccaaattttggcatgcctaagaaaataggccatttcaacagctaatttaggctattttggtttcaatccaaacacaattttacctttgccaaaattagccatgccaaaagttgacaaaatttgacattgataaaaattggtaaggccaatttagaccacaaaccaaaccagcccatagtaacaaatctaaacttgtattacaagacagcacctttccacccaaagccttttcaaaaatgttaaattgtagcaaaataaaccttacttaaatttggcaattagtaatattgctaaaattttaacaaaattttttattatttaccaagtttagcacaaactaagatttttttttagcaactttaaaaa

SEQ ID NO: 99567 - DNA, 521 bp, Oryza sativa
acagtagttcatcaaactcaaagaaagaatgaaaaatttccaggtaactttctagcttattgtccatcttctatgagaaaacaaattgaagagcttgcagtacagtaatccacatttcatacagaatctaagacaaattattcaagatgagtaccgacaaggcgttgcgaggatggttttcacaggtaaggagttcttttttcaagtcgttttacgttctttctgataaatatttccttcgttctagaatgtaaggagttttggtttgtcttggagtagtttgacttagaacaaatccaaaacaacttttattctgaaacggagagagtataatttacttcaagctattctatcacatgcttcttgataaacctgaatcttgaacagtcactggagagcagccttctgatcaggtgaggacagtagtgctactacgcttggtgttgagagatgctttctcctctgatctcattgtggtgaaaaaaaaaaaaaacatgactaggtgattgaccacctgattg

SEQ ID NO: 99568 - DNA, 524 bp, Oryza sativa
tgtcagtagttcatcatttatttctaagggcagtcacaactctccacctaggatggtgtctatagtattaactacattgccatgtaggacttttaccttatgtggcactatattaaataagagagagagtgaagagaggaagaaactgggtctcatgtaagacacagcttcaacacgagaacctatgcattagacactatcaagttttacattgggagagaatagtctcttcataatagatgaagaataaatatgattggtagagaagagagatgatgtatttattaatgacccactttaagaaaccatgggttgtagagtgtagtttctactgtgaagtcttattgacatggcatcatagatattacttatggacaccatggattgggactgccctaatgctggctgcttctgccagcagtgatctgtccacgtgtgctctctcacacgggagatatatccggcccaagagcaccaaaagaaaaaaaaaatccaagagttgagcaggtgtgcgttctaagagt

SEQ ID NO: 99569 - DNA, 622 bp, Oryza sativa
cagtgcaactagtcatgcacggtgagataatacaccaaaaactagcaagtgtcaaatatgctagtagctggtttctctgctgaaatgggtgaggtctaagtgaatgcattgttttttttcacaaatttaaatgtatatatattgtgaaagtacctaagttagtatgcaatattgcatgcgataagtatagaatttatgtgccgatagttagcaattgatatttttaactgctcacttcaattcatgcatgtctaataggaatatctcagatagcatattgttctagctaggttccgtggcaatttcagttgttactggtccacttgaaagtctatgggtcgtagttaagtcacaccttatcgatgcaaagtacgatatctctcctctcttgttcatttttccactgcccataaatatcttgtttataagtatatatcaaagaatcagttactaacactggatcatggatcttacatgcatacctgctgctggttttataagtcaagaactcgagcatgcacatggaaatgatcattcatgcataacctaattaaagtcttttcacaaacatgttaatgatcactttgctgcatctaaatttattgggagtactcatgcatgt

SEQ ID NO: 99570 - DNA, 1202 bp, Oryza sativa
tgcattgagtgcaaggaaataggaaaaaaaataccaagctgatgtgaaggtcttgggaatcaatgtatcatgggattcagaatagaaaaatgaaaaagggatcaatcagagaatcactacgatggtaaaattttgaatgaatggacaaggataggtgctttctttgactacttcacttgccatacgcactgcaaacccaagtcacttacatacacactgcaagcccacgtgtaacatcattttggcaagaggtgggaaacgctaagccggttttccccttgattgaggataagttgaggaattccagcagatggtcagccctcaactcgataattgcatgtagctttgcctaattccccaacagatagctaaagcaaccactctacgtctctacccatctttcatactctctcaagctgtttagcatatcgacttatatcagtcacatggatcatgcagtacgattaagccatacaggttgccattctaaaatgaaacatccaaagatattattcagtaatgccacaatcattcttcagaaacatcacaaccaaaaatggaccaatctcccccgcccccgaaatgaagtatgaaatgctaaccatataaccaacagaagaacctaatccacaaaatcatccctgacgatggactagtaagcatcacacaacgaaaaaattgttggaaattcatagcgtgatccttatagtgatctagcccgctctacccatcatcatcccgtaatcttaggacgtatagacactcagatcagacagaggatcgggaaaataagtccataacactggatcgagcgggcaccagagacagccatctaacacgggcagaaacaggagaacttaagtgctcgtcagaacccaatacgcccgccacgaactcagcaccaggcgcgtacatcgaggtgccatccacaccgaagagatccacacgaaagcaaccaaactctgaccgcgcgatagacggattcaaatcgaaccaaggcacgtcacgggcagaacagatcagaacccccaacacacggcatgatctgatcgggagagaggggatccctcacctcggccatctcgtggcgtcggagactggggaccggaggcgaggatgaggggggttggaatcccggcgtcgcggagcggaggaccgagccgagaggaagggggagaacgacgacgacgacgacgtggtag

SEQ ID NO: 99571 - DNA, 564 bp, Oryza sativa
atgtgcagtttccccttaacaaaaaggtgaagaaacggttagttttcagaggagcttgcccatggcgaggccgatgccggcaatgccgacgcagacggcgagcgcgagccaccacgcagcggccccgcgccgggcgccgccgtcgtcgtcctcgcctcgtcctcgccgacgccttccttggccgagccggcggctcctgctgctcctctgagcccggagttctcggcctccagcatcatgacccaccggcggtgcgccgacagcaccaccgagtcccgcaccagcagcgccgagagctcgccgttgctcgccccggcggccgccagcttctcctccgcctcccgcgcccgcgactgcgacagccgcagcgcacgcatcaggcggtcgccgccgtcaccaccaccgccttcgccgtccccgcccttccgatccgggctcgtgctcgtccacgccgccgcgttctccaacctccacatcaacaaaaagggtaaaaaaaacaaaaaaaaaaacaccgcgccgctctaagcaatgccacactcgcgaattccacggcatcgatcgtgt

SEQ ID NO: 99572 - DNA, 720 bp, Oryza sativa
acagtaggctatcatgcttttcgtaaaaaaaaaaacgtggagcctgactgccgaatggccgatattccggcagcattgctggcttgctgctgctccaccctagaggcctactagaggataagttcatgactgcaagatggaggtgtgcaagtgtgcaacccatcttccggtatcgttcaccgggacgtttggcgtatagctctgctaccggtggtacgcttttcaacgggcgaatccaaacaaaatggcgtggacgaacgaggacgacgcgccgtggaaaaagatgccggaaaaccgattcaccccctccccaccaccgcgcgatgccgccatccatctgtcgcacggcgcggcggcaaagaaacgacggctcggccgctatccagcggaaggcgagaagcctcctctctcccccacgcgcgcgcgcgactgcctgtgctgccgtggcatgcacgagacgccacgagcccacgacgctggatgcgcgcgtgtggttgccggcacgggccatgtccgtgtccatgtcccgtcacgctcggctccacgtccgcgtacgtgtgtggactgtggaggcgagcgacgagcccccacggctagtgattgcatactgaattttctgagtgattggttcggctgctggaaggaaaaaaaaatgccatactgtggtccttgagactgagaactgaacctatatattcaaatctagagaaatattattta

SEQ ID NO: 99573 - DNA, 524 bp, Oryza sativa
ctccagctccaggaggggtggagctggagctgtgccaaataggcccgaaattaacttaggatttttcttgtttgcatgattttttttcttgctatttaatttactttagatgttatacgatgctactaaaaagcatttgtcaggtactcagaaaaaaagacaaaagaaaaaagaaaaggagacaaacaatttattgattcgcagcaaaggtaaatgagagaccaaaacctgagacctaccggggataaaacgactctcacaattcttaccttagttttcttttaatttttgtacaactatttcaaatgcatataactttcatgctatataaaattggatgaaattggcacgttctaaaaaattaaatccacaaaagagattcaataacgagagggtctagttagacaactgtgagggccacatatccatccgtcctattctttctctttcttctccatcaagaatcactaggcaaacatgattatatatgtctttttctaaaccgtatgggccagcatacgtgt

SEQ ID NO: 99574 - DNA, 528 bp, Oryza sativa
ttgcataatacactggtggagaaaggggctttactcgcgggtgggaacccccctatactcccggttgtataaccgggactacgaatccgggactaaagatgcccatctttagtcccgggtaaaataaccgggactaaagatggtcggagcagccccggttaattcttttttttttctcaaattgatctggtccctaaatatcctcaatcatatcctcaaattatccacaaaccaaactaacatcacagatctggaaagaaatgcatcacagattctcaaacaaaaaatacattacaaatcctaaaagaaatacaccacaactcaaatacatcccagatcaaatccaatatcacatacatcacagatcaaatccaatccaatatcacatacatcacagattaaatccaatgaatcacatattaaaaaaaatccggcagcagaggggagggcgccgccggccttccgtcctctcgcccccgcgccagcacggcccggcgcgcccagccgactggctgcctggccgcccgg

SEQ ID NO: 99575 - DNA, 854 bp, Oryza sativa
acgatgtaagatcggtatctatcaccaggcctctgtccttgcttccttccatccctacaatactactactgctaatcctctctctgggtcctctcactgtgctttgggctcctcacctaacaatcatccctcctttttatgcctcttcatgatgcacatttacttgcactgttgcaggcaccgatcaaaaatggatcacatgtaaggagtagcaccgttgcacagtgtatgtgtgtacaatgacgcgcacaatgcgatgcccattggtttgtgttggaacacagggatgcatgcatcccactgaaaatttctccagacaatatcattctcgcaggtataattgtcgtatgcttttactctgttatttcagactagtgtattgcaagtagccaagtaaccaaagcagggagcaatccacttagatttttccataattttctagtcatatttcagactagtgtattgcaagtaaccagagcagggagcaatagatgtttcagaactaattagtagctcacaggtttcttgtattcagccaacactacactgggtactacctcatttagggccaatccaccccagccattgtctgcacattcacttctctgcatataaaggccccatcacccacccgccagtgaaagagggtttaatacagaagcaatgcaaagatatcatgtttggcctctgcctgtgcagaagaggagaagatctcaagatccatatcatcatgtactcccaggccccagctccccaataccacgttaaccagatcgaaaacatcatgatacgttcatacgcatgataaatactcttatcccccggtgcattttgggtccattacaccatagccg

SEQ ID NO: 99576 - DNA, 560 bp, Oryza sativa
acaaaaacccatcaaatcagtcagtggaaagaaattggtgacggattggacaagttgatatctcaagtggtgttctgtctatagttttaggttgtgtttagttcagcgcaaagtttgaattttggttaaaattggagatgatgtgactgaaaagtcgtgtgtgtatgacaggttgatatgatagaaaaaaactgaagtttggattcaaactttggatctaaacacagccttataagggcaaggcattgtgccaattgcttgtttttcacatgtttttttaataagttttgtctcttcctcctaaatgacgttcttatagacaagtttaacaactccgcatgattttagcatctatattagttggacaattcatctccaagcaatcttaattgtctacttcaatttatgccaacaacaaaaatgaatgcccttttggcaagcttgtttagacgcttttatgaagggcaacaccatagctttcccaaatccaaatgcaattggctttgatgatttaatgtttctttaagagctacacggcgagtatatttgcaatttgaaat

SEQ ID NO: 99577 - DNA, 673 bp, Oryza sativa
catgacatatcataaagatagttaaaatttccaatttgtgaaacagttggtatacattaagtgagtggagtattaccggccaataggtacgtactagcagcttctcccttgttcgggtctgttctccacccttgaacttgtagtactagtacgcactgtatggatatcataccgtttcacattaaggaggatatttatttataatacattcatataaaaatgcaatagtcataatcacttactactgtaagattgttagaaattctttatatgactggtgtttgtaatcgagagggtccaagactaccacggttccgtctttagggtggatgagtaaacagatataatgatcgctacatattaacaacatcatagttagttaataccagctaaaataagacatatgtgcagaagataaatgtacccgacttacttaaaattataagcggctaggacaactctcttattttgaaagtgcaagaagactcgtccaatgtactgtgcgacagtaatcaatttctccttgtgcaagcccttcttgtattcagctatctcttttgaagtcttgcccttcagctggtctgaccctggtgctaggctcacagtatgttgtgtttggcagatccgagttggatccaagaagccgataggttcttttgtcttcttagcatct

SEQ ID NO: 99578 - DNA, 1507 bp, Oryza sativa
cctgtgtggagaggcgtttgaagacactaaccatctcttcaatgtttgccccatcttcagaaaaatttggcttatggtgtgccaatggcaaaacatcccgggggcacagcctgtagatgacaacgcagcttggtgggctgatctcaatcaactacaccctaaacctttcaaattcagggttaaaggatctcttctcgccacttggtggaacgtttggttggaaagaaatagaagaatttttcaaaacatctcttacacagaggatcgcgttgcgagaatagtaaagaaggaacttgatctcagacacactgctttccaaccccctaattgtcttttctttttcggattccctttgttctttctggtttctcccttcttttccttcgatgtcttcccctgtattctatgaactgtttttctctcctctaatgaaattaatgaaattccggcagagctcctgccgtcgttcacctcaaaaaaaagaaaaaaagaaaactctattcactccttatagggtatccctcttttttcatgttacttaaaaaatcataaaaaaaagattaaaaaattagtaagataaatcaataggtgatatatcacttcacaaacatactcattcaaattcaacttatacatgtagaaacgaaaataataaatttaactatgaatataatgtatatataattcacggtcaaatttgttatttttatttgaattgtacatataagttgattttaacttgcatatttgtgaaaagatatatcatatattgatctatcttggtaaaaaaaatttcgaattttttatgattttttgaatgtcatgcacaatatgagaggatgttctctggaggaaaaaaatcacttcccgctaatagaatcatttctgttggctatacaaatagccacgtcaacttattgtagctaatgccagaaagtcaataatacaataatatatactatacatgtccatggctgcacggctgcacgtttatggacaagtatgttttttctaatctcggctttggattcatgattggccggttggccgctgagaagaaagaaggtataactactaagaaaagcattatcgcaagcggtcaaaacggtcttcgcaagcggggcggccgtccgcctgtaagccaacgactgtgaagatcgccgatcttcgcaggcggggcggctgtccgcttgcgaatataattttcgcaggcagacgttggctagtccggtccgcctgcgaaaataggaatcggccgcctgaaaaaaaaacttccgcctgcgaaaataggtagaaaatattgaaatttaataataatttacgtaaattacttttaaactatttaatagaaattcttgcaggtagaatattatgtacatatattagaagattatcaagcatttggtactgataaatgtacatatattacattactcaaaagtgttgccaaaatatatatattacaatattttttttacattgtcagggtaccgagctcgaattcgcc

SEQ ID NO: 99579 - DNA, 582 bp, Oryza sativa
atgtggcgccacctcttcgcctcggacaaatctttccaagcatttttattcgtgttcatgtcctttcgatcatatttatacctacgtgaatcagtttattttaaaatagagggagtaatcttagtcggtgatgcactgattagtaagtaggcacctaggccaactagttagaggatccaatatagtagccgtaaaaatattttccacggaatagatacgctactccttctggatcaaaataaaatgacacatctaattgatcgagggttgtttgagggagtttttggtagctgcaacttctcctagcattaagagctctctcaaactgttaaatatgtgatctgaattttgggaccacaatatattcggatttgttttctagtaggagtttctattaggtgtctttcttttatcccctatatatactcttgtaagccgtacgggaaggggtgacgtttccattgtgattcccttagtttgtaatcatctcctctatagtgattattgccggtcggcgcccatagttttttcccgcaagaatttttcatataaaaatttgtgtttccgttgtgcatctatttt

SEQ ID NO: 99580 - DNA, 539 bp, Oryza sativa
tcttgaatcttgttaagaaaactgtccagatttgtggtattagatatgtcacatccacctaaaatctcttatattacgaatggaaagagtacatgtaaaacaagacaaatgattaatgtataattgattatgtattaactatcataaacaagacaaatatttgattttcattagaaatttcgatataggaagttttctaaacaatagtttgaaaagtatagttaagctccgttcgaatggatggatgggtcaagcttatgagctacacgtaaaacatgattagtgattaatgcatatattaagtattaactatcataaactttgattttaagagaaacttcgatataggaagttttctaataaacatactgtttaatactagtttgaaaagtatgctcaccataaataaggaaaaaccaggaagtactctcactatcaagaggatcaagcccggctttaatctgtcactaagaacatcatcggttctcttctcttatatttgcttacattctttattggtgtacatcaaatctgaatca

SEQ ID NO: 99581 - DNA, 609 bp, Oryza sativa
gaaaagataaacgccgctgggagacgggcggcttgtgagctatcatcatacatgtgttgcgaataaccggttggctaccaatcaatttttctttactataatctgtgccacgcctcctgtaaacagcttagcgtatgagttaatgtggagatgaattgttaccaacaaaaagagatgaaggttatttggtgagggtagaaagaaaattcagttttttcctgttggcagcaattaatgcataattagtgacaaactgtagtggagtatcatcctatttttttcccagcgttgtcagtgaggtgtaggtgtggagataatgaactatatgccacttttagatgtggcaattaactatttgccattagacccacatatcatagacatatgtggacccacatgtcattgagataggtatgccaaatagttaattgccaaatctaaaagtggcaaatagttaaatgccccgataggtgtgtatgtactgcaaatgcatatatattttacattactgttcatacgcgtataataggaaaaaacataattgtcatcatccatacataaaagtgtttacacattgatccattaatccggaacccaaaggctcagtta

SEQ ID NO: 99582 - DNA, 581 bp, Oryza sativa
tatagccatcgacggctgctccttcactgagctaatcattgtctacccatggtcattaccgtcagtagctatcccgtgccccatcatcgctctgcactatcgctatgcctcagcgataggtaaatgcggaggatcccagagcctatgccgctaatggttgctcgtcgtggtggcacctatccccatagctcagtgcctcagtcaactggaggggcaacgacaatggtgctgcaaacagagcgaaggttcgtgaggacgatcatggcggtcaggtttcctcatgtgtttggccatcatgcttgccacttccatcaccatcagacttggcatggtgcttctgcacattgctcaacaaggctgtggcaaagctcaagaactacgagtaacctgttacgccaaagctcggctgggcctagcacattctcgtcacgacatggaggtggcggtgtggaggcgagaaagaaaaggattgcgcatcaaaggaggcggccaagggagagacaaagaggatccctctcaagcctagagcatggactaaaaataggtgacaatttttatttaattggggatcctctagagtc

SEQ ID NO: 99583 - DNA, 643 bp, Oryza sativa
ggctctttttacattatttctagtagggaattttttgttgttaaatgtgtatgatctaatggtgtagaggtccaagtggctgtttatgttttgtttgactcgctgacgcatcaaaatctaatccttacgatctagatatattatgatctaaaaatgtagatttttcttttctatagcagatctagaccttacgatctaggtatattatgatagaacggtctagaccttacgatctatatatattatgatctaaaggtgtaatttttttctttttatagcagatctagaccttacgatctagatatattatgatgtaatggtgtagattttttcttttttcttttgtctaatctttttttttgttttttggttaatatgggattttctaacccgtgagagtgaacgtggtggctttttttctaattacattgtatttctaatcggattcttcttaactggaattttagatatttccagattgtatttatagatggactcttacctaatatcaattatggcggcgggcctcggctagggtaacagtgccggcggcgacggctggattagggttagggtttgtttattctttttttttgtttcgattttttatttttccgtgcgggcggcacgcgaaaatcgattt

SEQ ID NO: 99584 - DNA, 680 bp, Oryza sativa
cggccatgatggccgcgagtggagtgtgtctcaagcagcaaggcggcgcgcgcgggaggggagggggggacaggcatgatggcgtggggagtactgccgcttgcattgccttgcctcccccgcggtggtgggacgctggaccaccggacatgcgagattgctcgtcgagattgtacttcacgggctgtctgctagcgaccactctcgttcgtttccagattatgtgtgtctaggtctcaggaattcttgtcccatatagtagaaattatttgttcttgccttacgtgatctcgtggcattccattccatggcttggtttatatggtgagatttcttctatcgctaacaatgtcatttgagtagctagtagcagagccagaaattttctaaaccgtgggcagtgggtaagcctaaataaaacgactaaaatcaagtatatatgtctaaattatcactaaagttgcacatcaaaatatataatgtttttatataaacagtccaaacgtgcatataaatgtttatacgttgaaaaaatgtgaataacttaaagcggcactgctgattgttcagaatttgctatttaaatctaagcattgatcatgagcacagagcacgcggtacaggaaagaaattcatttagccggacgttgcatacagcatagtacgtaatatgcatttca

SEQ ID NO: 99585 - DNA, 510 bp, Oryza sativa
taatagatacaattgcctcctcagaactctatccatgcgtggcaatcatcatgaagcacatcaacctaaaccgacaacgtatgctgtgtcatattgtcggattcggctcaatcggctaaccccgtctgactcgaactctgccgatcttagccatagccaattcggactccagccgattctcactctgtttccgggacgatttccatctcgatttcttctccatcttcgatccttggattaccaaatttgttcattaacatacccacatgttagtgggccccacttcctcacctcatcccctctcttctatatgtatcctatcccctctctcttctatgagagcagggttgagcggagagcggcggcagacggagcaggcgggggtggagcggcggcgcgcctgggccatctccattgcaccacctctctccactggccgagcgcgctgccgaagtgaggcgaggggatggcacggttggcagctagagggggttgggcagcgatcggaga

SEQ ID NO: 99586 - DNA, 567 bp, Oryza sativa
tatacgtatgtattaaaaaaccaaaaaaagaaaaagatacggaaagaaaaaaaacacgtcatgtatatacatatatactttatatacataaagtatatacatacgtatatttctaatatgtatatatgtataaaaattatatacgcatatacaaagtttgtatacgtcgtatatacaatttgtatatgtatgtatacaaaatataccaactttatgtatgtatatatacaaagtttgtacatctatatataaaaaggtactcacatacaaaatttatatacgtgtatacaaagtttgtatacatatgtattaaaaaaccaaaaaaagaaaaagatacggaaagaaaaaaaacacgtcgcctgcggccccatctccgcgcgcgggggagtgtaacagccctctctccagaaccgtgtagcccagaccaatcgacaagcgggcccacttacacataccaccccatttacactttcgtcctcgtttcgtgtaaaagggttaacccgggagtgatatggttggagggaagatgccttataagtcggttccactcgtgctaaacttgcaagg

SEQ ID NO: 99587 - DNA, 765 bp, Oryza sativa
  unsure (1)..(765): unsure at all n locations
actacattaaccgaattaacatcagtacgtctaccaaactaactccgatatattttctaaattaaaggactacattaaccacataaaagaattctggtaggggtttcttcaaccggtactatgagccgctctctttaggggtttcttgagtagtgacacatgggattgttagtgggcgggtgatnnnttnnntntnntnntanngatcncnngtnncttnnttntantnctnttttttnatttntntttttttacttttctattacatcataaatttcaaaaaaaatcgtaaaaaaaaattaggagaaaaaaattctaatactctcatttgtgtgcacagactttataccgtaaactttacacgcataaactttgtgtatagaaatattttatatataaaatatttgaatccaaatttgaatttgaatcgggtataataaacttttgacttataaatattcgctctacaaactttagatgtgtaaaatttaggtatataaacttactaaaagaggaaaatataaaatatttgaattcgaatatgaatttgaatcaggtatataagcttttgacttataaacattcgctctacaaactttaggtggataaactttagatgtgtaaactttaggtgtatcaacttactaaaagaggaaaatataaaaaatttgaatttgaatttgaattgggtatataaacttttgacttataaacattctctttacaaactttaggtggataaactttagatatgtaaactttagg

SEQ ID NO: 99588 - DNA, 692 bp, Oryza sativa
agagggagcttgatggtatgtacatgagtaattctgagaaaattaacgatttcgctttaaaggttaccacgaaaatttcatagagtatgttagttaatgaagaatttaagaaactaacttggaccatgatttattaagaaatatttattcccttgtttacttcattactttaattaatttgcacattattttaaattctaaaacaagctaagtaatttttaaattcttacaaactcaatacaattgaaacacttgatttgaaagaaaaataaaaaagacacttatgatgaaccaacattgtcatgaacttacgatgtttgtgggttgatctcttatgacaaaacaacaattgtcatgataagccgtgggattagttaatgatgatttgtccttaattttgtgacgaacatcttattttcgtcattaggccacaccgccctccaccaaacgtcataaatgaaatggtataatgacgaacaactccgatgtcacgagaaaattgtcatagaaggtcacatgtgttgtattgcgcctttccctcttctcctccgcctccccccttccaataaatgttcccatacactcgttttgactttggtcaaagtcaagtttaactaagttatagacaaatataataatatttataatactaacttagcttcatcaaatcaataattgaatatattttcata

SEQ ID NO: 99589 - DNA, 853 bp, Oryza sativa
acgtcagcgccacatcagccgtagacccgtggtagatcggttagatctcggcctttcgttttgtttagattagatctcagccgttcgttccgagactgcttctgtgcactcggtccaccgtgaacccgagccccgctgacgcaataaatcctttttccttttcaaaaataattctttattgcgtcataatccaatgaaaatctatataaatgatttaatccgatttaatctttaaaaattaataactaattcatcttagctcagatttagctggttcaagtctctcaatttctctaaaattgagatctacatgttaaaaatatccacatgtgctgtttatgattgtttatgtactgttttggtgatttttctcttttatgcttagattccgacgtttccagagagtccgattttgcaggagaagactttgaacaattccaaggccagcaaggcaagtcacacagatcccaaacaaccctttgtgcatgttgattgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagtggaattacggtctagcgaagctccggctccactcccacaggcagctcaactagggtataagccaaacgtcttctccttcgcaacttgtcttcaactcaggtttgattgattattgcaagaatgagcatatgacatactcaacaagccacacagcaaatatgcaagtgcacaaggataccaaaggatggcataatatagggctcatt

SEQ ID NO: 99590 - DNA, 501 bp, Oryza sativa
tagaggatccccgcagtgtgaaaataacttcggttaaaaaaaatatttttagttttaatacaccatagcgaagcacaagtattttggctagtaaaagaccaagttaaattgcaatgtaggaccaaaccaccatcaaaacatactacgaaggtataaattgatccggtttaagtagttgaggaaccctccacactttgttttacagttgacaaatgcgaaaaggaaaaagtatactttgactccctcaactatcgcccgagtatgattcatgtcctccaaccacaaaaccgggtatatcgactcctccaactatcaaaaccggtacaaacaatacccctgggtggttttagaggtggttttagatgacacggcgcctacgtggcgcttttgaccgaatctttatcctatgtggcgcttacgtggcattagaataaaaaaattaaaagaaatatgtgggatccatatgtcattcacacaaataaagtattatgggacccacat

SEQ ID NO: 99591 - DNA, 720 bp, Oryza sativa
ccatgttgttacccatgtttcgccaaaaggagagccgctcgccccaaagacggcacgtgcgaaattcagttcacagtgtggcataatagtaagggaaaagatccccatcacggtcaaggactgggatcatgtatcgaatggggataaggaagtcctatggaaagagttgaagaaaatcttccaattcccggatggatcagaggcagcagtgaggaattgtgcactgcaaacaatggccaagtcttggcgtggttgaaaaaccaccttgaacacgaaatttgtgaagacaggacacacactgttttcgacgtatgccaacataaccctgaatcagtgggacgactttctgacgttgaagaactccccggaagaaattcaaaggagccaaaagtatgcagagttggccaagaagaacaaatttcctcatcgcttaggctccacgggatacgcaccaaaggtggagcagtggacaaaagaggaggaggaaatgaggaagaaggggcaaccggtaccaatggaggaatggacacagagatcaaggaactgggtaagagctagaactcctaagatcacggatgaaggaaaagtatcgtttgaatttccggagctgcagagcgttgccaataaaatagagaatttatccagttcacagaagaaaggatttttcaagcctaagagggagaaagatgtgctaagtacagggctgggtactcctgagca

SEQ ID NO: 99592 - DNA, 589 bp, Oryza sativa
tatcaagtaaaaggacttccattttaatcacgcaattgtgatctgataggatagttcaactccaagaattttacttggctcaaaaaaccacattttgccttccaaattttgacaactaatttgtcagcattaattttcttccttaatatatagacagactttaacaagctcattaactgtaataaaagggaaatttgagccttctttattgtacttgctaattcaatgtaaacacatataagctgtaacagatggtttcaaatttgatccttttttgctgtacaagctcattacctgcaacaaatgctcattgttggaaaataagagaggagatcaatccagaagtcagctcctctagttgccaagctgcaaacgcatgtgaatggaaaaaacaacaaagcgagtaagttaggagaaggtgaccttttctctttttctgaagtaaaggttggagctctgcccattatattaagaagttggtttcggaatacaattcgaggatattacatggaacaaaaagcaactgaactttcccccataaactccattgcatagcgaacatagtaagatgcacggccagtttattttt

SEQ ID NO: 99593 - DNA, 606 bp, Oryza sativa
gaaacatacggtgaagtagatcgatgtggcgatggcgatagggttcggcccaccggtggctggaggcgtgctgcgcacatgtgcggatcagaccagacgagataaaaaacggacttaacgcgtgtgcgaaaaaaaaaccttccacgtgcaaaaaaaaaatcagaaaaaaggcaaaaaaaaaaaaaaggatgaaccaacaaaaaccggaagctttatgtattttttttattattagctataaatatagacataattttcttcctcttactaaaataaatatataagaatggcttattgggtatgcagaagcatatgtattcacagaaaatatacaaccatctggaatctaattcggaaaatcagttccaacttgtatagtgttttttttaaaaaaatgttctctttgttcccaaataaattacttgttagatccatagcaacgcacggatggtacttctagtgtaacgttaaccggtcagccataattgaagctttaatctgctggtgtcatggttacactattaattaactacaggaaaaaaaaatggcagtaacagtcaacatatttttttccccttatgttgctgtctccgctaggtttggttt

SEQ ID NO: 99594 - DNA, 671 bp, Oryza sativa
gcctgcaggtcgactctagaggatccccatctgaaaataagtacatttttatacactgacctaattcatgtataaaagtaaacttatgttgggatgggagaggtgtagataaagtaagggattgttcgtttgagctaacgatgggttatcgcgagcacgcttttcaagtttctacacggtattatctttgtaagaattttctttgtcatcatttctcgaataacttttttaaatcaaccttttaactttctaatatttaattcatccgtttgcacccttgactaattgtcatatactcagatttattcatgatccatcatccatcggcactttagaaataggctggcagagcataaatgaaaggagaagaaaacaaataaataatgtatctacggagcataaataaaaggagaaaagaagaaacaaatactagctggacaggtatggggagagtgatgatgtttcatactgatctatctatatatgcactgattgagtatggatttgatgttctaggcctaaccatatgataataacttgacagctctatgtatatcaattgggtgttcttggctcatttgattctgtataaattaagggatataatgaacagtgcagcttgcttgaaaacaaattggaaatattataatcaaatgatggtaattatatac

SEQ ID NO: 99595 - DNA, 655 bp, Oryza sativa
  unsure (1)..(655): unsure at all n locations
ggacgagggggggggggggaaaaaaagtttttaggggaggagaggggggggaaaaaatacgcccccaaaaaccccccgcggaaatgagcccaccgaacccccnnnnngnnnnnaaaaacaccccaaacaaaaaggccccaaaaaaaaccacaaaagaacttgggggggaaaaagaggggggggggggcaagggggggaaaaagggggagaaaaaggggggggggggacgggggggagggaggcgggggaaaggggaaaagggggggggggaaaaagggggggggggaaaaaagggggggggaaagaggggggggagaaagagggggggggaaggggggggggaagggggggggggaagggggggggaaaggggggggaaaaggggggggaaaaggggggggaaaaaagggggggaaaaaggggggggggaaagggggggggaaaagggggggaaagacggggggggggaaggggggggaaagaggggggggggaaaagggggggggggggagaggggggggggagagacaaggggggggggggaaaaaaggggggggggagaaaaaaggggggggggggaaaaaaagggggggggggggaaaaaggggggggggggaaaagggggggggggaaaaagggggggggggggaaaaaa

SEQ ID NO: 99596 - DNA, 667 bp, Oryza sativa
aataagggaaataaaagggaacccgtagaaaacaaagaacctggcttatatattctagtggattttgctcctagcctacatgtaagttagatttcatgggtaaacgggcaaagcgggcatgggtagtgattacctatatccatgcccatttacccatcgggcatagcttttgacccaataagaaacccatgggtataaaatggagaacaaacccaaccctaatagggtttttacccacgggtaaacgggcaaacaggcacaattgccatccctagacacaaacaacttcctccaaaattattcttgtgcttattttctacgaatcatccaaagtcataaactctagtgttccttttaaaacactataggattctacatgacattctatattattgtgttttttctgtccctatggttttagaatcccacattccgaaggagccctaaaccagtactaattcttctgttgtacaaaatgtcatcttttgtacgtagccaaatatattgatcaataaagtttatcaacccaatgttttatggttttaacattttagttttaatcttcaaacatattagatatgcatcctactatgcattgtcacataataggtgttggatgattatatattgttagaaaacaataattcttgatttcttgtcattttca

SEQ ID NO: 99597 - DNA, 555 bp, Oryza sativa
gatcccctttacatcaagagttagaatctacatcagaattatagccgatagctcaaaaccctatcgctatcggttggtatctgcatcggctggaattactctaacggcttgttagccgatcagctcattgatctactatttgtatatcttgtcagttgcaggatcaaactgactggcacgcccgcatctcaccaacctttggacttgcactggagctaagcagatctcccatgctagtgtgtgtttttcgcatcaacactcctcaacaagtctttccagggaatataatgcttgattttgggcccttttttaagaacttaatatatgccttctcctgttgttgcaaggggatgtgtatcacactttttaatgtaaaatttttaggggcaataatttttttctatttgtgaatataaaactctatgggcttcgaatcttctggagtaatgaaaagttattgctccatgtcataaaaaaatggaccgcccggtaatatcatcagccaaacgagctgtcagatacctcaaatagtgaaacatcacaaaggtctttcaa

SEQ ID NO: 99598 - DNA, 641 bp, Oryza sativa
atagaatacatataagaatttaaaattcaaaataaaactaataaaattaaagtagaatttagagtacatatagaaatacaagttacaaataactaaaatttaaaggcatatttgaagttcgctctcataagacatgtaaaattatattgtcattttaatatatttgaataatacattgagaaaatatatatgctattataagagagaaaatataataatgctagccgcacaatctgcatgggccactatgctagttttcctaaattacagtggtacgtagccaatatcatgaatagtagtcgtatttatctaaaatagaatatttgtagtgacattgatgcaattaacctcatttttaaagtgagtttggcagtttgcatgactaacagtgtactggactcatttgcagcctatagctacacaagaaagctcgacacggctgcaacgagattaattaaaagttactagtcaccgggttgtttaatctctctattacgtttgataccgaaataatatcgtcagagatcttcaccgactacatgaaaaataattcagcagatctagtgcatgccttgcaaccactaccaagtgtactggttcatctgcaatttttggcctattatatatgcatatatatttac

SEQ ID NO: 99599 - DNA, 575 bp, Oryza sativa
ccaagattttcctgcaagtcttaatccgcacaatcaattcacaataatcgctgtttctcatgtgttgacaagtgctcattcccaaacgataaatttacaatggaggacagaaaatttacaagtgctcattcccctttggtagaacatatattcactcaggtacattttttactatagacgacgtacctgttaacaaacaaaacattgtcataactttatcagaaatatcgatcccttcctcaaaggtgcttataggattccactttgtaagaaacttcctgttgttagggcaagccggccggcgggaaatagcccttgtgtaaaattattatggttattctatcaacaacgacgactcaaatctgatgtggtgatggaattgtcgtggatacatgacttcactaaatgatgtttaaatcttaataattataattatataaaggtggttgcaatttcaataaaaaaatatgagtaaatttcacaaaactacaggtatttttgaacaatttatcacaaaactacagatttaagagcttgtttcataaaactacagatttagtgtcttcgtttatcac

SEQ ID NO: 99600 - DNA, 617 bp, Oryza sativa
tcctgaaccatgaacagtattggcttttctaattttttgagtagcaccaaataaccaaccgtgtaccaacataattggaaatatagggtcacacacagccacgtgatgagaaatggggtcactaacatggatgtacaaactataattaaccaaaacgagctctgtgaatccgagtctatctacaactaccattaccatgttctatcatctggttctttttactgaattacaaatgtgtacaaaatttaatatgcatactacaattttaatatactttcaagtttcaactcaccaaatcaagcatcaaaaacttaccaaactacatcctacatttggcaaatacttaaggatacatgacacaatatctattgcttcagcaggcattcacttgtggaagatctgcagtaataccattgcaaaattacttcatggagaactcctaacggatgatgcaagttatatgcatagtgcacactgaaatttcacgtcttcatttgtctgacaatgttgactcaaactgcacatacttctcaatccaccaatgaagtattgaatttaaatggtgcagtattacgagagtggtccacataccttgtgccatagacatgcttttatct

SEQ ID NO: 99601 - DNA, 690 bp, Oryza sativa
  unsure (1)..(690): unsure at all n locations
gcattggaggaagctgtccgtggcggccatggaggacgacatggaggcagctgagcagaggaagacgaaggcggctagggcgcttaagcttcgcgacgacatggccatgtntgcgtcgtgcatgcaacgatcgaacacgtactagctgctgtttgcaacgaacgaacgatgcattgttgttgcattttgcatggtgttgggctctacatataggcagccatcccacgatcgatcgagagcgacttgtcacacgtgcagagcacgcttcaagaaaacggctcgtgccagttgccaactagtgtgaaaagattattttctttcttttccagcttggctttatgagaaaaagtcatggtcaactaactggcttgggaaagtctaaatatagtataattatactctctcccattatttcctagctatatacacgtcgcctaaaagtgcatgttgtcattagtctagaattaatatattattttgtaaggtgcgaaataaaaaattaatgattccaaaacttaggatcaatgaatacaaaattatacatcatcgtggactctccatttagtttttcttgattaaatcatttcaacatttaggattagaacaaacaagttgtatttggtttggagtcaattataaatttccattaataattataaaagtatgggtaccgagctcgaattcgcccta

SEQ ID NO: 99602 - DNA, 905 bp, Oryza sativa
  unsure (1)..(905): unsure at all n locations
tcttgggaggatcnnncccgagnnatttnngatctcccaatgggcctgtattnaaatttgttttatgggtacccatctatttatganngtgtgaggggcggtnngcatgtnnggtatanntgcatanntgagaatttggctttaaaaccctttatgggatttttatcagccaaccgaaagttaagctatagttgaagcttaagctaaatcttaagctaattaagggattataaagcaacttcttaccttcggaaacacattgagttctatacgtagcaatcaattgaatcttagttgatgaagaaagatgtgtatgacatacttcaacacaacatgatcttaatcgcgaagattattaaatatgctagcttcaattaatccagcccacaatttttagcgagctaaacctcaattaattaaggccccatcaggaacaggaaatttataggatcactgtatgaatagccaggaagattccacatgagattctcaccaaaatctttgtcgaattccttaagtacgttgcaaaatggggcttagtggaactgcttatcaaacagaaacaagggttggtgtttgtatggaatcagatttgtctgcatcgttcaataaattccggtgactatgcgcaagtgaattgccacagaacagcaagctgacgtcttcgtagtatatttatttggaatcgcagatgttaactatctttctaaaactttgttaaagttagagaagtttgacttacgacaaaactaaaaccacctcagtcgttttacaatgtagtgcccgggaaaacctaggcgttatccaacataatcgccgagcaggacatccccccttgaacaggcggagcaacacctgataggcccgcagcgatcacccttcccggcagttgctaaacgataatg

SEQ ID NO: 99603 - DNA, 948 bp, Oryza sativa
ccggcgtcggggtggccggcgtgtcgaagaggaggttcttgatggaggactcgaggacggactggtacgaccgggacgcgtgcgtgtagacgacgccggcagggaggctcgcggcgaggcagtcgagaaagccggcggtctggttcgccggagcggctgcggcggcggccggcgcgtggtgcaagaaggaaatgcaagccgcgagcagcgtaaaagcgaagctcataggcgccgcggccatcttgtagtggttagatgcttagtagatcattggtttgcttattgaagaacatgctgttatttgtggctatatttataattagtttggaaatggaagtcattagtcgttgctgctaattgaatcgagtcataatcagagggcgtgttatgtggtttgcttttgcttccagaaaattaaaaataataattcgcaaaaaaaaaaagagagagagagagaaggaaattccactggtggaagtcattgacacgcacaagcagatcatcggattcgattggttgccatttggcaagccagaatgatattctacgatttttggtcaaggaaaacttcttggtttcacaatatttttcaatgaaatgatttaaaataccttatgcttataatttcgtttttccttgaatatatactgacgggagagctacagaacgcaatactatttatgcatgataattttcgtttttaacctaaaactgttaatgcatatttttcatgttagtggtaaacttgcagcactatcatgagagctagatagcgctagctccagggaaaccaagcccctcagcggagaacacgagagtgagggtaattcgttgtccgtttttccggccggatcggcgagacaatgtagaagccggcgaatttggctacatttaactataaaaattaatatatatatctatatgcttattttcactactagaaaaagc

SEQ ID NO: 99604 - DNA, 656 bp, Oryza sativa
atcccccgcgtgcctgcgcgcttacctcacaccaggggtgggtttatcaatacttgccggagtaacgcgctcacgccctttgtcgcaaaaactctatgatgttatgtggaataccctctgcaaagaaaggagacgacatgtgctggaagcgagctaactggcctaagtgtaacactatctctgaaagatccgtgcaatgaacaatggcaagtcaatctcatcgataacactgcttgttgatacatgtatactaactttatcatatgccgccaatggagtgaacgatgcacacatgtctgatgccgtacaagctccatccactgtgcgtgatcgaaacacattgtcactaaagcgcaccatgtgccgtgctaaatgccttacacatacataatgatgagaatctgatgcaggatccatctgcctttcaagacactcatcctatgaaaatgctgatcctgacggggccttaatctattacggcatatctcgataagaatatgtgcctggatgaaatgaagctaggatactccatagattttccagatacgatcatggtaaactacaagtatgtcatacacatctttcttcatcaactaagattcaattgattgctacgtatagaactcaatgtgtttccgaaggtaagaagttgcttt

SEQ ID NO: 99605 - DNA, 647 bp, Oryza sativa
agtatttttataggaactgaactaattaggcctagttctgttgttctaaatggataaatagatgatggattatttgattttctttctaaaataatattctagggttcaagcgaatgaagtaactattataaagttaaaaaaatattttaaaaagtattctaaggaacttatatatgtagaaaccgtttgcaaaaatcacagcttagaaagcatgactgtgataacctgtaatctataagaggaaaagaagaaggcccttgtaaaattcttgtgtttcatgtgaataaattagttatacaaaatttaaaagttgatctaaagatgtattacaagaaacttatatatagaaataggaagctttttaccaaaaaaaaacgtaccatttaggtgctttgaaaacatgaatgtgataatttattatctgtaagagaaaaggaacatacctcaagtcctgtaaaattcctatattccaaaggaatcttgactattgctatagaatattatagtaaaataatatttttctgaaatgtttggttgtatatacacttgtggatatagagaccggatttttatccattatataaaaaaaatctcagcgaaacatcattgtgaaatgatcgccgcgaaacaggtttctggatgtaaaa

SEQ ID NO: 99606 - DNA, 564 bp, Oryza sativa
tagggagtgtgaactggagatggacctcttcgatccgcagtggctccccaccgcccatggtcgcgggctccacgggtgcactccatgccattgccactgctggcgccgatgtgttcctggaggacgaactttgggctgacccgtattaccacgcatcaaccctagcctcccgtcgccactgctgtgcaaggactgactgtccgtgtagcagctttgccccggcttgggttggatcggcaacgagaggaagccgagatgtggaggcaacggcactggagggatggggcctcgggatggtatagtccacgtggcgaacaaggacgtctgggcgatggacacggtggacggcttggcagcactgtgccatgagtttggatgaacccaggagtcaagtagcagcggtgccatgagtttggatgccggctgcgacactgctagcttgtcgaagagcatggagaggcccgcgccatggtctagacaggctcatcaccagggatgccggtcaaatgtggccattgctccctcatgtgcagtggcggtgaccgccaacgggtcctgcaacac

SEQ ID NO: 99607 - DNA, 595 bp, Oryza sativa
tttttgcaaaaacaaaattttatataaaagttactttaaaagatcagattaatccaaattttctaatttattttagctaatatttaattaatcacgcgctaacactactttgtttcacgagctagggaagggagcgagggttcccgaacacatacccacagctagctccttgggcatttttttttttgagataatcccttatatgccactgaaaattggtttgatcccttatatgccactgaaaattggctcttcccttatatgccattggtccaaatttgcgcaccctctcatgccactaccgtcaattgaccgtgtgttgactgttaactctcaagtaaaaaagacatatttgctctctctgagttgttaggcatgccctataatcagaagggtaaatatgtctttttttcttgagaattaacggtcaactgacgggagtgacatgagagggtgtgaaaatttagatcaatggcatataagggagtagccaattttcaatgacatataaggaatcacaccaattttcaggggcatataaggattctctcttttttttttcactgggctactgccccccaccggtaggtaccct

SEQ ID NO: 99608 - DNA, 602 bp, Oryza sativa
tgatatatagctagaaacaagtcaaattgcaagctatttgggaagatacatatgcgaaaagctggaatgggatctatatatgtgtggtgatggcgtctgtatgataagaagcatgcaggtataaaagacaggagtttgtgaagttatgctgcatgtactgcccatatatatgcacaaaattcacaattgcattgaaccctgtttgctgcttaaaattgaacatgaatgggtagtttcatatatagctgagtacagttgcacatggtcatcgtgtattagtttccacattaacataataacataatatcatctatcttctattacatattaaaagtccacaaacgctctaaagtcgtcacatgacacttctataaacgctcttaagccgtcatatggtactttttaatcttaccgttgattttcatttaaattggtggacccgttctaatctcactgttgatttattattttacactattagcttagatttattattaaaaaaaataataacttcctcctcctgtatatatgatacaaacacgactgctgttctgatccgtaggaacgtacgtacgtacgactgaaaacacgtaggtagtacg

SEQ ID NO: 99609 - DNA, 563 bp, Oryza sativa
accattcctatatttttcctgtgtttttcaattctttttttgtcaaaatcctgtgttttccgatccctctgttttttctaccctgcgattcaaaagggcccttagtaatgagaaaacataggaataggaaaaacgcgggattttgataggaatgtaagtgtaaaacacaggattgcaaaacataggaaaacacagtaatgatcatttgattggaccgcaggaaaaacacaggaattagaggagagataaagactcaaaggaaagtttctaagaggttttaccgcatgttagaattcctccaaaacttgcatggcattagacaatctataggaattttataggattccataagatccatttctttgattcaaatggctacgtaggaaaaatttctataggaataaaatcctttaaaattcctataaatttcctttaaatcacagggggcctaattgttttttcttctattttagtctccatcgtaccagcaatatcgtaggttcaagacgtaattgaccagctccagcagtgtgcggccgaattaagagctcgtcgatcactca

SEQ ID NO: 99610 - DNA, 927 bp, Oryza sativa
ggtgtcggattgaatatgcttgcaagttctgttggtagcagcaaccgaggatcatacttccatcgtattagaacgtccacactaactatgtagagtactccctctcctataaaaaataacctagtaattaatctttacatattataaaagtttaagatatttttgccaatattttggtacgtcatctgtatttgagtaggttttaatacttttttcagttttaatctctactacttaaattccataattttagaaagggtgaaaaaaaatcatgcgggaaaagaaaacgcatcgtaatgaaacgcgaaagaaaaacagcgaaaaaaagtccgatccggactggaaacgggaaaaataatgtggcggaaaaaagctgaaaaaaacagaaaaagccgactgtacaaaaatataaaagtcgccgatcgtaaaaaaaataaagaaagccacgcgaaaaaagaaactgtcgtctaaaaaacggtgtacaaaaaagaccgtaaaaattaccagagaaaaaaacacattataaaacagcaaaaaaaagtccctctcttttatccgccttttttttcttttttttttccggttttatttttttcccatccgctttttttgtccttatattttattcgcaatttttgtcatgagaaagggtctgtgcacattgtgaggattctttttttttatctacccggttttttcgtcgtcgggccgaactctagcaccaccgccacatcgatcggccttctcatgctttccctcctccaattgattgaaaaatcaattctccactactccatcatcattttccccataattttttcttttatttccgctttaatttatcagattcaatctctatatttagaagacaccatttatatcctagagttttatggattcgctgcggttttgataaaaacggaaaga

SEQ ID NO: 99611 - DNA, 1067 bp, Oryza sativa
cattatgcacgtgacaccacactcggatcctaccgattaaatatgtggttttatgatactccatcttaaatatgtagttctgggataaatttagtggttaatttgtagttttatgaaacatcaccttaaatctatagttttgtgataatttagctaaaatattatgaaatttaatcaaaactttaacaccggccaatcaaataacaaaaattttgttcatcaacaacaataagcatgtgctcttaaaaatataggcgtaccaatagatacactgattttgtggtaggataaaatggacgggagatgattttctggtaggataaaaaggatgggagaatgagatctcagaaaatggattaagggttaagatgtactacaccctggcttgatgaatgagtaagatcacaagataccctttagccttgggatttggaatattttaatcctatagataaaatttctagaaaacctggagaatttcaatactacaggagaaattcataaggtctttgaacaaacatttgaattaaatcatttcctttataagtattcctataaaatagataattccatatagattacgggaaaaaaatatctcatgtttttttttctacctgcaaactttaaatcatttttttgaacattcaatatattgaacattaaaagcacaaaacgtgcactggagatacatgattgtttttccaaagagcagcttgtaagagttgctttgtaggataagtattgtcattacaagtatgactaatattttgataattcagcacttcagattcaactttaaatcggggcgtcctcatttgtgtcaaggagaagtttcctttctttttttttaatttcggtaggaattcaataagcatgtaattccatttctatattttcttctattttatgttttttacatgcgttttacagggttgcttagtgggtgggatgttaacgattccgatatggcactacccgttccgaaccttggcggtacgacgtatttcacgtaatccggtggaaaaccaatatattcctaacaaatttcgtgaactaaaatttaaaca

SEQ ID NO: 99612 - DNA, 585 bp, Oryza sativa
ccgcacgtttttaatccaacgggagagggtttgcgcgttcgtgttcttcaatatcatgggacatttaattatttgccagttttaagatgtgccaattaatgatttgccacttgctgttatgacatgtggaccctcacgtgacaaatcatttaaaaccactcataagagtgacaaatagttaattattccaatattggagtacggtgggggtcggagttttataagcccatgaagcggcccaatatctgagcccaataaccttgaaaccggcgtcctcaggttatccttgcacggaagagaagtctgatgagccaattaaaaaaaaaatcagaacatgagtcattcacaaaggaacactacccaaaaaaggaaaagaaaagaaaagaaaagaaagaggattgagacattcagtatttcagtgctagcatgttgtatgcagagtccaacagagagttatttttgctgcttttttattggcaggaaagaaattaaacttaatggcgatttcgtttctcagaacagaagaaggcatcacatgcaaatgcaaagactagagcataaccaaacaacatggatgcattcaag

SEQ ID NO: 99613 - DNA, 541 bp, Oryza sativa
attgtctgcttgcccccgcatcgtcctccctcacgggcgacatgggaggcggaaaccgccggcatcgccgctccccccttcctctctctgccgcctcgccgccgctggcaaagccgcgcggccacaagaacggcggcggcggggcttcgtcgccttcgtctgcctctcccgtcggcggtgggggcccgcgcgagacagcgaaggctacccagatccgggctgccgcggccggatctggcggggaggccgccggcggagggtcggcctgaggtggcggcggcagttggtggtggtggcggcggggattgaagatggcgggctggcgacggcagttggtggcggctggtggcgggggtgacggcgttgggaatggtgagggggcgccagcggcggggatggaggtggcggcgaggctgatgacggcgggtggatctggcggcgaggctagcgacggcggccggatccaggcgtgctgcaggccgatctgccccccccccccccctccccgcatggcgacggcatcggggcggctgcgttggag

SEQ ID NO: 99614 - DNA, 1034 bp, Oryza sativa
attttaatggcgggtgatgatctgaaagtggctagctagctttgatcgcagatcataatttcttttttgttgagattgtgatcgatcaatgcagcgactaagatagattacggggatttgacagatgttgggaagaatggcttaggaagaagattgagagggaggaagggtgccaattggcaaggcgagaagaagaagaggcatattagaaaagctggcatccaacgaacggaatatggacgtgcagtggttgaaggggttcgtgcttctcgatctctgtctccatttgtgtgttggggttgactagtgtacatagatatgcagaatatatgtgtgtgttgtggccagcacgcacggccctctcccccgcgctatttttgggctttgccatatgcttttacatggatgcatcatgggagacaatcagtggtttaaagacattatttttttgtcaatggtttaaaaggcactaatcttttctgaacatcctctgaatgattaagaagtttacgatcattggagaggaaaacaatataaggtgctaaggtacacattttttttcatatatcttttttctgactacatcaaagacagtaacacacacggctatgtacgcgcaccattctcgtataccaacgcgtgcgccctttaacgcatacttaaaaagacgaaggtcaacggcaatttcatgttctcactcaaatcctattagaaatgtatatgtgcatgtgggagtacaaaactcctctagcgagaaggcaagataccctctcttgagagttcgggtagggtgcgagttcagagcccatgagtatagcgtgcgaaacaaaagaacaaaataggggatttatataggttcaggctgttgataagcgtaatacaataatcctatgttcttactatatgggaagatgatcgagttgttcaatggatgatgtggtgaaatggaaggtggtgaacacttcttcaacgagtttttaaggctagatctaacctagtctacttctagagcttggaataaatttttcggaacc

SEQ ID NO: 99615 - DNA, 830 bp, Oryza sativa
gcgtgcttttttttaaaaaaaatctaccttgtaagataaaaataatagatcaccgatttaaataaaaatcgatggttggattagagtgccacttggcgacctaggagcgttcgtaaggtaccacttggcgaattaaaagtatttttaagatatttaatgaacttttatatataattatcttttttttgaaaattctaaggagtatgtgatatagtagcttagaggtgtttataaaatgtttaatggattttaacccccgcataggggtggggagggagggagagaggtttggggtttttttcttattaaaaaactaacaaatcaatagccaaatgttttgttctttttttaagattttctagcattttatttaatttaatagcaccacgtagcagtttagaggcatttgtagaatatttagagtcaaagagcgagaggtgctagacctaataggtggaggtctctttgtgattttttaatgtaaaaataattttgattatgatttctcatgaacatagctcgttggtacgtacgtgacgggaggttcggaatgtgtgctttttttttaaaaaaaaatctaaccttctaatataaaaataatggatcaccgatttaaataaaaatcgatggttggattagagtgcacttgacgatctaggagcatttgtaagataccacttggcgaattaaaagtatttgtaagatgtttaatgaaattttattatataattgtctttttttttgaaatttaagattttattttatttaagtatgtgatatagtagcttagaggtgtttacaaaatgtttaatggatttggggatcctcta

SEQ ID NO: 99616 - DNA, 602 bp, Oryza sativa
cttcttcaaggctaacaacatcaaacactttgaatgtaaatggacatgttgaacaaagtaggaaaaggaagaaatactctgagtgacggaaatgtttcctttgatgtttctcagcaaatgcaaggttcggtttatccactgagcaaccaacatgctcctattagaagtaaaagtgctgctgatagtatccagtttcctgttgaaagagattctaaatcagttgaccatttcgttgagaagaaaaggtccaagagcaagaatcatggtagctcttctgatggggggttctgtctactgtttttccttcaattctcctagtttggtttcccgtatgaattcactctagttgcatcatttggttatgtttcttttctgaaactttcttttattcaaatacaggccatctcgtgaaaagatccaagaagcattcaaaagtaaaaagcaagagagagatggatcatgatgaatacagaacttctaggaaaattaagaaagaggagcggcgccagcgccagtctggcatagattctaaccctggatatgatttagctagtggagacgttcctgatgaggccaaagctttgccttcaaaatcgatggcc

SEQ ID NO: 99617 - DNA, 764 bp, Oryza sativa
tagaaatccaactaaaagtataaaatttaaacttgtggatgaaaaataaagcgtcaacggagaatccaataaatcgttcggtacaagcaaactaaggttttcataaaatcaaaaggatgcaaccaaatgtagataacttgcccgcaaccaaaatattttttcgataaatagggaaacgtaactctagaactttgttataagtctaaatgtcagagcacaaaaaagccgcaaggtttaaatgcaagcaactattttcttttcacaaatagtaaccaaaagtttatacaaaatttaggtaatggagatttcaaaactaaaataaagctttgaagtccaaagagaagttgggaaaagataaaactttatgattgaagaaatccaactaaaagtaccaagttgaaactcaattatgaaaatacaaccgtcacgcgagaaacaaaagtaaagtttttatataccagatatcaaagttcaaaccaacttaaggaagacgaacggtgataaccgaaaaatatggaaactccaaaaaggatatttgaagaatcgatgcaagaagaacgtttgaaagtaaaggaatccaactaaaagtaaaaaaacataaacttattgatgaaaaatgaagcgtcaacggaaaaaccaataaaacgttctggacaagcaaactacgattttacgattttcatgaaagtgtactgttccttaaaatagaatataaagaaatggatttctataggatatacatgcacagcaatcaaactgaaaat

SEQ ID NO: 99618 - DNA, 652 bp, Oryza sativa
actccggtctaacccctccttctactcctctcctcctcctcgttccgtttttctacttcgcttcttgttccaagctatgaaggtggagatttagggagagcaatttgttgtagagggaagagatgcgaacacaggaggaggggagtagaaggtgccggccagggagaggggtgacggcactatgaggggaggtgggattcggttcccctctctctaggtttcaggggagaactaatggcctgggtttatgggccttctcacgctggcccacttctaaagatatttttcttttatttatttctgttaacatttttattttaacaagtcaacccaaactaaaaaaacctaactatcttttaatatacggggtattacaccagggaggcaggaaatacatcagatgtgatctgatctcaattgaattgacctacaaatttaaagcaaatccaagggatagaatcctagcaacttaagagataaagaactaacaaactccctaacaaactctaaaccggaccacacactattcctcgtcacggattgccgtcgttgttcctgttgcggcgccgtttatactataatccccacatgacatctctccctccctggagaagcaactcgtccgtgagttgaaaatctggataccgagacc

SEQ ID NO: 99619 - DNA, 543 bp, Oryza sativa
aatgttgacggtagaactatccattttttttttcttttgaggctaaaattatactctaagaagatttggtggaccaaaatgtactccattttttttctgcagcttgtatttgttagttctgtctgagaagctccctagtttctcactgtcaattcgatgaacgtggcacgggctcactctgctctctcaatatacttggcataatattttgcatatcattccgttcaaggtttttcacatgtgagaactcccttcccctcaagatctatgtggtgatcgaacaattcgaatatgtatttatatggcatctgcctatgtaatatatgtcgctttcaaaaatgtcactctacagctgtagagagaggatcaagcgcgatcagtagatcgacaacctgtttggcaccattcaggagatcacaatctggatagaagcaggagtcttcaattgttcaggagagtagcatcctagttgtaagctgatttttgcccctttcttttgggaggatgttttttaagcattctcctagtagctccgacagcctc

SEQ ID NO: 99620 - DNA, 1119 bp, Oryza sativa
ttcaaactcatattcacagaagtacatgctttcaaaagttctcggtcatatggagcaagataggaattttctttttctcaaaaaggcaaggatgtatgctatggtatcacgatgaacgaaatgatgcgatgcatgtatgaaatgatacagtgcttatgaagatatcttgtattgcatacatgccatagaacaatccttttaggaaaattgttctcgagactattcatcctactcaaggtttttcatgggcatgggaagggttgcaactctttataggctataggctaggataaggtgacacaattaaatatttttttaactcagactcgtaacaaacttctccttatcgtggaaaaagatgataattttaaaacaaatggatcatcttcgagatgttttcaaaacctacaagtcaagttcccaaaccatgtttgtgagttgctgcaatgtacaaatcttgcatccgaccgtaaaggggcacaaaatttgcacactgagccgtctcaacttaacttacatagtttgcttatgacttgttcctagtatgatatttccatttaggcttgtgggtttctaaggtcatggtattctatcccccttaaaataaaataaaatttagcaatggtgtttatcaagaaattttaatggaagagctaaataggtctatgtgctagtctgccagatgctgtcctatccaatcccaaggcgcaaactgaagcaaaagactataagatgcaaccaaatgtaaacggcaattttcataaatagggagacgtaacgtattttttggataaatagggagacgtaactctacaactttgttataagtctaaatgtcaaagcacaaaaaagccgtaaggtttaaatgcaaacaactattttctttccacagactagtaagcaaaagtttatacaaaattttggtaatggagatttcagaactaaaataaagttttgaagtccaaagagaagttcgaaaaagataaactttataattgaagaaatccaactaaaagtaccaagttgaaactcaatgataaaaagacaaccgtcacgcgagaaaccaaagtaaagtttttataaaccagatattaaagttcaaaccaacttaaggaagac

SEQ ID NO: 99621 - DNA, 887 bp, Oryza sativa
tatataatgcaactaacaaaaggggtaatggagggatctacttaaattgtttggtaatttgggttccacaaatcaaattccatgtgtcaagcaaaaatacacaatgcagtagcatactttagttcctctcttgccaacaacgtgctaaaaaatcatttaatagatatatgcttctggacagggataagcttaatttcccaattatgccagtgcaggctgtacaaacgaaggtttgcttgtatgctaatgtacagatgtaaatataattgctcgtacaacaaattaattttccatggtaacagaagagccatatcccaatttcacattaataccaagaggctgagctttttctcatgatagagaatctaaaaaagaaaataacaaaacctattgacgcaaccaaagctgccagcttatcttgcatctataccattgagagtatgaggtacattctgaaatgctaaatcgagcacatgaattatcataaggatagtcctaaacattctagtacatattaagtttatgttcctagcttgttgtacatgtcactgtgagagtattttaccggtaactgtgaagaaacaagtagggcggctaaaagatgtttcatttggcagaaagtatcatgttccattttgcaaaaagtatctcactaatttctgttaaataggactcatcagtggatttcccatcaggtattccaaatatcatttaagcagtaaaatcaacgtgtgtgtgctccataagaaaaataaatgaagcatgacaaattgtattatgaaagaaaatactacgtcgtttttactctgcataatctctcacaaaatgtagatctgcttcaatcacacttgaagctctgaccctagaaactcaatcacacatcaaat

SEQ ID NO: 99622 - DNA, 1577 bp, Oryza sativa
tctaacataagtatgttatttttttattaatgtaaggaaattatgtagtcaaagctatgcccatcaactatgacaagtccaaagcaacgttcttttgtgacacgaattcgaaggattacggacagctctaacgaatagtccaaggcgaactgattttctggtagtttgaatatgtttcacttgtctttcaaatatcgcaaagccaggtcaaggtttgcaaggtttgtcaatattttattatcatacattgatactataatgcagctaaagatgaatgcaaccgcgcgttcgttaagatgacattaatgataagttgattttatgtgctatctttgacgctgagctcacagcctcaaaagtcatcaggtcctatctgatatttttgattagctgatgaccaactcaacacaagtaatacccatactaaccagtatgtggtcaatatatatatactaacatcagagaatacatgctattatgatatagtagtataatcatcataggagacatcacttttcagtgtcagtactctactcctcgaagcacatcatggtctgaactcatgaacaaaattgtttgaaaacagctgctatgttctactctatatttagtatggctatatatcaaagttcaacaagagttacaagaccgtgtcaagtcggcaccctctgtttctttgccccattcttttggctgaacccgttagcactgaagtaatattcgcaatctagagcgtaattagttttgaatttacgtaagttaactaacaagttggaacatcatttgtcagcaaaacttacatgatggcgaccatgcaaaagtaacgtcatcaataattacacaaggtaactagcaagtggaacatcattgtcagcaaaaaaatacatggtggtgaccatgcaaaattcacgtacgtcaagtacgttgtcatctagtcctacttatgtaaattcattaacaactgtctatctaggtaaaacagaggatgtgattattgacgtaatattaccttgtcaatctgttctttgtgttaaaaaaaatacaattttgtttacctggatctacagttgatcagttccatccttggttgatgtacaggcaatgtctcaaaagtctcatccaatggatggacttcctctcttgctaccacaggctaatctgaaccacatcctgaaaagaaacataacaagcaaattaaatatagaagtatatctgtaatatttattgtatgaatggttaggaccgtacgcaaatgaaaacaatagtgatgaccagtcaagagtacctataattccagctcctggttgggataaggaggcatgttcaaatgaattaagaagtctggcttgcacatatgctgtttacaacaaataaaactgtagcatttaaaactagatatcatatagctgtctgtcaataatttagtttgagtaaattatatgtcgctaattagcacgtagggcgccggaaatcaatagatcttgataattaacatgcattgaactgatggttcagcttcccctagcttgctattcagtaaaaaaggaactgccaatagcaattaaagatgcaggtca

SEQ ID NO: 99623 - DNA, 1790 bp, Oryza sativa
acggttttcttaaaatcaaaaggatgcaaccaaatgtagacctctagcccgcaaccaacatattttttggataaacagggagacgtaactctacaactttgttataagtcaaaaatgaaactggtagagcacaaaaaagcccaagatttaaatacaagcaaatattttcttttcacaaacttgtaagttcaaacaaaacttaggaaatctgatatttcaaaactaaattaaagatttaatgtcctaagagaacatcaaaagcattaatacaagagaaagttcgaaaataaagaaatccaactaaaagcgttcagttcgaatgaaaagacggaacattgaaacgtgaaaacgatcaatacaaggaaatcgcaattttcgaaaaagcttcaaggagcaacaaaatgcatgggtccactttacaacaaagttattttttttcaataaaccggaagacgaacatcaacaactcaattaataagttcaaaatcagcgttagagcaaaataaaacggtcaggcttcaatgcaaaagaatattttgtttttataaaccaaaaaacaaagttcaaacaaacataaggaagctgaaccgtgacaacaaaaagaattggtaaccctaaaaaggatatttgaagaatcgatgcaagaaaaacgttacaaaatcaaggattccaactaaaagtacaaaatttaaatttatggatgaaaaataaagcgtcaacggagaatccaataaatcgttcggcacaagcaaactacggttctcataaaaccaaaaggatgcaaccaaatgtagttgtttcactcgcaaccaagatattttttcgataaacagggaaacgtaactctagaacttagttacaagtctacgattaaaacgtcagagcacaaaaataccgcaaggtttaaatgcaagcaatcttttcacaaactagtaagcataagtacatataaaatttaggaaattgagatttcagaactaaaataaagttttaaagtccaaagagaagttccaaaaagatagtaccaagtggaaattcaagggtgaaaaaactaccgccactcgagaaaccaaaataaattaagtccaaatagcatgtaaaaagcatgaataaatagtaacattccaaaataaagaaatccagctgaaaccataaagtttaaacaaaaggacggaaagagaagcgtcaagggaaatacctagaaacgtttgtcacatggaaactgcgattttcataaaagcttcaaggtgcaaaaaaaatgcatcaatccagctgacaacaaagttatctggtttcaataaagagggaaacccaacaatacaactcaattataacttcaaaattaacgtcagagcaaaattaaacggttaggccacaatgcaaaatgaatattttgttttattaaaccaaaaaacaaagttcaaacaaactttaggaagacaaaccgtgacaaccaaaaaaaaattggaaactccaaaaaaggatatttgaagaaccgatgtaataagaacgttacaaaatcaataaatccaaccaaaaatacaaaatttaaacttatggatgaaaaattaaccgtcaacggataatccaataaatcgttcggtacaagcaaactacggttttcataaaatcaaaaggatgcaaccaaatgttgtacacaacttgcccgcaaccaagatattttttcgataaaaagagaaatgtaactctagaactttgttataagtctaaatgtcagagcacagaaaagccgcaaggtttaaatgcaagcaactattttcttttcataa

SEQ ID NO: 99624 - DNA, 553 bp, Oryza sativa
ttaatttatttagatggcatgcaaactgcaaaatgcacagtctataccacaataacatattgcttatatatagcaaaacattggatgtaaaattgtcaatttaattataaatagagcaatgttttaatagaatataaattagctatgtacatttaaattatggtcaacttaactcgtttttaatttgataacataaaataattaggataagaaagagatggagatataaaagaataggaagaggaagagacaggaagagcgtactactttcttatgtttttttctttttccggcccacggttatacgaagccacacgtaagtaagtacggacgtttttttttataatttttttttctttttctggcccacagtagaggaagggattactttcttaaataataatagatctaatcaaatggtctaaaatatcgggtctaccaatttaagtgaaaatcgacggtgagattatatagtgccatgtgacggtctaggagtgtttgtaggagtgacacgtggcggattgagagcgtttgtaggaagttaatggacttt

SEQ ID NO: 99625 - DNA, 1921 bp, Oryza sativa
cctgcaacccgacgccaagccaagcagctcccatctagcctcacttgttggttattggtgcaggaagctcaaacatatgtgcctataataattgtagtaacatcattcacgggcatgtcaagtttataaatagaaggcaagtagcaagaactgggaagagtcatatatgtgctggactgaaatttcaacgcttttgattttgagttttgagtctaagtcaagggtgaataaatttggttgttgaaattggtgattgattcgataatgaccattcaaggactagaaagaaacatgtactccctcttttctaaaatacaagttgtctgtgaagggaatttacctaattacaatatcatcatgaaaaatattagggatgagaccaagttatagtgtatgacgggagccaaagatcttagtagcatttgaccgtagatggtcgtaaaccctttgtatttacttcagcaagccgttttggactcttttttaatgatgtgcatttctcctatgcgttcaagaaataaaatacatacataagtatatgaacttgggatattcttggtctaatttcttcaggttccgttaaaacttctgacataactaatgtaatcattcgtttttatcgacagatggaagagtaaggctgcgttcgtttggagaacaatgggagattgtttgtttcgtttttcgcgcgcacgctttccaaactactaaacggtgcgtattttgcaaaaaaaattatatatgaaagttgctttaaaaaatcatattaatccatttttaaagtttaaaatagttaatactcaattaattatacgctaatagctcacctcgttttgcgtatcttcccaatcccctctccctcaaaccagcctaagtcaaatgtttatttggagagatcatgcatgacatcaatcgattagtgtcttatatagttaaacatctatcttatttctatactggggcaggatcttactaggtgaaggctttgtatggagggtaattatctatgtaatccagattctactcagtcatcggtcatgtatatactcatgtgcacgtcataaaaaatttttgttgcaatcctttgcagtacgtccaagtcagaggtcaaagtcacagcaagaccatttcgatcttctgtttccaatgccgtttcgtgctcattgcccggccatgtatatataataaacaacccttggaggacaagcagcgaatcgagtttttttagctattacaattcatggattgaatgtgtttgttatcattccagttgctttaaattgatcagccagcaaaagaaaaaaaaatgtgactataatcttagcatttttttttcgaacaataaggtgtttcctctcgcacaacagaaagggaaatcaaattatgtgcatctcgtaagaaaaatgggagagtatatatataagatatgcgccagattttataaagtcactctaatctttctatcatgtggttaacattacaaagacttcagatctaatatactcatatctattggatcccgttagagtaaaagtacaatagcagactacaagttagctatgaacataaacatacgtggagatgataagagaacaaaagagaagaaaattgatttgtagtcagctgtaacacgaacttcaaatcgttatgtgtatatgaaagctggagcctgggactatatatgaattaatatattttgattgaaaaaatggaagacacaataatgacttcaaacgaataagtcaggtcatctgaaaactccagcttaataattatactatgtagttacactataaaaaaatcatgcatgcttgtatctcaattttttatttttattattttaaaatttacataaatatattttccttatacaaaatctacaaaaatatgcttctcaagccttttgggagagttttttttt

SEQ ID NO: 99626 - DNA, 530 bp, Oryza sativa
atagaatataaagaaatggatttctataggatatacatgcacagcaatcaaactgaaaataaataagccagtaatttacataatttacatatattgaattagtgaagtgagcattggatgtacctgcactgtctcaagatatctacaaagtaggcatctctagtacacagtctcatctcgccactgcaaagaaataaagttaaataaatgaacagacaaaggtgaaaggaaaaaaatcattaaacgaagtccaatctcaaaatactctcctcaacccctaaacttcacaaaagaacaagaaatcctaaaaccatcacagtttctgcaaactggaaaagcaggccgttgtatgatcttctcatattgtgttttatttcctatgaccaacgtagtgtcgcacgccaaaacttgtttctcacctcccatgacctgatgtcaccaatgcagtgcacctcgatgacgaagaagatagacgacagtacagtccgcctgctggttgcactcaagctctcacatggaaggctctgcct

SEQ ID NO: 99627 - DNA, 1212 bp, Oryza sativa
tttgataaacagggaaatgcaactctagaaactagatatagaaactagatataagtttatgataaaaacgtcaaagcacaaagacacaaggtttaaaaacaagcaaatatttccttttcacaaactagttagcatacattcaaacaaaatttaggaaattgtcatttcagaacttaattaaagctttaaagtccaaagagaagaccgaaaaatatatactttgtaactgaaaaaataaaattgaaagtaacaaattgaatctcaaggaaaaaaaaccatcacgctagaaaccaaacaaaaattttaaggtccaaatagcttgtcaaaagcatgaatacaagagaacattcgaaaataaagaaatccagttgaaaccatatagttttaacaaaaggacgaaaagagaagcgtcaagggaaaaacctagaaacgtttcacatggaaactgctattttcataaaagcttcaaggtgcaaaaaaaatgcatcggtccagctcaaaacaaagttatttgttttcaataaagagggagatccaactctacaactcaattataaattcaaaattaaagtttgaaagtccaaatagcatgtcaaaagcattaatataatagaactttcgaaataaagaaatcctacgaaaagcatatggtttaaacgaaatgatggataatgaagcatcgagagaaaacaagaaatgtttgatacaaggaaactgtgattttcattaagacatagatgtgcaacaaaatgcaagggtccagctcaaaaaaagttttggattaaaaatgaagcctcagtagagaaaccacaaaatcgtttggtacaaccaaacaacgattttaataaaatcaataagatgcaaccaaatgtaacgtctaggccgcaaccaagatatcttttcagttataaatccaaaaataaaacatcatagcacaataaagacacaaggtttaaatgcaagcaaatattttctttcacaaacaagaaagcataagttcacacaaaatttaggaaattgacgtctcggtactaaattaaagctttagagccaaagagaagatcgaaaaagagactttgtaaccgaagaaatcaaactgaaaataccaagttgaatctcaagaatgaaaaaggaaccgtcgcgcgagaatccaaagtaaagttttaaagtccaaatagaatgtcaaaagcatgaatacacgagaacattcgc

SEQ ID NO: 99628 - DNA, 1991 bp, Oryza sativa
aagacgcaaggtttaaatgcaagcaaatatttattttaacaaataactaagcataggttcgaacaaaatttaggaaattaacatttcagaactaaagtaaagctttaaagtccaaatagaaaatcgaaaaagaaaaactttgtaacaaaagaaatcgaactaaaagtaccaagttgaaattcaaggatgaaaaaacaaccgtcactcgagaaacaaaaataatgttttgaagtccaaatagcatgtcaaaagcattaatagaggagaacgttcgaaggtaaagaaatccacctaaaaacataaagttaaacgaaagcagaaggtttaaacgaaaggatggaaaatgaagtgtcaagggggaaaactagaaatgtttgatacaaggaaaccatgattttataaaggcttagatgtgcagcaaaatgcatgggtccatctcacaaaacgttatttgttgtcaacaaacagggagacccaactctacaactcaattatatgatcaaaattaacgtcagagcaaaataaaatgcttaggcatcaatgcaaaatgaatagtttgttttattaaaccagaaaacaaacttcaaacaaactttaggaagacgaaccgtgacaccaaaaaaaatggaaaccccaaaaaggatatttgaacaatcgatgcaagaagaacgttacaaaatcaagaaatcgaactaaaagtacaaaacttaaacttatgaatgaaaaatgaagcgtcaacgcagaaaccaataaatcttttggaacaagcaaactacagtcatcataaaatcaataggatgcaactaaaagtagacgtctagcccgcaaccataatattttttcgataaacagggaaacataactctgaaattaaattagttataagtctactattaaaacgccagagcacaaaacaacctcaaggtttaaatgcaagcaactattttcttttcacaaactagtaaacaaaagttcatacaaaatttaggaaattgagatttcagaactaaagtaaatctttaaagtccaaaataaatgaaaaaagagaaagttagtaattgtagaaatcaaacttaatgtacctagttgaaacttattgattacaaaacccgttacgcgaaaaacaaaagttaagatttaaattccaactaggagaacatttgaaaataaagtaatctaacggaaagcataaagtttaagtgagtagacagaattgtagcgtcaagggagaaacctagaaacgtttgaaacaaagaaaccgcgattttcataaaagcttcaagatgcaacaaaatacatgggtccagctcacaacaaagttgtttgttttcaatacatagagagacccaactctacaactcaaatataagcttaaaattaatgtctgaataaattaaaatggttggtcttgaatgctaaagaatatttcgttttcataaactagaaatcaaagttcaaacaaacttaaggaagacaactgtgacagccaaaataattggaaactccaaaatggatatttgaagaatcgatgcaagacaaacatttcaaagtcaaggaatccaactaaaagtacacaatagcctctacaaagaaaccaagaaatcgtttgttacaaccaaacaacgattttaataaaatcaataagatgtaaacaaatgtaactctagcctgcaaccaaaatatttttaataaaatcaatgtgtttttatttatagaaatgcatttgagtatttataaaatttatatttgagcacttcttgacgtgaggtgatatccttaaacttagttttatacccaacatgcacagaagaactcaaacgtaaccatgccctatacgtgtatgcatggccacactaagttactcaaaatttttcattttgggttggaaaggaaaagtttaattcgcccttaaattctctatatgcaaaggttggattgtcttcaccttgcttcaaaatgaatatttgaggttcacataaatggattagttt

SEQ ID NO: 99629 - DNA, 630 bp, Oryza sativa
gttttgagctaccctgaaggaaccaagattctatcccttctagattgggctacacaaattcgacaacgagtttacttattgttttcaggttgggactaagcagtgttttatgaatttttagaccatgatgcgaagacaaaaaatttagcctaaattcatggagtctactgggtatgtctgcaagctactgttaaaagatagcatgactatcttttatagtttggactacataaaaagatgaacaccgctgtctacagatttcagaacacggttatgcacactaattgagaccgaactctacaactcaattataagaacaaaataaatcagttaggccttaatgcaaaagaacattttgtttttataaaccagaaaacaaagttcaaaaaaacctaaggaatacgaaccgtgacaaccgaaaaaaactagaaactccaaaaaggatatgtgtcctacggaatatgaaccgtgacaaccgaatacaattggaaactcaaaaaggatatgtgtggaatcaatgcaagaagaacgttacaaaatgaaggaatccaactaaaagtacaaaatttaaacttatggatttcaaataaagcatcgtcggagaaccaataaatcgttcgaaacaagcaa

SEQ ID NO: 99630 - DNA, 1045 bp, Oryza sativa
tttgcatttgcatatggtcctaaccatacatacaataaatattactgatatacttgtacatttaattattagcttgttatgtttcttttcaggatcttggtgcctgtggtagcaagagaggaagtccatccattggatgagatttttgagacatcgcctgtacatcaaccaaggatggaactgatcaactgtagatccagctaaaaattgcattttttttaacgcaaagaaaagattgacaaggtaatattacgtcaataatcacattatctgttttacccagatggacagttgttgatgaatttatataggtaggaagatgacaacgtacttgacttgcgtgaattttgcatggtcaccaccatgtatttttttgctgacaatgatgttccacttgctagttaccttgtgtaattattgctgacgttacttttgcatggtcaccaccatgtattttttagctgacaatgatgttccacttgttagttaacttgtgtaaattcaaaactaattacgtcaggttggaatattacacagtatactaacggtttcagccaaaagaatgagacagaaacagagggtgccgacttgacacggtcttgtaactcttgttgaactttgatatatagaacatagcagctgtttcaaacaatgttttcaagggtttcagaccatgatgtgtgctttgaagagtggagtactgacaacaagtgatcatagcatatatttttcttatgcgagtgtgaccacaaactggttagtacgggtattagttacttctgttgagttggtcatcaggctaatcagaaatatcagatgggacctgatgacttttgaggtatgtgagttcagagtcaaagatagcacacaaaatcttcaacctggagagctctgttggtgctgtggcttgctttcgctcatgacattttaagtgcagacaggaacacacttgtcttatactgcttcttgccccaatacgaaagctgtgttctagctctgggaaggaaggaaagtatgaattattgcttcactatttcttagtcag

SEQ ID NO: 99631 - DNA, 549 bp, Oryza sativa
tttgagaaattcagagaaaagaaatccatgaagctagctagatcatgccgtagaatttctgtacactttcttgttactgttggccggtatccctcacacgactgttttttttttcgaccaacaccagacggtgcaatgattcattaaatagagcatgagaaaattacaagactaccatagtgagaggcagtaggcaagaaaaggaaaaaaacacaccaccacgcaccaacagcgcatatacataacccaggagaaggctagcgccggaccgaccgccgctaagtgtgaccaactgtcgctaaaccaacaaagaagcaaacaccgaaaccgcgaaaaacaaacctaaacgagcgccgcactcacatggctgttttgcttattttttcctggtggattctgaaccatcttcctctttgtttccttttggcctaactataaacaatctcacagttaccaatacctgccaccaaactttgcactttactttccacagtttttgctagatttcatcatccgatagttggtatatttaccccggccggtgtacat

SEQ ID NO: 99632 - DNA, 1221 bp, Oryza sativa
tcaacttttccatcacatcaaaactttcctacacacataaactttcaacttttccatcacattgttctaatttcaaccaaactttcaattttgatgtgaactaaacacagccagttaccggtttatgttaaactggcatactatatgtcatttcaaaaagttacaatcatgccttcaaagtcgcaacaagactccactgaccattgctcgactgtaagtcaataacaaccttgcggcacaaatagcagaatattgtttcctaatcatcacctacgtcaatcatggctgctagtcagtgtctttgaaatgatcaacagcaaaagacagtttcagctgaaaaattgacattaatcttgaaattttacgaaatcttgcgtttgctttctttataataggaggaggtatctgccctttacaaaaagagaaaaggacacatgttcagcaaattcatctttctcatggattgcacagatatactcagctttcagactgagaaatttacaagtttcgtttcactttcatatgccttcttatagtcagcgtcacagcaagaccgtttcttcatttgaatttcaagagaagtgaccaatgcacatgattaattcttgcatagatatctaggattctcattaataaatttagtcaacataacatcagaatgaagattgacaaaccttgaaaactttagcacaaaaaattaaccttcagcgagaaaaattaggaagaaaatttggcaggacttataggtggtgcaaaggatggaaccaatactactaggcaaagcagctggtttcattattgacatttgaaattctgagggaagtacacataacaacagaacaaatacatgaactgaccaatacacatcactctgttatgagcaaattgcattttggattggattttattactaaaatctcattttgaactaccgttcacctaatatttttattttggattagttaattttatatttgttgtattaatattgtgaaccattatatttatggatatcaagatttttaatcctgataatagttatccacgactccatcaccaccacgcatgaaattctacaaatatggtggggttctcaattgagccccggcatttatctccatttgtgctacttgtgtcccggggagaagggaggattgtgtctcccatcttcacctgaaattaagcaacgaactccaagtcaaataaaaccttgcacacaaa

SEQ ID NO: 99633 - DNA, 758 bp, Oryza sativa
caccctgattgggcgagtagaactccagttatggttgttttagtgtggacagtctgaaattctggacagattcggaagcctgctttcaagtgcaaattagaccatttaaatggcagaataaaaatatgctttctacatcaaagttgtaggtattgttctgtagattttcaaaatgtatacattttcagtcatagccttttcatatttcaagatataaaggtttgaagcagcagtcttgtgtatagtccaagcggcgttccttgttattgagttttgataggatggcgcagtaggttcacctttttcattgttttatacacatgtttgaatgtgtttgctgaggttttgtttgtgattaggtggtggtccaccagatcgtgcatgatactaatccttcgttggaggcaagtgcatgacgaactaattgtgtgattcatggattgtttactctatctatttatttctgatatatttctatgtgataagtgactaatgttcagattattgttcacgctatttacattttgagttcatcttatgtttacgatgttattcttgtttcaatattttgtattctggatctagttaaataattcaagtaccatgcttgccatggatgtgcaatatggtttcaatttggttctttgattctggttttcaattattcaaggaccatgcgtagtcatgggaattcaatttggatctttattcatgttcctgtgggtaagcgctgatcacgcttactcggctttgccggc

SEQ ID NO: 99634 - DNA, 526 bp, Oryza sativa
aaaactacaccacaaataaagattatacttatgtctgcttcggcatgcaatagtgctctgcttaaagtagaattagaaaagagtatatagtactagcatattgcccatgcgttacaacgggattttaattaaagaaaattataattaacttgttataattaccatttgtatatatttaatctcttaattcttgcatatattttttactgacatgtggtctatgatccttctggctccataatatcatttttttttcaaaacaaaattagggatttagtagcgagggtggttgacatatggatatggcccctctagctccataatgtttttttccctttccaaaaaaagtagggagtatgtctgagaggattattgttggctcaatccgtaatagtgacatcctagaggcctcccgagctctcccctacccctctttatgaggtttttgtgattattgagaaatgttaagagttgggttgagagatttgaagtttgagagcacaagacaacaaatcccatcactcaa

SEQ ID NO: 99635 - DNA, 1680 bp, Oryza sativa
aatcgttcgagacaagtaaactttgatttccacaaaatcaataagatgcaaccaaatggagacatctagcccgcaaccaacatattttttttggataaagacggagacgtaactctagagcttagttataagtcaaaaataaaaatgttagagcacaaaaaaagcccaaggtttaaattcaagcatatattttcttttcacaaactagtaatcatatgtacaaacaaaatttaggaaattgatatttcaaatctaaattaaagctttaaagtccaaagagaacatcaaaacaattgatacaagagaaagttcgaaaataaagaactcaaactaaaaggtttagttcgaatgaaagggcggaacacaaagcgtgaatggacaaacctaagaaatcgcgattttcataaaagcttcaaggtgcaacataatgcatgggtccagttcacaacaaagttatttgtttttaataaacaagaagatagacctctacaactcaattaataagttcaaaattaacttcagagcaaaataaaacagttaatcctcaatgcaaaaagaatattttgtttttataaactagaaaacaaagttcaaacatactttacgatgacaaaccgtaataacaaaaataaattgaaaattcgaaaaaggatatttgaagaatcgatgcaagaagaacgttacaaaatcaagaaatccaactaaaagtacaaaatttaaacttatggatgaaaacgaagcgtcaacagagaaaccaataaatcatttataacaagcaaactatggttttcataaaatcaataggatgcaaccaaatgtagccatctagcccaaaaccaagagattttttcaatacacagggaaacttaactctagaacttagttataagtctaaacatccgagcacaaaaaagccgcaaggtttaaatgcaagcaactattttcttttcacaaactagtaacataagttcatacaaaatttaggaaatggagacttgagaactaaaataaatctttaaagtccaaagagaagttccaaaaagagaaactttagagttgaaattcaataatgaaaaaacaaacgtcatgcaagaaacaaaaataaagttttcatataacagatatcaaagttcaaataaacttaggcctcggttgtttcaacttaagattgttgtaatccagattattgagccagattaataaaagctgaattataataagctatagtcgaataagctatgagttgtatgttcatgtggattatggtataataagggtagtgagtctctagccacccaacaatttgaaaaaagcacgtttagaggagattaacagattatactaatcaggcttatagattattataatcaatcataataatctacctgtttattttagattattactaataatctagattataataattctaatccaaaaaggatatttaaagaatccatgcaagaagaacgtttgaaaataaaggaatccaactaaaagtacaaaagttaaatttatggataaaaaatgaagcatcaacgacgaaactaataaatcgttagggacaagcaaactactatttttacaaaatcaataagatgccaccaaatatagacgcctatccatcaaccaagatatttttctcgataatcagggaaacataactctagaaattaaatt

SEQ ID NO: 99636 - DNA, 698 bp, Oryza sativa
gcatccaactccaatagcttattctttttcagtaaaaggaggacccaactctacaactcaattataggatcaagattaacgtctggacaaaataaagcagtcggctacaatgcaaaagaatattttgttttcataaactagaaagcaaagttcaaacaaacttaaggaagacgaacgatgataaccgaaaaaattggaaactccaaaaaggatatatcaagaaataaagatttcagaactaaaataatgatttaaagtccaaagataatatcaaaaaagagaaactttgtaattgaagaaatcaaacaaaaagtactaaattgaaactcaaggatgtaaaaagcaaaatgaagtagtttagaccaaatagcatgtaaaaagcattaatacaagataacgttcgaaaataaagaaatccaactaaatgcataaggtttaaacgaaaggacagaaaatgaagcgttaagtcagaaacctaaaaatgtttgatacaaggaaaccttattttcatagaagcttcaaggtgcaacaaaatatatgggcctagctcacaacaaagttatttgttttcaataaacatggtgacccaactctacaactcatttacaagtgcacaattaatgttagagcaaaataaatcagctaggccttaatgcaaaagaatattctaattttataaaccagaaaacaaagttcaa

SEQ ID NO: 99637 - DNA, 529 bp, Oryza sativa
agattcatatcgatgtaaagaacttgcgtcaaaaaaaaaagtaaagaactgctcccaaactggacaattcactattgtaagtttgtaactaaaaacatcttacataactcttataaacaaagctctcaactgtttgattttactatatgggagttacaagaaatcttggtttactcgtggcatgccacatcagcatctgtatgagttctgtacccatagcctttttctttctggatctaggaatagctacacccatttaaaaattttataatgtgtgaactttacaaaattctgagaaaaatgtacacgtagatacgtaaaacatgttaatgtattagcacatactaaagttgagaagtactccctctgtttcacaatgtaagtcattctagcatttcccacatttatattgatgttaatgaatctagacagggaaatgctagaatgacttagattgtgaaacggaggaagtatttgatattttgagcgatatatgtactataagtaccatttatcctatttgtgaact

SEQ ID NO: 99638 - DNA, 549 bp, Oryza sativa
ccctgtaggattgcgaaccccaactgaaaatcgctcaactgcaccaaacatcacagatattagtgacttctcactgtcagtgattaatgaatgtaacccactggtgttgtttctggatgcactaagtgcagcactataatctggcatttcaggaaaatgctccttactcagatataaactcttgagaaattataatctcagatatataccaaatccaattaggttgccatacttttgcaccgcacgcgatatgcttagtgctttctccttcccaattccaatctaaaaacagatgtgcaaattatatctcattcagagtgaagaatactctttcagtctgttattctttaccaaaattatgaaactatgatataagtaaaaatggcaaataaatccctgctttataccttgctgcttatgtcttcagatgctcttgtttgcctaaaaagtttacctagatagaatggaaccatatcactaatacaaacgcccctgaatggaaggatgggtcaggtaacaaaagatggtccatgattaattgatgatcga

SEQ ID NO: 99639 - DNA, 729 bp, Oryza sativa
tcagagtgataggttgaattacgactgaagaacttaaaaataaaatttacatctatattattaggcttctaaataccaatataaagttttaaaaatagattatgatgtaaaaaccccaaattaattgtaaactaaattttaaatttcagattttgattgcagctagtaaacaaaccaacaaatgataaaaactgaatgacaactggtccaggatgtttagagtgagataggtctggactctagcatacttcggccgaggcccagggctcgacttgagtggggaaaggagacagaggagccgaaaaagctaatgggcagccagtctctcccgcgcgactggacatgtgtcgcgcgtggagagggcggcggacggcgcgccatgacggaggtgcgatttttccctttttttggtttctttcgtttctcttctgttcttttttgttttttcgtttctcttctgtttttggtttttcccttttttttaagatgtacatattgcaaagtttgtattcgtgtgtataccaagtttgtattcatatgtatacaaacttatttgtattcatatttttttctcacggtttttaacatgtacatatacaaagtttgtatacgcgtatgcaaagttggtatatgtgtatattttttatacgttgattttttggtacacataaaaattatatatacatgtatatatatactttatatatatacgtataaactttgtattat

SEQ ID NO: 99640 - DNA, 1522 bp, Oryza sativa
gtgggtccaatattatacaccgttagataaattgatcttaaaacaaacaaaatactatgggtcccacctctcctctttatacgtgcataggtaggtcacgtacgggtatgtagtacgtacgcctccctcccttttgtttcctttttttactacttttttccatttatacaattgataattttataaacaaagaatataccattatataactctttataaacacaggtaactaaattagctctataatatttgaaaataaaatttacaccatattatatgtttacccattaaatcaataatgtaagatagtttccacttaaaccggtgtactaattactttgtactattatttttaaataatgcactattttaaaataaaatttacacaattatattgtgtacctatcaaataaacaatttaagatctatattaactaatatatacatgcacttaaacagatagacccattatttaaatcattggatctatttttataattactttggactattattctcaaataatacattgttttaaaataaagtttacaccgttatattgtgtacccattaaattaacaatttaaaatatagattaactaatttatatttatactagaacaagtacgacccattatttaaatcatcggatctattattaataactaaagtgtctaaagttctctttttggcctgctgcataatgcacgtctacaccttttcctttcgcatgtgtgacaaagcgtcatgtctgaggcatctcaggtgatcatgaccgctgcagcgctaccgattttgttaataacatgaaaagaaaattaaatgtgtgatgcagtgagagaagaattaagcaccgtgttaacacttagctctgtttaagccgaaatcgatagttgattacataataattataatgtattgtgttatgttgtattcagattttgtattatttgtttgtacaattgaaagaaatcattatgttacaaatgtgagcacaatattaacgaatatcaatagaactcttactaggataagagtgttataagggagtttaaggcgctattttttccctgattccatcttttggattttcgtttgcacgctccacgctttccaagttcgtaaatggtgcttttcttaaacatctttttaactttttagaagttaattcattcgtttataatctcaaatagctatcacataaataagataattcatcaatttaagttgtcctaaaccctaaaccctaagtagtacataattataattttttcatgcgagtcatgatgatcagtaaattggtgatcaacgcataatcaaagtcgtaagatgaatatgtaagagctactataaataattgtaaatatgactatatataaacatggacgaagctagaatgaatattaacatatatcccatacatatatattacatggttaatattataattacatgtggtaagtccattaaaatttcttaaaatgccctcaagctgccacgtgatgctctaaaatattagaaa

SEQ ID NO: 99641 - DNA, 1164 bp, Oryza sativa
atatatattacatggttaatattataattacatgggtaagtccattaaaatttcttaaaatgccctcaagctgccacgtgatgctctaaaatattagaaattataagaaaaaaagcaaagtatctattacttgattttcacttaatcgatgggtccaatattataaaccattagattaaattgatcttagaacaaaccaaatactacgaggttccacctctccaccttcggtacgcacctacgtacgtgggtacctacgcttcccctcccttttttccatttttccctttcttctttttctccatgtatacgcttccctccctttcttattgtatcatgcaccttcatgagacgatttaatcacaagaattttaagtatcttgctctcactttttcatttgtagccatactacaagcaatagtttattatttactcgagaaaaagaacatgattcaaaaatcgtaagtacttaatcaatctcctactcaaaagtttatgaatggattttaaagataccttaagaaaatagaacccttaaattattataaaataacagtatctaaactttagtttgcccttaatctatcagacaaaatttttaaacaaacagtaaaaatcttacctttcaaataatacaagtgctgcgcgggccaccttcctagtttgttataacttgtagaagtcgaaaacttgcatgtttgcatggtgatatatctcatattaacctatcttatcaattttttatttacaactataggtgacatgaaaaaacgaggagataaaaccagttttccgtataattaagtcattgaatatacgaatatatttgagatatctgattagataatctgttatatatgggtggtctctgtatgttattgagccccgttgtttcgcttatttgtggaataagccatatgacatatttgcaaatgaaaagtaatttgtgaataaaacttatatatacatgttcttaacgatctaaaagcaaaggctgaaaaataaactacgatgaaaaatcctaaaataaactctatatttaatattgaaatttgaaattttggttgataagcataagcatacgcaaaaagatgaggcctataagttgtaattaaaatgattatacagataatagtcgtctaaatcccagtatttatgctctg

SEQ ID NO: 99642 - DNA, 787 bp, Oryza sativa
tcgccgcggcgcagcccggcgaggccgtgaacgtcagcgagcggatcacggcgctcatctccgactcggcggtgcgcaccatcatgggcgacaggttcgagaagcgggacgaattcctggagggtctcgccgagggggacaggatcactccgggttcagcctcggcgacctgttcccgttcgtcgaggctggccagcttcgtcggcggcacgacgcggcgggcggaggcgaaccaccgcaagaattcgggctgatagagtgcgctctcaggcagcacggggagcggaggaccgccggcgccgtggacgacgacgaggacatcgtcgatgtgcttctcagggttcagaaggatgggagcctccagatgcctctcaccatgggcaatatcaaagccgtcgtcctggtaagtagacaagtacttgctgattaatactgtactaatctcccttaattgcacacgaatacttctgagcttagagtagtatttatcttaccaataattaatttttcaatcgtatctacaatcgtaccctaacgtacgttctcttccctaatttagtgaaggttcaatcacactttctggatctataatccattatattcgtgaaaggatgaaatataagacatattttaccaaacctcttttacctgagtgcactaaaatttgactactgttaatgtcaaaatctacaaagttttaccgtttaagaataaaattaaataactttaactgatgaatggagcgagtatatatgaaaatgggtaccgagctcgaattcgccctata

SEQ ID NO: 99643 - DNA, 695 bp, Oryza sativa
  unsure (1)..(695): unsure at all n locations
tgtgtttggcgtgcttgcattntgaaatacggtgttaaatatgtagtactgctgttaggagcgcagcacgttccttagcatttcgagcaccaaacatgtattagtctaagcctacctcactccacgtcctgtcatcccgctcccatcgctcccatcgttatcggagtaaatgatttacttcgataataaaaacaactttcctacttccgatcccaccccacgtcccatcatcctgctcccactattatcggagtaaatgatttacttcgataaaaacaacttcccagattccagtatatattctatttttcccgtacccaaccaaccactctcgcccccactttattttttcctctttttttttgggatatgcatcgatccatcatcccagcccacagatcggtgacgcaccatggaggaggacgacgacaggcgatggccggcgagcggtggccggtggcggttgatgcgaaggcgctgcttcgggcctcgctgccgtacgtcgagcaacaccttaactagtaaagaggcgttcacctaggtcaagagcaacaatcggcggctgctccacgtcggcgacattgacagaacaagcacgtaaggaaatagcactccgatttgcatctgcatactctagtttaccttcacgcatgaagccccaatttttttttgccaatccgattaacgtgcaatct

SEQ ID NO: 99644 - DNA, 547 bp, Oryza sativa
ccgaagagccgacaacgtatacacgaacgcgagtcgcgagattgccggctttgcaaccgctcgccgcgcataacgtgtcctcaggatcaacactgcgcaggataaaacctctattcttctaatatataacgtgcaattcttgtgtgcgttaaaaaaaaacactacgcaggatagcatccgccgccgtacgtcgcccgtcagtcgttcatcctgtctagctcgtttcaggcagccgatcagttccatctgctgccgcatccgcgcatccgagtgccttgccgagttccgtcggccgtgtagcgtagcgctgtcgccgagcgtccgcgcgagtgctaactgttgcaagcctgaaactgcagctgctaaactgcactgaggcctgaatcctaacgatcaagaagaggtgagagcagcaggcaacagcaacaccaccaacgttgccatcgccaattgaggccttgtttagttcacccctaactactccaaacttccgactttccatcacatcacatcacaccacatcacatccaaaacttttctacacaca

SEQ ID NO: 99645 - DNA, 681 bp, Oryza sativa
cggtggccactggctttgcttgacttttttagaattttggtgtcgggaaaatcaatgaaaaagatactctctccggctctataatattgatgttttagacaaggttaggttaaacttttataactttgaccattaataactttaaaaatatttactttaaacaaactagaacaacatatatagatttgtctttcaaagcactataataaaagtaaacatgcatttatttattgtatatattatagtagaaaaataagatcaaagatatattttgtaatccgtgtcattgtccaaaatgtcaattaaaatgaaaccgaatggagtaaatgagtgatctcaaactgtgaaaacgatgaattgagcccagctggcagagtggcagttatgagagaggcaattgattttaggctggacccttgctactctctgtgtcttgtggctattttgatggtttttttccaacacaaatatcttcttttttcaattaggatctgttgtaccacattcaacagaaaattgagggaaaatctgtcaattttttgccactggatgcgtgtcaagatttgtgctccatgcgagaaacagcgagtagctgatgtgagttgatcccacaaccctagacttaaatgcatggcccttccatttcaagccacggtgtcggttatgaattacatccgactt

SEQ ID NO: 99646 - DNA, 656 bp, Oryza sativa
agctataagctactataaacttatgtagaggagagaagtaaataaaagagaaagatgttggttctcatgtaagagctggcttaacacaagctccaaaacaacattaaatgtataagtgagagatagagatagaagaagaaaatcatagctaaccttatagttaatctattatatgtgttaactttagtataggctaatagtaggaaatgtgctatattattatccttgctctaaaacaacgaatctaaacaagtattgactatttagattgttgtttcaagaggatgtttgggagggaggacaccccctaaaattttataggtagtaatattttggatgaagttagtattctgcaggcacacctatatactcctgtcaagtcaacaccaagtagtcgaagctctcacgagttgccatgaaaaaaaagaagataatactcgaacaaccctcaccatgtgccattccaggtgacagcatggggcacatatttcgaacatcaggtatggcaccttaaataatactatctttatattttaatatatgacgccgttgactttttatttaatgtttgaccattcgtcttattcatcgtcaaatgtttttaagcacggcataaatattttcatatttgcacaaaaaaatttgaataaaataaa

SEQ ID NO: 99647 - DNA, 1122 bp, Oryza sativa
taaaacaaattgttcttaagtctattttctcaacttcacctctcttctttttcacgcacattctttccaaactactaaataaaaatttctatagtaaaattgttttaaaaattataagaatccattctaaatccttttctaatagttaatcaattatatgctaatacgtgcttcattttacgtgttggagaggagatgtcccctctcctcccgaacacattctaatgatctttactttaagtatgagggagttgctatatctctactacttaaatcatccttctccacctccacctccacctctacgtaaaaacctactaccataaaaaccatccatctaaaaagcagacttcttaaaaaaaaagctaaataaccccactaagtctaaattctctcggtaaatttaataaaaaatcgttgaaatgcatgagcctataactactactccctctatttcagattataagatgttttaaagtcaaaatgtttcaagtttaaccaattttatagaaaaaaatagtaatatttttcgacccaagataaatttattataaaactatatttaattattaatttaataaaactaatttggtaatgtaaatattactatatttgtctataaaatgagtaaaacttgaagtagtttgactttgaccaaagccaaaacatcttataacctaaaatggagagagtactaattaactaaattctgatcatctattaggcgaaacatgttactctctccatattttaatgtatgacgccgttgacttttcgactaacgtttgaccattcgttttattcaaaatttttgtacgaatataaaaatatttaaatcatgcttaaagaacatttgatgataaatcaagtcacattaaaataaataataattacatattttttttttgaataagacgaatggtcaaacgttacataaaaagtcaatgttgtcatacattaaaatacggatgtagtatttcgatatagattttattgagaattcatattaaataaagaatgaagttgaaaatagtttaattaggctcttttttttgaactcaaaattaattattacaaatataaggctgtactatatttgcactaccaacttattacattacc

SEQ ID NO: 99648 - DNA, 693 bp, Oryza sativa
ctatagggcgaattcgagctcggtacccgattgttcaatatagttgtgtaaaaaaacaattttatttataaaaacagaagctaagagccatatattgaatctaattgttatacaaattatagttgagtatgaaagtcaattatgttttttttttcatgtagatattacaattgcatacttgtacttataaaaatggaagataagagttgtaattcaaatctaattatacctttgttaacgaccaaatttggtaatccaagtaacggagatgaagatgggatcgaagcggagtacgagatggagatcactccggaaacagagtaagtatctgaagtccgagtcggttgcgatcaggatcgacagagtccaagttggacagggttagccgattgagccgaatccgacaatatgacacggcatgcattgtcgggttgagttaatgtgcttcataatgattgccacatatggatagagtcctgaaaaggcaattgtatctattaattatgacatttcatgtaatttccttagagatatgttttgggcaaaagtctgccgcaaagacttatggtatcttagagtttgttagagataagagtcatgtacgatatggacatattttgtaatctcgggtataaatagaccccgaaccctatgtaatcaatctaacacacgttcaatacaatcttggcgcat

SEQ ID NO: 99649 - DNA, 538 bp, Oryza sativa
tggcccgttggcttttgtttcagaaatcagaacacattttctctacatttcaaatctaattcatcagtaaggatcatcaaaatcataatttgtgctaattagtaattttcatttgttttgcatagtatgccgcatatcgatcagcttttacaaatcattgtgacatatacatttttcagtgtagtataaatatagtaaggcaactacacgattgctattggccagcaaataagagagttttttctcttttttttaataatggtatgaaacatcccggcctttgctcacaagagctatagtccattattacaaaagtagcacactaaaaagcttagtccaaagagttataaggctgatgattcctgcacgttaatgctaataagaaggcagcggaaatcacaccacagccaagctgtattaatgtccaaacctccaaatcgctttgcgcctttcaatttgcaattatttctcttgcctatgttttcattttgcaattatttttgtgctagacaacaaataataaatgaatcaacttctg

SEQ ID NO: 99650 - DNA, 1520 bp, Oryza sativa
atattcgcaagggtgagtaccaaccgtactcagaagccaccacagcaacaatgcatatgaaagggtatttcaaaggatagctatggttcttttgcgcaaagcaagttttgtaattctttttacaagcctcagacctagcattgactgatcaaattttagtaccagtgtttgtatttaaacaacgatggttctgtccaccatccattgtgatcccaaggatagcttcccgccattgagttgttatggttttctgaggatgcccaccttcccccttctcaggaagtggctccaacagcataaaaattcgtcatgcaacaacccatcccacacaagttaagaatttagagactagccaagtgtaatacatgtcccgatgctcaataaccgcgagcacgactattcgaatagatttggtttactcacacttcagtggatgtacactttacccgcactccgcgactgcccaacacatgagcctcgtcccaacacatgagacgtgtcacggcaaagcttttcgataacctcgcattggcagtacccgctccatgaactttatatcctcatgcactctaggcgtacacgatttctagcagtgagaggagttctggcgcacccgggaaaggaaaaacacatgcactcctacgttgcttcctgtcgttgtacccagtccatcatgattgttctcttatgggtatcctcatgtagtattgccaagccagtctctgaccatccggaacgggcatccaccatccacctggccatctgaaccgggcatccgccagcagactgcttgccgcatcacacacctaaaagaagaccactacgcatggatactgcctccgctcagctatctactccgctaggtctatacccatatgagaagtgcggttgtacgggggatcgtttcattcttaacttcatggctcggtccttaactgaccagggacggcactagccttttccggacatcacccaaatcctccatccgccccagtcgaaaacatttgtttagttttattttcctttcacaaattatgtcatcaatatcatggcaatgtggcgctcatgtctccacatgccgcatctcaattaccttcccaaaggtaattgcccaagcatatagcatttgataaatatgagtatgcataaatctagagtagcatttctaagcatttgtcatagttgactaaggacttatacgtaaatcatagttacaaggatttaagggtaaacaataatcaaggcatggcataatcacaagtaggatgttcataactgcatgcaattttatttgtaaacaaaacaatttcgcaattgggattaatatgttcaaggaatagtgatgacttgccttgctctaggtcttgtgggccttggccttcacccggatccgcggctccctcggtctctatagttacatgcgtaagaacaatttgaattcgatcagaattcaaacaaaatccacataatgaccgtattgaaaaacgagcgcgggaggtgaattttatataggctacttt

SEQ ID NO: 99651 - DNA, 705 bp, Oryza sativa
gttttttttttttgaagtgagtatattggcaaaactcccatactcttgaagacttatttctccacctcgtgcaataattcaaaagcaagtgaatatgtagtgtaaatcacttatgtctgaaaatctccacacacatacagttatactatatatgtttccaagctcatatctttctacggatcactctcaatgggtcaaatcggcttacaattacgtacttggcctagtttagcccaatgtatttagaattatcctttttatgtgcttctcgctggtgaagacacgtcctgctgcaatttgttcttcatcagcgacaccgtacgtccaggttgttgtgagatatttaactatttatcactctaactggcaatctggcactaattcagccatgaattaaaaaattgccaattttcaccgtgagttcagtagtcagctttgcagttaaagcgagccatacattaagtattgcattaatggtttgacttgaagtttgcaattttcaaaggtcagctttgtcatagatagccaaaaattccagctgcctctgctgcataataattactactacgaccgtactaaaatataagtatttttgaacggatgagatactttctagactatgaatctagatagatagtatattgatgtcctgaaagttgtctcatctgtttaaaatcttttatattttgagacaaagaaggtata

SEQ ID NO: 99652 - DNA, 1031 bp, Oryza sativa
tatagggcgaattcgagctcggtaccccgacaccgtccaggttgttgtgagaggggttgtgagatatttaactatttatcactctaagtggcaatctggcactaattcagccatgaattaaaaaattgccaattttcaccgtgagttcagtagtcaactttgcagttatcgtgaaccatgcattaatgtgtttgaattgcaatttgcaatttgcaaaggtcagctttgtcatagatagccagaaattccggctgcctctgctgcatcacaattactacttcatccgtactaaaataaaatataagtaattttgaaccgatgagatacttttcagactatgaatctagacatagagtatatattgtatttctagaaagtgtctcatctgttcaaaatcttttatattttaagataaaggaagtatattgctgtgccagcatcatcagcatgggtgttgtgcttgttggagtgatcatacaggagttgcaaattgcaactcaaatcgttaacaatagtacagaaccattgcttaactgttctaaataacagcacatttactagctagtggatgcattccaatggattagtaaggacagacgcaatgtatcttgctggggtcaacagtagtgtaggccccaaatcaaatggtagttatcataaattgcatgatatgctatttttagagaaacaaattaaaccgtatctagttaatataaactcatttttatgtttgatatatttgttataacatgtagaagtggaaaacttgcatgttaatttgcatagtgatatatctcatatcaacttatcttatcatttttttatttacaactatttaggtgacatgaaaaaaacgagaagataaaaacacttttctgtagaattaagtcatcgaaatacgatatgtttgagatagctaaatagataatatgttatgtatgggtggtctctgtatgttataagttgtaattaaaatgattatacagataatattcgtctaaatcacagtatttatgctctgaactcaactg

SEQ ID NO: 99653 - DNA, 1644 bp, Oryza sativa
taatatatgacgccgttgactttttatttaatgttgaccattcgtcttattcatcgtcaaatgttttttaagcacggcataaatattttcatatttgcacaaaaaaatttgaataaaataaatagtcaaacgttgattaaaaagtcaacgacgtcatacattaaaatacggatggagtaaaaatattagttcaacagtttcccttttgtcttgcaccgaaaaatagggagtagatttaacttaaaaaataggtagtttcccttttgtctcgagaacggtgatcgatatcccatcaatatatcagaattgttttctcaagaaatatattgctaaaaagaaaacttaatctgctcctactgaggcacaactacaagtctacaacttcaaatgggggtaatgcattgtggatggcaaggattggtttattaatttacacaaagttaagttttattttctttacaaaagaacttaattgatgttagagctataatagaaatagactgttttgaataaattaactgtcttatctatctgaataaattaaacaccttgtctactcgtccaatgtttgtcataattttttatttttcctgttgcaacgcacggtcacctctgacagattaacaataccaatttattcctagtaaaatcctaaataaaatatttttaaagcacataaaaatcaactagtagatatatatttgtaccattataataccaccaataatagaaggggtcgtagatgcaccccctacataaatagtagtaagacgtagtactgattaattcaagtaatgatattttcttctttgactataccagatattagagcttaatcagatgttgcgtgtgtttgggaaacacaacaatatatgaacttgaaaccttgataccgctgacattttttttgtgttcattgcaacacgtgtatgcatggtaagcacagcaatatactaattccccgagatagctgataacaactgcaaagttgacaattgaactcactgcgaaaattggcaattcaattttctagctgaaatagcgcctgcgttgcaggttggagagccgtccaaatcaatgacccagcgtcgcgtcggtcactctcgcaggataggatcctctctacacaacactccaaatagattattctaacagatgattccgttaaattttagcataatattgacgtgtctggttattcgtcttattaaaaagaattatataatcatattttattttattatcaattgttttattactaaaagaatattaagcatgaattatatattttttaaagtttttgaaatcaaattttgaataaaataaatggtcaacgttataccacaggtcaatttcccagtctattttaaaaacaaagatatagtattaatttgaaaaaatgtgttaaatgccaatctttccaaataagaggaccgcaagcaattagcagacatcaaaacctgactttaattcttagatgcattatcatactaaaataacttttctatgtatattattatagtaattaaacttctctatatataccattcctagttgcccttaaggtattcgacaactaagctactagctagctagctcaatacgccatcagcgacaccgtccaggttgttgtgagaggggttg

SEQ ID NO: 99654 - DNA, 1440 bp, Oryza sativa
attctttactggacaattatgtaatgtattgctctctcgtttccttcttgattaatgatcaatcagttcatctcctctcttgaaatcggcctgtgctctcctgatgctccatgccattgttgaaggcgaacattcaggccctgccgccgccgctgccgaagctctccaccgccgacgaacggtcgatctgcaggcacgccggcgagtcaggtttcagagtagactgttcatttcacttcctacaagtgtttgtgttcatcgtgcagatgcagaatcactgattcatcactcaccagagttctcaaggagattctttttctcatttgcaaaggtcatattcaaagaagcctccatatatgctggtgtgtgtacagtcctggtctcaagtctcaacgatgatctgcacaaataaaaaaaggatgaacaatgttagacaattatactgtcacttttcacatttcagatatcttccttcttttatcagtgtttactgtcaaaggttagattgctacaaataacaccatttcacttttatcagtgcaatggaaatagggagttctcaagcatcaagaaaccggcgtgccatattagctacagtttctgtataaaaacgcatgaatactttgttgaggtaaaacgtaaaagtcgtttttaagtaagcatgtttcacaaaatggtgcactaagcactagtctgagttttgaactgctatttggtggtggctactttctcctgctccgttagtatgttttccaattgctactcccttgctaaatggtgcgttacgtacacaagttttactatatagaagttttttttttgaaaaaaatgaaataattgtactcaattaatcatgtctaatagtttgtcttgttttacacgttgccaaaaatcctagctgaatatctggttcgaactcagcgactgttctcatctaggacactatggaacaggtgaatcataaaacacaagaataagaaaaactaattagtttcatatatatgaatgcacctaaaaaacagagaagtgtaatatatatggaaaaaaatataggagtgatcgttaaaatcagaatacacacagaagtcaatgattttctagaatcaaattgccgccaatattagaagctatagtaaaattgctcatagtaaaagagacgtctgttgcctacgtcaagacagagtgattaatccacgtaatgaccttcttgttgccttgcattgacttactgccagagagattggaaaaaaatgcccccaagtgttatcagattattgtatgttgcgtaacacaaagaaactgagatgtacttgacagtgcaaggacaaaagatatgaggtttaagtgttatcaaattattgtatgttgcgtaacacaaagacactaagatatacttgatagtgcaagggacaaaacatgtgaggttttaaccttgtgatc

SEQ ID NO: 99655 - DNA, 1016 bp, Oryza sativa
atctctctcatccaattcatgtgtttttcctgcggttcaatcaaacgatcattcctgtgtttttcctgcgttttgcaattctatgttttacacttacattcctatcaaaatcctacgtttttcctattcctacgttttctcaatcctacgatttaaaagggcccttaaaggattgaataggattcaatcccttaaaggattgaataggattcaatcctttgtttcaaaggccttcataggatttttttccataggattgaaatcctccaaaattcctacatttttcctacaaatcaaaggggcccttcatgtgctttggagtgtcacattctcaaggttccatactatcatgggttataagcactgaccacatcttagaaaaaaaatactttcatctaatggatttgcatggatatatttcattacttatgtccattatatgaaacaaaccgatgagaaaacactaacattgatggtggagttgaccatgtttaaatcctggttctccacgaatattatgcacgcacggataaggttttcaataggtatgtaagtgtgatacacatgtataaccgagcgagtatgtgttttcattttaaaagaaaagaagctaatggcttaacacctatgcaaatgcatgagtatattaactttccaaatctaaaggtttactaatacgaggtgtaaaacaggcacgagtgtggtgcgggtgtacagggatgtgtatgcatcttccatgtaatcaagaatgtacactggtgtgaatgtgtcttcagtgtaatcaggaatgtacgtaagatgtgtatgcgtcatccgtataattagaaaaaaaactagggcttaatcagattgtagccaaaataacccttatcaatttttcggtaagttgataatgttaccaaaattttggcaggattttttttatgtatttaccaaactttggcaagaagctaaatgtatacacacctttgacaattttatcaaaaataatataatttaaaatagtatcaatctga

SEQ ID NO: 99656 - DNA, 1082 bp, Oryza sativa
ggaccaagattctaatatggaaacttgtgtggagaaatgggatgtcgtgacgacgctcaagattgttgccgtcatcaaagcttgcaagaatttgacaaagctttcgtcattccacaatcaaatcctcacacacaaccaccctatgtgccagacataaccaccaattcaagaacaccacaaagctgaacccgcagccccatggcctcaagccttaccaacacaccaaaggcaggctagctagatccatgacacacgtgacaatgctgcgcagtcgatatcatggctctaccgagctgccacgacaccaggcataactcgatgatggtaggcttgaagtagttctaaaaaaagaggcttgaagtccaattacaagtgataagatatcattaaatcgctcttgttcctttcaactacgagtgataaattggtccaatctgtcaaacagacagaaggatgagcaagagaatgggcaaggtgtttattggatacaaatatgaaaaagaggagggaagggatggtgagtggttctttaaaaaaatataatttatgagtggacgagttgtaaattattatgatatataactattgagttggacatggttttggattgatctgagattttcatgctagaaaaataatagggtaatattgattacattatcgaaaaagaatttgagggtatacattccatcgagttatcttaatctatttgaatgtgtatccaaatgtgctcacaaggagcacaataagaccaatagagtctttcataagggaccgtgtaagctatagattgctgacatccccaactatccatgagaatatcatacccaagtatgaattgtacgagaaatctaattacttagatgtaggaaaatgcaatataaatatattggcatgtaaatatagtgtgccctagcaattctatgtgacaaggtcatgtcacaacaattcatctactattagcacatttccctctatctctctccattttttcataccttttcaccctcgtgatctacctagtttttcttcgtatgttttccatttcattataatctttcctacacaatgtcgaccctgat

SEQ ID NO: 99657 - DNA, 551 bp, Oryza sativa
agagtgttacctagggacagtcggacagacagacaatccagatgtagtgagaatgcttgaggggagggatctcaacagatcagcttatggagccttagcacaagatatcaaagcgaaactcctcttacttcaggaggtaaaggttggctgggtccgacaaatcaggcgtcgcataagttagcgcagaatagaatttttttaccagtgcttggtttaatgtatgtaacccctcattcttagaggcggcttttttccccttattaaatccagggaacttcattttccccccttattttactgtagaaactagcaagtgcagaggattcaacccaattttgtatatgagaagaaaaacaatgcatatactctatatcatatttcccacttttatctcaaaaggtacaagttttaccctgtgccataagacaatgtacaacttagatcaagtactctccacagatagccgcccaagcagttggcattgatatccccatcacaacgacgaatttggagctggtaacaagggtccgagctcgaattcgccctatagt

SEQ ID NO: 99658 - DNA, 1294 bp, Oryza sativa
gggtgatggcggagtcgccggccgtgcggctgttccggcgaagggcggcggcggcggcgttgcgcggggggtgaaggtggtggtaagagggctcgtcggcagggggcccggcaaggtgttcggccggtcgatcccggcggcaaggttcggccacctcgcctacataaggtgaaggcgcagctgcgtcctgaaacgtcagtgatctgatcttcttctcctctctcactctctgccatcgagggaggtgtgctttgtactagcttttttcttcttcttcttcttcttcttcttcttcttcttctttttttttgtttttgggccaatgatactttgtgctagctaggtgctcgacaaaatgcgtccttgattgatgcttggtgattttcactagatctgttcatacgacttgtaaatagtagaacatgctaggtacaaggtacttttcagattacactgttcttcagttcttgtacttagtacgttttcttttttttttcttcttctgtatgaaatacgctcgtaataacatcgatcttattaaggttgtttaactttttggtgttctgttagatctgcagttccttcttttttttatatatatggacaatttgatggtcagatgaacagaaggcctttaccaagtagtttctgaacttctgatgctagatctatacgaaggttaggatggatgcacagctgctggtttctacaaacatcagtacatcatatcccgttgcgtatgtggttgccatgagtcttttctgttttaaaaaagaggcagattagaatgttcgatacagctatgaatcattgatttgcttctgcattattcatgcatgcagccatacagctcaagtattcgttgttttgtctaatacggtgtactctgtatctgggtttctttcagaccacagtctgcgtcagatatttttcttctctaatccatttgtgtatttgtgttgttcaccagtagtgcacgtctggtatgtacttgctacttccatcttctgaaaacaacgagggaaaaattatctttggcttgtaatactaattaactccttacatattcttgaattcctcttcggtgttccagacactcttgtatgaaagtatagagctattttctcgtagtacaaaatgaggataaaatccctctcattacaaaacaaagagggaggttatgtgtcttatggaagaggccggggatgtaaaacatttctgttgtctttaaaaaaaaagataaaagagggatttgaagaattgtatttgaaattctgaattatacataacgaaa

SEQ ID NO: 99659 - DNA, 533 bp, Oryza sativa
cttgatcttagccaaaaggccgagaaaggtatgagttgttgcgtgatactaaccctggtattatagctctcctgatgctcctttctctgaaaactgacggtgtggtactaaacagagcactgcacctggtctgttacttgggctaattgtcttgcaatcataactctccagaggcccaaaaaagacacaggggcccatgtagatgcccttccaggcccaaaccacgggaaggccgaggtaaagccttccatgaatttttttcatttttaaatgtttcttttaaaatatttacagaaataatctatcgttggaaaaatttacaaaaatagaccctactactctagtgaagggcggcaaattgacgtggcagatggcagctcgatgacggccgattgaaaaagttgaattttttgcattaacacccttgccgcgcactgccagggcggcaaggggcctccatgcaaaaaagccaacccaggaagggccatatcaacagagttggaaagaagcatttgacttgatttttttttgca

SEQ ID NO: 99660 - DNA, 808 bp, Oryza sativa
atatatatatatatatataatatttctatacataaagtctatatgtacggaatttcatcaagtttatacatctaaagtttgtatacccaaagtttataagttaaaagtttaaatagcctgttcaaattaatttggattcaaatatttttttatatagaatatttctatacataaagtttatatgtatgaaatttcatcaggtttacacatctaaagtttgtatacccaaagtttataggttaaaagtttatatacccggttcaaattcgaattcgaatttgtaagtataaagtttattcacatgaatatatttttcaagtgtattagatttctttttatattttttaaatggtttaaaattgatagtgtggtagaaaggggagacgtgtgcggggagggacgcgggtgctgatagtttttttttatcgcttaaccctccctccagcgagcgatcgcgtactaggaccatccttttccctatggataatgataatagtattatctcccttaattttgataggacttattttattcaattttaacatcttcgacaccaaagctttaacttttaattggttgcaaaatagtacaaccttaataactactccatctgttcacaaatacagataattttaagcccttttgacttgtccaaaaatattaatgagtttaaagtactttttgtcttatcaatcatttatttttcaatcgtatcaccaatcactttctggatctataatccctatattcgtgaacggatggaatataagacatattttaccaaaccccttttacctgagtgcactta

SEQ ID NO: 99661 - DNA, 1141 bp, Oryza sativa
tgcaagacgtcaccggctacgtttgcctctccctggctctcgtcctgctcactctcgtgctccacaaggtggtggcgatcgaggaaggcgagcggttgtagtggcgccggccagccgaggcttccgccggggccgtggcggctgccggtcaacgatcggcaacttccaccagctcatgatgggcacctgtggaccctcgtttttataacaggaatcaatcgtgtaaacagtaccatttctctgaatcaagtagtctggtacacatgagctcatagctgaaataccaaatactcatacacgagagtctagtgtgaattattacaacataagcccgcaggcattgtcttaaatcatcggaccgagcggtccggaatacaaccaaaagcagaattagataagacagcggattttaggcagcggcatgccattgccacaggcaacgaccgtactaagacctactgggcgacatcgtcttcatctccctcctggtagtaggcatagggatcctccggagcttcgtctcccgcttctgattaattttatattcgcaagggtgagtaccaaccgtactcagcaagccaccacagcaacaatgcatatgaaagggtatttcaaaggatagctatggttcttttgcgcaaagcaagttttgtaattctttttacaagcctcagacctagcattgactgatcaaattttagtaccagtgtttgtatttaaacaacgatggttctgtccaccatccattgtgatcccaaggatagcttcccgccattgagttgttatggttttctgaggatgcccaccttcccccttctcaggaagtggctccaacagcataaaaattcgtcatgcaacaacccatcccacacaagttaagaatttagagactagccaagtgtaatacatgtcccgatgctcaataaccgcgagcacgactattcgaatagatttggtttactcacacttcagtggatgtacactttacccgcactccggactgcccaacacatgagcctcgtcccaacacatgagacgtgtcacggcaaagcttttcgataacctcgcattggcagtacccgctccatgaactttatatcctcatgcactctaggcgtacacgatttctagcagtgagagg

SEQ ID NO: 99662 - DNA, 684 bp, Oryza sativa
atgcacgtgcaggaaacggacggcggcggtgacgacacgatgacgtgcgtgcaagaaagggcggccgccgccggcaacggcgacgcggacgcacgcagcaacacggggaaatcgacgagctagcctgcccagattgatcgcgcggcagaggtgcgtgggctgatcggtcataactcgaggtcaaacttcgctgacgatgccatgaaagacccaagccatgcacatcatcggttcagttcagatgatgagaatcttgaagattgcatgaatgaagaaaatgattcaggcctggtttagttctcaactttttcttcaaacttttaacttttccatcatatcgaaatttttctacacacataaacttttaacttttctatcacatcgttccaatttcaatcaaacttttaattttggtgtgaactaagcacaccctcagtgtgtgagtaattttgattgatgtactttgttgtgctcagtagatacggaatgcatacaaatttgtgtgcactgtacgtgcacgcgaccgccggaatccttccgcgcgcgagattagcgatagccagttaattagtttcatgcggttttgaaggtagaagtgctccaagatttgtgcacgccaggtgacagaatctcaataggtgtgccatacaatttttttttcccacgtacatatcctactagtct

SEQ ID NO: 99663 - DNA, 653 bp, Oryza sativa
tcaggatatattatgccggcggcggctagatgatgtctacaccgtagggttgcatgtgccggccgcaaccacccacaggttttatctgatgcggtgaaggtcagtgtgaggcaggcgccattgcaccgaccgaaacacacgaacagcgacaacagcaaacagatactagagcaaagcccccacaaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaa

SEQ ID NO: 99664 - DNA, 1772 bp, Oryza sativa
agtggctggctagctaacctcaatgagaccaacaggagtcctgttctggccttctggggctaccagctgtgatggcattcacttgtggattttgtgaggggcatttgtctctttccattcttatcttattgtttggtattgcatctttgtcttcccttctctgggtatgtatatatgggcaaatcccataataaaatagtaggcaataattagtcccttggtacgttgaaattttcacaatttgaccctttgcaaaaactttttttacatatgaactgctgtcaaaacttatttcaaatttgactcttttggtcagcgctaaatcacctggcgctgaacttagacacctcagcgccatgtcaactggcgttgaataccgtgccaccgcggatgggtgactaagtcggcttgccaacgcatattcagcgccacgctatttagcactgagatgtcttagttcaacgccaagggttatttttgaaataagttttggtgacggtttatttgtaaaatagtttttgcaaagggtcaaattgtgaaaatttttgcttggtacgcatggatggtttttatacagtatgataacacaaagtaaaatgccttcattgagcagtctctctaacttttgcgcccttgtttgagatcaaattataaatgctccttcgaaacgtatgaattttacagcaaacggttcaattcttctaaaattttggcccacaaaattcctcaaatctgaataggtcctaaatatcaacgcacattctgcatacgccatagctggatatgccactgtccttttactagcattggcttgtttgacttgttgaaaacaacacgtcggtctaaatttgcaaagccaaagtgtcctatatattttaccccgccggcctccatcccctcaaaataagttcatttttcacccatatcccacgcttagcaatacaaaagcaaaaagaataaattataccaactttattaaattccattgtaattggctcctactttatttagttcgaatgcaattattctctatttttataaacttcgataccatgattgttaaaagttaattttttaaggaaaaaagaggacaaaatgttcttattttaaaacggagcaagtaataccaaatcggtcgtggtataaacaccaacatataatcatcgagtgtgtgatagtgataccaaatcggtcgtggtcatcaagttgtggcgcactaaaaattcacgtactaaatgagacaaaccaagacaacaggagtactaacagtagaacgcctgaaatattcaaagtactcaaatgaattggtcaaaaactacggccctgtttagatcccaccctaaaatttttcactccgtcacatcgaacgtttgaatacctatataaagtattaaatataagctaaaaatttaactaattgcacatattgtgactaatttgcaagacgaatcttttgagtctaattgctctatgatttgacaatgtggtgctacagtaaacatttggtaatgacggattaattaggcttaataaattatgtactgacggattctataattagtttttttattagtgccgaacactctatgaaacaacctatataatacccaatgtgacacgtcaaatctttacaccctgatataaacacccctatagctctttaatagtctcattagtgcattagttagtaatttagtaaaatctattccctgtactacaaaacgcattaaaaaaccacaagaaaaaccacattaacttgcacactcctactt

SEQ ID NO: 99665 - DNA, 527 bp, Oryza sativa
cgtgtaaatacactaaaatattagagggtagtgggtcttttggggtggagtggagctgtggagcagcaaaaacccagctccacccccgtagttcattttctaggagtagctctgccaactccactccaaaaaaagatgaatctggaccgtttggcacagctcccgctccaggtaagttggagttgggagctagagttgtgccaaacagggcctatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcatgccgccaaatacaaatccatcccaaaaataccaaaattcccgcttttgaagcccttccttgacccctcccttggatccaccttgaaccctcgtgtacaaatatacaaattgaattcaaattcaatctccacatcaaac

SEQ ID NO: 99666 - DNA, 637 bp, Oryza sativa
ctccaatagctccctagctggttcagttgctccatctcgccatcagtgatatttgctctaatacctttaacaactgatttgatcaaatgaggagcacatctcatatgttgagcttgaaatgacaccatgaaactcaacttctgcctgaacagctcctgtcgggattgcagaaaacagtgtgcatcagtagactgctagaaaaaagttgcaacaggacacctcctagtgaacctatctgcaaaaatggggattttatttgtacatgaaaattctcccggtgaaccaaaggactgaaatgatatagtatgccaaagttaactctgaactaaaaattcagaactatatttattcacacatagtttcaatcttcagcaaagcgacatagcgcagcggatgaattttgatcccaaatctatcgccacacacaaactacaatcgctaatagttctcgttaggttctccgttatcaagattagtttaaagatgtaccggaattgaccaccgtcaaaccaatttcagccaaaaaactcctaattaaaaaactaccactaccaggcagcacaacttgaactagaaaaccaaaaaaaatccgatcctccgtccccttcaaaccgctagtagacgagctcggaatcgg

SEQ ID NO: 99667 - DNA, 777 bp, Oryza sativa
aattcgagctcggtaccccgaagctctcacgagttgccatgaaaaaaaagaagataatactcgaacaaccctcaccatgtgccattccaggtgacagcatggggcacatatttcgaacatcaggtatggcaccttaaataatactatcttatattttaatatatgacgccgttgactttttatttaatgtttgaccattcgtcttattcatcgtcaaatgttttttaagcacggcataaatattttcatatttgcacaaaaaaatttgaataaaataaatagtcaaacgttgattaaaaagtcaacgacgtcatacattaaaatacggatggagtaaaaatattagttcaacagtttcccttttgtcttgcaccgaaaaatagggagtagatttaacttaaaaaataggtagtttcccttttgtctcgagaacggtgatcgatatcccatcaatatatcagaattgttttctcaagaaatatattgctaaaaagaaaacttaatctgctcctactgaggcacaactacaagtctacaacttcaaatgggggtaatgcattgtggatggcaaggattgttttattaatttacacaaagttaagttttattttctttaccaaagaacttaattgatgttagagctataatagaaatagactgttttgaataaattaactgtcttatctatctgaataaactaaacaccttgtctactcgtccaaggtttggcataattttttatttttcctgttgcaacgcacggtcacttctgacaga

SEQ ID NO: 99668 - DNA, 506 bp, Oryza sativa
aggtgggacccatagtattttgtttgttttaagatcaattttatctaacggtgtataatattggacccaccaatttaagtgaaatgaaggggtagatgttttgtttttttttagaatttctaggattttctttaatttatcatagcgccacgtggcagaaggaagtttaatggacttttagtatataataacataaatgtgagtttatgttaaataaattcagtttaatttgtttccgtaaaaataacatacagtatcatgcaatttatgataactactgccatttgatctgcggcctacactactgttgaccccagcaagataaattgcatctgtccttactaatccattggaatcactggtggagaagtgctttttagtcccggttcgtaacccccctgtagtcccggtttttaaaccgggactaccaatccgggactaaagatcgttatctttagtcccggttcaaatgcccgggactaaagatcgatctttagtcccggttg

SEQ ID NO: 99669 - DNA, 1820 bp, Oryza sativa
ccaaagcatggcgaagacgacgacgacgacgacggcgacgacgcaggcgacggcgtcgtacatggtgatcagatgatcgacgacgacaacgtaagtacgcgaacgcgagtgcaatgcaatgcaggatagctagctagctaggctagggaacagatatatacgaggcgatggagatgagatgacaaagagagccgtttcatctgcaagatcgatgcacggcgcacggcggcgccgtcttggcgcggggcgccattgcagatgagctcgaggctggctgctgctgctgcctgctgctacacgccacggaaaccgcgttgtctcgtcatgcggtggcgccgcgagcggtgcccactgaattgagatggcaacggcagatatcataagaggctaagatttttgcaacggcccggacactgtacttatccttgtgttttcttgctgcttttgaggccatgtatttacatctcataatttggggaatttgaaatatctcgttttcatgtgggggaattgaactgtaaacatagtaccgctcgaaaatctaattctcaatcccatgtaatgtgccacaaatggatgctatatatatctccatctcaattaatcaaacagagagaaaaacatacaaattgcttacttcatatatctaaagaagaaaaaaatgaacaaaaggagagagcagtaatgcttgagttgccttgctaaagtccccataaaatacattttatttgatgtcgttttgaggtggaggtgccacatagaccatctcttatctatctttttttttttgtgtatatccacttataaatatagagaacggatctctacccattatcaaaattaaatccatccatatctatctatctaactttagtgtatattcacttgtgaacacagagacaatatctctatccattatcaaaattaaatctatctatctatacctatcttttttttttgcgagggctatatctacctatcttgactgtatatagagactggttctctgtgcattatgataaataaataaatcaatcaatcaatctatctatctatctattaactgtgtatatccattttttgttacggaggttggatctatatccattattaaaaaataaacctacttgtttatatctatcgatatatctattatattaaaaaatagaaaaaaaatggaggcaacacgtttcttttggaggctaaaaattctcatattaatcgaagaataaaagaaagatcctggccattaaattatattgttcaaattatacctctgtatagattgttcaatatagttgtgtacaaaatacaattttatttataaaaatagaagctaagagtcgtatatcgaatctatttgtatttataaaatgcctctatatacaaattacaattgagtaagaaattcaaatttgtttttattttcatgtagatattataattgcatacttctatttataaaaatagaagataagagttgtatttcaaatctaattatacctttacctacctttgtgtgaaattatacacgagaatcctctagttattatatttcaaatttttctgcttgatctgggcatttttctctttgaaattatgtagctttcacttctatattgttaacagtagcaacatgtgtgtatattccaacatgcctccccccccaaaaaaaagaaaaaaatagcccatacaacatgtggattgaacatactagcgtagtatcgttcaactttccatctccaagttcatcctctgaggctttgaactctgtgaagaattaacaagagaaacgaacaaacctattaaccatgtagcct

SEQ ID NO: 99670 - DNA, 799 bp, Oryza sativa
cagccatttaggctgtgttcttccccaactttcgcaactcaccttcctcgtgtttcacgtgcacgctttttaaaatgctaaacggtgtgctgcaaaaggtttatatacgaaagttgctttaaaaaatcatattaatctatctttttaaaagtaaatatttaattaattataagaaaatatggtactccgttttgcgtgcgtgggaggtgagtttccaacttcacatccgaacacagccttagtagtcttagtatctcaggtattagtatggaccaaaatttatttataacgaatataaagtatcttatggtaaaaaagataaaatcccccatatgattaaaattaatagctctataatggtatacgtaatactcgtcgacataggactgaaaccataaaacactgtagtatgtttgtatgcttccccatttatactttgattttaacaaagcaaccgaactagggtcaaaatttcggaaacccacccacccacaccccacccaaaaccccctctggaaattatttcggccgatttttttttggatatttcatggttttatgtatttggcaaatgttgttaaaatttcaaattatttcggatagaataactaaaaattgagaaacttcagtatccgatacaaataccgaaaatctctccgttttatattataagttgtttgactttttttctagttaaactttattaagtttgataagttaaaaaaaacagcaacacctaaaatatcaaattattttcattaattataacattgaatatattttaataatatgttggttt

SEQ ID NO: 99671 - DNA, 668 bp, Oryza sativa
ccgatacaaataccgaaaatctctccgttttatattataagttgtttgactttttttctagttaaactttattaagtttgataagttaaaaaaaacagcaacacctaaaatatcaaattattttcattaattataacattgaatatattttaataatatgtttgttttgtgttgaaaatagtactatatttttctataaacttatcaaactttaacttagaagaagtcataatataaaatagagggagtaatttgaaccccgaaccaaagtagacaagtagtgcctcaccttgtttggagtagcatgtactacgatccctccgtcccaaaaaaacaactcaacctatgaggggatgtggctcttcctaggacaacgaatttggataaagcgtagcccaaattcattgtattaggagtggtcaaattctcttctaggttgagtttttttttaagacgtggacatggagccaaggttgtcagtatctcgattcgtatcctagtatcttacgatactacgatcctaccaagccgaaacgataccgatcccacctagtatcctatttttatactatcgcgatcctactattcattactatacgatcctacgaaatcttaggtggtattctgattctacgattcctacgatactacaaaatattatttaaaat

SEQ ID NO: 99672 - DNA, 635 bp, Oryza sativa
ccgattgtcatatagaaccaaactgattgaggataaaccggggaactgccatgagcctgacaatcgatgtgagataaaattggagaactgccatgagccttgacaatcgatgtgagataaattgcttgggtgtttgaaatcttgaatgttacaaacgattgtgagaaatttcatgagtctcgaattgcttgggtgtatgaaggccatgtttagattgtagccaaaataaaccttaccaaaagtttagcaatattatcaacatgccaaagtttggcaataaactaaacgttgacattttttttgataacgttgccaaaaaaaataatatggttgaaaatagcatcaatatgaacagcccggaatttcatgataaaatcttgacaatcttaaattgcttgggtgtatgaaaccggataactgacattgggtctcgacaatagatgtgagatgaaatttctcacaattgtctgaaatcttgaatgatcaatgaatgtggctaatcctatgctatgccactgcttaatttatagcttggttgactggttgtatggcttggcagtttctagaagatgagcagtccaccgaaagatagtgggccaataataatggtatggctaataataaaggtggaatgg

SEQ ID NO: 99673 - DNA, 647 bp, Oryza sativa
atttcatacaatcactattcatgctctgaactccacaacattcctaattaaaaggttgcatgtgcttgaatactaaaaaatcggcacccgatttttttacaactaagcacatataactaacggtagcgctaatccacgcgctgcacacggaatattagatcgagcgccacacagcgctccctccttccagttttttcgttttttaccacccacctttactccgcatcccacctttcatcagtttatttttttcgtttttttaccaccctatcttccgtggttcttttttctcttttccatcttatccgtgcttcatcaaagggcccggtaaaatattaaacatccagattttttttgtttttggttccttctctccagttattttgtttcgcgttttagtaaaatatttatcatctagtttttcttttccagttttctgtttttctagtgtctccccacgtttcaaaagtaacgaatttactccgtggagttttccatttactcctagccttccacatctgctccttctaaaataacaaatttactcgcatgaatgcccttactttttacttgcatgaatgtccccatatcgtgcgacaccattcctagatggtcgtaaaagaactactacctgcttaaaacactag

SEQ ID NO: 99674 - DNA, 589 bp, Oryza sativa
acgttggtggtgttgctgttgcctgctgctctcacctcttcttgatcgttaggattcaggcctcagtgcagtttagcagctgcagtttcaggcttgcaacagttagcactcgcgcggacgctcggcgacagcgctacgctacacggccgacggaactcggcaaggcactcggatgcgcggatgcggcagcagatggaactgatcggctgcctgaaacgagctagacaggatgaacgactgacgggcgacgtacggcggcggatgctatcctgcgtagtgtttttttttaacgcacacaagaattgcacgttaatatattagaagaatagaggttttatcctgcgcagtgttgatcctgaggacacgttatgcgcggcgagcggttgcaaagccggcaatctcgcgactcgcgttcgtgtatacgttgtcggctcttcggaatcacttacactacaatagttagctgccaaccattggagacatttaactatttaattcctttgattcttcgataaataaatcgtagtgccacaaatcacaacaaagaaacacataaccttattaagaaaatcaaacattgaaaacaagg

SEQ ID NO: 99675 - DNA, 1141 bp, Oryza sativa
caatatatggatatagatttgtaaggttatggataacatatacctaatagtaatcaactaagcttggcggggctcatcatataccaagtcctatatggaatcataccacgtatatagaaggagttccggataaggaagaacaagtagagttctacatggaaactgtaagaactactcggattgtatgcatattggtctcctagttctacttggacaatgggacatctatgggtataaatacaagacccattaggaggagagggagagggagagagacgaagacaacatctgtcagaatagacaccaatacacgccgccggacatcaacatcagaaataagcctagacatacccaatctggcgcctacggaggatgacaagagggatctggcgctatctctaatcttgccgggtacttattcaaggaggaagactaccctgtcgtcgacaacgtgttggtgttccatgctgccaagttgacgacaagtagataggttatctcaaatattgtacttgtgtaattctgatgaataagagcaacatcggctttggccaacaggagtagggttattacctgattctgatgaataaggggtccgaacctgtatatactccgtctcttttacctcaatctcgcatataccctggtaccaatgatcaccttactatataaatacagtagtcgtgatctaaaacattgacaagatccgatcattgtatccataaattgatatacacaggtaatagatagatagatagatagtggatagagaaccaatctctatacacagccaagataggtagatataaatagatagatttagttttgataatggatagagatattgcccctacgttcacaagtggatatacacataaaagatagatagataatggatagagaaccagtctctatacacagccaagataggtagatatagatagatagatttaattttgataatggatagagatattgcctctgcgttcacaagtagatatacacatagatagatagatagatagatagatagatagatagatagtgaacggagtacaatctctatacaccgccaagataggtagatatagatagatagatttaattttgataatgcatagagatattgcctctgcattta

SEQ ID NO: 99676 - DNA, 934 bp, Oryza sativa
caaagcgaactactgaactagtcgttatgattctatcagtttctttaatgagtaaattacctttcacaacaaacgaaacaatacgatgggtagaaatagaatcataaccgggtctcagaacaacaaagtcaattgcttcagtataaggacttcgtttggttcaaaccgggtctcagaatcataaatgactgaccagcttgacgggaacatatcctatgcacacaagcttctcgtgcacaccaactagtaaatttcacagaaaattctagaaaaattaaacacatattttcaataatattattaaattgtgcacgagaaacttgtgtgtataggatatgttcccagcttgacatgtcaactttcacgtggtttgcatttgtttccatcggagattcggagttcatctctactttcaaaaaaccgttcaaaatttttagactaaactagaaaggtagtccctacaaatacgcaggcatacaacataggccatgtacttaagaaacttataaaggtttagatatttttttctcagtctatttgttagctctatgcagtatattatttagtaaatttcaagaaacaattaattatctaaaatctgtgtcatcatataaaaagaagatagactagtaggatatgtacgtcggaaaaaaaaattgtatggcacacctattgagattctgtcacctggcgtgcacaaatcttggagcacttctaccttcaaaaccgcatgaaactaattaactggctatcgctaatctcgcgcgcggaaggattccggcggtcgcgtgcacgtacagtgcacacaaatttgtatgcattccgtatctactgagcacaacaaagtacatcaatcaaaattactcacacactgagggtgtgcttagttcacaccaaaattaaaagtttgattgaaattggaacgatgtgatag

SEQ ID NO: 99677 - DNA, 757 bp, Oryza sativa
caatagacaattcagtaattagtagttgagttttgaactatgatgggttcaatactaacattcttaaaagtagaattgaaaaaaatatgtcatatttcaaaatcttcgcacttccaaccggaatggaaagcaaattgaattgactccaccattgatttttttcttaaaagaaaagattaactcctccatggtcacaacgtatgccttgcaaatcgcaagaaaaaaaaaaggaagaattaaaaaatctgcaagacaaaatggcaatacataggttggtggagaggatgcagaaattggaaatgttgcaagcagaagaaatttgaacatggaaaaagaataaggaacaaaaaatgttgaaaaacttgagaagaaacattaaagccaaagtgaaaaggttgaattaatcctaggggaaaaaggagagggtatatacctggaaattgaaataaagggatgaaaaatgtttggatggacaaaacatggaaataaatagaaaagagactgcctatcgaatgtacattcaagagaatttctctcacaaatctgtcaaatgtaactacataattgtaatgaaattacaacataactagtatataactacacaattcgaatgtaagtcggatgtaattcataaccgacaccgtggcttgaaatggaagggccatgcatttaagtctagggttgtgggatcaactcacatcagctactcgcttgtttctcgcatggaggggtaccgagctcgaattcgccctatagt

SEQ ID NO: 99678 - DNA, 814 bp, Oryza sativa
tttagaaaatttgagtgactaatctcttcctttgcagcacactcatatattaaacctaaatgtataaccgcattaattatttgatacacatgtattgagatttctcaattaatatatacattacaacctaaatttcaaatggtggttgccttcatttctaacatgttcttagaatgcacatccttaccaggatagtaactactccctccgtttcaggttacaagatattttgactttaattaaaatcaaactactctaagtttaactaaatttatagaaaaaaatagtaatatttacaataccagcatagtttcattaaatctataattgaataaattttcatcatatatatgtcttgggttaaaaatattattactattttctacagaattagtcaaacttagagtaatttgactttaaccaagttaaaacgtcttataacctaaaacagagggagtatttaacacgtaaatattccgcagcaatacgtgggggtgtcatctagttaatttatattttgaggtttgcccgtctataagggttggaacccctctcggcatacaaaataaacaacgtttctaccgtctataagtttctagacatctattggaatccatccaaatatttccgacattagaaatttacaaatgctgtctccggcgccgccgctcctgcagccacacttcagaactttctacttgctgtgtttctattgcctgtggaaccatcgacatgatgtggtcttttgaaacttgcaatctcttctcaaccttttgagacgatgtttagaagaaacaaacctctaggaacaccg

SEQ ID NO: 99679 - DNA, 666 bp, Oryza sativa
taactattattaacagataaaattgtgtatagttgtattagtgccggtacgaaagtagtcgcgctgtccctctcattttgcaataatttctcttgcctatcttttcaaaatagggatagccgcactgtacctgactttttttttcacttacatgaatgaatgaacttctctatggaaactagtattttgatatctcgagcggatgtccacttgtctatttataaaccatccaaacaacaaagaaaaattctcaaatcgtctacactaacagcgtaaattttttaaatcattattcacacccaaatttattttttattctaaatgtgtaggtcgaatttaaacttagatttccgtcgctgatatatatccctatactaacattgttaatgtttttcagatttttcactaccatttacattggatttggaagaaaaaaaagtaacgaggggacatcccttaaagaagttagaatccactccattctttctctatatataacatttcttgttggcctccatatataacactcatagatcgccatggccgtggtgcaaatgcaagacgtcaccggctacgtttgcctctccctggctctcgtcctgctcactctcgtgctccacaaggtggtggcgatcgaggaaggcgagcggttgtagtggcgccggc

SEQ ID NO: 99680 - DNA, 666 bp, Oryza sativa
aacactatcattataatagtatttagtatatttttctttcatgtgtttaatcacgtaaacaagattaatccataaaaaagactatagctatcaagtattttacacgttacaggacaaaatcttgcctcatctttcacccaaatatcactatcagcatgctacttattttttctggctcctagtagactaggtgggacaaatacactgaagagaagcacaatagtcatctgtctttgtgaagacaatgtgattttcaatagcctcatattccggctgtatgctttcttttgtgttcataccttccaattatgattttttctagcttgtaatcatgcaatccttgacaagactattggtataagcgaaaaaaattgataactgaagctaagaataagtcagttgtctactcagaccaaatccccattagacacggccttaaaccgcacgcaggtccagtttggatggccatcatgttcaaagaatatctgaaggtagcttttaaaaaacggcaaccattttatactgctaattaataccactagacttttttttttcaagacgacctacacaagacaaaaaagtttctattgatatagcaggaaaaaattacaaggttaccactagaccatgacaacgctagaagtggatgtcagttaaacaacaatc

SEQ ID NO: 99681 - DNA, 631 bp, Oryza sativa
catatgtgaaactttggcctgataaaaaactaaggaaaatagatatgctacatcaagttaaagacaatatgcaagtgtgtgtgtatatattaccatctgaaatttaatttgtgatctgaactgtttttcttcaacaaattcagagtagcagaaaattcttatctgaacaatcataatagtagaaaacttatctatgaacattaagagcagtagcaaagttacttactaggatgacagctttcaagttgccggcagtaagaggcacctcgaggctaccttccttgtgtatcctgatgagctcatccatcaagtcatcctcctcctccttggcgatgtcaggcggcggcgcggccatggcctccttttgctgctgccgctggcggaaggcgctgtccaccagctcgtaggacgcccggttgaccgcctcgccgcgagccgccgatggcgccggcgagccacgacgacgggaacaggtcgtcgaggctgaacccggaggcgagcttgacgatctccgggaggacctcgaggaagtcctcccgcctctcgaacctctcaccgatcatggggcgcatcgtggtgtccgcgatggcaaccttgatccgctcggtgaggttcacggccctgtcccggc

SEQ ID NO: 99682 - DNA, 909 bp, Oryza sativa
ataattgattatctccctatcttaaattccttatattttgagattgagaaagtatctaattaatgcgccagatatctatacaactaataattgattatctctctatcttaaatcccttatattttgatattgagaaagtatctaattaatgtgccagatatctatacaactaataattggttatctccctatctctaacaataaatctccagctagttggtgttgctttacatatgaatcagtttattattgaaggcatgacagaactccactgtccatagctaccaagtgatctgacaacacaaagtgagagtggattctaagttcaagatgtaggaatatattatatatactctacttacttgggttaagtggcatgttcacgagtgtatgagtatgaggtacgtgtctattgtcgtatatacatatgcattttccgtgtaatcaaaactaaataaatataaaatactctagttagttttcaagcgaacactctatgactcactcgacaacacttatccaaccatacacaggtaccatatacagatatgtatcatccgtgtactaaaaaatagtaatatgctctactttttttaagcgaaatcttccactcactcactagatacttgtccaaccatacataggtgccatgcatacatatatatcttctcgtgtaataaaaaatattaaaatattatacttatttttaagcaaactctccttcaatagacacttgtccaaccatacataggtaccataaatacatacatatcttctcgtgtaataaaaattattaatacattatacttatttaagcaaacactcctttaataaacactagtccaaccatgcagtggtgcagtagtatatttgtctttttttctggatgtacaaggtatcatcaaaatc

SEQ ID NO: 99683 - DNA, 691 bp, Oryza sativa
cgatcatctaagaaagttcagttgagcaatctactttgtctttacctgcagcaaccaaagtattgagttgagaaaccttcttagaaggcttctgtttgttactgtcattcttctctttgtcataattagaatcaggagaggcaacattgtcactggaacaatcatcttcaatttcctcaacttgatcaagtgtcggttctaccccacggacagataggtggtcttggttcaataacatgtcctgataatgtggatcttgatacaattggaatcaagagaggcgacattatcattagaactatcatctttaatttcctcaacttgatcaagcatcggctctacttgatgaaaagatagatggttttggttcaatggcataacctgataatgtggaaaagacaccgatcgagaaggatcttggacacaattgaaattaggagagtcaacattgtcattagaaccatcatctttaatttcctcaatttgatcaagcgtcagctctacttgatgaacaaataggtggttttggttcaatgacatatcctgatgatgttgaagagacactgatccagaagaatcttggacataattgaatgagaagagtcagcattgtcattggaaccatcatctttgattttctcaagttgatcatgtgccggctccactcgatgaacagataggtggttttggt

SEQ ID NO: 99684 - DNA, 500 bp, Oryza sativa
gagaggggcatggaagaaataagaataaggtaatttcattaaaaaaatttttgataaacacatcaaaaggataatatagtagtgacatataactagtaggtgtgaaatcatgacgaactggctccaaatagataaagaataataatatatttggtgtaaatgtaggaaacttataatgacacttctccaatgaatgtaggaaattttatgttctccagccttggaacactgtaatagccaaatgtgatcaacccatgtctgaatcacaaccaagcaaacaaaaaccatctcaaatctgacatatataaatcgatggatatagtgatatggttcaacatctatgctgattaatattatagggataaagtaacatttggtagattattatgtaagttacaatctgcacatgaaactctttaaaccaaaactacatcgaatcaagcattaaattaccataattgtgtatgaatttattccatccactcctaaggaatactact

SEQ ID NO: 99685 - DNA, 680 bp, Oryza sativa
catatgaaaaaattaacttattcaaaatacaagcaatataatcatttaatgcccaacttaaaaaataaaacttattattttttattttttaaaacttatgattaaatccatacattagtttcaccagaaaattaagagcaaaaactaaatgttatttaggtttaaattttaaatttgttttctaatttgtgataaactaattacatcccctttgttttttcgcaacaaatcttttttcactaaatatttgttgaaaagtaattttgaaattttatgcagaactttttttacaataaatcttttttattttaatgaaataattttttatttttaaaaattcataacaaatatttagtaattttccttattggttttcacaactcaaataatttacacataaaacatttctagcttttaacaatataccaaggacaacaaagtaatttctacaataactaacggtcaaactaatggtcaactacggaatgggtatgtaagggatccaaataaaaactcaggggcatataagagatcaaacaaatctcagggacgtagaagggattgggtgaaattacatgggcacgtagggaattggcccatatttcttgcccaaatttctcaatcccccaaccatattctttactactccctccgtttcgaaatgtttgacaccgttgact

SEQ ID NO: 99686 - DNA, 752 bp, Oryza sativa
tagcttttcccctatccaatgttgggaccaaatgataacacatctctaacagaaacagaaaattttcaaccatagtcactttcttcaagatatcccttccagttatttataatagagatgctggcattgcacctgtctatctatttttgctaaactagcctcaaagacatcgttttccttttcccattttcctgtttttaaggttcccatcactagccacctccttgcttgagttgtgaggctatatatttcttgagaaaattcccaatatacccctgaaaatttactcaatcccttcaatacccctgaatttgacatcatcccttatatacccctgagttttcattttgatctcctctatacccatctccgttagttgatcattagttgaccgttaaatattttaaaataactatattacccatcctatacaatggtacctacctaataaattttcatatgaaaaaattaacttatacaaaatacaagcaatataatcatttaatgcccaacttaaaaaataaaacttattattttttattttttaaaacttatgattaaatccatacattagtttcaccagaaaattaagagcaaaaactaaatgttatttaggtttaaattttaaatttgttttctaatttgtgataaactaattacatcccctttgttttttcgcaacaaatcttttttcactaaatatttgttgaaaagtaattttgaaattttatgcagaactttttttacaataa

SEQ ID NO: 99687 - DNA, 2490 bp, Oryza sativa
atatagtttttacaaaatattttgaccaaatgtagctttgctttccattaattaaaaaaaattggaagcgcttaaggcagcaatgtcacactacattcttggtttatgtggtacccacacacacaatgtactatgaatcaactatagtaggctcctgttggaacatgttgtcttggctgctgatttgctaagaaaggcttcttagttcttatactactgttgtgcaactttgaaacatcatggatattgaagcatgtcaactagggaagaaaaaggaaactggaagaggtcagtgttaggattaagttttcctagctcattgagttgttaaattattttgaaggtaggactgaaagaataaaaccatatcagcaagcaataaatgagagatgtgctctcctgatgcgctaaagaacattatgatctgttaggcagatcccctgcaagaaatttgtcttagttagttgcgagatttcagaagtacgatatcttctgggatgcaggttgatatacaagctgttattgatgttaagacttaatttgcagtcaaattatgtacctaatgaattattccaatatatttcctttctgtgaagatggttaaaggggtttgaagcatgacttggatgccaaggacacctcaaatattcaattttcgaattttggatgccatatcggttagttttccatctcaaaagagtatcaacagatttttgaagaaggtgatacatattccaaagtttgctaatgcataaatctgttataaaacaaaagcaatatgctgatggttatcgcatatccttgtgagttgtgatacaggagaaatgagctatcactttttctatgagttggccagctctccttggatacattatattttcccctcttcctaccaatcaacaaggaagacattttgtacaacgtacaatgctttaaagaactgaagggtatacattagcttaccatgcattttgaactgttgtatgcacaaaacagtcagagcacgggacatacatactaactaggtccagtagatgtattttgttgtcatttaaagttttaaactgctgtagcaattcatcaggtgatcaggttcttcataatatgcaacctgattcttacataatgttattacttacctaataggaggtcaatggacggctgtttgtatgaagtataagcgtatgactgtatggaattgcagttttccaaagatcaagagtctggtatagtgatatgtaacctccaaaaacttcttaaattccatgtcgatccattctataccttttgcactttgagctatctgagatgttctctcctgaagtgctaaagaacgttctgatctgttagggaagatcccctgcaaggaacttgactaatctgtcacaagatttcagaaatacattgtcttctggatgcaggttgatatataagctgttattgatgttaagacttaatttgctgtcaaatcatataacaaactattccaatttatttcctttctgtgaatctggtcaaagggtttcgaagcatgacttgcatacgaaggatacctcaaatattcaatttttaaatttttgggatccttttggtttgccactgtttgccatcttgagagtatcgacctggtaagctgcttatttatatgcatatgctcattgtgtttgtgtgatgatatggaaattgatgtgctgattaaagccttcttgtgcattctttgggcattcatttcttatttgcttgtgatgaatctgtaggagacattcaactggacaatttgaagagcatatccatcaaataaaggtgcttcctggtaattgataaatttaacagtagcaccattgttagttgtgcacttatcaaaaagctcaaacttatttgcaagttggtcttaggacgcttattacttttgacaaaggggtatcacatttgctataagggctctcccaatgcatagtgtctagattattttgtattagaacagagaactaaaacttcaacttaagaggaattttacttcttgatttcactattggtgccacattagtagcagagagaactaaaagtccattgtttgaatagtaatgtaagttatttaggtgcataattttaagaggagcttgacttgttttcttttggtgccacattgtactgttgcatgggggtcgattaagatactgatgcaactcgaggtgttcatcacaacaggaagatgcaatataaaagcctgcttagatataccagctaatattgaacttgccgcacctttggttgggatttgtatttgatgccaaataaggggatcaggtgctgagatttctggttctcattgaccagccacagaaacagaaaaggtaaaaagaactcccccttttggtcatgtacatttgaatttcttgcagtgagttcaaccctagtgcctagttggaagaagctgatccttcttattttgatttacagcacatttccttttcttctgtaagaaattat

SEQ ID NO: 99688 - DNA, 562 bp, Oryza sativa
tgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggctagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaatttcctctttatttgattgcagattaaatcagtctatacaagaagggggcccgaaggcctcggaagaagaaaagaagaaactatttaaagattggcgggggcctgggggctcactccgatgcacccgggtcgccagcctcgtcgccactgtcgcccactccgccgtcatcgtcctcctcgtcggagttgagggcgaaca

SEQ ID NO: 99689 - DNA, 733 bp, Oryza sativa
gaaaagaccaataatgcccaataatgctactttactcgcttggatccattttagttgagttgtatttactatttatgcaaacccaactttgatggtaaaatacctaaaattattatatgtacgtagtatgtgccccctccagttataaatatttaatgcagttgattttgatcataaagcttgatcatttatcatatttaaaagtttagtgtaaaaatatgcaaaaatatcatgtttaaagtacctttaccaataaaataagtcataaaaaaattagtgtactttttttaataagacaaattatcaaattttgttgtcaaagtcaactgcgttatgaccagagcaagtaccggaatttctcttaacatacagttggcattgtcttaattgtattggacttgtcgagcttggtgtttttttgtgggcatttctgacatgattttccctaatctatttacaggaggaaccattacctttgacaggacctaataatcgagtacttggtgcactagacagaatagagttacatttaaagattagagacgatggtggtgttgaccaagatttctgcgagaagccgagaacacaatgcatcagctataattttttaggttcataatataaatttagtgaaagtggcaacaaaatgtccggaccagtatgtgaacaagtagaatcgaatggcaaattaatcttctgtagctgccataaaattaggaacaaaattatgtag

SEQ ID NO: 99690 - DNA, 1437 bp, Oryza sativa
agcgtgccagttgatttgatcctgcagtcaacaagaaataaagacaaagaaactacggttaaattcataaatgatagccgatcgaccagtcgccgatgacgtatgatttatctttgagccgatatcgtatttgattcgatcggcaatcataaataggcaagaaagaactaaatctattcgatcggctgtaggtatcaacggaatataatccctacgtcgatatatacttaaatcaagcgattgggatagatcggtcatcacgccgagacagtataaatcacttagatcgaaatatatactaaggaaaggactataagcattcataacatagctgatcagatagatctagcatgaatcggctaatactccgataccactatattaagatattaaagcaagtaaaatatatcaaacagaagattaacatactttgttgtagtaagatcttaacataaaaggcagatctatcatatcaattaagcacatgaaaaaatataaagctaaataaggtaagatcggctgaaaccccgacactaccctaatcggcaaccaaaagcaggctagagatcatggttctaatcacgacttataaggtcaaactcaactgatgcagctataagtatgaaaagaacaacaatatctagacaatcaagccgttggatgcttcatagagtggtagataccctatataatcgaagtcaacgttggtatttaacttaatcggctgccttctcacaatagatgttaaccgattgaaggttaaataacaatattgccagagattatataggatatatggtaacttgacgaattatataaacaagattagagtatcataaagatggaagcactaatcccgagaacgcaagccgccataacaagttttacctctagttgaagatcgaaaccgatgcagctcaacccggcagcaggaactcgtcgaaacaaaacgaaagtaaaaggatggcgatgcgccgagattgttattgaacgtgtgttagatcaattacatggggctcagggtctatttatacccgagattacaaaatatgtccatgtcggacacgactcttatctctaacaaactctaagataccataagtctttgcggcagacttttgctcaaacttatctctaaggaaattacataaaatatcctaattgatagatacaattaccttctcaagacttaatccgtgcatggcaatccacatgaagcacattaactcaacctgacaatgtgtatcgagtcatattgttggaatcggcttaatcggctaaccttgtctgactcgaactctgccgactctgattgcagccgattcttgctctgttcccagaacgatctccatcttggattccgctaaagttttatcttcatctccgatacttgaattatcaaatttggttgttacaaatatgtcggtgatttattgc

SEQ ID NO: 99691 - DNA, 1066 bp, Oryza sativa
atgctggtgctcagtccattgcctgcatcgactcttggatcccaattgaggaagctccctgcatttgtgcaagatggcctttttgcgagcagtcaggtaaaggcaaaatgttcacagttgctgcttgtgctattaattctaattttgatcattctgttacactaatgactatgggagcagccgcattctgcatcgcaccattggattggatgctttctgcacgcagcataggagtccatatgcttccagacaacttgctatcacgtaatcccttccagacaactgcattataatttgactttgtgttgtttgacaaatttgtcagatttaggcatgagttatgaacaggatccttgtatggtgctaaaaagttttgggcgtatatatgacgtgcaaagaatagtttagacccaatgaaactgtagagtattattgtttatgcctgcagttgcttcaaagagaacaaattcaatctatctctgttgcttgtgtttcttttgaagccaccttataatttttagcacttaatgaagccaactcttctattgggtatttcaaggaagatatggggtcttgctttcagaatagaaattgtttctggtggttgtgcctgtgcatcctttgttgctgcttaggaaaaataagtctgcatggctcataccatcacctggaatatttttgtttcatatcatctgaatttcaattaataaagtctgtatccggttctatttcactattggtggtttctaaccgtcaataatacttgaaatcaagtttgtagtctgcatctggttctacattctttggtggcctcaaattgttatcacatatgcagattcactattgagtatgtgataattaattatttgtaatgacatttctgttatatcttatatactcccttctttgtaattaacagtaatggaattattgttagttcaatttgaaccaaccaacatgtcatataataaaaacaaatagagcgtgaaaatagcatttttcgaggttatgtgactaaatcccttgaacaaagaactttaaaatagaaagggaggggtaccgagct

SEQ ID NO: 99692 - DNA, 2130 bp, Oryza sativa
cttggactactggagatgatcagaacaaaatcatcctgtatgacagtgaagtggaaggcaggaacagagttcttggagctgatggatcagtcgatctgactcgctgtttcgtagccgtcaatttggatgatgaactggtgctcaatgtctgtgtttctgaaggagctggctcaatctttgagctcgttcttggacacaatgatgaagaatgtgtccttgagcaaggtccctatgaactgcaggtgaatgttgtttggacagctgccttgaagcatcgacagcgcagaaaattgtttgagcgtatcggtgacttccgcgtgttaaggtgatatgtagtatgaagatttatatgggggaagctgttacatctcaagcagttctttcttgttatatagattataatttttttgttcagctgagttgaactcgtgcttaactgaaaatctgcctgcaagacttatttagttatatgtactggtagactggtaatctataagattactgatgtctagtagggagtatggatctgtctggtagtctgtataaccttttctgaacctaccaaagtttattttgcgttcttggagaagtgtcttgtctgtcattgttacttactgggttgtgagcatcggattgaggtagtttgtagaggtttgagcgccatgtgtgctctactgttgccatttgctgttgagagatgctgagaacctgacgtttatggctatatatatgttgatgttttgtaagttaatgctactactattgctagaactaagtaagttgattcattttatgacaaagtgagtactcagttaataaccgaacaaaacaaaataacactatgatgcactgaaatagttcggtcagctttggctacatagtaagatgttgaattcggtcgactatcagcaggtgggtttgaactttggatggttgagtactgttggcatgtgttccagccactgtttccgttatacatttattataaatcattttgacttttcctcaagttgaatttttttaaagtctgatcaaatttatataaatactagtaatgtgcccgtgctaacgctacagtaaaatttcatattgcaaatgtaatcgagcgtagacagtttatgcaactattgaaatttgtcaatgttctgcattacatcttggttaaaccgaacattttgcagtgcggacaaacaggacagtccatttccagttttgacagaaatcaagattcattgtattttccactgaagtcgaaaatgaaaacaccacacttcagagcatgcaagcaaccagagtacaataatgcacatgatatctatgttggcaagaaataactaagccccatttgttttttgaggttcagttttttcccacacaacataaaaattaaataaataccagaaattcattgaatagataaacaacaatatctttacattagaggaataatatatatacattgttcttaatgagaatacatcaatatatattgtggtaacacctagtaggtttaaaaaaattaactcaggattttgtaacatgtgtcactaatatttaacataaaatagaacaatgccatgtaatttgcctattctgcacttgaaggttggtgatgctttggtagctggtagctggcaaccgaggggaaatagctatatgtgaaatgatttgccatgttctgaccgacctaaaagtgcatgacaaaatgttattttgcacgatcatatgtatcaagtcaagattgtcatgaaaagaaaaatcctcagtatggcaaattgaaaaggatgcttctcttcttcacaggtccattgtatcctttagagtagatcgtttcaaacaactttttctcaaatggcaataccaagctagcaccaacatggccttgcatgacacacctccagtgttcatggaagtctgggcaaattatcatggggtgtacaatatctcagcaccctaaagaaccataaaccttgcataccggaaacaattgatcccaataaatacaaaaaggacataacatgttgtgacagcccagggcccgaaaacggcattggtcgcaaaaatttcggaatcggagtttacagtcaccggtaatatctcctatttaagctagtgtagatagagctagct

SEQ ID NO: 99693 - DNA, 583 bp, Oryza sativa
atttcgctgcaaccaagaaacaccaacatggaagcatgtccccactgctcctaatctgaaaaatggctgcaacaaaagtaacagtgggctacggtcacggagattactgaacaaatccgggcaaagtatacactggtgtctcaacattattcacttatgctatgattccaaactgcacagcttcatcacagctcaaaggagatattcaaccacacccgggtattataccaacaagcacattgtcaactccagatactacaaaagtacaaatcaccctacttaatcaacacatagagccaggcacagcagatgagcgagacatgcatgttattcacttcccccagcaattactgtacaacatatagactgctaatagaacaacataaacagcagcaggggacatctggataaaagctatctacaatacttgcgcatgttcctctagctagatatcaggaacaaacagaacacagaggcaaatatggcaactaaaaaaaatggttttagatccacacagacaatgcagtgtccttctctacaaagaaacagctgatcgcaaattaagcgctatgcaagctcactg

SEQ ID NO: 99694 - DNA, 644 bp, Oryza sativa
accccctccgcaacagcgcgtccacgttctttctcctgatagataaggaggccgcgagtgcgatccgttttcatcgcttctttcccggggttagtttctccttctccgcctgagttgctctcgcttcctcgcttctgatctcttgcgcgcacgagagattggaaggagcagagcctccgaaaccacaccttcgcctgagatctgcaccgggtaggcgggtgatcaggtttttggggagtgcctcccgcacgactgctcatcgcgatgtctggagtcgccgccgctgctggaggagatggcggaggtggtgcgcccccaacaggagccggagctggtgcgccaggaggaggtgccgtgaacgacaacaacaacggaggcaattttgcctcaccatccagcagagggccattctcggggtataatcttctcctcctgttcccattgttagcgctattcctgttcccattgttagcgctatcgctatactatgtgcgctatgttcttgttcctgttcttcatgatgcctctatacgttactgttatgttcctgttcctgacatttatgatgcgcatagtatgctactggttatgtaaagaacggcctacactgcttatgccatgaatattgctttaacattttggat

SEQ ID NO: 99695 - DNA, 1740 bp, Oryza sativa
atcgtgataagtctaaattttaatggctgagatttagtatgagtccacacaaaagtttttggaaaataatagtccgtttcacctatggcgcaatagaaacagaaacataatcaaattattacaatgacagattacatgttagatatggattgatgtatgacggcatgcaacagctaacaactgacatcagtaaatttgaaacggaatactagcgtaaaacagaatcctatactgattaatacgtagcgtaaaaaagcaatcaacataattaaaacagaatcctacggtgattacctagcatcagaaagcaatcaacagtggttaatcaatagaagttcagcacaattaaaaataaggaatattagaagtagagtatagagtccatataggaatttaaaacacaaaaattcagaataaacataataaaattaaaagtagagtttagagttcgtataaaatacaatttataaataaataaaattcaaaattaaaaaaacatgggaagaagagtctaaagtcaaatacaatttagaattaactgaaattaaaaattaaaaattaaataatattgaaagatgagtttagattccacatagaaatacaactattaataataaaaatttagaaataaaaataaataatattggaagaagagcctatagtctatatagaaatataattagtagataacgaaaatgctaaattaaaaaaaaataaatattgaaacacaagtctagagtccatataggaatataatttacaaataactaaaatttgatattaaaaataattaataactaacacgtatataaaatacaatataaatattacacattagtagtttcgtaaagttagtacaaaatttaaaattatgttgtcattttaatatatttgaataatgcattgataaaacatatatgatattatgagagatattagccgcgcaatctacgcgggccagcggatagtaattcccacattaatcggataaaaagaaaaggagattccaactagaaagacaatttaaaaataattgaaattcgggattaaaaattagcattattgaaagaagagtccatataataacccaatacgagattaattaatatttgaaataaaaaataaaataaaatacgaaattagcaaaaaaaaaaaggaagataagagttcgagtagaaatacaatttaaaaataactaaaattcgaaattaaaattaagcaatattgaaagaagagtgatataaaaacccaatatgagattattaaaattcggagtaaaaaattaaaaaaaatctaaattagaaaaaaataaaaggagagtttaagtagaaatacaatttaaaattaactgaaattcggaattaaatataagcaataatgaaataagagtatatataagaatccaatacgagattaattaaaattcggaataaaataaaataaaatccaaattagaaaaattaaaaggaggttcaaataggaatacaattttgaaacaacttaaattgaaaataaaaaataaaaatattaaaagaacccaatacgatattagttaaaattcgaaacaaaaaaaataaaataaattctgaaattaaaaaataaaaataagattttaactaggaatacaatttataaataactgaaagtggggataaaaaataaatactattaataccatctaaaacacatgacgagattaattaagtaacatgcctataaaggagtagagtggtggcggtt

SEQ ID NO: 99696 - DNA, 520 bp, Oryza sativa
gtatacattagcgtaccattttgtgctattgtagtaggcacgaaacagtcagagcacaacatacatacaaactaggtccagtagatgtattttgttgtcatttgaaaatttaaaactgctgtaggcttgtagcaattcatcaggttcttcaaaatatgcaacctgatccttatatgatgttattatttacctaataggatgtcctgccaatgaagggctgtttgtatgaaatataagcgtttggatgcaggttgatatatactccactttgtttccactttattggtatgcatcctctccgtctcaaaaagattcaaatcctggctatgtcttgattagttgatttattttgggagggaagatgtatgtcattttggagaaagctgttattgatgttaagacttaatttgctgtcaagtcatatggtagtaataaactattccactttatttcctcagacctacctgcaagtttataataaactattccactttatttcctagactttatattttcgtgg

SEQ ID NO: 99697 - DNA, 601 bp, Oryza sativa
aataaagtaaaccaaacttgcaagataatttgaaatagttgaaaacaaggttacaaattttgtactttttaacaacaggtttcaaaagaaataaaagaaagttataaaatcatcatgctaaatttattttattgtagcaagattaaataaaacaatattgtaaaacttttgctgataaatgagccattagtacagtaatggatgtacagtactaataacactggaataaattttgaataagaaccattaaaagagattatgaaatgcatgtgccattagtttggtttaattaaaagagaaagggaggagaacagttctacttttccaatatttttagagggcttctatgggtaaccatttggcataacctagggtcaagggggctctgataccaacttgtcacgtccggaatttctatccaaaatttcaaacgcttacatgtgtgtaaaccctcgtccaggaatcagtcgaggcacacaataacaaattgataatagagtgcaattattactctaattaataagcgaatataaagtcattacagaggtagatagttcctctcaaacaataaagttctaagcagcggaaaataagataaacg

SEQ ID NO: 99698 - DNA, 510 bp, Oryza sativa
tatagggcgaattcgagctcggtaccctatgccgtaccaccatctacaagtaaacgattcatgaagagaagtgtagttgaatgactgtgttttaatgtgtcatcgtactcataacatttctatcattcatgacagacggatgaattgataggcacatatgtggtgacactgctatatgtgaatcttaaaaagctaacattgttatcaacgttgctaacttgctactatttcattgctctccaatgaacaagcgttgttgtgcgggtgtatctattacctatactatatacacgttaggtggtagagagcctatataagattttatatatacctgaggagttttttacaaagtagtctaacacgcgccaatttctagaaggatccaaacaattaaaaaaaccgaaaagagaccgatacgagaaggatgttattagctttagattaatagttttttgtgtgttgcattttattacaaacaatacttaagaatctacatacaggtgttacgtg

SEQ ID NO: 99699 - DNA, 526 bp, Oryza sativa
aggtaaaataaaaattgactactaccactaatagcagcagtctgacaaccgagtaacagctgcagcctatagcttactgtctaaggaaaccaaataactaactagaacaaggattatactaacagttattacatacgcttgagactgagttgtgatacaggagaaatgagctctcacttctcctatgagttggccagctctttttttttttttagccgggccggagttggccagctctccttggatacattcctttttttctcttcatatcaatcaacacggaagaaatttgtacaatgatccttaaagaacttaagggtatacattagcgtaccattttgtgctattgtgggcacgaaacagtcagagcacaacatacataccaactagatccagtagatgtattttgtagtcatttgaagtttaaaactgctgtaggcttgtagcaattcatcaggttcttcaaaatatgcaacctgattcttatacgatgttattatttacctaataggatgccctgccaatg

SEQ ID NO: 99700 - DNA, 644 bp, Oryza sativa
ttcaagagttaatgatatcttatttaatatttgttatttaagatcggagcaaataatattacgtcttcatagccgctcgaagcacgtacagctccatcaagtgcgtactcccccgtcctcgttccaaaatataagtatttttagtatggtataaatcaaacttttaaaattttaactattaataaaaaaaattaaaaagattaatcatgtaaatttgatgttatcatatttatcattaaacgaactatcataatatgaactctctttatttaaaacattttacttttgtagatattgttggtcaaagaagcataagcatcttgaagatcatgccgagatcttaatgcttatattttaggacgtaaggagtatattagtggagtaggagtactccctccgtttcaagttataggatgttttgacttaggttaaagtcaaactgttttaagtttatttgaccaaatttataaaaaaaagtaataatattttcaacccaagacaaatttattatgaaaatatatttaattactgatttgatatatattctggcggtgacatgggaccgggagtatcatgacttagagacttgaggcagacacgatcacccacgtggcctaaccccctcgggggggggggtcggaccc

SEQ ID NO: 99701 - DNA, 764 bp, Oryza sativa
aaaaaaatagaggaatagaaaaaaatacatgattctaacagaaatataagtgcaaaacagataattgtaaaacatatgaaaaaatataaaaactaccgtttgattgaaccacataaaaaacacttaccatagaatggataaaaaagatagattcaaaggaatctcttgctaacttttctccaaaattttcataggattacctatttcataggaaatgataggatataattcaatccgttgtttgaaagatttttatagtaattatttttcatataattgaaatcctccaaaatttctatatttttttctataaattaaaggggctcttagcttttattgattttctttttgtttctccgggagtctgcaggatttttgttttagcttgtgtacgaggtgatgcctatgatgcacaagctaaccatgagacgccaatgtccaattttcgggcccctttaaatcgtaggaatgaaaaaaatagatgaataggaaaaaatcaggattctgacaggaatgcaattgtataacagaggattacaaaacacaggaaaaacataggaatgaccatttgattggaccaaggaaaaacgcaggaatcagatgagagagatagactcagaggaaatgttccaagaggttagacctcttgctaactttcctccaaaatatgcataagattacccattccataggaaattcataggaattttagaggattttattcctataggaatttttcctatatagccctttgaatcaaagga

SEQ ID NO: 99702 - DNA, 1011 bp, Oryza sativa
atcaatttcaagtgttagcacgtcaaagaaaattcgcatagaaatttcagctgtcagttattgttcattaatcttaatttgaagtgttgtcaattcaaatatactacttagcaatttcagttttcattggcaagtgcacagtttcggttacttgcaattttgaagctgtgcattggcagggtagttatcaatttcatacacaaatgaaaacatagggaaaaggccgaaaggctaacgggcgatcgatcgctgccagcgatcgttttttttttcttttcctctttttagtaagtttatacctaaagtttacacatctaaactttatccacctaaagtttgtagagcgaatgtgtataagtcaaaagtttatatacccgattcaaattcgaattcagattcaaatattttatataaaaatatttctatacacaaagtttatacgtgcaaaatttatggtataaagtctatgcacatgaatgagagtattagattctaattgtcttttacttttttttgaaatttatgatgtaatagaaaagtttttgaactcgtcattttgacggtttgaaggatagatatatgaggaaagatgatacaaacaattaagttctttgattaatataataaagcttttagaatgaccctttttcctaggggctgttagtgggcgggtaatcgtttccctctcctcctagcgatcatacgtccctccctctaatactcctctttcatctctctttttttaacaaacagtgcccctaattgaagtactcagttgacacttgacagtgtacctaccagtgtttaaactaatcaactccttcttaatcacttagacattttctgtcccatatctgctagcacgctcctcctcctcacaggctcacacccgtttgtactcttcgccggctttagcgtacacgccagagtccgtcctcagtatgatcttggcgtcctgcgtgacgtagcacgcccagttgtccacgtaggacagcggcccggccctgatca

SEQ ID NO: 99703 - DNA, 2026 bp, Oryza sativa
attaatttactacagctgttttactactttcaactactgcttttaaatgctagttttatgcaaaagaacccctagcctcctttggttatatcctgcatcatacctcctcttccggtatgatttgctgagtacagtgggtagtactcagtcttgctctctgttcccccacaccagagctgaagatctttctagttggagctgtcttgttgaagttggtttttgtcgctgccgtcaaggtttgcctgtggagtggagtcatcccgctgctgaagtcaagcttcccggtttagctcgcttttatctttccgcttcatttgtaaatcttttatatttttgtaagacgtggatatgtatgtcaacaattgtcgtttgtgtaccctggctggtcctggacagggatttaatgcacattcagcttagaaattctggttcgtgaatttctgggcgtgacaatgaagccccatccgaggtggacgatttggtgaccagtgatattactgagtctatggagtaatggaaatctttccatgtcaaaaaaaatattaaatttatttttcatagggaaggggctcacaatagtggcttgccattagagcccttgagcgtcacttaggcgttgcactaccgccaaagcctggcgcaccccaaccaaaactcaaatttcaaactttgccaaaattcatgtgtttcgggagtttcgttttggtttgatttgctacaagtaaattttttgtttggaagttttgatggatctaattgccaaagagatgatttttgagttttaaaagttaagtttgggcctgcaaaacttaaacttaaatgggcctttaagcaacaacgtcgctacctctcaacatcacgcctgccgatgaagcagctacgatgtttgacaagagcttccacgtacgacgaactagctatcacactccatttcgacgtgcacaaacgccatacatattttttgtgttgctgcgaacgctgcacgacctgcctagctaaccctactcaccatagacgtcctagtctgttgattcgtataaaatctcacattcgatcttagtcgccgtcgtaattaacagaggctcacgtacttacggtactagtaggacagacgacgatcgaaaggaacgcaatgcttacatctgcgcttaatagataggaagtggaaattctaccaaacacaactataatgctcgggcattatcgggttagagttggtgtgaaaacgaatcggataacatcttatctgatccattccaaatccgctcaaaacgagaatatggtacgagtttatagaaatccgatagatatggatgtggatgcggatagtgtgatatggattctgtgtggatgtggtatctttaaaattcggcggatatagattatctggtaggccgtttgctagataatctgaaattgtcaacccatgtaaccgctctatatgttaaatacatcaattaagatagactccttaatctatgggtctgtttggggagcttctagttgctgcagcttctctcagaatctccagctccccaaaacagtccaaattgtcacccagattatgagaatatatagttgtagaatccagaaaatgaactagaacccagaagctggaaaacccagattctcagaagctggctaccaaccaacagattctcagaatcttaagctcccccaaacagggcctaagactctcaccgtctcatcttacacttacaaaggttaaagcctgataataaatcaggatgttcttggcaaggaagttctgatcattgcattggcattccatgtttgtaggtagctcttattgagctggggaaagctactttaccccgaaatgcaagcactaggtaggccctttctagcttttggaagaaaaaaacgatgatgacatagttgtcagatacgcttctatggatgaaatagttgaggtggaatgttttaagggtttgtcttgacgatagcggaaaatgatgaaagcttgattcttgggattgagaaataactttttttcgtttgggat

SEQ ID NO: 99704 - DNA, 921 bp, Oryza sativa
gaggaatatatgaagttgaataaaaaagatagcaaaagagctccgagcagaaatgaaaagtggagcaggacagaccagggggtgatgaaaataaacactgatggagcttttgatcctttcaccagaacaggaggctggggttttgctatcagagatcactcaggcaaggttgttaaatcgggagcgggtaaagttcagattctgatgaatgctttccacgctgaagccctagcatgtgcagctggtataagagccgccagtgaatgcgggatgcaaagggtgacggctgaaactgattcaacgatgttgaagtcggctttggagaagaacacttttgcttcgtcagctcttggcgggatcatttgtgagataaagaactttgtaaattttgctttcctgtctttcaatgtaagctactgcccttgaggttgtaatagggtagcgcatgaaattgcagctctgggttgtaaatcggaagtccaggacattcttgggtgggatgaatgtcacaccctgaagtttcccccccttttcttgctttaaaaattggttaaataaattgcccgaagaaattatcttaattaacctagagctaaatccctaattaataaatgcatttaataatcgaattcggcgtggtggaatttttcttgagttccccatactccaatacattaagatgaattttagtggaattttcagagccttgaaaataattttaaccaattaaaattgagcaagtgcaatatttttaaatcccaggaaaaatcctttcccctttttccccttttcccttttcttttcctctttttccatcttcttgggccgtcggcccagtccaccccccctttttctcccgcccgcgctcggccttcctcttgttgggccggcccatgcgcccctccctcctctctctgggac

SEQ ID NO: 99705 - DNA, 622 bp, Oryza sativa
tttttttctctgaaagtctgatgcgtttgcttgcattgcaacagacggtggtgttgcttttctttctttaatttgggggcagttaatagtttgagttggtgatcactggatttttctttctctctttctgatgaattggtcttaatttggctgcattgcctgaagctgggttgatgcgttcctttgttcgcgttggtcggctcgtatacgtacgtacacacagggacacggtcaccaatttggtactccatccgtttcacaatgtaagtcattttaacatgggactagctaaaaaactgtcgagtgttttttgaggggaaaactttcaaatctaactatagtatataatttcactagaactatattataataataataacttatatatatgtattaaaataatatatgcaactttatatgtaatttatatagagataacaatatagttatagtgtagttacactataattacaatgtaattacaatgtaattacagtgtaactacaatgtaactagaatgtaactggaatgtaacttatatataactttgaacaaatctaccgtaaacatacaatgatgggactagcttgtgaaaaaacggtttagatttaatagcaaaata

SEQ ID NO: 99706 - DNA, 2153 bp, Oryza sativa
tatgagataggcaagggacctagatgcaaaaaaaactagccaaatgcttcttttcagctgggcaaattgcattacgccccttgccgccaccaaagcgcaaaatgtgcacacggcgccgtcgagccgtcgtctgccacgtcagcttgccgccctccgctagggcggcagggtctattttttaaatttttgtaacaatagattatttctgtaaatattttaaaaaaaaattaaaaatgaaaaaaattcagccttccatgaccatgtaaatgtttggctcaacttttttttctcactcttaaaagccgaagcagtttttaaattttgaaatttggattttgatattaggtccttttttttacatatccttttagcaatcacgaaaagcgtgaacgctgttcaacgaaagtgacaagaaaaagggccaaaacgaacacaaaaccaaattcaaaatttcaaaatcagctgcaaacctgcaagctctccctaccaaattcaaaattcaaaggagtatgtccctttctcaaaagctgtttcagtctgtattccgtaaccagttcttgcctgcctccatgaagcgaggagatatttcagtgaggaattgaacgagacaccggcgacgctgcccaactcctcactgacatcggcaaagtctatttatttcttactccatctctttcagagagtgtgtgatcttgcagaagcaacttggcatcaaaagatcaacccacatttgttttctggagaccaggcattttttgaggaatatcccaagtgttaattctttgataaatacgccggcttttcgttggagttatctgcccatgccaagaatattcctgccatcttccttccggttatcctgagaagatgggagaatggctgaatggaagtgtagagacttcatttgtcaatgaagttaggccgagttcgtttgcggttgttcctaacctccacttccttatttcccgcgaacacgcttttcagtttccaaactgttaaacgatgcaattttataaactttttatatgtaatatttaccttaaaaatcatattaaccatttttataaaaaggttatttcctccgtcccgaaagtagctaccttatgtgacactacctagtactgtgaatctggacagccgtactatctagtactacgaatctgaacatgagaggtagtgtcacacccgtactagctacattttggattgtccagattcgtagtactagttagtgttgcataacgtactaggtagctacattttgtaaccgaggaagtagctaatattgtcactccgtttttcgcgtatgggattacttcccaaaccacaccaaaacacacagcttcagtgggaaagttgggggcatattattatatcttccaattgacatccgtctgtttgacggttcaccgtagacaaactaaaactttgccatccctcttatgccactatgtacctactttgcagctactcattttgttcaataaaaattaatttagtattggatatgacattcgttatattataatatatcacatccagtttagattttttttttttgacggagtgagtaactcctgtagtacatgtgaggtatatccgtccgggccaagagaatcatcctgcatagctttcgatttgaattttgacaattggcatgcctgcctattattgtaaccgtttttaacatgaagaatttctacgctgcgttgtgtcaccgagcactaatttgcaggtgaggatcgctgcgaacagttgaggttgactcgttgcatgatctgaagattatgaaataggagtatatatcacggccactcgagcgtatcaaatcacaaatgattttttgttcaacgcttcgccgccgcagcgacatcgtccatgtggttttcttcttttttttttgtatttcttttttttctctctttgacgcctaactctgtcaaactgcccctaacccaataacattcgaaaacaagaggaaaattcgtattacatttgaatatttgaaagccaaaacacgtatgaattcgtctgtatgtatgttaactcgcatttttacattatttagccgctcctatttaagaagcagcaaaaaaaaaaagaaaaagaaaaaagatcaagaagataattaagcaaatttaattacagatttc

SEQ ID NO: 99707 - DNA, 713 bp, Oryza sativa
atcatctactcactccatttcatattataacatattataattcgttttgaattttttttcctagttaaactttcttttaagtttgattacattagtaaaaatataacaaacatattatcgaaatatattcaatgttacatttaataagactaatttgacgtcgtagatgttgataattttttctataaacttggttaaacatagagaaatttgattaggaaaaaaaagtgaaaacaacttatgatatgaaatgttggttaaacatagagaagtttgattaggaaaaaaagtgaaaacaacttatgatatgaaatggagggagtaactaataatgatatgatcagtgacgaaagtatgaaacagtgcaaactaatatggtttgttttgttttgttttgcattttgtgttcatatgcagttgttcaggacgatgcttcacaagaggatgaacgctcgaccgagtaatgctgcggcgtcgtcgtcgaggaaatactatcttgaggataagccgagggagaagatgcaaagggagcatctccatgatgatgaagatgatgatgagaatgcagaagatatctttaaatgggacaaaactgattcagattgtaagtgagagttaatattcttcttgctgcatatatttgtttgcattcatggacatattttcaaacatatatgcatgaaaagattacatatatattgcagtaagtatag

SEQ ID NO: 99708 - DNA, 1155 bp, Oryza sativa
tataataataataacttatatatatgtattaaaataatatatgcaactttatatgtaatttatatagagataacaatatagttatagtgtagttacactataattacaatgtaattacaatgtaattacagtgtaactacaatgtaactagaatgtaactggaatgtaacttagatataactttgaacaaatctaccgtaaacatacaatgatgggactagcttgtgaaaaaagggtttagatttaatagcaaaatatctcagcacaaatcttaaagcggaatcaacgactaagaaatttgacagttttcactcaagaaaattgtcgacagtcctctagcaattccgttttagcatttcccacattcatattgatgttaacgaatctagacatatatatctatctagattcattaacatcaatatatatgtaggaaatgctagaatgacttacaccgtaaaacggagtaagtacttctttgcatgcagctgaatggatgaattaacgatgaataatttggttctatgataatattcgagaatataaacgaatgaattgaataaaacaaagtcaaaaggttgttctaaaaaaagcattcttataaattttaaatttatacacgcaaagtttcttttataaagatttgcaccatttcgagacatgaaaaatgtaatacttaaacatgttttggtcgaattttctatatgatgagaaaaatctaatacgaagtatgaaacacactggagtgtatggccatgcttgcttccatccatccatttccacgatacaaaaatgaacaagaaaaagatggacacaattaattagcacgctagtctttgcatgtcgcaatacaaggtaggtaaaggccgggggaagcacatcgcaccatcaccacatataaaaatcgtcacatcaacctcatccaaatttcgcatcatcacaaaaacaaatcaaatcccctccaaatttataacccattaatcaaaattaaaaatatcccccaatggtcaacacacacacaaaaacacacacgagatgatcaaaggccattccatcccgccctgaaggtgggccccacctgcagcctctcgccttcgcctatatatccactcgtgacacacacagccccctctcgcttgccacgcacaccaccaa

SEQ ID NO: 99709 - DNA, 594 bp, Oryza sativa
ttccgtgtaatcaagaatgtacactagtgtgaacgtgtctttcatgtaatcaagaatgtacatcagatgtgtatgcgtcatccgtataattagaaaaaaaaggagctgttcagattgtagtcaaaataaaccttaccaattttttttaagttaacaatataactaaaattttggcatgattttttatgtatttaccaaactttggcaagaaactaaatatatatacatctttgataattttacccaaaaaatggtatgatttgaaattgcattaatctaaacatgccctaatgaattagtctgtgtttagttccaccagtaaaaaaattttactaggtcacatcagatatatggacacacatttaaagtattaaacaaaacaaattacataatccagatgtaaactgcgagacaaatttattaagcctaattaatccatcattagcaaatatttactatatcaccatattgtcagatcatggcgcaattaggtttaaaaaattcgtctcgtaatttatacataaactatataattaatttttttcaatatttaatatgttcaaacgttcaatgtgacggagaaaaatttctttt

SEQ ID NO: 99710 - DNA, 594 bp, Oryza sativa
aattctaattattttaaattttctaaacttccctaatctccctctaatctcctatttatttccttttcctttttctccctttcctttttttttctttcctttctttttcttttctttttctctttttctctcttttccttttcttttctttctctcctccctcccggcttctttctctcttcctcggcttctccctttctctctctctctcggctccctgctacctggggcggcgacggcgaccgagcaaggggaggaggcggcggcttaccaacggcggtggcggcgacggcggcgcgacgacgtcgcacggcgcacggtgcggcggcaccaaggcggcggtgcggcggcgcgagggcggcgcgacggcgacggcggcgcaagacggcgacgcacggcgcggcggctccggggcgacagcgcggcggcttccaaagtggcggcgcggcggcacgacaacggcggcgcggggcacgaggcggcgacgggacgcgcggcgaccggacgttgacggcggcggcgacagcggcggcgcgcggctcggggcgggacgcgacgggcggcgacgcgacggtagcgcggcgcgacggcgac

SEQ ID NO: 99711 - DNA, 1008 bp, Oryza sativa
tatttcaataatcttttgtcgatttccttatcgggaaacatatcgaacatacaaaggtttgcagtatccgtatattccataagtcgtaggttaaaaggttgtatcttacccgtaaccatgacacttacctcttgggaacccttcccatctacacgcaaaacagagtaatagattaacacatgattaattaagtattaactataaaatacttaaatggattaatatgatgtttaaagcaactttcttgtagacactttttacaaaacacgtatcctttagtagtttgaaaagcatgcgcgcaaaaacacagcctaagtaccttttgatcaagagcatccgaaaacatttgtttttaacttccatttgtttcttcgacaacaagtttccacactttccagtcagttgccaataatttgactatagcatatgcatccctgaaaaatcaaggggtggcccataagctcacttctatcacctctttacttattatagatgaaatattaaaatacgtctagtcaaactttcaaatcttaaatcaccaacagataaaattaatttatgaagatttgttatgtgaaaataattaatttgaagtatatgcttcaatggaaaaatacattcatatgattataattcccatatgaataatgtaaggctatgtacaacgttgtgtaataacaacctctcttcattaccatgtaagtaaaattgatgacgtggaaaagagatagaggaaaaacaaacatgggtgctacgcatcacagcggatcagagtcgacttttaatgtttattaaagagaattttgttgcagggtggagaaaaggaaagaagggtagtaaaaaaatattttggtaccttccttttccaacctccctcccttgatttccacgcgtacgcttttcaaactgctaaacggtgcgttttttttgcaaaaaatttctacacgaaagttgttaaaaaaacatattaatctatttttttaaaaaaatagcaaatcattaattaat

SEQ ID NO: 99712 - DNA, 896 bp, Oryza sativa
taagtaggaaaatatgctgacatggatctcttgtagagagattataaataaccattgtggctacccttatagccaacttatagctgctagctacactattgaccttgctctaaggcaacgggtggggttcggagcagaccaggtcgacagccagcgcgaggacggcctccttcttcaacctatatatacatcatcatggtgaacagtggaaacctgctttgccaccactgtgctgcaggacaatgtcgggtgggggatcagcttcgcgatcgtcatcgtggattcgtggccacggccttcttcctcactttccctgccctccccttgggtgatttatattccccgcccaacgaaagggcgggtggagtattactattgtaaaatttcgaatcagaaatttattttttaaatctttttaaaaaaataaaaaaataaaaaaaatcggtgtacatgtacaggccagtcacgggacgagcccactcacacgtctctgtcgggtttgcattctcagcgtgcatcacaaacctccagccaacaacccattcgaactcggcgtagaaactcaattctaagggactccctccgtcccaagaaaaaacctcaatcctgagtttgaacctggacacacctataggttttttttgacggagggagtagtttattagcaaataattagttagatagaaggtaaaaaattaaacaatagataaacataacttttcaaaacaagattcctatacaattttttataaaaagaacgcatcatttatctgtttggaaaacacgcaaaaagagagagaagaagatgctaacttatactccctcattccctaaatgtttgacgccgttgacttttttaaacatgtttgaccgttcgtcttattcaaaaacttttg

SEQ ID NO: 99713 - DNA, 707 bp, Oryza sativa
tctttttttgcacccataaaaaagttcaggtgtagaactaataccacaaaagaagaaagatttgcttgcaacttgcatagagatatatataaatacctaaaaaatgctctgaaacagatagaatcctaccaaaaaagtgcagaagaactaaataaactctgagcccaacggtagagagagaaagagagaaacctgaggagagggggcaatggagggcagggcagaagagggagacggagctggaaatggagatggtgccatgtccatcgcactatcgctgtagcagtaaatgagacgacggagctaccaaagaattgggagagggactaaaatcagtcacattgctcataattattgttggaccactgtgttctgctgggaccttttctattcactgacacgtagctgcgttcgacagcagcacaaaagagagaaaaatccactcgttttccatgccccgcgcttccttaaaaaaaaggttaaacggtgttctaacttcgatattagctagctgagtagcacgcgcaattacgtggctagaacctacaaaattatttatttttcacatgattttactttaaatttataaaatagccatctcgttgccttatgactttaaaagatcaaaccttatatttctaaggtttctaattttatagttttttaaagtcatacgagtcacaatcccttactcctttatttgtttt

SEQ ID NO: 99714 - DNA, 525 bp, Oryza sativa
cttgacatttcgcagaaattcttgattgccataagaaatttattgttctctctctttttcagtccctgtaaagcatgaagaccataaaaaaatttgcccaaaaaaaatcttcttaagctttgcttgacctttaattccgaaattctctattgtcatatttgatatgcttttgtttgttatctaaatcttgttgtaaaaacatttcattcacaaaaatgtctgaataatgaaaattgaataaagggtgacgcagccggcgtagtagaggcttgtgtagaggccttttccctcgctgtccccgtgcttgttccatgccacggtgttgcatcccaggacgacgaacttgttgcgctcgtcggagatgcggtacacgccggtcttgttcagctccacgtcgccgtagaactgctcggtgacgttgccgctggagttgtagcacctgtacgccaccggcagcatcaccttcacctccggccgtgggaacaccgtcagattctgcacctggatggtgtcgttggcggcggc

SEQ ID NO: 99715 - DNA, 677 bp, Oryza sativa
atccgcccgcttaacattgagcctagatatgattttataatgatagaaagcaagactcgttattttttttcttaatgctttatggttaatttgatgtggaaaacataactgaaagtcttataaacaaaatgttatttcgtgaatgtgtttaaagattaggaataatggagatgatgtttatttacatcagccatctaaattggtatagaatagtgaaatgaatgaacgaatgtaaagtagtactttttggaaaaaaacaaaaactaaggattgaaattaatgagaacacatatcaattaaaggaaatcgttaaaaagtggaccaaaattacgtaataaatttgaaaaagtcaaaccaaatcaggaaatagaaatcaattttaaaaaatatctaaacctaaaattacatcatattagcagcaagcggtaaacgtcacggcaacgactctacaaggagattccgaaacatagtagaacccttaatatgctttgtaccttcacataaacgactccaagggtgattctacaccaatttgactttgataaaaaaaattagaatatttgttagaaagcaatactagaaccaacaatctacaacaaatatgagattatgttaatttagtttagaaatcaactaataatctaacaaataggaaaaaaagtagaactattttgttg

SEQ ID NO: 99716 - DNA, 1199 bp, Oryza sativa
ttttatcctcactcgtgcgcacccgggaagaattgcacactttgtcctcactcgtgcgcgcacccgggaagaatttcccggtcggtcaccaatcccaaattgctccagggttaagtgctccaggctaagcacgcttaaccctggagttctttggagatcggcttccggaaaagaaactgtaacttgttgatatgagtattctattaatcctattaagccctaggccgagatgtcataattcggcagtccctgatgatccccatgccaaatctcctatatgtgttggcattcgctagaccgaactactagttctctgctcggtcctttctcaacttgactcacctgccaacagtgcaagtacaggaactctactaccatccaattaacaccatggctatagccacacacattatgcaccacaatacccccaccattagacaaaccggcttgcatagatttactagccgaaacaatgctgccaattatagcaggtttatccattatcaaaaacatacctctactctgatatattatgaataattaaggcatctagcaatttaattaaatctaaacatcggtccaaataagtatttaacagtctatcaaaatactgaaatagatcaattaatccactaaactattagaataccgaaagcatgtacatccctcacacaacatcgactagactttccaaaccgaataatacagcatctactcggtctaaagtgtaaggatactctaaacggactaatagggatcgatatgtcataagcaatattatttggtgaaatgaaaacagtatcaacaccttccccacttgcacaaaatatgaccgaaataaattctaaagaataatatataggtacaaaaatcacaaatatctctagcacctaattatttcggtcgtagaaaaaataacaacacctacaactaataatggtcaatatgcaaaactatatggtaacagccctccataatataaagactcatatggtatccaagaattataataagaatatgagggataactagacatacctgagaatggattccataacataggcattggtaatataggtgaagaatataaataatgtggttgcgaaagaacctgatgattggatgcaaaccactgacttggtgcatgcctcctaactcccttcttattatttgcctccacttcaactttaacatatgtt

SEQ ID NO: 99717 - DNA, 1019 bp, Oryza sativa
gatttcgctagcgacgggggacgccctccaggagtccaggttgcccttcgttctgatcatcggcaactatttcgactttgttggcgttgacgatcgagagacatgcatgcacgtcagaggtcaggacacactgcactatcatctgatgtttgcatgcatgcgcacaagttctgggtctcagtggggaaggcaaaaggagatccatttagtgatggctgctacctgatcaattaatcatgggcacaatgcttcatctcggattaagattttctacaggattcgggatgatgaatatttcttattagtttttccgataaaaggaaattaatttggaagcaaacacacacacacacacacacatatatatatatatatatatatatatatatatatatatatatattgatctactatgtttcaggtattgcgatgttgatcctctaaccgaaagttcactctttcctgcatgcacagaagatttatacaccgtcatcgcttcaaggaatccaagtaggtaacttacatattgtatgcaacctatttgaagtattcttgatttctaattttcatagaataattaatgatcatgttacaataagtgttaggtaatcaggtccctgaatatataattatgtttatcaataagtgtttaggtaattaggttgatcgatagcaaaactcccatagttcacaaaaaaatttgatctattctataataattttaaaacagagaactcacgttaatctctattttttcagtggcaactaataattacttttccatgtatgtcttatcatgtttcaaaaactgtatgaagccttattgttgacgttcatgcagttaaatgtcgtgactaattccaatttttagaactatatcatgaaaactgtactcatgacctattaataacgaatttcaaaaatattaaatcagaaaaaagttataattcagactgtcaaattggaactattaattataccaggaccgaatctacaagtgagactccaacatttttttt

SEQ ID NO: 99718 - DNA, 687 bp, Oryza sativa
gttaagcaaaaagaagtatacttttgattggaccatgtgagatcatattttcgatgatttgctaaaaaatgattatattaaattacatgatcattatgtcatgccatcacttccagatttaaaagaacaaatttattgtaagtggcacaattcattcgatcattgtactagcgattataatatatttcgtcagaaaatacaatcggctaataatgaaggccgattacattttgcaactccaagaaagtcatatgccaaggataaccgttttgataaaagaaatcggtctaggtggtctagcagacagaagtcttcagcatgggtaggaggtagttcaataaggaagcaaatctgggtgctgaagtctagaggtcaagacatgggtttagctgcacatgatttacaagctgacgcgcttgtgggtgtgcaaatggcttaagttcatggagatgttgtggacgctagggggcacgcgcgtgtacgacaactaaaaaatttacaccatgtgagtatgaagcgagaggcatcttcggcagagttagtaacaagtcagaatccgccgaagagctcggggggcaatggcagacagctaagacactcacacagcttatcaaattggcagaagaagcagctccacaagctaagtgcagaaaagctaagggagagaggtatggcatgggtttctaa

SEQ ID NO: 99719 - DNA, 560 bp, Oryza sativa
gggagtaaagatatttttccgctattaccaaagtctttttttaaacccggttaggattaaaaaccgggactaaagttaatagcactgaaattggatttcgttgcatatgtgttactaaaatagtaaatatgcatttaaaattccaattaacatatgtaaatcccacatgcatgtcgtgaccgaaaaattgccttttgccgaacgctagtgtattaatcccagtccgaggaaagccggggttcaccacacaaacctgatacaaaaggcacatctttattatatcgataatatttacattattacgaaggcacttcatgcctgaccaacaaaaatagacagcagcggactagcgggcctacggctccatcttgacaggcgctcaactggggtataagccaggactcgacctagacttcttctctgaagcttcttttactgaagggaggaaagatagagcaagaatgagtacaaccacagtactcagcaagtcacaccgggagatgcatgattaatgccagggagtacatggggtaataatataggggttaagtttggcagta

SEQ ID NO: 99720 - DNA, 548 bp, Oryza sativa
caggtcgactctagaggatccccttctcgccatattgagattctatggaagaaatgaaacgttacccgcctacttatactttttatagcaagcatcctcttagccaagaagtcctaaaagtgaagcccctttcaagctttaatcttcctcaagtgctcccactaactaagcatgccaaacttttcctagcgtgcatttcctgcatcattggcttaacgaccggaccaaaaccagggtcaaaaccaccaaagacattgggtgaccggttttgtataattgagggaccccgtatatctggttttgcggttcgaggacgattttgtatcttacgataagttgagggatctttggtgtactttttccactggatcacacttgtcgcaaaggcccatcccaagtacctaggcacctagcccataagcccataaccgaggagtagaagaggggcgctttcttttcttttcttttttttggtttggcttccctggaagtgagattggggagagagagtatcgccgcccaagctcctggactgatgggtttcgttg

SEQ ID NO: 99721 - DNA, 642 bp, Oryza sativa
agcagtggcatgggctgctgcatcgtcaccttacggagacctgtccgggctttcagagtttccatcactcagagagaagcaacgcagcctttccaagttgctaatgctagtactatcaaggttttcttatcagaagagagtacgacctaccattacaattttacaataggagatctcctctccgatgagataaatgaaaccactgttgcatctacttcggcgtacctatcaacctttatcgcagaccaaccaaactgtacaatagcgcagaaggatcctgagcggtatgcttgtggtgataacaaatgtttggatgcggatgacgaaaatggaggctaccgttgtgcatgcatcaaatatactaatagcaatccctacctcgacggtgactgcgaccaaggtaactctaactgcatgtttacttacaaacatactacctcccactggtggagaaatcgtttgtaattccggttcgtaaccccccttagtcccggttgtccaaccgggactacgaatccgggactaaagatcgatttttagtcccggttggtaacacgaaccgggactaaagatctatgtaccattttttttatttgcatggccctgtttgctgcatgggtgattatatatatatatatatat

SEQ ID NO: 99722 - DNA, 734 bp, Oryza sativa
cccaaaatgatcatcatatatatttatacactaagaccaagaaaatcacattaatcaagacaccatgcacacatcctcccacaatacatgtatcgattaaaacatcatgtcaattacaccgtagcgtgcacacacttctcccatattgtattaattgtattccgatgaaatccatgttaatgcggttatatgatgttcaatttgagaagttttggattccattatatgatgatcaatttggtgagggagtattagctatcagaaactcaaaaaatggattaatatgatttttttaaacaatttccctatatttttttttgcaaaaaaaagacgtttagcaatttgggaaatttgtgcatagaaaacgagaaagtgagttggaaacttaggttgaagtcaacactcaatagcctgatgcagaggcatgttcagattactgccaaaataaaccttattgccaaatttttagcaagttgacagtattgccaaattttagtagaagagaataaatatgttgtgccaaaatttcctatgcattactaatatttgataactaactaaatgcaactatatatttgtttattttattaaataatggtatggtttaaaatgataccaatctaaatagaaccccccttttttttccccttttttttaaaaaggggcccccaccagaacttaaacaggaagggccaagtcttaaacggtactctataaatggcaaactctgttgt

SEQ ID NO: 99723 - DNA, 590 bp, Oryza sativa
agaaaacaccatgaaaaatttctggtcatgttgttgcagctcttcatcaccattgaagccacgttactctagattctgaacctaatgctctcggtagagatggctttcccttataacattcttgcagtcaaatattaaaagttatctcactagtatgtgcaaaaatgttatgattcatcatgaaaatacttttgcgtagctatattcttaatgattttaatgagaaaaaaaatcaatgatcaaacatgagcattgaagattgcatcaatggcattaatgccaagtaaaaagaactggtgagttgtaaggttaataggcaacatgctgctttggaagttttggaactaacaagccattaagtttgtttgctctgtttcattttcttgcctttaagcgccacttataaataaatttctctacaaacatcattttcagagagttgatatggcatcagcgatactgctcagtattgcaatcatggcacaactatcatctatatcagctcagccggctcctggatgccagtcccattgccgtgatattgaaatcccatacccatttggcattggcacagagtgtgctatcgaacc

SEQ ID NO: 99724 - DNA, 575 bp, Oryza sativa
ttggtaataaaacttagcaaataaggttgtgtagggttctaatatacgacagttacacttagcatatatgactatttgagttttagtataagattatttgagttttaatataagattattagatttgtaattagacttagcatataagattgtgtagggttctaatatacgatagttacacttagcacacatgactatttgagttttagtataagattattacgttttaatataagattattatatttgtaattagacttagtatataactattgactagctagggtcctataatatacgtcacctagacttagcatttatcactatttgagttttagtataagattatttaagttttaatataagattattagatttgtaattagacttactatataatttattgactagctagggtcctgtaatatacgtcacctagacttagcatatgattgttagcatataagattgttaaaacataaatgtctcatgacttagcagctgtttcatgtatgaacagatggctgatcgcgatgaggaacagatattgtatgatacaatcgcggagggaagca

SEQ ID NO: 99725 - DNA, 619 bp, Oryza sativa
ttcctgcagcccggatgcggtcgctcgcagtcgaagttggggcgcttcaccaatcaccagtccctctcacagtagcagatcccgcctccgccctcctgcacatgggtgaggcacatgcgtcaaaactcgccaagaaaactaatgcaagaaacaaagaaagaaagactggcgcctctcctcttctttttcatccgtgtcaaaccgtcctcgcccaccatgatcgcctaccgtgctccctatgctcacgcgtgcagcagtgcggcgtcctcctcgagcagcctctcgatggacggagctcgcgagatgtaggaagcaggcgcgctgctgggaggggatctgcgccctgacctgctgccggagaaggaggaggaggaggactcgtcggagctctccctcgccggtgcttcttccacctcgattcacgtcaccggtggctgccccggatgctgcgctgcacgccccctctgggcccgagaggcgccggcggcagcggatccaccgctcccgcgcctggcagcggtggagaacgggatggccccgggggggcccccaaatttttgggggggcccccccgagcggcgaaaggggaggaagccggcgcggtgagcggcgcccggcg

SEQ ID NO: 99726 - DNA, 1404 bp, Oryza sativa
ttaaaaaaataccaacaataccatggcggcatagtatcataatgattaaggactaaaatcataatgaatcccattgtgagctaattgatctaagcatggctaatcattcctaaaccaatcatctaataaattaatatccgaggctatcaatgacatagggtaaacaataggctgagtacggtaaatatccaccccacatgacattataaaataatgcagtttaatagaaaagcggggattttgcaaagtaggttcaacatgatcaatgatattcgtatgacttggcttgctcttgagctgacaggacctcggcgaacttcaaaagagactggagcgtcggaactgccggattctatacgacaaacaaagcacacaagcaatacataataaggctactgaaacagcaaaaggaaccaattttaatggattctagacattttagcaaattcactgcaacttgaatagattaaaacggagctcgaatgatttagatatgaattttacaatatgaactgtgttgtttactcatttatcatatagtaatgcccatagataaattacatcaaagaaaatatatcatcggtaaacaagcctcacgagttaacaactcaatgagtcaatatatcgtgacgcgggaccatccaaatgatcaaccgaaaccggcgaatagaaccggcggcttaacatggctcaaactaaagaatgactcaaaacgactggacgaatgaagcagtggacagcacttcgtgcaaacgaaccattaacaacctaacaaacgactacggctgaaccggtagactagacacgtttacggcaaagactcggtgcggaaaacgattgatcggtaggagtttagagatgcacctatggctttacaacttaactactgagctttaggtcaagacggtggctaggttttagcgagacacagccacggcacagcgggacttaacagcggctcggcttggcagcaaagcagtggcggcggcggcaaagcgccggcagcaaatcggcatcggcgcggctcggcttggcacagcagcagcgacatcggcactgcagcggcgcagcagtttaagcaactaggcacgcacaacacatacggggacgacatgacaagcggtggcggcgctagagcaacagcacggtagtggcgtggtagcagtggcgcgcggaagctggggttagggtagctgcatggcaacaacgcgacgacgcaagccaacacgagtgaaggaaaaacaaaccctaaaaacaggatggaaacctcaccggagagtgacaagtaccggagaggagatgacgacggcaacggtggttccaatggcaagctcgggatcgatgacgacggtgctagatgagattaagcggaatatattagaatatagatggatgggtataggc

SEQ ID NO: 99727 - DNA, 594 bp, Oryza sativa
ggtggtctttctcctcccatattacttgcactagcaggacttgataagatggaagtgaaaatgtgttaataaacatgtttttatgtatgtaaaaacagcaaacaaagagtgaagatgaatgactcacattgatggttgagtgacaattggttcactgctgccctctcctgtttgcctccttttttgactagctgtgagactaattgtagtagtgaatagttgtgcatgtcaacatgctgagttggcaaggttttgctctggaggtaggtcttttgcccgccatctggcaagctgaaatatgacccactctaataactactttcaattcgctatgaatcggcctacaataagaagaaaccaaatttacaattagctaattcgtccaaaagacaattagctcattcaccctaggaacctaagtgcatccataactaatacagagcataaatcagttggtatggatattaccaaaagacaaagcatcatcaattggtatggatattcccaaacaattagctgattcgcctagggacctaagtgcatccagatctaattcacaaacacaaaaattgaagacaattcatgcaggcttct

SEQ ID NO: 99728 - DNA, 536 bp, Oryza sativa
gctttgtttccgcgactttatgcagaagcaaaaggtcaagatgcacatccttcctagactgcagaaataccttcatgcccacttgtcacacccgaatttttccccttttcgtagtaattcactaataaattgtctaaaaaattactttggttaactaggaaaaaaaccctaattaacaacatgtttaataatcgaaaatgtttgggagatttcttttcaaattctctttgctcttaaagcactaacgggatttaaagcgaaatatccagagcatcggaataaatattgataatttaaaatgtcaagatttacattaatgttaatctttctttccagcctttggtcgtgaatcgtgcccgattcactccgctctccgtccgcgatttcattttgcataacgacccgagtccgaatcttattccggttccggttccgttcttttcctaaaacggcactgcatctttttcctttccctttccctatttgttaccctattcttttcagtttccccctccctctccccactgccgtgcgcc

SEQ ID NO: 99729 - DNA, 621 bp, Oryza sativa
cctattagaaggctgatatgtggagcttggtagggataaactgtgacatacctgcatcatatatagtgcaaagccaaaaatattgactcaagaagataatcaatcatactcctagaacaagggtctttatttatggcggaaaatgaaaaagtaaaatattttgtggaatgatggaataaagaaatgattctccctttttcctatactttcgctctaattggttctcttggcatgattatggaaggggcatggctatattttctttgctcaatattttgagagcaagctttatttccatcttctttcttttctttctttttttttctagccatgcctttccttccttttctcattttctttttgccaagaacttttctaggagaagaaagcatagttcaatgtaggagtttatttgaatggatatttttgtggaaagccaacttctagtgtagaagcttagcttaattttatatgtggaaatggaaagtggtaatgataatgaccccttgatcatgagagtatgaaagatatctaacacaagtcacataaatttgacaaagcttaatataatgtcaaacagtcatatgcatgataaggtttgatcattaatgtacttgcaca

SEQ ID NO: 99730 - DNA, 873 bp, Oryza sativa
cggttcggcgctgccacgtcgaggccacgcgtcgaacgcgcccgagggctgtcggctcggtctttctttcagttctggtcggctagagaagttgcacaggggaagggtaagccaagaaggctgccaggtgggtccaggtcggtgtaatctaggtgggggtgtgagggatgggtagataattgggtgtaagtgattttggacaaattttcaggattaattcacttacccttcctttgtaactcgatagtttattttgtggccaggataaattagtgtgaatttttgtgatgatagttgaagatacctagattccattttctttggttgcacttaaaaaattttggatagattactcacagtaattaggagaaaatgggccctttggaaattagtttgaatttttaggagacctaaacagagaagataaattctgataaaattatatttattcatgataaatgacctagtatttgaataaattatttcccctatacactttcatgcagttaaatgcacattttagttaggtatggttttaaccgattaagaactataattagtctattatttgactggtttgactgatttattcgaggtatgaaatttagttattaaattataccaaaattacagtgagttttatatgttaagtagagcctacatgaattttcccacgattttatcttacacgaattattttagataattcgcaagacttatgtcttatatgtgtttccctttcctaaatgcatgtaaatgtttataaaagttatatttggactctcattaacctgaggtgatattgatatgttagaattacagtttaccttacacatgtcataagctccttacctatttatgcataagtttact

SEQ ID NO: 99731 - DNA, 764 bp, Oryza sativa
ctgcagccctgtttgaagttgtcataatttgaaattcaaattcaaattgttgaaatgaagtcatatagcaaaatgaccaaaacaaaagttgtagatcttgataagtcatacaactttgttgttgacatttttttttcatttcaaattatttactaccagaaaaattatttgatttttcttatatttaaaattcaaattttatataggtcaatcaaagtcagatggagaaataaccaaaataaaattgatagatctaattaagttatacaactttgtttttgataactttttcacataagtttatttagtatgataaaatttgactcggattttttatattttgaaattaattgagaagagggagctaaaatggacttctcggcgaggggggagcaaatgggctaggctggcagcccgaagaagaaggaggggaatgggaagccggcccaggagggagagaaaggctgcgggctgagggagggagagagtaacacttgggccaaaaaaggcccaaggacagagagatattttaatttattttccatttattttaataggttaaatgaattttgtggtattaaaactagttattgagctccgaaaattcacggaaaattttagagaataatttagaccgcttagaattttacaaaaatatttccggccatgatttttaaaggaaaaatttagtttcctgattaattcacttgattaaattgctttaacttttaatatatttcttgtagtgaaaagtataatgagtg

SEQ ID NO: 99732 - DNA, 1457 bp, Oryza sativa
tgatataatttatttgttcactttcatgttcatgacatgtctttagatggatgttgaaattagttttgtgaggcttgacattagccatgttgatatattttaaggtgtatggtttctattttaacttcctctagctagcactaggccctaatggtttacttgtttatctagatcttagttaagattcatgagacctattatgaaatgcaaatcaaagattcaaatgcacatgaaggactcaagtcaaaacatgttttatgcaagtatgcatgcttttactcgtgtttgcatttatgtcctaggttataaatgaaaaagttttaatttgttcccaaattttacttaggttcaagttagattgaccacacctaggttaaaaatggaaatttttagctctcaaaaatggaaaagttagcttccaactattttgataggaaatttttaaggtctagaatttgggtacgttacaatattatattgaattcagagtaataaatagaataaaagaaataggagaagattaccgacaactccgaaattcttccgactacttcttctctactctcttcctattctagtatacaatatagtacaatagagcctcttataattcagctcaatcttggaagtctgtgtgagagtgaatgaagcgaggtccttttatagggcagttatgacggttgtgagaagggaaaatgtccgaactgccccgcaaccatcattgggagaacttctggagcgtccacgccaaacccaggatcaacggtgatcagggggggttcggccgaaccagagggttcgaccgaacctgggctgggccctcctggcttggccttcggtcggtggagtccatggaccttcctctatccatttctcggaattttgggttgatttactgatgtttcgatgaagttcacaacccctccttgtatggatacataattctcctcactttagtctgattttcctcccaacttcagggttttcatctgcataaaaatatacaccaacacttgtggaatattgtggaatatgtgagattaagcacctattactatgttggatgttttattatctagactttatgtagatgttggcagtatgggattggcattgaacaaccgccaacaaaacccccccacacttagccctttgctcgtcactgagtaaaggttagtgtaaaatgaatttcttcaagatatgtatcaagcatataaattattttacaaccatacctgcacctgtgaactttatcagtggctaacttaccatcttgagtaattgagaaatagaacgatcttgattccagtccttgcttccctgttacactcatgggatttttataaattttcgcaaatcagctcttctcctcctattgacttcctctcttgtccctcaaggatgtatattttctttttggatccttaccaaggcaaaatgtgccatgggctgcagga

SEQ ID NO: 99733 - DNA, 746 bp, Oryza sativa
agtaacattaaatctccagtcataaacggctacaccacgttgaacaggcccaaccaacccacgtgaactacagtgcattgagtcgatttattaaggtgggactaatcacggtgaatctggtcgaccgcccgtaactgcgggcacggctattcgaatagttttactctggccagaggtgtacaactgtacccacaagactcagccccacgacacgtttccgtgcgccgacatgccaccacgacatactggaaagaggccgtgacaggacccttcgcataaccccctctaaccgatcgcaccacaccttagggttcgcccccgcccccagcagacaatgggcagccctcctctcgtgccgcgatgaatccagaagccgatcaaccggacaccccggccgacccaactccatcatgcccaccctcgcctgggtacgtcggctagaggaaagctacactacaagcccagccgttaccacgctggcttgtggtaagtacgataagttcttctagggcatcccacgaaccggtctttaattgccatgggtgcgactagcataaccatgcacccacagcccaccattcagtcgcattctagttggataattacgacaatgaagcatggccagatgtctcgagcacgcagctcattctgatactaaaaaggtctaatattgtaattatcccatcaactgagctagtggtaattaagcatggctaagcatatagttctagctaggggctgcagga

SEQ ID NO: 99734 - DNA, 664 bp, Oryza sativa
ctgcagcccatttttggccaatggatgcactgccatggctacaggctttagtaacaaattaactgcttgaccttttattagccgacctagccttagcaatcttactatctccgtttttaatagataataccgttaattttttttcacaggtttaaccattcgtcttagtaaaaagatttatgtaattataatttattttgttgtgaattgttttataacttaaagtaatttaagaatgatttatatcttatacatttacataaaatttttgaattgtatgataaacatctgttcaaaaatcaatggcttcatccattacaaaatagagggagtatatcataaagtagagaggagggcgcgcaagcgcaaccaagtcgcgacgtgtatgaagtatgaactagatagcagcctaccacgccaccgcacggttaaaacccatttttttcttgctgccgctgctgcttcagcttccatcataatctttgacccgtcgcttccctttttccctttccttgcgacctttgcccacattcttcacgtttttacctccccgcccgctacaaaacgcctctcctcaccacgccacgccacgacacaacgatctccctctcggcctcctgtggcgccccgtcggtatgaactccgagcagccgccgagcatggc

SEQ ID NO: 99735 - DNA, 1029 bp, Oryza sativa
tgtttaatcatccatatgcaatttggttgcaatctatcttgttcttgcttgtgttcttcgattcgcatgcagggattagccttctcggcgaggtcaaccaggtttcggcatggttgataactagaggagacgtggtgctgcgattgcgtggctcagtagcgtgtttgttcagaagccggatccagttgtgtcgcgactccgctcaaatcgactgtttatcaatatctatctgaagatcgggacctaacaccctgatcaaacatatcaacaagcagttgtaaaaactaattgagtgagtgctctataactaatataaatgctttgtaacttaatgtaactgaaagatggatgtagaggaacacaaatcttgatgtaagatcctacagatgaaacattgaaagacagatggagtgcgaaaatctatcacagatgaaatagcaaaacctaatacttaattaatcgtgtgctaatccatcgctctattttacgtgcgtgaagaaggttcccatcttacactaacgaacaaagctgcagcaatgttaacatagcgagagtgtcgaagcaagataatgtaagcttttcttttcgtcaagagcattcttacacaacttttagttacctatattatatagctaagttcaccattgcctagcacagaaagttaatgggatactaacaatgaaagaatagttctcatcactgttaacattgctaatcctgctatagtatggccatgtacattattgctaatcctgctatagtatggccatgtacattatggtcgattgacataccaattcattatcaaaacaataaaacaagttgaagaatgtaatgtaaccacaaattaggctacattgcctagcaattcatcgtcaaattaaacgatgacatgggcatgcctagcaatgttccttcgaattgatccagactttctaaaaaccttgggataagaaaatcgtgatggatccaaaaacctgagatggttgagttgaagcgtagccttgtgaactttataattatggctta

SEQ ID NO: 99736 - DNA, 536 bp, Oryza sativa
ctgtagatgacgagactgaaatggacggtcttctcaagagggccatgccatgggttggtgaggagatttgcaagaaagatctgaatattcagaacagtgtagtgcctggtctaaatctagctcagtggatgaacatgcagcacagctcctcgcttcctggcacggttgtgcaaccagagttactaaactcattaagtggaaaacctgtacaaaatttggctgcagctgatttatcaaggcaaatcagttttcacccgcagttcttgcaacaaaacaacatccagttcaacactgcgttggtacctcaacaaaaccaacagacagaacaattagcgaaagttatccctacaccaaaccaattgggaagtgttataataccgcagaaggtggttcaggattgcaactctgaacaaaggcagcatgtggttactcaaccagtgcaaggcagccagccaaacataaacattccacagcctcagcttgttgttcaggctcagcttcagcaaccgcaagtcattctccaggcgcaactgcag

SEQ ID NO: 99737 - DNA, 595 bp, Oryza sativa
ctgtttgtgaattgctgagttgaacatccactttgtatgattttggtgccattacaaatgttccttttggaaaagttgggcaaaggtgtcccaagtggttggtgaattggagaagaaagatgcaagaaaatgcttgctagtggaagcatgatctctctagaaagtttgatgctcgtagcagcctagcagaaaggaaagggtactgaatactccatttgctgctatgtttttgtgttgttcaagaaactgaagggagtgtggtgatgtcagatttcactttgtttcagtagcaaggaaacaaaatgtttggctattgtttcttcaattattagcttcattcagaagagtggcatgtgtccaaaacatgcaaatagaatccatctaaaataactgtgaacatgcaaacaactgaataattgacatatcatggcagttttaagtttgatgtaatagcaatttgtctgctttccatgcagacaactttattcaagattttgtgccaactggtccatgcattagagtgactccattgaaagaatagtacaccctccgttttttttatatagacggcgcgttcacttttaaacatatgttt

SEQ ID NO: 99738 - DNA, 761 bp, Oryza sativa
tacttgtatactcgagtactcactcggttttttaatatacaacacagttgacttttaaatatatgtttgaacattcatctaattctaaaattttatgtaaatgtataagatataaatcatgcttaaagtaaattgagtgataaaacagaggtattatttggtagtactgatttgatatagggtcttatcgtttgcactatggtttataagccgttgttgaaatttaaattttaaaatttgtgtttgaagttgatcttgatgttcttttaatatagtttttttgcatttgtttttaagtcgctaagcactcatatatatttaagttatatataaattatgttacaactaattatagtacaattacatttgaaagttttttaataatcatgtgacggttttttggagactaccaaataaataagcataagtagttgtctgtatctctcagcaccaacacctgtgatcaagcaagtcaaaccatgatacttaaactcaatttactttaagacaatgacatgtgttgaatccagcagtacctaaatccaaatctgatccatccagaaaaattgacattgtctaatctaaaaaactgatcagtactacagtaccccccccccccccccccccccccccccgccaccaaattgagcagctgaaacaggatgctcacatcatggttcttggaccgtgtccatgcacatctcacactacagcaaaaggcttctttcaccttgatttcctctgtattctgtcatctcgct

SEQ ID NO: 99739 - DNA, 629 bp, Oryza sativa
ctgataatacgtgggaaagaggcaaaaccttgacttaatgggttgtataggccaattcattctacattagtacattacagttaacaatgtgttacttagctcatcttggcacttcactgatttggtaccttccctatgcctgtatatagtattgtattttctgcataccctcttatactattgttttatgtgtttcgggatatctattataaataaaatgaatgatcactgggataaaaaaatttctattggtgccctaagtattttagctcttttgctttatatttgttactgcgtggaactctgcttatttgctgtattccaaaccttgttctgctccgtcaaattctttatacatatctattttttatttctagtttcagtaatattagttctctaacacatcgcatgttcataggtcttgttgtcactagtggagcaaaaggtgatggtaagcttctactgtggaatgctttgagaggagaactcgcttctgatctaaattcaaacttgaggtaaactggaactttccttattccgtcatttatttgacttttgtttagtgtatgctcttcttatcccagcctactccttttgtctagcgttgtgtcactccaatattcatgcag

SEQ ID NO: 99740 - DNA, 659 bp, Oryza sativa
cagttcagatgcggcagcgacatcggagatttgcaaggcggcagatgtgatggtcaaggaggtggcggcgcgcgcggatctgatacaggaggggtcggcggaggaggaggcttaccgacctcctgttctgattccggtggcaacagctagggactttggcggcagtatgcgtggattgactcaaaggtatcttcaccttgttttccctacaaccaatctgttccccttatgcaatgagagatgctttcaatgacgtgtgtagatcagatgcactgggtgcggttgcatcccaaaatttttttgattgtactgcatagaatatcctaggttaatgttattcggtgttttgtatctttataatcatccagctgttatatgtcggtcagtgttaccaatgttgaagtaatgcgggttagctgggttttacattttgttttgtgcaaaatttggcatggagtgagaagggggttatgatgacatgtttcaaataaaataaattagtgttaacaaaaatccaagcagttttaaacctaaccaaagcattcctttctgttttgttgcccataggtatattctgaaattagaaatttttattgagtataggaaacaattataaactgtaagaaatttgatactgaacatgcgaattttatttctca

SEQ ID NO: 99741 - DNA, 588 bp, Oryza sativa
caagatgtatctactcatccccattcctttctatgttcagatgcctccggtttcttattagctttgacattcttgtctagttcacctagtctagatatccaattgaactctgtttacatttcatcggacacagttacatagaaaaacacatacatacagtatagaggtttgcttaccttcgactggaagatgcaccccttcccttatgttcaaatggatcttcccttcgaggggattatgatggcaaggcaaactgtttgatggagaaaccacctacctctctcgtttattttacttctttatgttggatcatgtatgtccacttttggtcatagccactagtagtatgatatttgagggacatttaacttttttttcacttttaagatgtggcaattaattatctgccactcgctgtgtataacatgtgagccctcatgtgtatatgacatgtggatccagtggcaaatcatttatcacccctcgtaagagtgacaaataattaattattccgatatttgagcgcgtaacgtgggcgatgcctactcatttggggaaaatatgtagtacaaaccacatatgtagtgg

SEQ ID NO: 99742 - DNA, 583 bp, Oryza sativa
actttagtcccggttggtagcaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttacaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatctgggctgcaggaatt

SEQ ID NO: 99743 - DNA, 718 bp, Oryza sativa
cttgtatgtaagtttcacgtaattttgaatcgttagatctattacaagatttgttctatggaggaagaaaaaaatcacatcacacacatatatgaaagaatttgttcccacgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgtaaaatcaaaggggggccagccggcttttgacagttcaaaagattggcaatttctcctttttttttcatgcattggcaatacataaaagcgaatagtttgcaaaagtggacaatatacttacatgttcatttaaacttcacggcacgagtcttcactgtattgaaatcgctgctatgggccagccggattgaattgggccatacggtggcctgttggacctgggtaccatatataggggtaattaaaaaaaaatttattgggaggcgccatggcccctgccaccccccttagttccgccactagctcacgctatcatccagatccagcagtgcccacccaacgcccgactccatggcgtctccttcgtcgtcggcggagagacgttccctgcgcaccgtgccgtgctcgccgctcgctcaccggtgt

SEQ ID NO: 99744 - DNA, 561 bp, Oryza sativa
ccccgccgccgctgggggcatcgatctcagcgcccccgcccccgcccccgccggcggcgactggcgctcccagctccagtctgagggacgcaccaggatcgtcaacaagatgtatctactcatcccccttcccttctatgttcagatgcctccggtttcttattagctttgacattcttgtctagttcacctagtctagatatccaattgaactctgtttacatttcatcggacacagttacatagaaaaacacatacatacagtatagaggtttgcttaccttcgactggaagatgcaccccttcccttatgttcaaatggatcttcccttcgaggggattatgatggcaaggcaaactgtttgatggagaaaccacctacctctctcgtttattttacttctttatgttggatcatgtatgtccacttttggtcatagccactagtagtatgatatttgagggacatttaacttttttttcacttttaagatgtggcaattaattatctgccactcgctgtgtataacatgtgagccctcatgtgtatatgacatgtgg

SEQ ID NO: 99745 - DNA, 623 bp, Oryza sativa
ctcttgctgcgacgacgacgacgacgaggagacgcatggatggatggcaagtcaatgctcccgcgtaagtgtagatacaagtggactgcacggttggttggtacaacaagtgccttgagttgaatggtctcctcctctcctctccattgaccacctctaccttgcatagtcaaactgtgcattgacccccatttcatttatgtagtttggtttcttgctcactgtcaaattcaagggatttaactttatgcattgtttgaatttggttcctagggcttgtttggatttaggctaatttatgtcttaccaaatttttggtagtttcaaccgtactttatggatgtttggtttgatatcaaatgttcgccatactagtataaattgtattgtactctctccgtttcaggttataaaatattttgactttagtcaaagtcaaactgttttaagtttgactaagtttatagataaatatattaatatttataatactaaattagtttcatcaaattaataattgaatatattttcataataaatttgtcttgggctgaaaatgttaccacttttttctacaacttgattaaacttaaaacaacttgactttgacaaagtcaaaatgt

SEQ ID NO: 99746 - DNA, 550 bp, Oryza sativa
catttaacttaataccccgtctcaaaaaccaagcatttcaagttatgaatttagccaataatgcgtgtaaattcatagctaaaagttgctatatttcacaaggtatggtatatcatataatctacgataatacattagtcaataatctattttaacctaggccatagtctagtatttggaattctgtatgcagatgaaccattaatcatctgaactgcactctttctctacgagcgattcagtcagtctgtcggtgatcgctcctgtctcactccatgaatgtagctgaactctagtgtcagtcctgcatttgtcaaagctcatctgccagattaacgtggatgaaagttctgaatatattggccgatgtacaagactcgtgcatgatcctggcaacatgtccacttttgctaatgttgatgccatatgcaaagattaaaagtagaattctctttcacttttttcactcggtgtagtgtgtagtgacgcctgatgagaggagcaataggtcaccagtcacgtgaaaaacccacgggctaggctcacacat

SEQ ID NO: 99747 - DNA, 525 bp, Oryza sativa
cctcctcggcctcgccgcgcgcgagccctcgtcgccggattccccagctcgagcgcgcgctgggttcgagattccgagcacgcgcgcggtgctccggtgagttctcgcacccgcatttcctccccccctctctctgtgatgctttgctgctcgtcgccgacgcggggggtttgatttgatcgcgcgcttttgggtgggggtttattggttcgcgaatccgcggcggggcgcgggtggttgctggtcgtcctcgccggaatggttcgattattggtggagttctctctcggtttctaccgattatttcggtttctagtccctagaatctcctcgcgttgttcttcccttgcttaattaatggcccaaatgctgctcgccccttgctctcctatggtggagttctctcggaatttttttcccgatttctttcggttttttcttggtttggttgctcctcgcgctgttattggttgctcctcgcggtctccttttatggtgaactcatgcggcgtgctttgaggatta

SEQ ID NO: 99748 - DNA, 555 bp, Oryza sativa
agaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattc

SEQ ID NO: 99749 - DNA, 587 bp, Oryza sativa
aaaacaacctgatattcaatgtttgagtctttatataaaaacaaaaagaattgtgggttttatgatgaactcatgaactcatctgagttcacggagcagatagccggaagaggcgccggggagggtcagagatttaggggcgtttggttcactccctcactttgccaaactttgccacactttttaggatatttgtgtatgccaaagtttttcgattcaaaggcccacatgtcatacactcatcttttagccaaaccttgtctaaggtgtggccatcaatttataagccacacatttggctagttttggcatggaggtttggcaatgttcggaagtgaaccaaacaaggtccacaggaaccgtgttggatcgagaatgtacggtccagatgcaagaggggtaaaaaaagccgctgatgctggttcacgggagccattggatcgcaggaatcgtccgatcgagaatgtgcggtcaaaaatcatgcggataaagtgcggcgatgcctccgaaccccttgagtccatgaaatcccttggattgtgatgatgcggtgagcaatcaggcacacagtgtccgtatatttcttg

SEQ ID NO: 99750 - DNA, 617 bp, Oryza sativa
atctgtaaactcaccatgggcttactaagcctgtttgaaattggtataagtctactttgagtccctcagaagtggacttattcttttggaatttgatctaggatttccaaagttcattaataatacttattcattttatttttttactcacaaaaaaagaaaagttaccccctctgattataaatatttgaagcttagaagaagatttatcaatcgtttaaaattctgccaatctgtatatgtgtataagtttatgatattatgacagtacttttcaaggtaaatctattgttgccacttttttgtgcttttaaattagtcatttaaagaaatttcgatggtctgaattttgaaattttgatcacaatctcattccaggagttaaatatttatgaccggaacgagctttttttttaagaaaaaacaaaacaagttattcagttcagtatagctcagccaagagtgtgcatcgagctgaacaggtgacaacctttgacaacgaaaaagaaaaggaagaacatcatggacaatgcatgcatggcgatcaagatcatcgaacagttcgtgcatatgcacgcgtagctagtcgccttcttccccttgcctttttctgcatt

SEQ ID NO: 99751 - DNA, 641 bp, Oryza sativa
ttttagttttaatcaacaaagcatctgatcatatatttacaaatatcggatgtaagtttattatatttgaaaatgtaggagtatacgcataagatgtaactggaatatgaaatcagaaaagagatgtacaaaaaaatatgaaaaatataggatgagttgaacaacacacataccgagcaaggttatctgcttttatgacaattgtcaggcttctcctcaagtgatgaaacaaatgttcttgtatctattaataaaggataggtgaaagaagtataagctgcaagcaccatttttttaaagaaactaaaacagtactcaatgcataggtctccaacatgtgcaaaaaccacaatgtatgctcgaatataatataacctggcaaaattcatgtgaaattcacacatactgaactgaatcaccaaaccaaccaaaagctttcattttatcacactttttgcgacaaaaatgcatcataacatgaactatggatttgcatagtttgaaaaacagtataagctgcaggttctatttttttaagaaactaaaacagtacccagtgcataggtctcctgcatgtgcaaaatccacaatgtatgctcaaatattgttctgagaaaaatcatggtgaaattacacatact

SEQ ID NO: 99752 - DNA, 526 bp, Oryza sativa
catttgctcttcatcttatgagccacaaccaatatttgaagtttaaaacttaattttagatttgtttggttcttttatcgtagttcattttccagcattaatttttaaatcgctaagatcacatacactaagttttacataattttcctttgttgttgtaataagcattactgcttacaatcttcttccgaagaatggattttggaagatactgtaccaattccatcaacgggaacataattttaaactgaacatagaaaatactcaaaacatggggtcaaatacacctaatttaagaacggtaaatatatcatatgatatttgtttctcactgacctagtggtcccacaacacagtgacagaggaaaccctcagctcacagctccaggcgatttttcgtcgccgccggcgccggcgccgccgcgagccccgtcgactccctcgccggcggcggctggacgggaccgaatctcaggtcaaccctctctccccgccattagaatcttcgcgatactcccccaatcgg

SEQ ID NO: 99753 - DNA, 596 bp, Oryza sativa
cttataacatgtttgcagagccaaagcttcctttcggaatttcttcatttgtattttacctgtgttgaagttttaggtcatttatgacaacaaatcgatagagctaattgtgagagactcttttcttgacacaattgttgtttatgtaggcggtttcttactatgatttgggctcagatgaagagtccaatcaataatccatagatattggctcttctcaacaataatgtggtaaatgcggtcaaggtcttgaggtcgttactactaaacattgctggataattgaatgagagtttctgtatttatgtattatttgctagtctgttgaatgttctaatttcctcggttacaaagtttttccattcatagggttcaacatgtcttcgttatttgaagcacccacctttacatgtctcacctgtactagccacgtagtcgcactttgcacgactttcaatcccgtttaaaaacttatgtataaacttatcttttaagaaggtggttttaataagttttttatttataaaatattgatggcccaacctactacagatttagctaagttatactacatatttataaaatgaatcattgga

SEQ ID NO: 99754 - DNA, 658 bp, Oryza sativa
aaatgtcactactccgacttttcctaacttttactgagaaagtgtcagtcttggcttctgaactaacttctggctcactgaacacatcatcaagaacagcactgacatttttccctacatcacttcctgattctatccatgcattctctttccttagtgaaagccctatatcttctggaacatgggcatgtgtttttgtcaaatccatttcctcaactttgacatcaggtaacatgctttgaggaaggaaatcaacagtctccccttggaccttatccttctgagtctgcaaagggcgacatacaccatccttgctatgaaagatctgttcaactttagtagaatctgcagaatcaagcatataattttttttggcctcatcagtatcttcatgaaatcagcgaccatcattctctacatgggctgaaatacagtctttatcctctatatttgattatttgaaacttcttttcttcaaggatttctgtgtactttaagttaaccaacaaatttgagcaaaattcattatatgaagaccaggagaactcaaaaaacctagagctatcttccagtggcaagaataactactgcactgtaacatacagctatgacatgctataaatgcagaaacattctgcaagttctaaatatttctgta

SEQ ID NO: 99755 - DNA, 580 bp, Oryza sativa
atgctgatgaatggaacgtacgtacacatgggcagatcaatcatcaatcttcaagtcatcaaggagccctattacatgtctgagaaccgtggcaaaatcactgtaccagcctgctatcacctaccagttttaaaatataagcatttttaggatttaaaatttatgtaacgatataagcgattccaggacactgattcctatgtataaaaatccaaacattttcaactcgtcagaagcttaaaaaggaaatctaagcaattcaaaattcaaccaataatacgattgaaagagaaatttcccatcaatcttaatcattgctaaataatctagaaatggtttattttaaaacggagggagtattaatttgggaggttctgttcttggatctatggtccatggaggcatggagcagtactgcaagcaccagcagtgtatagtactgtgacttgttaaaagcccttgatctgtctgcagcctgcacaacccatccgatcttctcgacttgaatactatgggtgtgtttagttggggaacaggaaatttttgggtgtcacatcgaacgtttgaccggatgtcggaa

SEQ ID NO: 99756 - DNA, 599 bp, Oryza sativa
caatgcagaaatgcaagtcgtagtttatgcaaaccaggatactgctcttttccaccttgttctcgcacaggtaatggtcacacctcggggcgcaatcgtaggagtaggacctgagctccgagatgaacttgagcacgccgtcctggaaagggtcgaagtgggggcataccctcccctcggtgttgctggtcgacgccgccgccgccttctgttccgggctgctcacctcatccggcggcgcagtgtcgccgcatccagattcgggcgccaccgcatactgcgggctcatcccctttcctgtctccatcgcgctcttctcctcttccatcacgcctggggcgcaagacctgaaacatgcgaatccataaatccccaaagaatcaaacaagatatacgaagaagaatacgaactgctactactgctgctgctgctgctgctaccagggatgaaccatccaaggagccttaagaagacagcggactatggcggtgaaattgaccgaaaggcgagggttccatgaattgtacggactatggcggtgaaccatgaaagctaaacgaagcggaaaaccaagagatctctactaataggacaaggc

SEQ ID NO: 99757 - DNA, 594 bp, Oryza sativa
gaaaccagtactcatcattctctacatggtttcagaatatgtatccgctacatttgataattaggagcttcttttcttcaaggacctcagcatgtacttaagttaaccaacaatatggagaaaattttattagatgaggacaaggaggactcaacactctgagatatcttccagtggcaatagtaactgctacagagctttgccaagttaaatctgctgaactatcatgtttgtttaatacgtttgtgtagatatcctgaaggttttgttgtttctgcaattaatatatgaatcaaatccttagacattttctctatttagctagtacaagaccctgctctgatagttaccattttccaatgctgagcaaaacaataacagataatagtgctgctatcacagtttgattcattcacgaaaagttccattttctgatacaccatgcaagtttggagccctgcttaaatcactttcatttcctttagttaggcacacaagcacataaacttaccaacttccaaaggatctgatgttttcaccatgactgtatcttccaattctgaagcaggaatctgagaatcaccgccttcagaa

SEQ ID NO: 99758 - DNA, 634 bp, Oryza sativa
ggaaaggggcggagggcgatagccatcgggcggggaggccaatgagcttgcgtggagagggaggaggcggggaggccctcagcccgtcgatctccctatcctggtggccttgactccccacgtcttcgcccacgacgccgccggtagtctccatcctcacagcgacgctgccggtttcagtcatactacttttgccacaccctcggtgagcacccatgcacaaagcctctttgaaattgctaattagcgcgtatgcgccatcagactaactcgcgcgcgtttttagcccatactcatacgcgacccacacactcgcgcttaccccatcgcttcctttttttacgcttcttctggcgattgttattttgggtaaatctttccttttttttctccacatgcgtgattctttttaggatattttataaattaaatctttacctcccatttcacttgagaatagattcgtctcgtgaattagtccaagattatggatgagttttattaatagtctacgtttaatatttataattaatttccaaacatccgatgtgataggaaattaaaagttttagtcccatctaaacagggtctactccctccgtcccaaaaaaagataaacccgggtaccgagctc

SEQ ID NO: 99759 - DNA, 508 bp, Oryza sativa
atatacgacagtgagtttgtgatagcgttcgctggattggtgccgttatattatgtccacccaatgcaagtaacattggaagctcaattcttaagacaacatatatccatcattaagtgaatgcgagacatccctgctaattttcaggaaaaagagaaaatgattgtaagcattcttatcaacactgcacactttatattttgagtttctccaataacattaaaacgataggagagacaggaaaatggatgaactgcaaacagaggaatgtttgtgtccaatttatataaaaaaaatactaggagaggtttttttttaattcagtcatgctaatgttgtcatgttaatgcttaatcgttgctttttatttaatattttttttcgtcaggccctgatgagcaaagacttttggaagcatccatggcttatgtggctggcaaccccattatgacagatgctgaatttgatgaactaaagctgagattaagggttggtctttcttgtccct

SEQ ID NO: 99760 - DNA, 535 bp, Oryza sativa
gagcggcggacaacctcgtcgccggctgaacgcttgcaatctccgccgccaagcagagatgccgatcgttgccccacccccgactctgctagcatggcggcgaggaagagggggcatggatggcgagcagagaggcggaaggggggggggggcttcactagttgggggaaggcggcagcggcgccgagccgtagaccttgaggaggacgtggtggtggtggcggtgacgatggggaggcggcggctcgccggctccggtgggggaggcggcggcggcgggggaatggcttgtactggagatctaaccgttggtgatagatccaatggccaggattccttccctcctgcatttttcaaaaaggaacccttattaccgctaccattgctaacggtccatattttttttacaaatacccctgcattttgttttcaaaaaggccctctttcgcaccttatagaaggcagatatttctcatatttctgttgtttttcgctgaagcttattcatttctacttatgttgtgcctggacgaaa

SEQ ID NO: 99761 - DNA, 506 bp, Oryza sativa
atgggtaccagaaagaagaatctcggccggggagcacaatgcgacgattgtgttccacttctactcgcatgcagggtgcaagtacatctctgtcttcctgctgctggatgagaatgagatcgaccccaaaatcagcattatctttgaggttttcttgatggacaaagacgggaaaccttcctcgcaccatgcaaagaggaccatggggccaaacatggagacagcatcgggtctccggttcactgggtggcgtcacttcgtcaagcagagtgatctacagccggatcatgtcagcgacaaaggcacggtcacattcgtgtgtgggttcatggttgtgcgcaacgacgtccacggcaatcctatccccgtgccgccccccaatctgggtgcccaactcggagctatggggggcagcgccgacggctcggacgcgtcgttcgccgttggcggcgagacgttccacgcgcaccgggccgtgctcgccgcgcgctcgccggtgttcaggg

SEQ ID NO: 99762 - DNA, 578 bp, Oryza sativa
taaacttatttttcatctgcacatacaaaactaacaataatatctttctggaggcgtggatctttttttttaccgaagataaacccatggatggggttagctgatttgagtgaacatgatcttggagcaacttcatatagattctggatttattggttgggagcttagtttcactaacacgcaaagatctgtacatccctgcttggtagtttcacatgccataaaatgttttctaactccagctgaatatttactttaccttgtaaaacatgtagagagactctaaaagcaactctgtggtacgtaaaaccaatcaagcatattttctgcagtgatctcaccacttacctgaatgggaaatataacgaggctccatttttttcaactgatcatacttattcacctatcaaagtatagctatttctaattgtatcacggtgataaactaaaaaccgatggctttgcatgtgcagggactttgtgaaatgtgtacgatgtatcaagattctttctcacacgaagaaatgcacatgagattagtcggcgactttgagacagctttctaccaaccaagcttg

SEQ ID NO: 99763 - DNA, 612 bp, Oryza sativa
  unsure (1)..(612): unsure at all n locations
cgatgcgtcctactactagtagttaatttctccaagctattttcaattcaaagaaatagtttcagcctctgaataatggaagcaagcggatcaacctgatcaagacgattaattgcatcataatcaacagagagttatttaagagctagctatttttaggccttatccgtaggctgccttcacatatatctctacacatcgagataacaatttttacagacaactaaaatacattaatatttgtgtagagatggtagaaccaatcgtctcttaaaataacacatgaaaattatacgtctccagtttttttttcacgtgaaagtaaccagatatatagcttgtttatttctagctatttaagttcatattaaatcattactctagtttactaatatattgacgtacaattcttttgcacgttcgggaaaagaatcttactctagtttagtttacttagtaattaaataattagataattaatatgtcgagacttctggtaatttttattctagtttcttcactgaccagcgccatatgaaaaacaatttccaactacgatcggcttaatgccatctcgagcgaaaaccatctncacatgtgggcccttatgcc

SEQ ID NO: 99764 - DNA, 597 bp, Oryza sativa
gtcagctgggtgaagcactacctcgccgacgtgccgcaggaggtcgtgcaggcgcacttcaacaagaggctggtaaaatcgcacatggccttcaaactaatttttgacaaactctttgatgcaaagattgcaatctgttttcttcctagttagtgagacatattagaggaaaagattcatgttgttctcttgcttgaaatgctcttcgggagtgtggactctactactctagtggcgaaatgttgcttggttagtgctcatgtttaagtttttctgtgtttctgcccttgcaagaaaatagtatcatgatcttaatatgtcttatttatgtatgattagtcacttttatttttctttaagttcacaattttccctcttgcaatcttttctctcagtttgatgtcatatgcagttggcactatatttagggattccttttttgtgtatgaagtgaaactatttgttccccgtttaccaggtttattccgagtgctcagatcatgaggtttcagttgagactattaagagccagaagcatcatctcaagaaggtatacaatagagatttcgttcctaaaatctgtttgtattctattgg

SEQ ID NO: 99765 - DNA, 714 bp, Oryza sativa
ttggcggggagagctttggggggaggggctacccgtggggggcaccggccgccctgagaagatactgctctatttcgaccgcggctccggcccatagctggcccgggggctacaacatttcaagtgcgagcacctgggcgttcgatcagaatcagtttggagcaactcggtggttcaggagatgtcgtcactcgccggcaggcacgcaccggtgggcgtatctccatgctgcacgcggtttaatggcatcatgaaccgcgctttgcagggccgtatttaagcggcgctggcatggctgatattctcacagcgaaatgctgaattaaatcttggcagacaccagaagcatcctgttgatattgtagttgtcatctcaaattcattgccttttccatacaagcattcttttgacttttttctttaaggatcctaatttaacctggaaacatcctagacacctatatctactattaactggctcggacaactagagcaccattcgaacaatagtctgttattcgacttttactctagagctgacattcattttaatctgaacaccttgttgcatatgggtatgacactcacccatgtgtatcctgatttcttgttactaataaaggatttcgcccatttctatcctatacttttaaataatgagatttctttatatcgtaatttgacctcttatgtttatgaaatagtaccccttac

SEQ ID NO: 99766 - DNA, 686 bp, Oryza sativa
tacagtacctcatcagagcagtaatcttcgatccgaagaagaggcctggaaatgagtgtgatattctttctgcgtatgttgagggttacctttgggacatcattacagtgtctccataattattggattgatttattcataaatcatagtgctattccattaattcaggcaccgaatgaattgttgcttttcaatcttctttctggaagagctactcaacttagaggccacaataccaaggtatgctgaatgagtaatttgtatatttactaaatattttctgggatactaaatccataaatacctttcctcctttttgcatttttgcttaaaaaatatatagcagatgatcgagtacatacgtactgctgcatatgcgtagctagctaggctgccttgcctccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgattgttaaaatgattaaacat

SEQ ID NO: 99767 - DNA, 612 bp, Oryza sativa
taagtgcctccaaatgaatttgttgaaatatattggtttggctttttctgattttagtacttttgttattataagggttataatcatataaagcttttagatactgaataaatatcccagcctttgcactggcaaatgcatataatcgtatagataatccttacatctttcagtggtatgttgaaattcattgaagggccttcattcgttaaatgttttatccttgcactattatgcagttttgattaatcgtatttgtttatatctgagagtattgtttgattgcttttgttttctgtaaccttcagttctgaggacaaagacaattccagctatcaccttgtaggtgtcattgaacacattggccccagcaccagatcagggcacatggttgcttacgtgagaccgaatcaagagcaacctcacggtggcccttctccatggtattgtgcaagtgatacaaacatcagacaagtatctctagaagaagttctcaagtgcgaggcctcccttttcttctacgagaggattggaggctaacgtccaaggaagtaaattggttagattagcaaacattctttggatggacaaagatccattcagtagacgtca

SEQ ID NO: 99768 - DNA, 654 bp, Oryza sativa
ataaaattctaaagagggtaactaatcatgaagaatttaataaaattaaatttacccatgttatttaatttctcacatttgcttaacttgtaaatttattttaattatacacatacctacttaaaaataccaaatatgtcaataaatttgtatttaattaattgcatatttttctgatatgtacgcttccaaattcaatatttttgtgcacatgtgttataagtacaaagcaatcttaagcatccatgtttgtttgatattcacccggtgcaacacacgggcatatttgctagttataacaaaaataacaaaattaattgttacaatttatagaagttgaattttaacttgcatgtttatgaagtggtatattacatattgatctatcttattaattattttaattttttttcataaccatttagatgacatgcaataaacgggtggacatccacctaggtgattaaaacagtttcccgatacacacaactattagttgctaataattttataagctaatgtatgagtgattttgtactacttgggaattaccgggagatatcatattttttatataaaatttggtatatgagcatctttgatacactataaaaaaggattttttttcataccgctaaaaaatattttcacatg

SEQ ID NO: 99769 - DNA, 674 bp, Oryza sativa
tgcaagtagttcatcaaagttgccaagctatgtagatgtagacagtatgtggttttcaccttttccaatggaagcatactagaagaaaaattagaaaatagtgtgttgaattaaaacttaaaagcataatggagaatgcaatgtaaatgtacaccaaaagaataaatgaaattgcataaccaaaaagaagaccagagcaaactgccagctgacaactctttggacttcatagtgcctgcaaattaatttgagatccataccctgtcatgaggctgagcagaaggagcgcttgacgtataagcacatgaagtcggacaccaagataggtaactttgtttcacgacatgtacagcaggaccttcaaactggaccgcaggtgaattccatcctaataaaaataatcaacaaaaatcaattatgatattaaaaataaggaaactacaactacagattcaaagtaacagagaactgctgagtgctgaataatacaatctctctgtttcagattacttctcattctagcaaatctcacactaactaaggagctgtgtcaaattacattgttccctaactaagatgtgagaatgacaattattttggtaaaaaaaaatgaatcctagaacaagtaattgaaacggagggaatattatttagagaacaaacaaagcatacct

SEQ ID NO: 99770 - DNA, 1022 bp, Oryza sativa
ttggcttctgccatctcacaagatgcaagtacaactttctgattgaattgctctatcagaaactttctacttggattatgaggttttgcaacaacaacaattttggtcccctcttgagcaaaaaaaaaaaaaaagaaagaaagaaaaagaaaataaacacacacacacacacacacagagaagattccaatagctttcagtaggtccaaactgaccaaaactgttacgccctgtttagtttccaaattttttttcccaaaaatatcacatcgatctttggacatatgcatgaagcatttaaaaaaaataaaaataaaaactaattgcacagttaggggggaattgcgagacgaatcttttgagcctaattagtccatgattagccataagtgctatagtaacccacatatgctaatgatggattaattaggcttaaaatattcatctcgcggtttccaggtgagttatgaaattagttttttcatttgtgtccgaaaacctcttccgacatccagtcaaacgttcgatgtgacacctaaaaattttcatttcgcgaactaaacagggcctagcatcagacatcaaagagcaggcccagtgtgacccccacattgctcctgagtagtacagtacaagttagccaagcgctgtatgtttttccccttcacttttctactagctgatcaaaattttttaattagatcttggccaacctccctttgcaatgtccatgtcaagaacacaatccaaacttatcaaacacagactctgaattttcatagcataaactggggatatattcagataagtagggtattgcaacagcaatgtactatcttccaaggagaacacattaggtgccaatgtcacctcacaatcctaatcatatgcacgcacttggaccaggagcattgcaccatagagccattgccatcaaaagcctggcatccattgagattcttgcacacacctcttcaatgctaattcgtttctatgcatcttggatgttcttggggtgcagg

SEQ ID NO: 99771 - DNA, 1112 bp, Oryza sativa
agttgattttggtcttattcatctggtactttgtgggaatacactgcacactctgtattgcggtggttaactggttgctgtgatgctccgaggaacactaagtctgtgatagcttcagctaagcagtcagttagttgatttgtgcaaattcaatcctgtattatcctgcattgtaccgtcgcactgtagttgagggtaagctctagtgcatttcatcgaaaatatacatgacaccacagggcagtgagccagtgacatactggcatggtgacaaattataactggtacaaccatgatattcaggaatgttatcatctgacagaaacttatgtgctgttatcatctgacagaaagttatgtgctaatagttcagtagagttccttaacgattcaatttttagggacattttgacaaaagaaagtcctatactgtcatggttgatgagacctagacactaaatttctagggacatctgttaaactccttgcaagtacatgagttcatacatttcctacactgttgtcttccaccgatgaagaatgttgaacaaaataccttgtcagatgaccttctattagctagctaataagcaccatttagatgtatttgctttaaagctaggaatatgctatgctaaattgctaatatgacacatttactgctggatgtatttttctttctaaagaaagaagatggtttctgttgcaggaggttccatgaggaacaacaaaatgttctagaggttattgatctctgtgctttcaaggagtttccaagctctggactgcggttggtattccaggaggagctatgcccgttttccttcttatgtgcacgtgaggttggctcattaatgattcttatgtgaataaagtatcatagcatgttaactaattttctggaacatcatttatgtggtaatgcagggcggcagacgtggcacacctgtatatctgctatatgtgcttactgtttctggagttgctctcttatgccacttgcgaagcccattttcctatatctctggttcaatatttcctcaagacgatatagttgaatttaatctccaaacccaagtacagagtgctaaggttacagctgtaacagcgat

SEQ ID NO: 99772 - DNA, 4411 bp, Oryza sativa
cgggttcgcattagtataagagtatgctaacattcaaaatttatcctaaacaaacttgcccacttattttctcatctcaatcaaattacaaccatcactcacttaattccacatctctccttaatttcataaaaaaagaacttttaaaacacataggagtagtagaccttttataaacatctacgctaataaaactaagatgaagtaagatcacttcataagcaattccgtttactattttgtgaattactccctccatcccaaaataaacataaccatgagttttcgtaccaaactttgatcatccgtcttatttaaattttttaatgattagtatttttagtgttattagattataaaacataaatagtactttatgcgtgatttatgttttttagctttttcaaaaaaaaattaaataagacgaacgattaaagttgggtacgaaagcttatagctgtgtttattttgggacggagggtgtatatcctataataacctcatagttacagttaatacataattacagcatcgtgaatctttgctgatggtggtggttgctgatggtggtgcggcccgtgacgagagagagatggaatttagagctgaccaggtgatgttaggtcgtacaaagctgtcttgggcgtgatccatgtaagaggagaccagagaataagctttgcctcactgccaggagacaaggcaaatccatcgatgtgtgctccccattcaggacagctttcctttttcctttttctactcctataataaattatcttgtgtcaatatgtctgccgtatgaatgttttcagtacggacggtaactccacctggaggtgaattagcctttgtttacttccaaactttttcttcaaacttctaacttttctatcactgtccaaatttattttcaaattttgtatttttaagatgaaaggagtaaattacttgtccttttagttcattatacttcataagacaagggagaggtttaaaaggtgaatcgagtaccggtctcattgtttggtttattcgtggaataagccaaacgtatattcacaaacgagaagtaattggtaaataaaacttttatatacgtgttactagaaatctaaaagtaaaatgctaaaaaataaaaaaaaattaaaatcagctttaaattaagattgaaaatttaaattttaacggataagtataaagcgaaaagattgagtccctacgatttttgtcccgtgtctgaaaaatcgaacgatatgctggccaccatttgctactaccatgcacattaatccatggaaggcatctctcggttgctttccattggctggttgaccacatgacctgacctgacctgcctatacatgttgtaccactacaagtaccgggtatcttggcttcttgctgttgagtttttttttaaaaaaaagaaaaataatttgtagtagtactatctttttggtgatgagttgctacgtggccatttgaccttgccatgtcttttcttcggttctctagctagtgcttggcacttgtcgctgtcgaggtttcaagtagaagtatgggtgcttacatatacaagtacggagcaccatcatgtactcatgtgacgtgtatggtagtacaattactgctaatctaccactctaataattaatcatgtttactaaagtgaaaccgatttttctaaattagttggagccagtttaattcgggctttgagtctatggcctcttttcttagaaacatgtataaacgcaggcgctcacaacacacgtacactcatccctataaacgtacatacgcacactctacgagcacctccggaaaactggaccggcatatctagagattgacgaagtcaccactagcgtctcgctgttagccctacccctataagcacttccggaagactgaaccggcatatctagagattgacaaagtcaccactagcttcgctgttgaccctacccctatgagcacctccgaactggacgggtatatcttgagattgacgaagtcactactggcgccttgctattcacgggtacatcgtctaccactgaaataataattagccgtaaatgcgagcactcgtatcaaatttaggatttaaaaccgggtggttccaccacaaggaacctaaccagttgagttacgctcacttcacgagtctatggcctcctttgaaatgcgggaacaagaaaaatacatgaataaatgttgtaagctatagaaccttataggaacccaaaacataagaatttagaaaattatgcctttggataacttgtatagaaagaaacacatgaaactagggagaccacatagaatgaaataaagagtatgaggtatgaggtcgtattaatcttactatggaacaagacatagttatagctagttaaaaacaaattaggtaggtgattaaaatatcactgtacccctcattgatatggagagaataaaatgaaggaagtaccattgttttgagaaaattcaagaaatatcattgaggtcttacctcacattttcttctttccgtgtcttgaattcctacgtttttcctgtatggctatcaaacggtagttttgaaactttcttgtgttttcaaatctcttagaaatccaacggacataacatcatatttctatgttttttctattctcgtgtttttgacaatcttacattttaaagggggcccttcattatgtttttcatatgctccatctaatgcatactccttcagtccaaaattaaacaacctacgatatgataaaacggtgtgttctttgagtttgtttcgtattccacacgcacgctttccgaagtattaaacggtgtgtttttttaaaaaaaaattctataggaaagttgctttaaaaaatcatattaatccatttttgaagtttaaaaatagttaatacttaattaatcatacgttaatggctcatctcgttttacgtatctctcaatcaacacaaaagttgatttattttgaaacaacgaccatttttcgatactctattctacacatgactttctacttatattcattcatgtattttttattctacttttacgtttttataatcctgtgtctcaaataaccaaaatggaatttttttctatggttttctctggagctagccaagccgaaactacattcggtggaggggtctcgcatgagagaaggcagggcagggctgtgtgtgtgtgtgtgtgtgtgtgtgttgagctcgggcaccgatgaaagagcggcgcacgcggcggcgcgggcaccgaggccacactgatgaagaagcgtgccaactacacaaccgatgtagtacggtttagttgtctgaccaaaatattttcaagtatatggacaatatataaaaatatagtattaaatatagactaataataaaataaattacaaattccgtctgtaaattgtgagacaaatttattaagtctaattattccatcattaacaaatgtttactgtagcatcatattgttaaatcatagcgtaatttagcttaaaagatttgtctcataattagttattttgggtgtgtttagttccaaagtttttttttctagacttccaactttccattccatcaaacctttcatacacacaacttttcagtcacatcgtctccaatttcaaccaaattttaaactttggatcaatctaaatacaacatttatctatatttaatgttccataaaatttttagaagtttgaaaggacaataacagaacaggagagctcctcggaatccgaccacctctctgcactagtactgcatgcgtcaccgcgccggccaccgttaagaacaggtacaattgcgtaagctataagcctggcttataaacatattttaagtagataataaggagagagaagagtagcgggctacagatttgtagccagctatagcatggactccaagatgcagtgtgtataacagatgggaccatatattaatagtgtagtatataactattatatgaataaactattagattggctatagataaattggaattaataattagctatactattagggcacccacaatggttatctataggctctctacaagagatccatgtcagcatatttttctacttggaaggtattaaatgaagagagagagcaaagctatctactaacttagagatagtctatagagaaaaacgaggcaatgcatgagagaattatagataccaatgtagacatactattaaggtggtttactattaattgagtctattgctgagatgtacatgttttatagatagcaacttactttaccattgcgggtgctcttaaacttgctctaaccgctgtgcagcgacagtacgtgcgtcagtgtcatccaactcctcgccgccggctggcgaaagcctagctacgaa

SEQ ID NO: 99773 - DNA, 545 bp, Oryza sativa
gggcgaattcgagctcggtacccaattgtcaacacaacaacttggactctataggttgggcgtagcaccatattatatatttcgtttctttttaagccttttgtattaagcacagtttttgtgtgcaggcactcttgaagatgttacaaaactaagtgcggctgaactaaaaaggaagcgtgctagggagtggtacgcatcattggccaaagatcaaaagaaagatagaaacaagaaggcacgtgatatcaggaagcggaggaactatgaatctcaaaggtttaagggggtgtttagatggggctaaaactttttagcccatgtcacatcggatgtttggacgctaatttggagtattaaacatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaa

SEQ ID NO: 99774 - DNA, 1895 bp, Oryza sativa
cccataaatgagttatagatggctgtaccttcaaatttcttccaatgttttctgaatgttgcactgttttctgctgtaggtttcttgaatgagctccgagatgatgctgggatcggacgtttatggtctcttgtgtcaaggtacttattttttcctaacagttcacctgagaacatttgtatagcatagctccaccagaaactacatagcctaggagcattcaatgcaattttcatacattgtagattctctttacatgttaatttaggaaaaattaattacatgcccctgcagagtttgctaccctaggatttgccctccccatgttgctaacatgtggtctgaggaccacttgtcagtgatacatggagggagaaatcctagagtgctagcctatgcagggggcatataattgattcccagactgttgcaagtctgggctcagcatattttgttgtgtatggaagcccagtattgtctaaaacttgtctagtttttgtacatatgacaatacatgttgcttaccatttatgtaatatactcctccattgttttttttttgcagaacaaaggctgtgggccctgtacaagatatagtaacagctactgtaaatgaaagggaactgctgtttgttctccatctggatggaagtttgcgcatatgggatatttttaatcacactaaacttatcagttacaatgttcgctcgaatgatatcgaaggtaattcgtggtgactttatgcgcttcagaaaaggtcttatactgaatagctattagcttatttatgttaatgttccttgtaataagtgttgcgttgacattgtcagcacatgttatgtcattgtttatcatgttaagcaccaacttacaatcaaacagttactagcacactctgctgaagactcatatgatctgcaagcagcttgcttggtatgttcatagaataggaacaaggaatggatgcatcatgcagttgcactaaattatatcccagattcctaataattggtcgagtgtggtaatcgttggtgatggtagcctggtataaccagctaatcgagtctatttcggtgatttccatgaaatttcttgcagaacaaaataagtatggcaagtgaaaaaaactagaagattccaaaataacagaacaaaatactccctccattccaaaatataaccaacttctagtgttcaaaatttgtcccagaatgtaacaacttctctacctactctcttatctagaccaatcacaatcatatctcatttaatttctcacctacttcttcatctcaagttctcaacagatcacaaccatccctcatttaatttcacctctctccttaatccccatgaagaactccagaagtgcctgtattttggtactgagggaatagctaacatgtggggtctatttgtcagcaatagttccttttaaaggtttgatgaatcattctgaaaattgttagactgtaacagcatttgatgtacgaacactttgttagtgcatcactgaataacaactgcttctgcaactatccctttcttttggctaccctggaataaactggatatgttttacatacttaaaagaaaggatgtatttaagttgttgcttgcactaattgctgtatcttttcttgttcttgaatagtgcattttccattaaagtatttttctatctttaggtcaaccatctaggatatgggttggtgatgctgatgatgatcaagagttgatttttttggctgttctgcgtcaaggcactgtggtatgtcaagaaaaatgtctcaccactaaatttacttggtcatctggaatgcactgatttttcatgctatgccttttcacttgtcagttgactgacttataaaacacgataacagacctataaa

SEQ ID NO: 99775 - DNA, 1196 bp, Oryza sativa
atacaagatgctactagagacatgaagataagtgttatgatgtacacaggcagaaacgaacctgcaagcagttctccaatctacgatgatatccatcatttcaaacccctgggcatccaacaaatttacttcaatcatccgtgccaagaattgcaggaagttgcccaaaagtcaaacaaaatcatgtcatggcaaacagaaagtataccagtgataaaggattacctcaatcaggtcaccacatctagcacatgtccatgtaaacaattgtgtcaggtcagcagtatagatctgcaggacatcctctatgttaaactccaaaatattagaaaacgtgttgcaaacggttgatccatattgaaggatgatctaacattcaggaataacttagataaagaaaaaggtgaatgaacatacagctgaagcatattccacaagtgtcttggcaagctttgggttatatatggtggtagagggatggcgttgaatgacctgaatttcttttttcaccaaatgtaaaagaaccagcatcagccttttaaaaaggaaaacaatgaacatctagcgaagcaacattcaacatgctggatacatgtagaaaagatataactagtgacagaaaatgattatgtaacatgaaacaaaaaagaaaaaaaacacattattgtaacagctaaacttttggattcaaagtcgaagaggatatgcaacagctttgaataaaaagctgcatgaaagaacccttatagttcttctgtaatagccttttgatatgtcaaaaggaatttgaaattttgcactatatatcatagtaccaatggcaactagatacagctacaaccagccattttaaccagaaagattaaattgaaagaaggtaattttatactagtaaaaaaatggaaaaagaaactatcatactgtttcaatatactagtaggcactacaaagggggaaaacatcgaggcatgcaaatattgtggttcactgctagtttccttgcccaatgtgaacaattctcccgttaatcatttttttcaacaaaaaacggttaagttagttctatgcaaattatttgtttgaagatttcccaatatatttccatctagcagcaagctaaaacgtaatcaagcaaaaaagaccagctctaaatgcaagcaggaaggaatccactacaacattttgaagtaaaaaag

SEQ ID NO: 99776 - DNA, 627 bp, Oryza sativa
  unsure (1)..(627): unsure at all n locations
actactatgaatgtgagatataagccaagtaatctgtgtagctctacgactacagagttgagagtacagtccattttctgagcatccaaggcctgaaaccttgaaccacagtttagtgatcaaataatatgtggctaactagctatgtgctcagtagacagaggtatattacattaagaaaaacaacttagctttatatcatgttaatccaaggaaaattacattcttagcaaagtataacaagcatgatgcaacaaaacaaacataacttcaaacaatcaattctgacctatcaaagcaagaacaaagcccaggaatataataactacttcgaagaaattaaaatgcagcttcacagagagccatacctgcggggcatcgtcggggctgtgctcgtgccgagatcggcgaggcgacggcgagagctttcatcacagcggacatcctgctgccgattggtggctcttggaggaggtggtggtggatgagcgccaaggaggaaggaaggagaggaggggtgaaatgcatagggaggtcggngtttgagtggtgcaaagggggaggggagtgcanagagcgattgggtggtggcgtgtnttaaacagagccatncatncatncatgctt

SEQ ID NO: 99777 - DNA, 560 bp, Oryza sativa
ggcgaattcgagctcggtaccccatctagatatgcaagtgggtcgatttataaacatatttatagatcaagttaatatatataacatgtgagtcaaacctgcggtttatgcactaattttgtctataagcggcttccccacttgcacccttatattagtgtgtagtactgttgatagctcgagcgacataattttgggctgcttgggctacaactctttgggccttagagcagcatatgtttgcttggactaggctgcgtgtgagccgaaggcccagctcgaaagcttgatgggctgtggtggcttcagggcagcggcggcgcagacgatcccgtgagtccagccacggggggcggagcgaagccaccggcggcgaggtggtgaagggggctgaaggcggcgtccgttcgagcggcggcggccggatcgatggatcgagtcgagcaccatgcgcccctgtgtcccgcggctcgggtcggctcggtacaggcgaaagtgcagcggcggcgcctctcctggtgttggtaagctctctctctctttctctatctggttcactg

SEQ ID NO: 99778 - DNA, 537 bp, Oryza sativa
gtgtatgagacaaggatggcctatgcctcggtccttctgtgtcttggcttgaacaagggctcgtgcccaggtcctagtcctcaaatggctcgggtcggggctagtgcctgggaagatccacatgtcgagactggccaggccgggagcgtggtgaccgagggttatgggtgacccgattgtgggtttttgccgattccccctcggagttcaccacgccccggggcacggctcggttctgggccccgtttggcgattttagccgacccgagcccccgaggacaggatcgagcacgagcgtgctaattcaagccaatattcttcaaaaggaaacaatggcacagacacagtccttaggaaatcgaaaatgtttttattgaaatacggaagagaaaaaagataagcccccggccaaccctgcacgccccgggggggggggggcgcggtgttggcccgagcccaaaacctgacacccgacccccactaggggtagaagccacgagggtggtcgatgttccacgggttaggcagctctgtgcc

SEQ ID NO: 99779 - DNA, 597 bp, Oryza sativa
tgtgtcttatgcggaagctttttatgtaaaagttgttttgctttcaaatatattttgaaaaaaatcaattttaaatttataataataattaatactcaattaatcatgtgttgacgattttctcattttgtatgcctacacttaatcttacggccttatcttttcgcttgtgcttatgcttattcttatcagccaaattttgatttttcaatcttaaatttgaagttgattttggggttttttatcgaagtttattttcagcctttgattttatatcgctaagaacacatatatataaaagtttatttataattttttttttcgtttgtaaatacgtcgttttgcgatggggctgttaatcttcgtagtatacatttacgggtcaataaatttgataattcgtgtatgctgtagtgtgtcgtagcccgtaccacatccaacacttctcacaattgggctggaaatggaaaattctttttttttttgaagaggcgcggcccatcgttgcttcaaaacggcagggcaaagcccagcctaactaagtctgagttgtctctgttggatgtcaccttccggcccaaccggaagccctggcag

SEQ ID NO: 99780 - DNA, 537 bp, Oryza sativa
tgagcatcttgccatccttttctattgcaactattttatccctcaagttcttcatgttgcgtgctatggtcattttctggaggagcggattgttccaggaaaagtataacttgagctgaaaaataaaattggagtcaaagtcactgtctatattagtgtcctttgtagatcaattttcatctactcagactagtctctgatagtccgatatggatcgggaaatggcatggtagtggaaaagatgaatttcctttttaattttagaaattaatcgggctggtatgatgcaaaaaagttccacaaagaaaatcacacatgtgcagcagctgatccgtaaagttgaagcatataacatttattcaaacacgacaatatgtggaagtaccttggattgatggttcctgatgagctgagcagcatcgaattcatccagcacgtcctcaacgtcgtaggcgacggacttaactttggagagccaccgccgtgccactgctccatcttttcctacttggcgcaccttatcgtcagcatcttgca

SEQ ID NO: 99781 - DNA, 501 bp, Oryza sativa
ataaaacactgactaatgtaatgctatcaggatttagtgttaacgttgaatgcataaactgaaaggcttctaacgcatctccgtagagtccattttgtacacagcccacaattgctgtattccatgaaataatatctgatatgggagttatgctttccagcagtgaaaaggcggccagagagtcaccacagcatatatacatgtgtatcagagagttagcagctgaaactccagtcagaaacccatacttcaggatgaaagagtgaacagacttgccaaagttaaggtcttgtggacaaaaacatgaaggtataacagctaccacagtgctcaaggtgcagcttaggccttcagatagtagtcctttgaacatagctttagcctcttctccaagtgaatcgtttcttgagtaaccagaaatcattgtgttccatgagatcaagtctctcattggcattggcctgaacaaaatgcgtgctgtagatgggtcattgcatttca

SEQ ID NO: 99782 - DNA, 543 bp, Oryza sativa
tatctccagcacgccatgacatctagttaccatcttgatctaggccagtttagtgtgctcgggtaagttaagctatcagctattacatgtgcattaattgtcactctgttccatcacatgggtgattacagccatggaattgagtatcccaatgtcggtgatcacatttcgagcacgtagtacttcggaagtggtggtgctcatgactctgagcgcagagtgcaagcgaaggttgcttgagtgaccaaaaaacttgccaggtcgtgacagagttctacgcattgaaaacaacgagatctgcattgtttagttgatcccactagcatacaaatcggatcttggtcaatgcgcgctagctggaggcatcaaccatttccatcaagtcaaacgcgtacatgggttcgagaaattccaccccgttcgagatccatccaccggcgcgagcgccagatgccatccaagaaaatccccatgtttcgtgtaggattcgcgttgaaattgtagagatttttaggctctcgattgggcggagccctgtgaatt

SEQ ID NO: 99783 - DNA, 572 bp, Oryza sativa
ggttttgtggtttagggttacggattagatttcgatcacttttaagggtcacaaagtgaacttattcctttaattagctgcgggtgcattgtggtagcccacggaaggggactgagtgccatgttttggaaaaagtccactttgacacccttaaatgtataccgaatctaattcgtacctctcaaccagaaaaccggttaggatgactcccccaattactaaaaccggtacaaatagactccctcggcggtttcaagggcggttttgctgacgtggcgttgttgacttggtcttcgtcccacatggcgttgacgtggcactgatgtaagattagatttaaaaatatatatgtgggaccaatttgtcactcacacacaaaaattataataggatccactgacttgtggggtccacatgtcattctctttccaacctttctgcctccctccctctcccttatttctctctttctcttcccgtccgcgagtagcgcggagagcttgccgaggcacggatggcggaacacaaggcggcgagggagcggagtgtaaggcgccaagggagtgcacgaa

SEQ ID NO: 99784 - DNA, 612 bp, Oryza sativa
taagtaaatatcataaacccataattactttaattaaattatcactaacctatagatagaacctatatatttaccatcatatatatcgtaaaactacaaatttaaaagatattgtatcacaaaactacagattaagcgatgaaattataaaaaaactacatattttaaagtttatatctatagcactattgagattatgaaagttgtagttttatgaaatctgtagtattttataccataccttgaatatgtagtttcataaaaaaatgatattaaatatgttttatgatacatatatttaagtatatactagttttgtaatactctctcattccaaaagtctaagtactatttcattctttgatttttttcaaaagtctaagtcctatttgtagtcattatgtgctatattaaatttttgatcgaaacccaataagtcattttagtagttattggttgcatgtttattagttttgtcacatgatgaacgagttaactacatcttgatcttggtgaaaaagaaataggacttagcttttgaaaggagggagtagcttgatcaaatgaaatttactttcctttctctaaagagattaagttaaataagggatg

SEQ ID NO: 99785 - DNA, 541 bp, Oryza sativa
tcactccccggcacacaaaatgaagcagcgttttagtgcatgattaattaagttttagctatttttttttcaaaaatagattaatatgtttttttaagcaactttcgtatagaaactttttgcaaaaaaaacacacctttagcagtttgaaaagcgtgcgcgcggaaatgaggagttgggaacttatactacaaaacagagcctaagaaatcctgctaaaattatggcaatattaccatcttactaaaattttgacattaccaaaatttggtaaggtttattttagctacaatctgaataggcccttagggcctgtttgggagggcttaagattctgagaagcaactagttggaagccagcttttccagcttctagtttattttctggattctacaactacaatttttcagaatctgaacaaaaaactgtattgtttagggaagcttctgattctaggataaactgcagcagctaaaagcttcaccaaacatgcccctagttgaaagaaggcgaccattaaactgttagtagcacaaatct

SEQ ID NO: 99786 - DNA, 523 bp, Oryza sativa
tgattcatggcgcctttctccgaataattacagtatcagtaggagagccaattccctgtactcccactaaccaccacccccctgcaggtatgagtagctagctagctagctcttgatttatggagcacggagtatagcgagcagctagcgccttgccgtttgcatcggccatcccgatcgatctatcgcaagtttcttctgctactcgttctgaaaaggaaccatgtaggcgtagttttcgggcattgggatcggatacaccatcagattgaatctgataattttgtagagtgctactcatatctcaaccgatagatcaagaattaggagaaataatactcactcactttctcctccacttcaaaatataaccatatctcactacaccagatcctcacatctctgacgggatacctgtgacgggcaaacgaaatggtcactgatgaccgtcacctctgacgggtcatacgggatgccgtcatcggtgaggcatccagctacgacccgtcacaggtaactagtc

SEQ ID NO: 99787 - DNA, 734 bp, Oryza sativa
cctgcatgctcatgttcacgtgaatacgctaaagccatgcacgagttccaaagctgcagcttccctgtccttgtttgcatgcaattgctcgatttggttttgcttcttgcctttgctccttagtctttgcacgccgtacgtataagacagcacctgtgctatctgtccgtgcctatgcacgcaccgcagtcgcagccctcatgttcaccatccacgaccccgtcgccccggccctccacgtcagccacgccgcgccacgctcgccggtttcgcccttccgtcactggcctcctgccgccgcggatccgcgatcaccgcattcgtcgggcgcgccgtccatggcgctacccctccgatctctccggtcgccttcggccacgcccggccccgtcttccggtcacgttccgccatcgccggtctgatcgcgagcgaggtcgcggcctccgcaacgtcctcgttgtcgccatcgatctcatcgccacggctgacgatctcctgtcgatgcgcgatccccacctcgtgtttcctcctccacatgtcttcttgatccaatgctgaaaccttatgctctgataccacttgttataaaagttagtcgatatagcggaaagacgactaaccttcctgatcgcttcagtcatcgatcacccaagacatgccagatgacaacacaggaacacacgatatttgttaacgagggtcagctgaagcctacatccccggggctctgatt

SEQ ID NO: 99788 - DNA, 612 bp, Oryza sativa
tccatccctgctgtgatcctgggcttgttgaggcatggtgctcagtttttgtgtaccattgagggggatctctgcttgaggaccctgggatatgggggggtagcctagctctcttcttgagggcatagataggattagctgttgataataccattcgtcgtactggtacatgcttactgcagcagaccttcaactgtgtatagcttctgtatatttttactgcacgctccattgagacatcgacaactgttagtagctaacaagacaagattttctgtgactctgttattgtattaactacagtatggcacttctgtcgtagaacataacttctctttggtgtgaacattgtgactcgtcgcataacgtcctgatttacttgattatacagtattgagcagtagaaatcatcagaactttgcacgttgttggtgatttcccaatggaaattatactgctttactagaaaatcatagaggcctatctcagttttgcatgcttccaagctggtagcaagattcagtctttaagattgtcttggtgatcaactgtcatttttccctttttttggttgaaaaggtcgacgatctaaataaagatggggattttatt

SEQ ID NO: 99789 - DNA, 522 bp, Oryza sativa
gctgatgcacacaagttgtcaccaaaatatttttcggccgtccgatgtcaaagggacggctagctggggccttgatgctgcaaaaaggcatgtcgccactgagcactagtagtttgggggtagctgtccatgctggccacaggggaggccacccggcagggcatggcccacaccatctcagggttaatgcagccattttcccctaactgtcagtgtcttaatctccttttttgcttgcccaattgccgtgctccaaccacatttttttaggtcttctctgaacctaacagtacactctcaagttgcatgcacacagggtcagcattaggggctctgccagtactgcttgattggggtgccaccatggtttgctcatgtggtggttggtttttatcaacactgatcactgatctgtactaatactagctctctgctctgaagtcttgatcatgtgtggttgctgaggttaagctgagttgcgggtttgcaaccatatcagccaaaccaacaacttgcatgtaa

SEQ ID NO: 99790 - DNA, 500 bp, Oryza sativa
ctaatatatatattgtggttctttcatgcatgcagctgcctagaatagaatatcaaacaagctttgacgatacatgcattacaaatgtgcagcgcgatctctgtcacttcatccaccgtgagtgctgtcatatcaaaggatagttcttcgacccagagagcatcctggctacaagataagaatacaagaatcttgggagtggaacaacgcggtgccataatataattagatagtgtattcgaagtgacaatgttataaatattgtaacattttgacgacacttttcacttatgcaatatatgtatatttgttaatatcaaatgttttttagttactaatattttttatgcatcaattaattaattatttggaaaattatttatcacaaattattattgtagcatttttttaaaaaaattttgtacctattttcgcaggcagatcaatcacattctttctggcgcactgaatctattttcctaggcggcacctctagctcc

SEQ ID NO: 99791 - DNA, 707 bp, Oryza sativa
tatgttttccccttatattgttcaaatatattaaaatgacaacataattttaaattttgcaataactttaaaaaactactaatgtgtaatattcatattatactttatatacgtgttagttattaattactttttaatatcaaattttagttatttataaattatatatattcctatatggactctagactcgtcttttaatatttctttttttttacttccgatttttctgtaaattgtatttctatatagactttatactcttcttccaatattatttatttttatttctgaattttcaaattatattttatatacgtgttagttattaattatttttaatatcaaattttagttatttgtaaattatgtatattcctatatggactctagactcgtcttttaatatttctttttttaaaattccgaattttctatagattgtatttttatatagactctatgctcttcttccaatattatttatttttatttctgaatttttattatttctaattgtatttctatgtggactctaaactcatctttctatattctttaatttttaatttcgaatttcaattacttctaaattgtattcctatatttatattcctatattgaccttaaactcttattcccatgtttttcttaattttgaattttagtatttgtaaattgtatttttatacggactctaaacacta

SEQ ID NO: 99792 - DNA, 556 bp, Oryza sativa
aaaaaaaagcaacttatcaagaaattataacaacttttgagaaagaacatttggagtgccacctctcactttatcccttctcttagagtatgttgttggaaaatgaaacaatgcattgttcttgcctggttataaactttgtaattgaaactgtttgtctcttttccttttttgtacaaattgtttacccaatttataaaattaactgctgggtgcgcctaactgtagtttcattccaaaaaaatggaaatgatgcattggtcaccattgcaattcttttggtgtgctctcagatgcatatattccaactagatgtgtagaagtttgaatgctgaattgcatcattttgtaccaacaataatgcagtaacaaaaactacagaagtgtacccatattcttggaaaaagaattaagtccttaacttcaatatcacattgacaagaaaaggcaggtctatctcagtgacaaggaaaagcaattttataaacacataatggtttgtgctagaaaggaaatatccacattttaaaactacactcacactcttggtctgctt

SEQ ID NO: 99793 - DNA, 614 bp, Oryza sativa
ggattacggtagatttgtagatgttttcgtaaactttattttcccatgataaacttaatcagcatatattatatatgcatggggtaattatatgataacaagcgaaacataacttaattttgtttttgaaattatgattttaatatctccagcatacatggtaaggtagataataatttgattagttacaaaaatttgttgtactataaagattcgttgtactttatacatgccgcttttttttttctgacagcccttccttttttttattcgtgacagtctcccacaggccacagcaaaacggatccagatgcctccgttcccctcgtgtttgttcaggtttaggatgctttgtttttttttttttgagtgatctgctttgtttggaagccaggccatgttcagaacttcgttcccctcgtgtttgttcaggataatttgtttggaagccaggccacgttcagaacttttttacttctgtgaccaggatcgattctatatccaacggttggttttttttttttaccgttgctctatctgacggctattatttactcagaagtctcagtgacgtgattcgtcctaagattatctcatgattctctttgcacttg

SEQ ID NO: 99794 - DNA, 534 bp, Oryza sativa
aaaaaatcaactggcgtcaggtttctgaaagcttttttttgacgtggacccgtcaggaaaaaccatcatccaccgtcagaaaaaatgagttccacgcccaaaaaaaaaatacacatggcgatttggataaatatatgaacatcaatcacaatccatacatcaaaattcaagtttgcaaagcttacataaatagtccatctaagttcagtacatacaaattcattcaaaccggatttagtaatatacaaagggtccatagaaaagttaaatggttcagttacaattcatcaaacacatgtaaaagaaaattgtcttccagcagcagtccgtgttccgtggtgcttcaaccttgggcaaaggaagctaaaaggtttaaaaaaagaggttcaatttcataattttcttcattacaaaataaataacaatgattatgaataccccagttatagagaaacaaatagattagtacagggaaaaactgaagtgagcaacataaatttctcaactacaagcatgaaaatgaaatatggcaac

SEQ ID NO: 99795 - DNA, 537 bp, Oryza sativa
agctcggtaccctgtaattacatttgacaaaattttggaggaaaatttatcaacaaatatatagcaaattcgacatataaatacagtacaactcgaatatacagtatatatatatatatatatatatatatatatatatatacatgcttatatttaagtaatggactccaaaaaatcctggagaagtaaaatattggttcaaataaagctacgtacgcacgaaaccgtatgcatatataattcctgccaaattaataacgcatgagagtatgtagttttcatgtatgttccaaagtgccccttaatttaatggtaatccatggatgcacttgacaggaacacacacacgattacgatattaaccacacataaatccaacagcagcatgcatttgcaagagctactaatcaattgcattaacagctagctgagtgtagcattagctaatctcttgcaatgtcgccatccagagtaattaaggagaaaaattgcaattaattaacgcgctaaaaaatcgatcgatcgatcagctaggca

SEQ ID NO: 99796 - DNA, 504 bp, Oryza sativa
cctaactggtggggccacccttacggtcccacatgtcggctcccgctgcgaccagcccattaacttgtccaggaccagcaacgcggcccatgccggtcggaactgcccgaatcgcaacgctagatcgaacggctgtggtggctcgggagatgcggcacggttggcttgttgactttttccggcccggattgacgccgcaagccgaatccacgagtagtgggctgcggaattttgttttgttttttttttctccccatcccatcccggccctgacgccgccgcacgacggccggccgcggccgccgccggggaggtcgccgccgatgagccccaccgcgccgtcgcgtacgggtcgtgctctcgcccttctccctgtcctggggctgctgctcctcgtctgctcgccagccgggtcagctggtacgggacaatcgccaccccaccgcgactcttcttccgatctcggggctggtcttgcttaagtttatctgtagcttttgttgg

SEQ ID NO: 99797 - DNA, 654 bp, Oryza sativa
acttgatacctgtcctttgtcaaccgtgggtgataattcgactagcttgtgtcacttatgttgatctagctagaactatatgttagccatgcttaattaccactaactcagttgatgggataatggcagtaatagaccttttagtatcattacgagctgcatgctcgagacatccggccatgtttcattggttgtaactatccaactaaaatgcgattgaatgatgggctatgggtgcatggttttgctggtcgcacccatggcaattaaggaccggttcgcgggatgcactggaagacatacagcgcttgccacaagcgggaatgggtaactacctgacttgaagtatagcttttctctggctgacgcatccagacaagggtgagcgtgatggagttcggatggccctgcgacggcctatgcggctttctgattcgcctaggcacgagatgggactgctcgctgcttgctgggggcgggggtgaaacctgaggtgtggtgtgcttggtcagagggggttatatgaagggtcttgtcacaatcactcgacatggtgacgtgtccggccgggtacggtgacatgccggtggattgtgtcttgtgggtatagttgtgcacctctggccagagtaaaactattcgaatagccgtgcc

SEQ ID NO: 99798 - DNA, 893 bp, Oryza sativa
ccccccccccccctcccatggccatagcctatcggcggctagctgaaagagatgagggatgaaaaaatagacttatttctatcatattaaggcagtctgcagtttagatagggcatgcaccatatgtcacacagcttacacctcaacataccttgggcctaggaagcatggggaatactgtagccgggatgcaatatggtcaccaagaacaattgatatggaatatgcccagatcacctcatctcccaacattactcacccttgtgtccaatgtatgaatgaatggcgagcaccaagcacgcagcacaagacattgccgccctcactaatgctgcctacggagacaacaccaagcctaggttgtctttggctctgtaaatcagccccaatccccttgccgctcagcaaggtttattaggttacggtcgatgaaaaaattacgaggctataattatggtcaaggaaaaaaacaacaaaacaacatgatatacaacacggctataagctgaaattaaaccaccgttgtataacattggtatatatatttatactcggtactatttctttcaaagtaaggaagatgttattagatccttaaaggcttgtttagttcgtagccatatattttcacaccaacctgtaggcatgttgcatgtgctacaatttaatatcccggtttttggttggtttgttgaaatttgatgaagctatacatgttgcattgctagtataactaaggacccatatatatatgtgatacactcaattaatttctagctgaatcatgctacatacttgtgaccaacaatctacactttgtgtgcaaacctaacagccagcctccacatccaaaatgcatatagccatggattttgagtttataaaaaaatagt

SEQ ID NO: 99799 - DNA, 517 bp, Oryza sativa
gtacatggcttctatttaggtgtcattgctttatgcacctatctaatctagcccaaaaaaaatggggaacagaacagagaaaattatgagggccagcagtgaaaggtgcacactttcacaggacaaaaatgctacaaggtacaagctatatatggaattggacaatgcatttctgctgatctaagttttgacttgctggatcggatggactagtataattgtaagtgcactatacacaaaaaaacgaagctattgttgcagaccaaagaatctttgaaaaccagtccataataatactgatacactttcaaccttagatatcttagtgacaaaaggtcacgtgaattacttcgtacagctagcgacatataaaaatagtaattacaagccacgttttggcttaaaatatatatgcatagccccctaagtagaatatcagttaaacagataagttactaaatttaaatttcctgcgtttctgcaaatggtcctgattggaaccttaaaggataactaa

SEQ ID NO: 99800 - DNA, 582 bp, Oryza sativa
actctaaatgatcccccttcctatcttgggcaagtcattttttttatggagaaaaggtactttattaatggacatttttttatccttttttttttgcagatcatgtatatatctaccatgggccatgcagactggaagcccatgcagtttttgtgtttcgcctatttctatcgaatacttgacaaactgaaggctaccgagtcagctagcactcctatatacaatgtgaggcggtttactaaataattttatttgctgttcccttttcattttctatggaatccctgcacttacaggaatgacatatcaaataatcaaattgggtcagcttgctttactctatcgcagctcagatatgataagagcaaaaggttcactagggaaatggagctattagatgggatggaattcttacttttcatgagttgggaatgcatatatttgatatatgtggctccttttttagttacaaagttacataaacgcatgcttgtcttgtattaaggatcttagattacttggacactagtttttagctttgcagttcagcccgacagaatcacagaagaagcctagctaatg

SEQ ID NO: 99801 - DNA, 562 bp, Oryza sativa
ttttctttttctatctgctccacattactcctttgcttgtctttaacctctcttaaattgaaacctactccacttgattttgcgaaacaaaaaaggcaagatatttgcctcactagtcctctttctcacctacttcaacttcaaagtcatcagcagctatccatctgcctcttcttcctacacatacacctagttctgcatcttttctaaacggaaaccatttctgcatccttggtacaatcttgagccgaaataatcttcagttctcacagaccacacgagctggattgaggttgggaggcaccgagaatgcacctatcagctaagcacatcatgggagcgcttacttctaatctgtccccataggccatgccaatccaaacacaccaggcataagtccttccttcgcatcaactagtgttccttgagatggggacatgccatgctactaaaccagtagcatcttcctgcttggatcgaccgttgcagtttctggcgatggatgttgttgtgttcgaagcgagacaagctgggggtactgtacgcgttgttgctctttgct

SEQ ID NO: 99802 - DNA, 540 bp, Oryza sativa
aaattggtgcttatggctctatgctcgctgctggagatgtggaaaatattgtttaagagaccatctcaactcgtgtacaattctatagatgtaatatgaatcagccagtagcataaaagtataacttgaaatagagcttatgacatgtactttattaactatcctagacccgtatctttctttgagaatggcagaaccgtgtatgccatcatagcagggttttagttttgaattctgcaggacaacaaggagggtggttttagttgttactatgccagttttccagttctttttttttaaggaaaaccattttcatgttttattgcaacatattttattggattttgattaatttatttatttttatgttgggaagataaggaccttcagtcacaattactacatggaaggccaggagcgatgtacaacatatgtaatgctcatcctgtgcttttttaaaaatcttttttagtgtgcctctcccctaccttatttctaccgacaaggctcattatgtaccttgtaatgttgaatccctgt

SEQ ID NO: 99803 - DNA, 621 bp, Oryza sativa
atatttatgggtaccaagtttgatacccaggtaccatacctgatatatatatgcactagccatgatacatgcggatatcagatgacaaatattaggtctaatacttacggataccatgtttgatacctaggtaccaagcctgatacctatatgtatcagatacatataggtattagatgagtttgatacccaggtaccatgcctgatacctacaggcactagccatgatacatgtggatatcagatgacaaatatcaggtctaatacttacggataccaagtttgatacctaggtactaggtttgatgcctataggtactaggcctgatacctatatgtatcatccatgatatatgtggatattagatgagtttgatacccaggtaccatacttgatacctacaggcactagccatgatacatgtggatatcagatgacaaatatcaggtctaatacttacggataccaagtttgatacctaggtactaggtttgatgcctataggtactaggcctgatacctatatgtatcatccatgatacatgtgggtattagatgagtttgatactcaggcaccatacctgatacctacaggcactagccataatacatgtggatat

SEQ ID NO: 99804 - DNA, 630 bp, Oryza sativa
cattgtcatcatacaatagtatgacatatgtatagtatccatttagtcgccatagtcattacacatccccggatatccaaacaagaaacccgatgccgaaaccgacgcagagttgtccggtctaaccgctcaatacacatcggtctgaccaacaacccatgtccggtatcaccggacccatatttccagcagcacttatttaacacgtgcaaatccgatcatctccaaaaccaattggacaatagtctccaaatctctcaacccataattacagatgccgtttgttcatcacagaataagaatcataatcactttgattttacacaaccaacttgatatgaaattcgttcctataaagatttaaacttataatcttggagcgctactcatgtcactgtaaccactgggctacatgccttttgcgatgattatctatctgatctgattggatatgtagaactgtatatcacgtgtcgtgtgataaccctgctttatatgtatcagcgcgtgccagttgtcacacagtgatgctgatgacctatatggcagcaacagtagcatatgccggagtgatccaatccaagcaagcgatatctcattatctcatcatcagcatgatgagctactgta

SEQ ID NO: 99805 - DNA, 1110 bp, Oryza sativa
ttttcttcctggtagccaatcagtctgtaataatctctattccgtacttgtgcctaaacaattacaagtaaaatcaggaaaaaaaatacatgagctaaacacaaaaataattatgtgaataaaacatcattataattgttcaaaacacctaaatagaacacctcacttgttttttccattgctgctcatatataagcaagaatataaacaagctgcaaagatattgaggagtttagtggcatgaagacttacgtttaaagcatgcagatgctttggaactgtgtacatgcaaactctgtggaactcagctagaagataatccattgcatctggtacctgagcatttgtgttagtaaattattaaacttcattgaaagagcaaagccaggataggagtgtacagaaatattggaactagctatcgtcttagtggtcatgcagcaacgaattttgttttgagttccaaccatgataagaaaatcacaagattgtgcattatgtggttgcaaactaggctgcaaaaaagttgatcagtgtatgacaaaagatacacagtagccctatgttcatcggaatcaactggagtatctatcccagctactggcaaacagcatgtgagtttccatgctccataattattaaccttccactgtctattgccatgaaatttaatgtacacttaatatccacttcctctaaccatgacgaacagtgcaatagttcatcattgcatgccacttcatgtttaaatgaggtgtctaaagcagcttcaacttttaaacttaacatgaaacataacgaaaattagttactgtgggtttccattccacttattaaggatgagctgtcatgtaaggaagaaatagtcttttcctactataaactaattttaagtatcaatatacttccaccaatcaagaattcatgatcacaacatatgccttttgaaatatcagaagagagctataaagaaagaaaactgagtgcggtaaatgtccagaaagtgagcaccattcgatatgcacttattaaccaaaagtaatgcctagtaaaactaaaaaacacaaacatacctggctggtgactagaagcatgacatatccacaagca

SEQ ID NO: 99806 - DNA, 524 bp, Oryza sativa
gagttcgtagcacctggggacgaaattacctcaagacgttcttactgttccgccacaataaccgtcatccaacttttctctttttatctctctctctctctgtgttcgtggttcacagaggaagaagaacagtactagattcaatactgttccaccatggtccagcctgaccacaccacctgagccaacctaggtagttgtcaaccaaaagaaaaccgattcatatcaattcttccatcagttcacccccagattcaaaccaaatcaattctagtatctgtaacaacaataatcccaaagtgcaaccactactacacatgccatgaatcataaccctaggataaatctttttttcatccaactcaaattaactctcgatttaacattttcttttgttcgggctctgattcacaatatttattttatcgtttatttgtagtatttttgttataggcttatttggtcgtttcttcgtgtgcatacgctagatcgcgttgaagatcccaccggactcgcaggaactg

SEQ ID NO: 99807 - DNA, 2030 bp, Oryza sativa
attgtgctcttgaatattgtcgattttgtcgtgggacactgattgaattcggggagatcaactgctctgattatgtgtatttgttcttttaatgttgataaatctaagggcgatggaggccgctcgaagtatcgactcgattcatggaacctcaaaggtatcactttctaaaccaacacatttgattattccccatcaatgttgctagtaggatgctatttgagaaactatcacccatatagtttcccaactcgtatttatagtggtggtaggtgacatactcgtccgttgtaacttcgttaattttaaaatatactggtctaatattttgaaggtatttatagagatagtgtgggcgtgagtttgtagtttgttttttaaggaaataaaattctgtgctttcctacttggagcactcgaggcactatcacgtggttaggtagggggtacttagccgaaacttttgccgcccgcgtattaacacccggggtcacgcatgcaatgcattgtacatacataatccaagctagctaattgattgatgcctctccatgtgggagggggtacaagtccatgtggagggcaacggctcctttcagtttgtaccactattttaattgtattgtacccatcaacgccggccaatcacgtcgaaaacattctgctgctgagaaagattaagttaatccacactgatcccgttattatatttacccatcgaactctaggccccgtttagttccaaagttttttttttcaaacttctaactttccatcatatcaaatctttcatacacacataactcttctatcatatcgtatcaatttcaaccaaactttcaaacttcagccctagtatagctaattgactaaacagtgaccacggtaaattaggtcggttttcaaacatagtagtgctcctcttctgaaattaggcaaattaacctgggtaagggtcataagctgcgaaactagttacacagggaaatggtgactgcaacttaagaagtagcattgtgtgtcattgaaagaaaatcggacagtctagatcacacactgtacggctcatatcatggtagcaaaaatatattgtagtacagattactgtagcataggatctaaaccgttgatcggagaaacgacaaaattgtttgcagttgttaaattgcagtttcaagtataaactgcaccggatctgaatcctaaagtgggagctttgatttttccaatggtggttaagcctagctgagttccaaatttaagttggaggacctacgtactccatcattttctgtgaccatgtttctcaactactaaatgatattttttagaaaccttttatatatggagattcttttagaaagctaaatctattttcaagtttacaataataactaatataaattaataaaagctaataacttctctttttttcatgtaagaagaattcaatcccaacctctctttcaaagactctgttcggagatagagggtgaaaacttcacctttcttaacgtaaaacggaacaatacatcaacacgtgattaattaatcattagttaaaataatcttgagaaatatattgatatgattttttttaaaaaaacacacgatgactctagctagaacttaaggccccgtttagttccccaaaagtttttcccaaaaacattaacatcgaatctttggtcacatgcatgaagcattaaatatagattaaaagaaaaactaattgcacagttaggaaggaaatcgcgagacgaatcttttaaacctaattagtccatgattagccataagtgctacagtaagccatatgtgctaatgacggattaattaggcttaaaagattcgtctcgcggttttcaggtgagttatgaaattagttttttcattcgtttctaaaaacctcttccaacatccggtcatacattcgatgtgacacacaaaaattttcatttcgcgaactaaacaggcccttactactagtagcagttaggacctgtttactttgatgccattttcaacca

SEQ ID NO: 99808 - DNA, 531 bp, Oryza sativa
acttggacggttcgtggtgccctgagtggatccttgatgcgttctgtgcttggtcgttgaaattgggtgtgtgtttcttttctacccagagacagtagcgtaggtccctgtgggctcgtagattgagttaagctgcgtggaatttggtgtatggtaaacgccgcctgtttgcattttaggaattactgcttaggaatttttgtttgtacttctgatggatgttatcagtcattaccagcctttactaggggaaaatatcacagtttcttcaaattgcatcctgctaggagtaggatgagcaatggtacctggacaccaaggtggtacttgagtgaaatctatagttttttatgaacattgtggcttgagatcgaatggagtagtttatgttaatgaatttaggcatgtttaattattgtttgagcctctgcaaatgaaaaccatggtagtcatacttctatgactaaaatcattattgtctggcatcacaggagaacagaaaggtgtatgtgtttcgcctggtggacgatt

SEQ ID NO: 99809 - DNA, 578 bp, Oryza sativa
atcttcatgtcattaagctagcttcaatattagtgttgatgttatggtggaaggagcattatattacgcgcaatagtgttactttcttagagttgatagtcaagtatctttgtatttgtattctactatgagtgacgtaatatgttagaatgtatatggttttttaagtttattatcaattaattttgtttgttatggtagttagggtttggcctttcaactactgtctaattttgtttgttatggtagtaagggtttggcctttcaactactatctttttagctaaaaagcttattgattgtacgtagtataacaaaggccgaggatgcaatatatttccattaccttaaattgagctaatatattagcatcattccaaattatagggcgtcatcttttgaaggataatcaaactcgataacgttaaaatgattggtaataattatttttatgttaagtattatatatgtatatcattagatttatatttttaagtatttttatatgatactgatttatatattcgtttggaatataacgtgaaataaattaatgatatataccttctgatttggga

SEQ ID NO: 99810 - DNA, 721 bp, Oryza sativa
ctgcagccctctgctttagtctaagtttttgacttagtaataaatgtgaatgcaagcgtgccatgtttggtctctgccgagctccacatataaaccttagagtaggaatcaaaaaggcatcatttggtgaggaattcaaattgatacacttagagggactaagtgaatcaattgaggaacttggttttcttttccaaaatcatttgaaaacttccggaataagagttgataaagatcgggtgattggtgctctagttgttgttctgtctttcaaccgcccaaggcaaggagaagcagtgtctcgtgggaatcaggggtaagggtaagccaccgtgccaaagattatttaatctgagagagaatacatataccttgcacctgtatctttgagatatgcagcatagtagtaactcctgatcaacaaccaagtctttgtttcctttcgtccttcactcgggacaagcaaaggttcaagcttggggggttttgttgacggtcgttatcgatcagtttcgaccgtcaatattactaaaacaggagtgaactagtgatgcttgcaatgcatatatttgttagaataataatattccactagtattaggtttactaaccttttgcagagaatgatcataaagtggaggagaatcgacatcaacaccaacgataaatcaataaggcgatgtcgagaaccagacttatgcatgaatgggccacgaactca

SEQ ID NO: 99811 - DNA, 736 bp, Oryza sativa
ctcgggtatcaatagacccgagccctatgtaacttttaacacacacgttcaatacaatctcggtgcatcgccacctttttgctttagttttattttgacgagttcttgctttcgggttgagctgcatcgatttcgatcttcaacaagaggtaaaacttgttatgatgaattatgttctcggaattagtgcttccatctttatggtactctaatcttgctatgtaattcatcaagttatcatatatcttagataatcttcgacaatatcatgatctaacctacaatcggctaacatctgttaccagaaggcagttgatttggttaaatagtgacgttgacctagattatataagatatctaccactctatgaaacttccagtggcttgattgtctagatattgttcttcttttcatacctcatgctgcatcagttgagtttgatgtcttaagtcgtgcttagaatatcaatctctagcctgtactctggttgccgattagggtagtatcggagtttgagccgatcttatctgatttaaccatattcgatctatatgcttcaatgacatgttaaatccaccctttgtgtcaagataatgtcgcaatctaaatatattaagcttctgtttaatacattatacctgtttaatatcttgatatagagtagtatcggagtattagccgatacacgctagatctatctgatcggctatgctataaacatatataatcctgtta

SEQ ID NO: 99812 - DNA, 766 bp, Oryza sativa
attaaaaagtgatatatgtatacttttatgaaggtatttttcaagacaaatctattcatataattttaacattttcaaactcaacaacttgagagttatttatgatttatatttttaaagtttaacttaaacattgtcctaaacgacttcctttaccagtatggagggagtatttaattagttcttgatccgttcaatggttcagctcaagcgcactgttcagtaacagtacatggatacatcgaccacacatgaactgcagcttggcgcgcgccacgtgcgtgacacgaactctctaacttccatccaagatcaatgcaagtcagctagcagctagtatagtgttgtgttcgcggattttaaataagatttcgattctctgatgacgaatgcacggacacgatcgattgatcggtcgattttcacgcagcaattagccctcgcgccacggtggccgccgcggcggcgccggtggccggggacctcgtgctggtgacgagcttgaaccactgggtctctgggtcgcactcgccggcggcggcgtcgtcgaggcacctgcacgggttcgtcaccacgctccggccgtcgtcgccgacgtccaggcacagcagcccgccgccgccgtcccgagatggcgtcgtcgtcgtcgtcgcgttgacggccacgtgcatcgtcgagcccgacacgaggcgccacgtcgacagggcgtcgccgcggcagccgccggcgtcgctggtggcgagccgcgccggccggccgctcccct

SEQ ID NO: 99813 - DNA, 1293 bp, Oryza sativa
cctccatttcacaatgtaagtcattttagtattttccacattcattttgatgttaatgaatctagacatatatatctatctagattcattaacattaatatgaatgtggaaaatgataaaatgactcacattataaaacggaggaagtattaaacaaagtttggcaacaaactaaacatagacatatttttagcaactatgccaaaaaaaatgatatggttgaaaattgcatcaatctgaacagcccatatgtataaaaaacttaacctagcaggggtctacaacgaatctagatatgaccctgctaggttgagttttttgaaatggagtgagtaggtttttaagaatgagctaaagcaggtactactcaacactagatttttctataaagtagtatattctacacagccatacctatataagatggttgcagcaaaacgcacacacgatatcaaaaatataaatgacaggagaaattattccttactctcttcatcctaaaatataaaacttagaatcggatgaaacattttctagtagcctgttcagattcatagtactaaaaaatatcatatccgatttttttaataaatcatatccgattttaagttcttatattttgggactagggaatactcctctctctccaaagaatatttggaatgagcttcagtcggtggtgaaccagtgattggtacatgaaccaaaggagctagccgttgcctccggattaagataatctgcactaaggcagagagctcatatgctaacaatagtctactacagtaactacaaaatggtactgtagcaaaactcctgtagtaacagtgagcccttaggtttaatattgagcctctcctgtacatagcacgctacaatagcgatgtaatatgaaccgttagattactgttccttatctgtgttaggctattcccaactcaagactctagacatagtttttataaactccacatcatcaagaaactagtactagacactactcttccaatacaaacaccactattccatacttaaatttaatgctacttatctcacatgatgttttggatattgtgtagaaatcaagtctcatgcaagacatggtttccttctattttctcatttattcgcttgccacatcattttttattttaggtgacatcttatttaatgctatagacaccatctcagtcattgggttaggaatggcattagtacctttaaaagcaagtctaatagtacagtccactactagctccaattcatctatagtgcgatctgatagccaattat

SEQ ID NO: 99814 - DNA, 629 bp, Oryza sativa
atgtacctgattcacctcaataatttcttgaatgatcctctttagtgcaaaatcataaatggcaatcgtggaatggttagcattagctatatcttgacggatttgaatcgcttctcctgtcctggctgccgacccatctccctgtcaaacgccaacatgctgatacaggttgatctcgccgtctccgtcgccatacgctgccacctccggtggtgcgtccaagtcgtcgtcatcgtcccacaacaccagttgcaacggcgtcttgttgcccaccgcgttgatgcacgtcatgggcaccatcggcgcctcgaagctgtacatcctggtgacagcccgtcgcctgaaaggctcgacgcgctcgccgaagccgagggcggctcagggttggaaatttcggtcatttcggtcacccctgatacaatattatttcggccgaaatttttcattttttcatttttttcatgaatttgggtaatatttgttcaaattcaactaaattttgctcaaattttaggcaatttcggacaatttccgcaatttcgggatttcgcccccccccccccccccccggggggatacaaatggcttaaccggggggtaggaaattcttcattacgtacgcggggtag

SEQ ID NO: 99815 - DNA, 650 bp, Oryza sativa
attatatcgagatatttttctcactcatacatgcatgcaacgaattagtctgaatgcatgcgacattaccaatttgtgaccacctagcactagcagtaggtagatagcgagcgttggtgcgtgcgtggatggtggtggaaacgccgggtgtaaatatgtaaatgtaaccgagcgcggcagtgccaatgatgattgggggaggaacacatggccatgccccgcgcatgcatgcatgcatgcaatgcatgggccagccagccacaatgtaccccggcggaaacgggaaaccggaaatgaatggcagcgagagcgcctgtgactctgtgggcgatcaccaatcggcggcccttgcgctagggtcctcaacgccagtcacatgcaacagcagcagacagcaactttcccaggccgcacatgatagtaccactctcttgtacccgcatctgcacctctaaatcctaagctctctctctctctctctctctctctctctctctctctcgcaacgagctacaggcgtgtacgtgttgtacgtatacttgtacgtaactaggtatagcaggacacaacaactgaagactttgctaacagtactgactcttcagattataagaaagctacctctcgatctgcaggggtatccaatcgaa

SEQ ID NO: 99816 - DNA, 589 bp, Oryza sativa
gggtggtcgggcaccatggagcaccaaacaaatttattatatgtgtgtgtgtgtatgtgtgtgtgtatatatgtgtgtgttggaggcataccacgaagggccttcggccggaccagccgaaaccaaggattcaagcgacaagcccagaccggacgtaagcggcgaagaccgagaagggaaccatgtgggcgagagtctcatggcgaaggccatggctcggacacccggacatcaccagacaaggacttcgctagaaggcagtgcgggcgagacgaaatctctggcaggagggcctaggcttcactaggtgccgaacctcaccgaaaagtggcccaactgtcatgtcctgataaattcatcccgaattaaaaatcattctctaaaaggaataatagaattaattaaaattcgaaaagaaattggcaaacactaaaatgcgtacaagaaaaattcgaatgtggcccggagaattttttttaaattctccttggtctaaaaggagccctcaaatttaacttgaattttcagaacaccgggaataattattaagcaacaaaaacaattatcaaaatttattaaaaagaaaaac

SEQ ID NO: 99817 - DNA, 743 bp, Oryza sativa
attttagttaactaatctaaccttagttcataggcttatggtctttattatcatggttcatattttataaactagaggagctctagtccatgctagcaatttattatatcaacctagaaattattatatgagctaagtgccttaagttttggtggatggggatggaactatgcattcactagtctaacaagttttatttgggtttcattatagctagagtgtatttctatatacatttatatatatacatattgctcaatcgatactatgtgattagcacctatcctataaatttaaagtttagagctataacctgtacagaaggttccatattttattttactatgttgaagcccactgtttgctggttctatagatatttggttcacttcatttagactaaagatgaattttctacaaattttacaatttaaggtttctgtatgttggttattacttacataagtatttagaggcttttatcatacagtaagtatataattttattttataacttggaagtatatgttttggtgattctacagaacttgggtttactcaaaaaggatctaagatgaattttatatgaacttctaaaattcagcttatctaaaactagtcattcaaaggtaatagttttagaggcatttgatgtatagtatgtatactatttcattttgctttataggagaacataagttgtggatctgtagaaactgagtttgctccaaaatgagttgaga

SEQ ID NO: 99818 - DNA, 730 bp, Oryza sativa
  unsure (1)..(730): unsure at all n locations
ccgagtggtgatctcncgtaggagancatcactattatttaagcccaaaaggtcatgattcctaggaaaattaacctttggtatccttcatcctttgtcctgttccaaaagatatgtacaagaaataacaaatataatatgatttaaatagaaatataactgtaaaaatagataattacaaaacatataaaaaatacatttgaatagaccataagttaatcacagaaatcgaatgagagagatacactcaagccctctttgaagaaaaaaaattgtggatgaattttgtaggatttaaagtctataggattttttttcctatttggttatttgaaacaaaggatttgagctttcataatcctttgaaattccaaagaaatggttcaatacatgtcaacatctttggaagaaaagtagagctttaactttatattatgttttgaaaagactgaactagagaaaaatggaacacacgaatgtaagaggtgagagacatatgtctttattcctcatctcttctatagcctagatcgttgtattcgaatcagtgggtgtagtcatatctgttgccaagaagcttggagtcaccatcttcgtgggagagacagagatatgaggttggttactagtacacaaggtgtatctctacacaagtacaaggtgggacgcatatgaattatttttttttttacaaaaatacctcacttggatgcaacacttggactgagat

SEQ ID NO: 99819 - DNA, 735 bp, Oryza sativa
cgcgtgattgcttccctgtaagtagttcatcacctttttcttatgtgttaacttggattaatatttttgttataattaaatagataataagttgtttttcgatttttctcatatacaacaagtatggaacattgtatgattttcaaattatattatataagtgtatggaatataatgtgtaagattaaaaaacttagtataagatttgacgttttcttgaaaacgtggcaccataagtataggtagtctcataaatattggctatccatataagaggactaccataaaaataatatagtcaaaccatttctcaactaaacttgtcaacagaacttcgagagaaggtaagaaaatgaggaggttagttaccaatcccacacaagggaaaatattgctcacacgcattgtatgacatatactcccattaatcaataatttactaatattattaaatttcacaacgtttaatgaaaatttgttcttttgtgacaatgtggtgcgagactaaaacttgaacaccatattcttctgttgtttcttattctttattggtgataataatatagctggaaccagccactagcacttcacctgaatactagcagctagttcatgtctatgtgctctatattatttatggttttaaatgaagtagtactaataattgtacttaatgatgatattgtatgcatagaagtagtattttagaacttgagatatattttttctaaacat

SEQ ID NO: 99820 - DNA, 749 bp, Oryza sativa
ccgatgatctgctacagatggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgc

SEQ ID NO: 99821 - DNA, 744 bp, Oryza sativa
  unsure (1)..(744): unsure at all n locations
ctgggtttggagacgatggtccctagcnncannaccgngcaaatacgttccttgttggcatttcgtcgaacacctggttggcgtcgccttgctactgccgccgtcgctcaacccgtgcgccgtcaccgncacgggtctgcgtccccgccgccagcggtcagcccacgggtcgccatcgcagccgtcgtcacacgtgcgtcgcccggccactgcccgcacgcctaccgacgccgacgtcaacgcagccgacgccgacgtcgacgcaaccgacgcccgtgcgcctgcagccgccgccgttgcccgcgcgcagccgccgtccgcgtgcctgccgtaattgttcgcgcctacaaaattcgctcccctggaaagcgaataatgggtcgcccgcatgcgaaaatactaattttcgcacatatctaggtgcaggcagacgtctaaccacacgttaagattggttttgaccgcctgcaaaaaaattttctgtagtagtgagaaatcactgctcgtacgtatggagacgctgccagatcaaggaactctgtataagatcaactataaatccaaaattccaaaccaacgatgcaaaccatgtttggatcatatacagcatataacctagtgttcagtcttgtggacatttacacaacaaagttcttaggcacccatgtttggatcatattacaggtttaacctagtgttaagtctgggtgacatttacacaacaaagtcctccttacttgcatt

SEQ ID NO: 99822 - DNA, 842 bp, Oryza sativa
  unsure (1)..(842): unsure at all n locations
ttgggcccttatccatgcactgtgtttcgcccgatgatccctcactctgatgacacctaaggttgaaacctgttcttatgtccctttacgccgtctggacaaggcctccgaggaacctaagggatcttcggctggaaatgcccagaaccgataaggccttgtcagatcctgtagagacgaaagaccatataagatctggtcgtgtaagagttctcgccgtgcgtattaaccaagctgtgaaatcggaaatcaactttccaacttcacggctgggggctaggatcagagcttattcaaccaagccaggtcaaaggtccaagagccttatcctccgagaaaattcctctgacgacaaggttgggggatagggagagtgtaccactcaaacggctgactaaagtcgttaactgagaacgcactcttacacatgacatcaagagtaagagacatttgtcaaagatagatttctttattcacaaatactccttacagttttttcacaaatctttcgctacattacatcttttcctaagatatttgtcacagggtacgagtactaccaagagggccaacaccagtccatagactggaagatcttctcggccaacggcgacattgaccttgcaagatggtctatctctgccggagtctccgagaacagagcaaatccctcccgaagatattctaggtctaggtncgggtnntnnggtcgtgcagaaggaatcaccagtnnnnnnnnngngggggaaaaaaaaattaaaataaaataaaacacaantacaaataccagaggaatnaacaaataaaggacgatgaacagaaggacaatagagggaggagga

SEQ ID NO: 99823 - DNA, 1086 bp, Oryza sativa
atactatgtttagtactccctccatttactttggatagtaatattttatcttggcacacagaccaagaataagcaattctacttatcatccatttaaatataccactagtcattcctcgtaaacaagcgattcgttaatatttacatttctcgatgcccatgtaaccaatcttgtgtggaagaatggagagtcacgcattaaatttgagaaagtcattaagatgataggttgttggattgaaatatgcctatcaaaaataaatttttcagatttagaaatatgactatcaaagatagatggagagagtaatatttgtcactaaagttgctctatgtactgtaagagaagaaaaggaacaaatttgagtgtgatatgctcatatgttagatttgtccttttcaaaatataatatatatatatatatatatatatatccctccatcccaaaatatatttatcttttgattgtttttgtttattccaaaataaccgcatcttttaaacaatcattgcatcgggttttatgaaagtaagagataaatatattataccaatcctaacccaagacactagacatagttttcataaactccacatcatcaagaaactagtattagacactactctttcaatacaaacaccattgtttcatacttaaattctatactacttatctcatatgatatcttaaatgttgtgtgaaaccatgtctcatgcaagtcctggtttcttctctttccttatttattcacttggcacatcatctttcattctaagtggtaaattatttaatgctatcgacacatcctagttattgggttgggactggccttaggactagatagtgggagacaattgtattgatatttgaaaaaagtaaaaggtattttagttttttatttggtatgtgtagaagagatgataagagggagtaagtgtgagtcatgtttatgttttttttatgacacatattgtattaaactattaatgctgtcaagtgctataaacaattttcatagcaattgcatgatatttgacgaaacgagggtcgagggatatacccccctcgagtctcatggactgga

SEQ ID NO: 99824 - DNA, 731 bp, Oryza sativa
  unsure (1)..(731): unsure at all n locations
gtgagtaaaagcatangagctgctactgcaagtagttcatcattatccatctataatctatcttgctatatcgaacgcctatatgtatacaacatgaatatgtcacgaggctgcatcgatatccgaattagctttagctggtgattatgataaatcgattaataagaaatacgagatcagagcgcatggaggaattaaacctagttaatttaccagggaccaggaggagtgctccgggaggcgacagcaggctgtagggctgcgtgcggcgcgtatccaaccgatgctcctgaagggttttcgacttgtgttgatgtatggaatggaatcgactgcaacggaatatggtaaggagtattagcccacatactctaaaaaaggtaatagcccaaacggcgacaagtttttgggccaaaaagttcatgtttggcccaaactttgattacctcatgggctcaaattcagcttaaaccaagtcaggccgatccacttggaattttgagctggtgttaattaaaccattaattcctctttgcagaacaactgcgcctcacctaagcccaagaaaataagaacggcatctgctgctcggatgactgttggctgcttcgatacaggagtactttttttatctgcacaagttagaagtagaactgtcagatattgcaagacttgaaatttgaagccatgttctgtcacttatcgttttctttccttaagctgaacaaatt
